United States Patent 11,001,841 (CCCTC-BINDING FACTOR (CTCF) RNA INTERACTOME) - sequence listing, part 54

SEQ ID NO: 127495 - DNA, 1557 bp, Homo sapiens
agtgaacactgtcttgttctagattggatagttagaaaccttttgacatatttgattctttctttccacatatatatacacacacacttttttttcttgttgtgccatttgaaagtacattgcagacattactttttagcatgcattctcctaaaagtaagaacattctcctaaccataatacaattatacctttaaaaaataatagttttctgatatttaatatattgtccatattcaaattttccctacccatcaactctttttttaagaagccaaaatagtagtcagataaatctaaaatcccacattttggatttatctgatgtcttcagggacatgtttaacttttgtctttttatatcttttatttctttaggtttgggtgttttgatcaagttttttaaatgatttgcttcccttattatattcccttagctttttttttcttttcttttttgcatactcttagcttttaaaaatttcaccttgttgccacagaactatctcagggaggttgtatgagctcatttcgatggaacagaggtggcgacttcaaaggacgaaagtgggatacagacctgcccaccgattctgctgtaagcccctagattctttcattcatttatttatttactgttgattgactgacacagggtcttactctgtcacccaggctgtagtgcagtggcacagtcacgtctcactgcagctttgatctcccagggctcaagtgctcctcccagctcagcctcccaagtagctgggactaggcctgaaccaccacacccagctaatttttttaattttttgtagagatggggtctcacttttttgcccaggctggtcttgaagtcctgggttcaagtgatccccctgcctcagcttcccaaagtgctgggtttacagacacgagctactgtgcctgacccttagatttattttgtttttttcagtttccattactggatttatgtgtttttgtttgcctatcataagaataagtgttaaaaataatttagaaaataaggtatttataatagtatcagcatgttcacccaaccactgttaatatttttgtgtattttttccctttacttggtggctactattttttaatgtttttatcatatttgtaattctccggtatgtaaaattatgtattctgctttttttccacttctgtaatatttagggtttttttttacttcagcctcctcctacctagatattttttcattattacacactgtcatttaactattctcctatagtggacctaaaagtttgagacacttgtggtggagaaggaatttttacttgttttttgatcttgagtaatgcagcatgcaaatagtgtgatgcgcattgctttctttcttgggattgtcactttaagagagactcctagaattacatttaggagatcaaagaacataaatgtttttgtgtgcttacaagtttttcaaaattatgttcgctttttttttatagtgactgttacgggtgaaaattaagttttatgttgagattcagattgagaattgaatgtatttta

SEQ ID NO: 127496 - DNA, 1511 bp, Homo sapiens
cccagctgcttaggaggctgaggtgggaggaggattgcttgagcccattcgattgaggctgcagtgagtggtgattgtgccgctatactccagcgtgggtgacagagcaagacactgtctcaaaaaacaaaaagagaagaagaaaaaaagtacattggacagtggttagtgctaaggaggaaaaaagcacaggagggtaatgttattaatgtttagagaggaggggtgaaatttgaggtagggtcgtcaggggagacgtcattgacttgtatgaagacctgaaggtagtgaggaaccagctgtatgaacacatgagaagagcattttaagttcttttggaaactcacttttagaataatcagtgttctctgtgttttatgttaacagaggctagtattactagcttgaaacaagctgccctggttaaagcgcctctcattccgactttgaacacaatcgttcagtatctagaccttactccaaatcaggaatacttgtttgaaaggatcaaaggtaattattgatttgaagagaaaaaaataagagcttttttactatgctggaattttatcagtgaagattaacaaggaaaaacttttaattaaaagtataacatgtcttataaatacgtattaattatagcttaataactttattttgtgtaggaaacttaaatatgagctaaatgggctccagtgactatttcactcatttcctacttttagactcataagaatgggtgccattatgacattctttatagttccggtgtgctgagccttatttctcttaatttttataattcctatttaataagtttcttccttatatttctgtgatattcttattatttggtggaagatgtgctctcctgaggagactgacttgagaatcaggaaatgtaggctccctgacacccccatacaccctctgtgcctctctacttacagagcaattcataacgttagaattttttaaaatttggataaactttttaaaagattctcatcactaagacaagttttagaaatagtattcaaattgatcataaatcttaatttgaaaatattatagtgttctccctttcccctaaggttagagcaggattcaggaataaacatttttcatgactttttaaaacattttatataaggagaattttaaacatacacaaaactagaaaaaatagtatacacactcctcttgtacacatcacccagcctcaacaatcactagtccctggccagaccctgccctatccataccccgtccactttcttcctgtattgtttgaagcaagccctcatgtcattatcagttcatctgtaaatatttctttgtatatcactaaaagataagcctcccgcgaccccctgcttttgagaaagggtcttgctatgttgcctaggctggtctccaactcctaggctcaagcagtcctcccacctcagcctccccaagtgccgtgattatagacatgagccaccgtgcccagctgagcctttagaaaa

SEQ ID NO: 127497 - DNA, 3115 bp, Homo sapiens
aggtctgggcaagagtggctatgaatagacaacttcttgatcatatggattcatggacagctaaatttagaaatgtaagttctgacattactctttggacaatattagtgcctcttaatatgcaaagcatgttattagaatatcatttagagttcattataaattagaatattagttataaaggtacagtatgaatggtacatatataaggataaacatgactgttactatatggtatttattttcatgagatttttttcttcctccatatttagtgaattgttatgttttgagaagataaaggaataatatgtttagttattgagatcctcccttttcagttctcagttttattttccaaagagcttttctattggagccttttatttacctagaattgtgaggggaaacaaaaatgaggtccttgccctcagaaaacttaaagagttagagagataagacaacatatgcttgaagctatttcaaagtagattatgatttctgtttttctagagaagaaccctctaatcttgggccaacttttccatatacagagtgagtgagttccctatttccaactccacgtcttcctcccaccttctctagtacctgtgtgttctgggttctgttaggcatatggacttccccttccactatacggagctccacttagctctgaaggggctactacttctgttgtttcatccttcaacattcatccatccactctgcatcttctagaactattttgaaatcacttgtgctcattttttatccttttactcttatttaaatagggcatcaaaatagaggggcaaaaaatggtagcctactttattgaaacagaaacctggatggcattttatggataattcctgaacccaatcctagacttactcaattagaatttataagggtggggcctagacctctctctgggacacgttaggtaattttgttacagccaaagagtacagctgtactcttttgtaccatttgtcacagctggcaaattaagatgcatgtagtaaatgttggaaggatgaatgagtcaaatcatctcctgaaactggagtttgttgtagtttctgttataggctagtctaaaaatgctaacatgtttaaaatatgaagtcttagtcagacagagtattagctacttagaagaaatacaaatacatttcctcatctgaagtccctaggtgaccatgtgctataaaatttagagtttttggatttttttaagcaatacatgtatacctgtaccgtataatttataacaccagagtctagttaacactcagtaatcaaccacattaatacttctgcagaaaaacatatgaatagtcacactcagtgggataaagcctataaatagcttcatgtgaattcagttcaagtcttgccagtatatcaaaatttgcttccttacatggattacaagaaatcttttaagttcccagaaggtttttgtttcagttgtttataatattgtatttcattggaaacattttttcatccttttattttatggataaacaaaagcatggaaacagaagtggtaattgaagttgctacaaacacatacacaaaataataacacacaaaccagatgggatgtatccttagtcttttcacatcccagcattagttttatattagccatggaaaaggcatttgaaagtcccagtcctaaagtaatattgtaatattcaaaagccagtttcaaatgtaataagtctctgtttttccacatggttagggaattgggtgagcctgctgagagttaggcagttatgttagtttgaaaaactatcttactgattgcaaaccaatataaacactacattaataaatgtgtgaatagttaccctacaaatgtaaactgaagattatccttttagctaaacataataatcagaaaattttaagaaaaatttaacatatagctaaaagttttatatttttttttcaggaaaaaaaataaaaacatgttatttaagaatgtaatttagttgccaggcgcagtggctcacgcctgtaatctcagcactttgggaggctgaggcaggcggatcacctgaggtcaggagttcaagaccagcctggccaacatggtgaaaccccgtctctactaaaaatacaaaaaattaactgggcgtggtggcaggtgcctgtaatcccagctactcaggaggctgaggcaggagaatcctttgaacttgggaagtggaggttgcagtgagctgagattgcgccattgcactccagcctgggcaacaagagcgaaactccatctcgaaaaaaaaaaaggaatgtaagttagttaatttacactccagtggcatatttatttaaccatctcttgatttcgggtagctattactttcattctctttcactatactttatgattcttttaatattcaactataagatagtaaaaaaaattcttagagttgcttgtaaaaaagaaagtaattatttgacagctacttgggaattatgtatccaaaatctgtaccttatttcttctagtggatcaatgagacaatattagtgccacttgttcaagagattgagtctgtcagcacacagatgagacgaatgggttgtccagagctacagataggaggtatgtgaaaacagagcccagtgttggatttctattagtaaatctaccaagtggaaaacttcttgtaatggacggcttaacttattttgttaccttggggtgaaaaaccccaaatgtctataatctagtttgatttttttttaacgtgacagctttatcaagatgtaatttagctaccatataatttacccatttaaaatgtacagtccaaagtcttgggttatgcaaccatcaccatagtcagttttaaagcatttcatcacctgaaaaagaaactctccaccttttaccagtcaccccctgttctatacatttctcccagtcctttgcaagtgccagtctattttctgtctctatagataggcctgttgtggatatttcatatgaatggaatcacagaatatgaacatgactttgtgactggcttctttcactgagcataatgctttcaaagtttgtccatgttgtagaatttatcat

SEQ ID NO: 127498 - DNA, 1031 bp, Homo sapiens
cttatttattcaggcgctatgctagatgctagggaaaaaaaatgctccctgctttcaaggagctcaaattctatttgggaaaacagacaaaaactataacccggaagtgtgattaatatcctggttcagaggcctctgtaggagtacattcctaaatagaacttttttttacatttcttaaaagtaaatttataaatttagaaggataaccatcagatagtcttttagtacaactcaggaattaccacaggctgttaagtaaaacacagtgaagtacagggacaaataagtttagcttgttaccaggagagtaatcttttagtaggaggctatagttatcccttttagaaagagcttctagaaatttcaaataaagaacttgcttggcctatttatttcctaaagaaatttgtcttttgtttgtttcttactaaatgatttaaaagtcttagagaatgaaacgagcttaacttttcaacagaactagacagatgcctttgactgcttattgtttttatgactgttaaattgatatggctcagaaaatactatttaaaatttttaatcacaagcagactgtgatctctaaagagaaaattatgttggggagaagagaatctccttgagggttggtcttctgattcctggattgccattgcctagatataagtgttaactgtagatgtcagaattgctacaacacactgatactgtttatcttaacaattgtagggagcccagattctacctctccttccagcagtcctactttctggaactatagtcgttctatgggggattatgcacaaactttaaagaagtttcagtatcagcttgcctgtaggtctcaggccccatgtgctaacaaagatgaagccgatctcagctctaaacaagccgcagaagaggtaagtggaaaataaaagtgacttaatatttatgatttatgcattgttagaaagtcttctacttctggaacattttttctgtaatcttccattctgttggacagaaatgtaaatctggcacac

SEQ ID NO: 127499 - DNA, 1129 bp, Homo sapiens
tcaggattttctgaccaacatggtgaaaccccacctctactaaaaaattagcgaggcttggtgacgcgagcctgtatcccagccactctggaggctggggcaggagaatcgcttgaatccgggaggcggaggttgcagtgaaccgagatcacaccactgcactccagcctgggtgacagagtgagactctgtctcaaagaaaaaataaataaatgaataatgacaatatgattgtcatgcttaagatactatgggtgttcatattcacatttccccagttgacccaatactgacccttgtagtgctttttttttcttttattgatgcaggatccaatcaggtatcacatattgcatttacttgtgcttctgttgtctccttaaatcgaaaccatttggatagtgtgggttttgtgggattttttgttttgttttcttttatgacatttacattttgaagagatgaggctgttgttttgaaaattcagatttgtttgatcattttgttactgttagattccgtttaaatattattttctggcaagaatacaacatgggtggtggcatgtccttttcagtgtatcacatcaggagatacgtgatgctgctttgtctctttgtcggtaatatataataaaataggatcacttggttaagttgatagcaactggatttcttcatgattttccctttatgtcctgtttccttaacagccttttacccagtgattttagcatctgttgatgatccttgtccttgataaagtggtgattataaagtagagattttctttttttttttttttttttttttttgatacggagtctcactctgtcaccccggctggagtgcagtggtgtgatctcggctcgctgcaagctccgcctcccgggttcatgccattctcctgcttcagcctcccgagtagctgggactacaggtgcctgccaccacgcctggctaattttttgtatttttagtagagacggggtttcaccatgttagccaggatggtctcgatctcctgaccttgtgatccgcccgccttggcctcccaaagtgctgggattacaagtgtgagtcactgcgcctggccaaagtggagattttctaattatttatttctacac

SEQ ID NO: 127500 - DNA, 1080 bp, Homo sapiens
gccagtttatttactcgttcacctactgaagggcatcttggttgctttcaagttttggccattaggaataaagctgccataaacatacaggtttgtgtgtggccgtaagttttcaactccttgggtaatactaaggagcacaattactagttcgtatggtaagataatatttacttttgtaagaaacagccagactgtttcaaagtggctgtatcattttgcattcccaccagcaaagaatgagagattctgttgttccacaacctcatcagcgtttgatgttgtcagtattgtggattttcgccattctactaggtgttttacttaagtcaaaaaccaaaacaaaatgaatttcaattaaagaaaaataaagtaaagatcttttattttgtatagttggcgagctttagcccctctcctccttctccgtaccctaccactgttggaccagtggagagcagtggattgagatctcgctaccgttcttcacctaccgtctacaactcacctactgacaaagaagactacatgaccgacctacgaactttggatacttttctcagaagtgaagaggagaaacagcatagggttaagctgggtacatatatatttctgtatatctactatacatatttttggtgtcaatccttaacctactattttcattattttaatatccatactaacatactttattagcttagcatgttttgttttactttatatgtaacattattttatgcagttagaattaagttcactaaatttaggaagtgaaatatagctaaactaagaaatctcaaacctacaataagattgaaagctttttcgtataatgtaagttacaatttctatttaaagttgaggctacaaaataatgttttgaagcagtgcgtagtgaacttactcaaattatagctgtctcttttcaagtagtcttttggaaggttggtgtggcagagcaggctgaaagagagaacatgtatttactcgagaagcgctgctgtttttcataacattttaaaacttgcgttttagtatttcctgaaagcctatagtttaccttgggaaagagtgtta

SEQ ID NO: 127501 - DNA, 2221 bp, Homo sapiens
aatgaaggtgaaaatatttattgtacagggttgctaggattagtgctattttgaaactcactagtaaattacctacacataattttttttttttttgagaaggagtctcactctgtcacccaggctggagtacagtggcacaatctcagctcactgcaacctccacctcccaggttcaagcaattctcctgcctcagcctcccaagtagctgagactacaggtgtgcgtcaccacacctggctaatttttatatttttagtagagatggggtttcactatgttggccaggctggtctcaaactcccgacctcaggtgatccactcgcctcagcctcccagagtgctgcaattatgggtgtgagccaccatgcccagccaccctacacataacattcattaaattatagtttttatgaggaataagaaggtaattttagtttgctaagtatagagggtttttgtgttctccaatagatgccctcctcaccccccttattaaaaaaaaattgttctcttccagagcttgcccttgcatctctcttcagccttaatgccttatttgatttttggagatatttcaaatatactgtggcaccaacaagtctggttgttagtcctggacagcaaacacttttagggttgaaaacagctggtgagtgttttatatctcttgcaaaggtggggaaaaggttggcaataaatctttctcagtttaattttcccatttcgtagactcaaagctggaagggacatcagctatcttaagcaggatacaataaattgtcttatgaccaatgattatcattcctacttgtatacattcagctatttcatggaagtttgttccattgttcaggtgcaattaaaattaaatgactaacttgctgagttgaaaccagtttctaattttgcactctggaaatggtaaacacgtaatttgtgtcctttggtaataatacattctgtgatttaacaaccaagtaactctgttaacttttttcccttaagagaaagacttagttgcttaaatatattttcgtataattttatttgaaggtacatacacatatgttgctttttttttccttctagttgtacagactacgcctccacatgatctggcagcaacccaaatccctcccgctccaccttccccttcaattcagggtcagagtgtgttgagttatagcccttctcgttcgcccagtaccagtcccaagttcaccaccagctgtatgactggttacagccctcagctgcaaggtctgtcctcaggtggcagtggttcttatagccctggagtgacctactcgcccgtcagtggttataataaggtaatgactctcttctcttgtctagtcacattattttagaattgagaggtatactaaaaatcatctaatgagtcaaaacttatcagtgagcaaactgagagttgatttgcccagaacacccatttaaaaaccgagaatagaacataatatcttaaacacaacatcttaaaatgaaagagaaaaaattagcatttacagagataacaaacttagtgcaccatctacgatctttcagctgtctttaaaacaagttgaaacaaggataattttttactttagttgcttttactcctgttttccctcttgctttccttcttcatgtgaggcctttgtatacctttttagagttttagtgtggtttatcatgttggagtgtcttctaagctaaaagctgagattgtcacatagtttcttttttttttccaatgagtacaaatgattcttgaatatggacgctttccatggaatagtaggaaccttcatttccactcccacagtaatgtgaaattttgttctaatttttaggattaatagaaacaggattgacaaattgaaattttgactccttcttgaagcataaaactattaatataagggggcgttgaaagaagagtggtcatttcagatgctgtcgctactgtgttcgactaacatctctgtagctgctagttaaaagaggagtctctggagatgaaactgacacattgtctgcccttatccatttacatatttcttttttttttttttttttttttttttttgagacagagtctcgctctgttgcctagactggagtgcagtggcgtgatctcagctcactgcaaactccgcctcccgggctcatgccattctcctgcctcagcctcccgagtagctgggactacag

SEQ ID NO: 127502 - DNA, 1165 bp, Homo sapiens
cgtctgtaatcccagctactcgggagtctgaggcaggagaatcgcttgaacccgggaggcggaggttgcagtgagtcgagatcgcgccactgcattctagcctgggagacagcaagactccgtctcaaaacaaataaatagataaataaccagccacttctctgttgattacactgtgatgccaattaagttacatataattttgggttcccttttcatatactgatattaaaatggaagaagttttgataaaacattttaaagatgagagaaggtatatgcggtttcagttacctttataagggatgcaaaatttggtttttaaatggagcaatagtttcttctggttaattcctgtgctttttgttttttcatagatgcagggggaggcacaccctagtgcttcccttattgacagaaccatcaagatgagaaaagaaacagaggctaggaaagtggtcttagcctggggactcctaaatgtatctatggctggaatgatatatactgaaatgtaagtgaatcagtccaaaaaaagtgaaactttaagaagccagtggctggttccacaggtttttgtgtttgtttttgatttttggtgtttttaggttcactggaaagcctttctaattttttttcaggactggaaaattgattagttcatactacaatgtgacatactggcccctctggtatattggtaagtaagtaattttcactgtaacttacatttaccaataaaaaactgccttcaggtttaattcagcttagtatacatttccttattcaacaagtatttgactgcctgctgggttgtaaaaactgggaatacagcagaaagggagcaaggtaaatccctgctattatgaaaggaacattctgttagacaatcagattaataacacttcaggtaattatgagttctgtgaagaaaaataagtttagaggttagtgagatttgtttttattactctcctgaaatgcgctttctgtgtctctacctttttacttttcaagaccagcccagatttctgctccattgatgccttcctcagttttcacattctttcctctcttcttgtctgctcttccatagtcattgggtataaagagtctttatggatgttaaagtaaatttcatagtctatacacattaaagtctttc

SEQ ID NO: 127503 - DNA, 1325 bp, Homo sapiens
aaaaaattacatggggtcaggactcttgacatagatactttaacacaggggaaagaaatgctttgtcactgatggtgtctggccactttatcacgccactctatcctacggtgagccgccctacttaatcagtttacacatgtgagtccataaatgccctagggaagctaaaattatattaatagatacaaaattcagcttgttacaattattactttttactgcgggttcagagcctggtctgaattttgctgcttagctttctcccgcagctgagtgggagccgcaaaaccgagacctgtttccctggtaacgctccgagcgcctgggcctgcgacccctccctttctcgcgagaagagactacctagttcttccggtaactttagagccgcttgccggtggcctcccgcttgagcttggctttgcgcatgcccagagagagtggcgcgagcctgcgttttccggccagaggacatggtgcgttttcggggtcgtgtttgtgcttcctgtcttggaatctacgcgggttgtgggagttccgcgcctgctgatctgtcctgggttcagccaagggggatgtggctaggcgttccgcctctctaggggaagggaagaaagaagcaatagggttgctgaagttcgtgcccaggagccggggagggaagctctggactgggaaattgggacgcgggggctgagtggcgcgaaagctattgctctgtcctctgtgggatacgactgcttgtcgctggaacaagttttgcacggtctgtaagagttgagcctagctgaagaaaggaggaattataaatcccaaatgtggaccaaaacaatgcacgttttcccctctctccctcttactccgctcaccaccccatcataagtacgtgcccttctaaaacttggatccttgtcctttatccacacacaaaagggagagccctggagtacagctgtccaagtgcagagttgttgagatagtaatggcgtctgcatgaggatgtacaacagtctttatgacttacagcagatatggaatatagtctcccaaaacttgacattttgagtttctgaagttagccttttgcctagtccgtgtaacataccccaaagacaaaatacaaagtatttctagacataacccttaaattacaaaataagacatttttatgtattggaagtattaaattgttcttaaataaccagccacggctgggcgcggtggctcacgcctgtaatcccaacactttgggaggccgaggcgggtggatcacaaggtcaggagttcgagaccagcctggccaaaatgttgaaatcccgtct

SEQ ID NO: 127504 - DNA, 1062 bp, Homo sapiens
ctcctgccttagccttgcaagtagctggaattacgggtgcgcaccaccatgtctggctaatttttgtatttttagtagagatgggttttgtcatgttggctaggcttgtctcaaactcctgcctcaagtgatccacccgccttggctgggattacaggcatgagccaccgcacccagcccattgcagttttaatttgcattttcctgtggtaatagtgaacatcttttcatgtgcttgtttgttttctgtataccttctttggtgaaatacctgttcatatcttttgcctatgttctaattcgtttgtttgcttttttactgttgaattttgagagctccttatacattctagctactgatcctttgtcagatatatggtttgcaaatattttttcctagttcataacttgtcttttcatcctcttaacagggtctttggaagaacaaaagtttttaattttgatgaggtccattttatcagcttttccttttatggatcattattttgttgtctagtctaaaaagtctttgcctggcctcgatcccaatgatttttttttctaccatgattttttttctaaaagttttatatataagttcatgataaactttgaggtaatttttgtataagagatgtgactcacatcaagactaagtttttgcttacggatattcaattggtctggtgccatttgttaaaaaggttaccttttctctatttaattacgtgttcacccttgtcaaaaatcagttgggcatatttacgtgggtctatttctgggttctctattctgatcccatgatccatgtgtctgccttctgccaatatcctaatattgattactatagctgtatagtaaattggatacttaaaattggttaaactgactatgcccactttctttttctttttttttttttttgagacagggtcttactctgtagtccaggctggagtgcagtgctgtgatcttggctcactgtaacctccacttcctgggctcaagcagttctcccacctcagcctcccaagtagctgggatcacaggcgggcgccacca

SEQ ID NO: 127505 - DNA, 1048 bp, Homo sapiens
ctgtgatccacccttctgaagtaagtgattctgtgaggtaagcacctagatttaaaatgctgtattttttctgaggagtctagatattattttacagactactataaaggaaggaatttcttttggaatctgtatactttcttataattaaaactttaagagctgaggtttatttcagatatatagatttgtctatgccttcatagtttgtttttttttttttctttcctcctggaaattaaactgggatttgtgaaggacagctcccttcttcctctttaatttctcaattcataaccaaaatttgactcaataatggtgcctaagattaatttcatttttttgatattgagataaaagtatatctgctttttacaatacatattaaatacatatgtccttttatatcctgagatttttaaactggcttttttgttaaacttttaattttaacataattgtagatacatatatattttgtagacaataatgcagagagattccatgtacgctttacccagtttcccatagaggtaacattttgcaaaactataatgcactatcacaactgtgatattgacatttgatacacacagtcaagatacagaacgtttccatcaccacacggattccttatgttgcccttttataaccacacccactttctactcccaccccttagcccctgcgatcaccagtctgttctacattgctgtaattttgtcatttcacaaatgctgtataaatggaatcatacagtatgcaaccttttggattggctttttcacttagcataattttctagatattcatccaggttgttgcatatatcagtaatttgttccattttattaatggctggtattccatgatatgaatgtaccaagtttaaccattcacctgttgaaggacatcggggttgtttccactttttggctattaaagtataagtgctataaacacttatgcacatatttttgtttgaacctaaatcttcatttctctgggataagtgctcaggagtacaactgctggtcacaatgtagtt

SEQ ID NO: 127506 - DNA, 1016 bp, Homo sapiens
ataggccccagcatcgccctggtgcgatgtaggatttttagaaccccggtgtctccgtggcgcaccttaggatttcaagaacgggataatcgcagtgccgagatcgccgcggtgcagcttaggatttcaagacccaggtatcacggtggcgggagtcaccgcagtgactagaactcgcagtgcccgtcagccgccttaagtatttttcagatttcagtaacaagcgcgagtgagaacggcgatgtgaccaaactgtcatgttgcgcagggattgttcaccttggtttcgcgggttttcaaagtggttcgtctcgcggcgacgccatcaggtgggcggcaggttgggtggtattattacgggagtgtgtttttctgtttacaagatgaagaaatcaaggctcagaaatttttggaaagtttgttactggagtttgcttattgtctccgctcatggctcatcaaatagttgggattttggccaaaaaatgtttgcttaacccattttgcctactgacggctaggttgcttcacttctaaaaatcctaaaagttcatgggggcatttttactgaggtaataagacaaaaaatggccccctgagaggttgcctctttgctttcttggagtaagaggaggagggtgtggaggggggtgtccaggagtggagtatgttggtcgatagcctcgttttttaaccccccactttccctgagcagcggcggggaagcctccccatttgccgctctggccgcccctcccggggctctctgctgagtcactgcagagattcagctgctggaaccccggggatgaatgcgatgagaagcactgggggaaaggagtaatgaaatctgcacatgaaaatgtatacattgaagtacaggacagatagggctgggcaaatgatcgtcaaaacctaatggtttttgtcatctgacctttcaaggagatactgggatacagcctgctattgttgggtgaaaactgtgatataaccatcatgttctggcacttttt

SEQ ID NO: 127507 - DNA, 1042 bp, Homo sapiens
cagttacactacaaataatctacagaaaaaatgaaatcagggatggtaaggagagagaaccaatggtggttatatctattaatattttatatattacctgacaggttgctcaaaaaaaaaaaaaaactaatattggaatacatatcaagctacaaagaaaacttatactaaaaggtaaggtctgcaggttggaatctcagtccctacccccattctcccagcagttttctgcgcttctctgcaagcacactacacagaaagagagagagatactctcctccatcattaaggagcaacaagagaccaatagccacaaaataaatacctcagctgggacttatgtgaccgatacacgcaggacttccaatagtccacttcttaccttggtagaagatacgcagtcccttgtaagtgaaaaacttgcctgaagacttccatgagtgaagggcaggggagagctgagggggtgggatgtgcaggtacgcagcaagcaggggcacggccagcagccccacctggacccaccactccctcatcctgtaggaaaagcagagacccactgtaagcagtcaggtaacattgtccactcatctacaaaccaaaacctggtaagatggggtgggagattgctgttaccatgcaatgattacattgcccttcacataggcacaaagctgaccgagactataatcaaacctctgtctgccatagcactcaccatatttgttcatcattctaatcttaaggaaaaaaaatacattatttcaacatataatcttctgcctctgctccccgactttaaccccttagcccctacccttgtggtcttcccaatacctgctgaagaggactttatataaataaaagggacatgacttaaatgctggacactctttcgttgacttttatcaaggcttcccaggaaaaaaataacttctttcttatttactccaaaagctctaccatctacccactacccccaaccagtaaaatgttcaaaaaatatatatgtgctatatctcatgttttaaagagtgtgtgt

SEQ ID NO: 127508 - DNA, 1045 bp, Homo sapiens
ttgtcataaaccgtttttcattattgctcctgacctcctctcatttgctatattcaattaagtaagtatacaatttttattatgttggcttgggttacttccagttttactgttttagaaaactaatgttgaagtaaaagcttcatgtccatacagtttattttttccttacattttcaaactatactacttgtataaatggaatgattttatttgcacagattctcaagaacaaaactcttaggctaaagtatatacaatttttaactgcttctaaattatttttgaaaaccttattaccaaattttcatgtcactggcagtatatgaatatacctgttctaatcccatactattagcaaggttaatattgtctaaatgtttacctaatttagatgatgctgaatgcttccatattgtcatatgcattaaaaaagttcatgtttatgttgattaagccctttttatagttgacaggattttgtaatagttttattatgtttttgatgttagattgggtctcctgctgaataaaaagtgctgagcaaacagcataagctaaaggtgttccttgggaatagttgctgtatcttagagaatttctgtgaggccattcatgataaagtacaaagaatttgtagtttatgtgttgtgatcatatgcttttaactgaaaatttacttttcactgaaaaaatttgcatattacagaacaaaaggagaaatggggagatgctgtttaaaaacacctaggtgaaagtaaacaaggtgccttcaagtattttcacatagcatgatttttacaatgttttaatatacagattgaaaggagaaaaggcctgttctcacctaacgcagttaagcttacattttacaaataattgtgtcattttaatgtcaatttggtcacagttgcttgttctttgtatcagattacttagattttaacatcttcgaggttatttttatagggatttggcataattgattgtactttccttcttcctagactctgtgggtgtggttggaagtccagagatagttgtg

SEQ ID NO: 127509 - DNA, 1036 bp, Homo sapiens
atttgggaaggtctgaccttgaggtttcatcgggtgattgcccttgatttcttaggctttggcttcagtgacaaaccggtaagcagcacctatgtggggctggtgatggggtgtgggggcagacgcagactatgagggtcaggctggcagagagagctgtcctcatgacttcatcctgtgtatgtgggctttcctttcctcagagaccacatcactattccatatttgagcaggccagcatcgtggaagcgcttttgcggcatctggggctccagaaccgcaggatcaaccttctttctcatgactatggagatattgttgctcaggagcttctctacaggtcagtggagcttcagacttcagcttatgatgctaggaaagtacattgtttctggactgtttgtatcctttttctctcgttttcagcggtgcactggtttaagtttgctcagctacatgtgtgtttcctcgtctcccttctaggtacaagcagaatcgatctggtcggcttaccataaagagtctctgtctgtcaaatggaggtaattgccttggcggtaggtagaaagtgggtgtaatctagaagggccatctttagatacagcggcacctaaatggtaatctgataatatttcaagtagacataattaaactatgggatctctacctcttctgtgccatcaactcctttggtggtctgacaagatttatggaccctttctcagaatgttttaaaataaagaaacaaacagcattacaaaggatagtgactttacttacatagtcaataaaaagctgcattatagtcacatgtgctttttcaatgcattagatagcaagttctagtggaggacctagtaacagctatatcagaaggagtgaggagtgtaaagactgtttgccatatctgaaacaactgcaataggttatgagagtgtaggattgaagatacagaaaaaagccacaagtgtttctaatactactatgatgttagtgtagaaaatccttacttaatgtcatcaatgggttcttggaa

SEQ ID NO: 127510 - DNA, 1020 bp, Homo sapiens
aaaccattcagtagcaggagatttggctaaagatttagttcctagtataaaaccttttgccccggtgaggatcttcctctgggttcttgagctttacctccacttattcccctccagctactcaaagatggaggtgtgctgtcacccatcctcacacgactgatgaacttctttgtattctctcgagggtaagtgtcactgtcaaagattgtggcctagagcaatgtcgtgaaaagttgctgccattacaattctgggccaaatcctaaggcttgatattttaaagcaaaggtgttggccgcttgccagggaagtagaaggaattcataaatcacttatgggtcagactgcatggcccagactgcatggcctctgaggttccagccatattgaacattctgagttctcctcacacttatcttcctgcgttttggactctttcagtctcaccccagtctttgggccgtatactcggccctctgagagtgagctgtgggacatgtgggcagggatccgcaacaatgacgggaacttagtcattgacaggtaagaagttaccctttgctttggtttccagagacgtgtttttgtggagagtggggattgcttgttctgttccttgctggcttattccctatcacaggaaggctgatgatgacctatggggcaaaccaaaaagtcatggtctatatgaagaaagaaatagaaaataagagtgaaactggactctttgttagtattaaatgcttcaaagtattgaatcatggttgtgaaagtagcctagtgcctccctcaaggtacaaggctcttccttttgcctatctttctgcagcaacggggagtgagagggcagacttctctttctctgtcttgtacaaagaattcccatgccttggttcaaatgagaatgtagacactttcacaagggacccagaggtggtgatagctgtaactacttgggataagactctgacttctagccacctggctcagtgtagcttccagtgtttttactgatgg

SEQ ID NO: 127511 - DNA, 1027 bp, Homo sapiens
gcatataattttaaataaaataccccctctctcatctcctcctgggattaagggaagatccttggttatctctgcttgggcagtgagttgctgtgtgatccacttgtttgatgcttcatccttctctaaggagctgaaagtcatcttgctttgacaattgttgcaaaagtgttatattttcaagttgttgtttgttggattatgaacatttaaaaactagtttgtataaatggaattggcaagtttatctgcctaagatacaatttcagagtagaaggtgaataagctctttggtggctccttccagtgtggtgtgtccacagggtcatttactggggcttcccactggcttacatccctcccgctccagcctcaagttcacctgcgtgctgttctcttccactaggaaaacgctgccgcggtccacagtgtcgattctggatgaccacattagccactatccacagctagaggatcccatgggcttcttgaatgcatatatgggcttcatcaactccttctgagctggaaagagtagcttccctgtattacctcccctactcccttatgtgttgtgtattccacttaggaagaaatgcccaaaagaggtcctggccatcaaacataattctctcacaaagtccactttactcaaattggtgaacagtgtataggaagaagccagcaggagctctgactaaggttgacataatagtccacctcccattactttgatatctgatcaaatgtatagacttggctttgttttttgtgctattaggaaattctgatgagcattactattcactgatgcagaaagacgttcttttgcataaaagacttttttttaacactttggacttctctgaaatatttagaagtgctaatttctggcccacccccaacaggaattctatagtaaggaggaggagaaggggggctccttccctctcctcgaatgacgttatgggcacatgccttttaaaagttctttaagcaacacagagctgagtcctctttgtcatac

SEQ ID NO: 127512 - DNA, 1084 bp, Homo sapiens
tcagctgtttttagttataaacattttgttaaaatagatattggtttaaatgatacagtattttaggtatgatttaagactatgatttacctatacattatatatattttataaagatactaaaccagcatacccttactctgccagagtagtgaagctaattaaacacatttggtttctgaataaattgaactaaatccaaactatttcctaaaatcacaggacattaaggaccaatagcatctgtgccagagatgtactgttattagctgggaagaccaattctaacagcaaataacagtctgagactcctcatacctcagtggttagaagcatgtctctcttgagctacagtagaggggaagggattgttgtgtagtcaagtcaccatgctgaatgtacactgattcctttatgatgactgcttaactccccactgcctgtcccagagaggctttccaatgtagctcagtaattcctgttactttacagacaggaaagttccagaaactttaagaacaaactctgaaagacctatgagcaaatggtgctgaatactttttttttaaagccacatttcattgtcttagtcaaagcaggattattaagtgattatttaaaattcgtttttttaaattagcaacttcaagtataacaactttgaaactggaataagtgtttattttctattaataaaaatgaattgtgacaaaagtggactctggcttcccctcccccctcccccccacccctctgggataaaaattttccagcattgccaggagctttcaggtacacattaaagaataaaatgaagttaagcagctggagtataggatagtatttgattttcaagatcacccaaagctgcactatcgtcccaaagctgaccaagtagaataaaaagaaaaaaaaaaaaaaacaacccatgcgcaaagatagacatttgcttgatctgctggctcagggccaaatgtttaatttgcttctccaaagtcattcatcttcaaaagtctgattctgggaaactgatgccactagcctaaaagcccactgaccatgtagtgtgcatcagtttcctctt

SEQ ID NO: 127513 - DNA, 1336 bp, Homo sapiens
tttccttccattttcttgcaaagcttaataataggatatagatgggcatcttatgccttgctgttgtcccatcatcccattatatgagtaacaatttgatacccagtcaaaatgaataatttgttttgcatgctattcttggttattcttttaagatgtacatttggcccaaaacaaatctctccaacagataccaaggccaccaccaacattccttttgagtactccaaattggtatttttgaataccttctatgtacctggtttcatgggaatataaaaatatatatatttggaatttatgtttgtttaggattcagtttccacaagtctctggaaaagctaaactaaactaatagaaaggagatgcagggatagcatgataaatttcattatccagtgcttgttttgggttcttaatatggttttccttacttttttctctcaggtatattcagaggtggctatgatttattggtgaggtccaggctggccttagccgatggagtgaccatgcaggtgactgtcagaagtaaagagagaacacctgtagatgttatcttagcttctgttggataaatgcttactggacaagaggaaactgatgcacactacatggtcagtgggcttttaggctagtggcatcagtttcccagaatcagacttttgaagatgaatgactttggagaagcaaattaaacatttggccctgagccagcagatcaagcaaatgtctatctttgcgcatgggttgtttttttttttttttctttttattctacttggtcagctttgggacgatagtgcagctttgggtgatcttgaaaatcaaatactatcctatactccagctgcttaacttcattttattctttaatgtgtacctgaaagctcctggcaatgctggaaaatttttatcccagaggggtgggggggaggggggaggggaagccagagtccacttttgtcacaattcatttttattaatagaaaataaacacttattccagtttcaaagttgttatacttgaagttgctaatttaaaaaaacgaattttaaataatcacttaataatcctgctttgactaagacaatgaaatgtggctttaaaaaaaaagtattcagcaccatttgctcataggtctttcagagtttgttcttaaagtttctggaactttcctgtctgtaaagtaacaggaattactgagctacattggaaagcctctctgggacaggcagtggggagttaagcagtcatcataaaggaatcagtgtacattcagcatggtgacttgactacacaacaatcccttcccctctactgtagctcaagaga

SEQ ID NO: 127514 - DNA, 1039 bp, Homo sapiens
atgctgaaaacagacgatggcagtgggttttcccatataggaaagaatgaacctatcaagcctgcagaatcaatttcaatgccattaggggttgagaaaagaacgactgtggtttaattaggataggattttcttcagagagaaggggaaagaagtgaaagttaacacaaggccagaacaggtcaggtgaggcattttttttaaaccatgaaagagatacagaatatggtaggggaaaaggtcatgatcaagttagaatgaagagtcaggagagacattaattatagcaacccagtgtggttccaattaagcagagaggctacagcaaatgaggaggacaaagagacaacatcaggtatgaaggcagatcacagactgggcacaggggctgagttttatgtggaggtaaagacagaagacacttacatataaggacctgatacagagaaagagattaaggaagtaaataggaatggtgttagtagagataatgttcctgaaaccttagtgggaatttttttacttaaatggtttgattgatacaatgagaggttacagggatctaaggaagtctaggcagtaatctgtcgaagctgctggagaggatgacgaaatggggcgaggaggcaagatgcgggggcctttccatggcaagaaaatactgaatgcactgccataatgtaaatatgagagttacacagacaaagcaaggcaaataccaaagagaatcaggaaagaatgccctgaagatctgcattaaaactgttctctgaaattaagcttgtcttgtgaggattcactgaaaatgagagtcaaccactaaggagatttgtatgaaaagaacccagcgaattagagaaaagatagatgctggcagctaagacaggagagggacatgtgagttgggccagggtacagaaaatgcagtgtggcaaagggcagagtgggaaaggtgggagggagctgccaggtctcaaccacctgggggagaccatgacaaagtaagagacacttatgaggtatttccagaaagctttgt

SEQ ID NO: 127515 - DNA, 1046 bp, Homo sapiens
gtactgcatttagtgatttgcctaagatcattccacaagtctgaggcacataagatgtgaccaaatatactttagcagtctttcgaaggctagggaagggcaggaatgagaaatcttttgaggtatagtaagctgggcatggatctagggagcaaagaagaccccttccccagcctgaaggcttatggctgagctctaaaacaaagatttcttatgtggcctggcaaactgaggtgtaacacagagaaagatctctagaatctgccactactactaatgccctgctgaaaggggaaacctgatctgttcctcagatcatttgtaaacagcagataactgaatttaattaaagctgcagcaaagtcctgacccagatcaactattagctgctaaaaatgaaaaaggacctgcacttttctaatgataagtattagttacatcagtgtctactgcacctttataagcagtgtctagcaaacaatcaaaaaatacagaggcagtgacatgtaacccataaacaagagggaaaaaaatagtcagtagaagctgacttacagatgacccacatatagaaattaggaggcagtgactttagaaattactaggcagtgacttttaaacaacttctctaaagtgaacaccaaaggagttttgtaaagtgaacttttgtaacttttgtaaattacatctttccactaaagagtggaaaagatggacaaaatgtgtaaatgggtaaggaattcaatagataaatagaaactagaaaaaaaatcttgaaccaaaaaatacaatatcaaaaataaaaatttatttgaagcacttaatagcagattggacacagtggaaaaaagattagagaacttaaagacaagtcaatagaaattgtccaaactgaagcatagggagaaaaataagaaaagaaaataaaagaatagaacatctgaagcctagggaatatatcaaaaagtctaatacttgtgtaatgagtctcagaaggaaaggaaacagaatggaatagaataaatctttgaagagataatggatat

SEQ ID NO: 127516 - DNA, 1976 bp, Homo sapiens
tgcactgttgttctgttgtgattgttttttattttttgcattacattggtagcagcgtgagacttgaccatgctagtgctagcaataaaactctttttttcatctgaatattgctctcagtctttttactcatctttatctgccaccaccttcccagtgctttttcccagttaaagttaaaaagaactgtatttccagaggattttatgttgagggctcactatagtagtacactacacatttaattctttatgtatctcagataatcagggattacgtttgatttctaggactctctgggatctgtatataatatgtgcccttcacatagaggaatcttcataacttcaaaagcaggctccatctccatataggaatttctttatgactttcctgatgggttcagcctctgcttgtgtatttcttccaaactgagattctccattttgagacagtttatttcattgttgaacagttattcttctttatatataatcttaaatgttctttcttaaagcttcaacttcgttgtttgggttctgccctttgggatattattactatattatcatccttttagtgcattctgaatatttgcacagaaacaaatataagattggtttttgaaaattattttgaagcataagagtaattttgcataagcatgtttttccttaacaattttttctttttgaatgttattagggaacaatgttgcaagccattgaaagatacatgaagcaggccattgtggataaagtttccagtgtatccagttcagcactggtatcttccctggtaagtgaacaagcagcttcctagttcttaagcatggtacagttttgagttgcgaaaacaaagtatcactatgattgtctcacaaatgaaacagttaaaaatatgtatacacctctattactttatccaagtgtgttttatctagagcaggggtccccaccccagggcttcagaccagtactggtctgtgacctgtcaggaactgggctgcacagcaggtggtgagtggcaggcaagcgagcattgctgcctgagctccgcctcctgccagaccagcagcagtgtgagattctcataggagctcgaaccctattgtgagctgcgcatgcagggatctaggttgccggcctcatatgagaatctaatgcctaatgatctgaggtggaacagtttcatccaaaaactatccctctgccctctgtccatgggaaaattgtcttccataaaaccaatccctggtgccaaaaaggttggagattgctgatctataggatcattgagcaattaaaaacataaaatgttcgtatgtttgaaaggttttggaaatctgaaagttatgttgtacacataataaaagaggggtaagtgtggggtatgggacaggaaagaaacctaggacccttttctttcatttaaaatcttctttatgacctgcctttatgacttctactacttgtctctttgtcctctgctttttctggtgccctttgtctacgtgtatccttcaatccaaagtttcctgtcccacttctgaatttcctcccaggaagtggtcttttttttagtaatacatttttctttccgtttttcagcagaacacaatttatacattaaaacctatcacattgcatttgattaacgtcagttacctatatgtgaatgtgtaagacatctaaatacaagagttcctgattctggaatataattggctgagttttatagcagagaatatactagtactctctttcttccaggggagtttcctggaagtaaagcttgttatgataacgttatttaagcaccgttctgttgactgtccatccctatcctgttcttcctctttcattacttccttttacacacctctcccagcttacatatactcacctttgtaacaggtatgggagaaaatacttctggtttatcagttgctccaggagtaaagacacaaaatagac

SEQ ID NO: 127517 - DNA, 1038 bp, Homo sapiens
aactcattggcccttgattcctgttggttgaggattatctttagcacagaaataccccacacttcaggattatatatttctgagtgacacgttggcaaccacaggcagctgacactcccatgtcagagaagtcagggccacaaactgagccagtttgcatatttggaatgatgatcactgttaggtcactttggattcttcattctagtgaaggtaaggaaagtgctaccgtactcatagaggtcattgaccttgattcctgtcaggagctaggatcatttctgtataatggtggcagaaaggactctgtctagaattcatggtattcccttgagtatattttggtgctttcttgcctctgacagtggtggtaggggtagagaacaatcagtggttcaatcagggtgcacccaacacagggcttacatcctttgggataaaggtttgagtcaactattggagaagtagccaaaaccaggtaaagtgctggccagtggggaaggaaatgtagaatgggtggttttaggaaggagatgatgaatatcaattatggccttggaattagttgtagcagcaaggattgaactatgttccactcaccttcctttatttagtcttttgtagaaatagtgattgctaccgtcttgaagcctccatgatagattagacttaatggaggacatgaacaaatttgagggatggaaagggtagactgtattggacacctcttttgagccacttcacatggtctcaggccttatctgtgattccagctgtggcatcatgagcaagtcttttggggctcagctcactggcattgttactgccttacttcaggtatgcactgagtgttttttgcctactcagattcacttgcagctcacgtgtatactccccagaagtatgggggaattaatactctggggttaacgttcagccaggggctaacagttagtggttctgagatgtatttcataaggctcctcggaagattgctcattaaataaccagtggccagcatcagtgacccactcaagg

SEQ ID NO: 127518 - DNA, 1955 bp, Homo sapiens
cactgcagcctccgcctcccaggcttaagccttccaagtagctgggattacagctgtgtgccaccacgcccagctaatttttgtatttttagtagagatgtggtttcaccatgttggccgggctggtctcaaactcctgacctcaagtgatctgcccgtcttggcctcccaaagtgctgggcttacaggcgtgagctactgtgctcagccgttaggtttattttttaattccatttttccacagattttttgaagtcccctcgtatttgtgatagccctaaactggaaacatcccaaatgctcatcaaagaagaaggaacaaattgtggtatattcatgcaatagactattactcagcaataaaaggaaaaaattgctgattcaggcaacaacatggataaacttctaaaacatttatgttggaaagaaaacagacacaaaagaatatatgctggatgattctcttcgtataaactccaagaacagcccccaaactcatctgtggtgatagaagtcagaagtctactgggttagaggaaattgattggaaatgggcatgagggaactttctggggtgatggaaatgttcagtatttttattttggatggaggttacatagatgatcacaattgccaaaactgatttagcataatatttcagttgtccattttattgtataaattacagctcggtgaaaaaaaaaaagagatgtagttagtgtcttaactaactaaatgtatattgacaacctgattttactgttctactcattacaagaaggcatacccttatgtgatggcacccacccagtgaaagtctggaattgagtcctgagagaattgaggaattgagaattgagagaattgaggaattgagaattgagagaattgagaattctggaattgagtcctgaggaatgatccatcactcacattaggaagtactctggggagtgggcatcagtatgtgagaagttacgtcccggtttcagaaaatcaaatgaaaaattcaaagaccatggtttaggaagaaataaatgggttgtagaaactgttatcagctaggcagttttgaaatcaattgtgccgataatgtgtggattcgggtagggggagaaagatactttgtgcttcctaaggaaactaaatgctaagttcatccacttagtaagaaatatacaagcccgaaacaacttttctatttgaatggtgcagctgttcctgaataattacttctgaagatttactgccaggaaatggtttagaacaagaaaatgagatactattatgacttaaccaccactgtagtgaaactcctctcaaagatttccagtaacttcttacttagttaattttaaaagttaattttctgtccacattttacctgacctctttcccagttttaacatggttaaatacttcctggagttgtaccatctttggctttcagaaaccatagtcctggatttcctctcctctttgatttctccattttatcctatgatagctcagaagtggctggttttcttctgcctgtcatctaaatattggtattccctagggttcatatcagtgctgtagttctttcccaaactcatcatgctctttgataccctttatatttgtacatgcttctccctgtgcctggaattattctgttgccttttccacatagctcaaatacatgtcattataggtactgacttccttcttcttctttcttgacagattagtcattgtcttctctgttgttctcttttttttttttttttttttgagaggtagggtcttgctatgttgattaggttggtcttgaactcctgacctcaagcagtcctctcatctcagcctccccaagtgctggaattacaggtgagagccactacccctagcctcggttgttctaacacttgatttttttttttaacctctgttctagtattttaatatattgt

SEQ ID NO: 127519 - DNA, 1052 bp, Homo sapiens
gtagatcttcaggaagatcagcagtcccctgtaaggcagctgtttcaggggaggccattatatactctacaggcaaaggaagactaatttcctcacatatgggataaaggactgatgcttctactagcagaagatgtcacagaatttaggagttcggggtacttggcttcatcagagtctgtccatatatcttcattctacttttcagggccccattccttgccagtcaaggtcctaactttaacataagatgtcctgcaagagtgtgaattcaatttgcattgtaactgagccacctgcaggatatactttgtagaagtctcagccctgtagccacatgatataaggctttctatgaaggcagttatagatttctggcccccttacccagatttgagtagtgcttttaaaactccgagctcatcattttcttttcctgagaaaagaattatccagtgtacctagaaacaactaattaacccattatacaacttatttttactaaaatcttctatggcatccactagttagttacccaaggctttgtcttctgtaggtccttgtctgcagatgatgattttaaatattttgccactgcatgctgtggactactagtagcccctttaccattggaaactggtcattaataccttcaatcaaatcagagaagcaacttcaggttcatatctttaaggacttcttttaaccacttcctgtagcagaaattcagggttcagacagggaaacagaaccactatgagtattgtggaattaggtgtttattagaggaattagactagaaaactaggcaggttgagctgctggagtagggttcagagggaggctgttacataagtcatggaaggctattgcctcttttgtggctttgtttttgcagccaggtgtcttcccaaggctgctgttactcagagggctggcagttgggaagaaaagctggacatgtagtggagaaaaggaagcagagtaagaaagaaaaaggatgaggacaaacttttgaagcctgtagcacagaggtttatattaagaaaaga

SEQ ID NO: 127520 - DNA, 1022 bp, Homo sapiens
atagtgtaagctcattcacaagacattactacccagaactctgaattcaagttttctcttcttctccatttttgaaagtgtcagacgacaagaaagcaagctgtttactaaagaactgcagcatgaataatttctgtattataaatgataagatattctattttgaggttagtttataattcatttctgtctgttgtgcctaaaatcttggctattcagaatgatgacggctcctcagatactatggaaataataaatcatcaaaggcatacatttattcactctttcgtgttaactaaagcagaatgtatagcgcagagactttgtaaacaactcttacttaactgaaactacaatagaatctgtgtactagccatacaaaatccactatacagtgttccttcctttattattgaggttaaaaattcacataacataaaacttaccgtttttaccattttaaccattttaaagcatacaattcagtggccttagtatgttcacagtgttgtgtgaccatcaccactctctaactccacaacattttaatcaccccaagaagaaacctgtacccattaagtagacattcttcattcattcctcctcccagctcctggcaaaatctgctttctacagacttacatagtctggacatttcatgtaaacggaatcatacaataggtatgatacatgatacatacatacaacagggatgatgcatgataaaaggtacgcagccttttctgactggcttctttcacttagcatgatgttttcaagattcatccacgttgtagtgtgtatcagtacttcattcctttttatgactgaataatattccattatttggatagacaacattttgtttatccactcacaggttcgtactggcatttgagctgtctcgttctttaaatttaaacttttatttctgtcagtgtaatatatatccataaacaagtaagagggcactgagtcccagagcaaacaaacagctgttctctgtcctactgttttctctc

SEQ ID NO: 127521 - DNA, 1065 bp, Homo sapiens
aagtgggagaagttggatgtaggctggatatttgtgggtaccaaggaattgtttgttttcttaggtatggtaagattttgtggttatgtagaagagtgtcttcattttatagaacgacctcaaagtagttaggagcagtgtatgtatgggtggttatcaatttactttcaaacaatgcagcaaaaaatatgtatctatattacatataattaaagcaaaacatgataaaaaggaatagttattgaatttagatagtatggatttaggaattcattgtattgtcattccaatttaatgtataaaattttttataacagtttataaaaacagtgcacacccctttaattaggtggcctgggtacatgaagtatctttttggatgcctagaacacaaaaagggacgacaacaggccacctaataagatgataccaagaactataccatgacggcgaaaaagaactgctgcaaaaaataatttgccaaggagaactcagagtacaaagccttacctttggagtagagggaaggagagtcttaagtaaagctcacaaaaacccctaactcatagatgcagtctaaggaattcattccggaagcgacattagcatctcattagtgccattatgtgacttacttggcctctgagctagtctattttcttccctagaccccaaaatctcagtaatcctttggatccaagttatctccaagtgaaaataataggtttaggaaagcgtttttcttcaacttctatggagcacttgcttgctttgtcctatttgcatgtccgacggacggttctccagcaccactgctagtcgtcctccgcctgcctgggtacttgatcacaggatgcctctgacttctcctgcctttacccaagcaaaggattttccttgtcttcccacccaagagtgacggggctgacatgtgcccttgcctctaaatgatgaagctgaacctttgtctgggcaacttaacttaagaataagggagtcccaggcatgctctcccatcaataacaaattcagtgacatcagtttatgaatatatgaaatttgcca

SEQ ID NO: 127522 - DNA, 1176 bp, Homo sapiens
acatcccctcctcagtattccccagcagcgtgcagcacagtgcgggcttctaggaggcagtcggtggatatttacccatgattttaagaggtctgtcttgaccaggaatgttgagaagtgacctgtgtctctgcagcattgctgctagttagtccctcgtggaagaagtggcatgtccctcctgtgtctggctcacggggaccggcgcctcctgtgtttgcccccgccatgccctgtggtttcctttgacaccctctgtcattgtctatttttatgttttaaacttcagtgggatttacctctcgtttgctcccatatcctcctggtaaattgtaaacttggtgaatcaatgatgagtaatcagtaggcagaaatggttggaatttcctggtcccagtttcagatcatatctgtctttccccagactcctaacttcctgttgggacatcccttggtctggcctttccctccagagaagcccccagacccacccgcagccttgatttactgatgcctaatcttattttagtctttcacaccagtttttaacaactcgactgtatagatcttctggaaattttacccaaaaatgttagatgtgccatcccctcacaggggaaagtggtggggtggtgggggttaatgtgttgaaaatctatgtatcttgtattttatttgagtcagctgtgttttcacaacaactctgagagttaacatcatttctactttataaattaaaaaaacaaaacaaaaacaaaaaactaaagccccaaaaggattgaatagcttgccaaggctgtgtaacaagtgaaatttgaatccgggtctgtatgatcccaaagcttaagctgcccgtctttctattcccagttcaaacgtgccttgaaatgggagctcacttgatagtacttggcttttaaaaggctacgtacatgtaagtaccttcactcaaatatgctggggctcagtaggagaagcaaagagaaggaaaaggtattgattgatcgatttgattctaagcagagattgacagagataagcttctaagacctttcaggccccagagtgtgactgttgagcacctaagaagacctcacttgacccgtgacttcccgccagagccttgggaagcccatgagtgcagcgtgctcgccggctgggctggaacttgctgct

SEQ ID NO: 127523 - DNA, 1044 bp, Homo sapiens
tcagcagcattcgccagcgtcgggtcagactgagtcatggggcccgagctctccacgagttggttctccagttggttctcgttgggggtaatgcccttcatcgaaccgcttcatccccagcctgtattgtctccgtctcttcgcagttgtcagagggctcggccgccaccctgaaacagcccagagctctctgaagagcacgagcttttacgcttctctccccaaatcaactgactttttcattgcttctgtggaggctttctgtgggagaaaagcgtgtttatggggcaagctcagagagctcctgtccccgtggtggaatttttttagtggctctgcccacgtggtggtgagcgccggtgaggatgggacgcattttctgctaaaatggctgtgcgaggctgccacctcgtggccagcacaaggcagtgagtgtgtcccttgctggagcttctgggtgaaataaactcattttaaaggtcttcagcaaggacctcactccctcactctctcagtgtgcatatcattccagctccagggcttaatgcgtctgttgtggcatctctcaaatctgtactttgctatctctttgactacagagtcactaccttccgataagcccttctgctgtctccagaccgatccttctaaagcgtagatgtcattgtctttctctcattaaagctctttcatggctcctcattttccaggttccagctcatgtctcaggaggccgctaagcccactcctctgccccagcctgtgtctgcgcacgtctcttctcccttcctcctggtttcctctggctgatacctgctcacctgaaagtcatctcaggtgccacctcctccagggattcctcgcattagattagcttccttcttccccattcctagctgacttccttcattatgcctcagatcctttttttggaagaaaaagaaagaaatggaagacagactggccagcagggggagagagagggagggagggcatatcagagaattcaatatgctgcgttttaaccagatacttttcttcctc

SEQ ID NO: 127524 - DNA, 1061 bp, Homo sapiens
gctttccttttcttgtgggtagaactctggaaaagtggaggggggtgggtggggcttcaggtaaagtacgtcagcaaattggataagtcggatcttcgttgtgtgagtgggtaagagatgaactggggggaggggtgtgtgtttgggcagtgagcaagccggcaagagaatgtgagtgggcggccagttggttggcaagtgagaggctgtggagaggttgctgctgggacgggctgtgcaattaaacagttgagcagatcttaatagcagactggggcggtgctctccgcaggcctgcggggagcagggagcaggggaagcaagcgagctggaagcatcttcgggcacagagctagatacgaatttcagaagcacataacctgaggaatagaatgcaaccagaggagggagaaatagagattccaggcagcgtttcctaaacttaaaaagttttgaatacccagttttgccttgttctggggacctctggcaatgttgttcaagggaggaatttttaatttcatagaaaagtgaattttaccaccacaagagaacatgagaccaaggtcataaatccctttgtttggagtgtccgttctgaactccttgtatacttttatttgcaggaagaggctataccagcaagtattatggttttactgggtggggcggcaaggccaggaagagatggagatgctgttaaaggtccttgctccagaacattcagagatcagaggaactcaagaggtcaaagtaggctgatgtcattgttcatccatttattcagcaaaactttcttgaacacctactgtgtgccaggcactggttggcagtgaggtgaagacgatagtgatgaaaacaaaggcatggtctctgtcatcatggaacctaagtaaacacataccaaaaaaaatggcccaagaaaaatcatgccctgaggggaaggcactcagatgaaaaggaccttcttcccagtggtcccctgaggaggtgatttccaaggtctcagctaagggatgagcaggaatgtgtgggtgcagggggtaggggtgagagctctc

SEQ ID NO: 127525 - DNA, 1968 bp, Homo sapiens
aaaaaaaaagttggttttattagattacagagaatactttctctatccaaaatctgtgattttaatctagaacactgaatgtaggtcagtatccaccccattttcagaaatctgggaagatctttttttgtttttcagcttctcagaataaatactttctaggatgttacaaacatggatgaagttcaccagaacagatccagggttaaccttttaaagtcattagatatggctccagtaaaaggcatgagaaggcacccgtgagaccctgcagaggaagcctcactcctgggcagccttacggctgacgagctaccttactgagcatattcctgcctctacaccagagactcactctgtggtccggtgtcacctcgattctaaattccctgcttcctggtgaatgatgctatcacactttagaaacctggccaataaatgctttgaaatttaaggatagctatcctgaaaaaatttaatataacctaaattgatagtctaatgacatcagtattcagaagaggcattctatttcagcaagtggttttcagaaaaaaaaaaaaaataaataacctgagtttttcccctgccactctcccctcttgcttttatgctgcaaaaagagcttgtggcttgcctgacacaccgtgttgttctctgccttcgaagatctagctccctcagcctccccacgttgtccacctctccaataccattgctccactgggaagctggcccggaggtgctctaccacgttcatctctcgcagcccagggctgtctttaacgttacagagacacagatatcaaagtgttgcaatttatttggctttcattaatttgccggaagcaagggagggtagatacaaagtactcctctaacctgttattttccttgctgttaaaatgtaaagaagactgatgtaagaatctctgccttccaccagtcataaccatggtatgcacagagcttatgaatcatcttctaaattcacagctagttttaaaatttagcttccaggctagatctgcaggaaatgattgggagatcgtaagtgctatggagtgaatatgaagttacttaccagatcccataaagttagctcagggaatcctgaggaaggtgtcactcagaaagctgctttcaaagctgagtcagacctgcatggtgtttattacctccattgtgttaccatgccaaacatataaatagcttcaaagtgagttcagattaaaacacagaaaaatctttggatatattcacaggccagtgggggtcatgtaacaagtcagcaaggaaaataaaagatatttgaggtacagcctcaactttttaagatggatcttgaataaaaaggtctaatgaaatattttatggtattgctctctgggatttaaaaaaacaaagcaaaacaaaaaaacgagggcactggaacaatgttttagatagatcacgggtgttttccagtatgcatttttagtgcacttacttaactgagagccctctcatatgaaactggaatgtcaccaccatgtgataaagcgtagactagctgtgacctaatacgtactgatcatgactaacgcagaagtccaggtcactgcggttgtatttcctgtggcctcaatgttctggggttagggttaacagggataattcatttctgtgttcaagtctctaattcttccatcatgtaaactgtaagtgggagcagactggattcagcattgctacaagagaaaaacaacaaataggaacaccaccaacaccatgtgttgggagccccatgtgccaggcactgtgccaaatactcgatattgattatctcttttaatacacaatcctgtgtggcagatcctactatgagacccattttacagatagacaactgaggctgggggaagttggaaatggaggagccaggattcaagtcacagcagtctggctcctgcgcccaagcttttaatt

SEQ ID NO: 127526 - DNA, 3240 bp, Homo sapiens
gaaataaaagagttggggtctaagtggcaaagtgctgccgtgtttcaagttaagggcttccatggattgtgtgataaatacaggtgtgaatgtgggtgatttgttttattcttcagtgcccattaagtagaagcttgtattttcctccttcccccttcaagagcccccctccccaccatgcaggcacatggaggccccaagttggaagcacattcacagcctgaagctgaaggacaggctctgaaaaatctttctttcagcaaaacgtctactaatctcagaaagtgagctttgtcaccattgatactctgtaaggtgggatgaaagcaagttttcttactcattttgcccagttgtcaagaaatgctgcccttctctctaacataaattaacaggtttggctacagcctagagaaatacaaaatgtcacattttagccttagtggccggttttcaaagggtgcctgagtgtgaacaccatgtcggctgctctgttaatgtgactgggtctcataaataggtatttttctacccctgtgatggacaaatctgaaaaagttttttcatcttacaagcccagaggatggtatttagaggctgatttttggtatctcagttcctggtagggaagacgaattccgtatttgaaatttggggacaaacaaaaataattctttctctttccttgaagggttaatgctccaaccagcctcagattggttcgcttgaatcttaaaattacttttctggtcacgcgcaccgaaggtctaagcatttgtgaaatgtcttttttttttttctttcctcttgatgctgttctctttgggctgtcttaattacacaggggttgagaaaccaaattaaaattaggcgtgtctggtcaacagtgatcacgttgcatgcttttagctttgcttgttgaagttgcttctcctccccgagtggctttcctccccacaattttttttttttgaaggaaatatcataagctctttcagaaatactcacaggaagtgagagtccgtatgctggttactcaccagcaactgagtgttggcaggtggagaatgctaccgcagcccgcccagacggatctgcagactggccccatcgcagaggattagacagagggtgcatggatcatagggtttttgaacagaagggagttttaagaggaaattggtcactgcgtgtcatctcgaggggtggtgattcagggagcagggctgggggtcagaaggcacgtggctgccatctcagaggttgctgctcacttctcagagggcaggctggcttctaaaaatcaacgctccctccacccccaaacagcgattcttctgcagtgaatcacttccagaaatgaatagccacagttttttggaatgaacgttgtgaaatccctcctttataatggcaggttttcagttggtggttttatcagaatttctcaagatcaaaacgaaaccttctctttaaaaaggaaagaaagtactatcgatacagaaagcaaaagtatttccagtctcctactgaactgtcacggcagacctctctgtatctatatttagagctgtatgtccatatatttgcctgaatgtgtgagttcttggaagtatggattcattgccaggagctggtgatttcctaagcagaggtcgctaactacaagaaatgttacactcggtgagtaggtggtactttctgaagattattggtaacccagtgttggtcgtcttgagtcatggatttaaatgacggctagcaagctcttaaacaccttctgctttatatgatacagagtatggaactgcaggacgcacagacaactgtgaagggtttttaagaatatggattcattgaataatcagtgaatcttgtgaatatactagacctttggaggaggaaagggtgttttacagaaggaagtggtttgtgggggcttttaaaggtacagttatcgcttttctatatttattttcagcatcattcagtcctcctatatgaaagaaagaaatggtctcgatagagaaaaagttatgctgactctttaaatgaagaaacttgatcctcatgttactcttaactggacttttttcctcctaaatattcataagggaaactatcccatgaaggcaactaactttctggcaatctctatgatgtgtctaattcagaacccggtgggctctccatgcattattggcagcacttttatccaggggcacagacagggaatagggttactggaaacagggagtgtagctcaaggaattgttctctctctggagtggataagttgtttgacctactgactcatttcataggaattaggaaaacaacctagtgtggtttttattgttagtcctggaggattccaaaatctgtgtgcctgcaaataagatgagctggggaaagggagcaccagcatttggtgtttctacttgcctcttttcctgatggaatccaatcctctgcttccaggacaagtcctgcgcttggggatcctctgtacgcccgttcactggtgagtatgtatgacagcaatttctgatttcactagttcttgcttctaacacctaaatggtgctttgtctagggaaacgctttaaagagcattttcccccagtacgtttataatacatttcatatttacctccagaaaatactgtggatgtgataataattataaaagacaacccacagacaacaatgaaagttaagaattaagatatattctgatagatttttgcagcatattgacataaaggcagttttggttttgacatatgtacactaaaatgatatctgtaatgctattaaaactcaagtgtacaaggcaccagtatattctggcaaaaataatataatgatcaacagttaatgaaagacttgtgctttgagcttctaacaaaatgttaatatgtagagaatcttgtgattcatgatgctttggttctcaaccagggttatcaaataagctaaaagtatcagaagaggacaaagaaagtacgtaaaacatggataaaagcagaaaccgagaaaagatagctttgatatttaaagtgttagattatggcctctatataatgtcatatatgccagatccccccccaaaatcacaccctcaaattatgatcttcattattcaaaagatgtttggcgtgttggtggtacagtggtgagcgtagttgccttccagaagatggttggtgtataattactatagaatttcttgctctc

SEQ ID NO: 127527 - DNA, 2536 bp, Homo sapiens
gttaaagatataggtaggagaggtagctaccattaaagatacagatttgagattaatgccacagaaggagagctgaaaccactgtactacatataaccgtgtgtgtgtgtgttgcacatgtgcgcacacgcacttgtgttaaactggatttgttggcgtatctccaattcaaacctgggtcaggtgattatgttgtaacttactgcccagttataatcacaaactgttacaccttcatcagaaggaagagcgagttccctagatcagtgtgtttgtgtgtttgttttgttggatggatcctgccgaggcactgagagacagactttgctgggccctgttttgtaaacaaatctgttcacgcacgctttcttctatcattggatgtgtacactggctctgattttcccacccgacacgccaaagcctaagcatttagaagcttgttttcttttagaagtaggcaggcaccaaagaaaaacctgcatatgcatttaaagtgtgcacatctaccctaagtaagtctttggatctttacagttttaactctgggccatgtacagtgtatttcagcccactacacacggcagacctgcgagacgtcctgacagcccccacaaaactatggactgagcttagtgcaaaagagaaagcccttcttacccttaaagttcactgcacgggccattgtgggattagtcaccccagatgataaaacataatactggttttcctaagtaggggtgattcagctttctcttagattggaatatgaacttaatgtatataatacatacagtcacttcctgaacttgtagttttttgcatgttttatttaatattctagccaggtttaagtttttatggcaggaagtatgtgaatggttatgacaggagtaaataacagttgattttatgattacagtacaggaagtaacttttcacaccaaataaatctttgggaaaaaagtgctggcttataaatttaacgtacataaattttccagaatcttgcatacagtcgcctgtgctctcttaaatggaactaaatacctggctggtcttttttcttttaacttttttttgtcaacgaatgtctttgttttagaaagaggcattttcaagtgttttgatgtgacccaacgtgacctaaaaccattaaaagattctaagcaaaaataataaggccaaactttagtgtaaatagcatgaaaggcttgaaaactaaataaaaaattattttttcctttaagagtaaatagctaggctaggcatggtagttcatacctctgaacctgtgaaccattgctttggggggctgaggtgaaaggattgcttgagcccagaagttcaagacgagcctgggcaacatagcaagaccccttctctattaaaaaaaaaaaatagccagatgtggcacacgcctgtagtcccaactactcaagaaactggggcaggaggatcacttgagcccaggagtttgaggctgcagtgagctatgatcacgccactgtacgccagcctaggcaacagagcggggggctctgtcttaaatgaccaaatcatttttcatcattaaagcccgggaagcctccaaactgccaccgagtcaagttccttccagtgactcctatagccatgatctgcaggcacttgggaggaacagcctgttaacatcagagaggctgttgcatgtgaacaagtttacagagaagaggaaagaattggatagaacttcagttacatttcattgtaagcagagctttaacagaggctttgtttttccttgaataaaaaaatgaatagcgggaatacaagatttagagaagatttctttcttcacccttttcatcttaaagcctaaagatgttgtaatgagaaaaatattgtgacattcctttctgaaggttactattacacacacgtgaattatgtgaacgaatgggtggatgcctggcagattaaaatgtggagttccagatgcattcataaccaccatgtggctatgacacagtggcacatcattgggctgggagtgaaaggatgaaggttcagacttcagccctgtgtctgggagcctcacccaaccaccctgacggaaaacaggatctctgaatcccttctacctctacaactcggtaccacacattgtgcaactaagtaacttgcaagttatgtgaaactgttttcacaggatcagcagagttaccactgcttcgttgtcctgaatcttcattacatttttacagacaatatatttgcatgtgacatgattaaaaatctaccttgtgtttttatggtctttgtaggttttaaggtagtttcttatatgctgttttccttgctgtgcagccaacctgggtgttactggcagacatgctgagggcaggctctggatgtggagtcaaggtcaggctccctggctctgaatcctggctcaaccacctactgattgtgtaaccctgggcatgtccttaagcacccagggcctcagtttccttatctgtaggatgaggattaaaaatagaacttacctcca

SEQ ID NO: 127528 - DNA, 1550 bp, Homo sapiens
tttcttctctgttgtttctgtcactttcctctcccttctaccttatttttttcttcctttccttctccttcctctctttctggcattagcagtttgtttgtttgtttgtttttgtttattttgagaccgaatctcgctctgttgcccaggctggagtacagtagcccaatctcggctcactgcaacctccacctcccgggttcaagccattctcctgcctcagcctcccgagtagctgggattacagacgcccgccaccacacctagctaatttttgtatttttagtagagatggggtttcacgatgttggccaggctggtctcaaactcctgacctcaggtgatccgcccacctcggcctcccaaagtgctgggattacaggtgtgagcccccacacccggccctggcattagcagttcttacacaagaacagcgtaggcatgaatcctgccttcatggcacttacacactagcagaggaatctggcagcaaataagcacacaaaggcagctgcagggtatgatgtgccgtgacgtaaagggacaaacaccgtgagagtctaactaaagcctggcatgtgtcaatcctatgtacctattcagaaactagggttcatgacggtgcttctgttgttacctagtagaagtagctttgtaagcacaaagattgtagttttgtgaagctatctagtacagagtcactctggaagtttagcattatagagttttttcatagaaaggatggatagatacaagtttttcctaacaagcacaagtggcagtctttgaaaactaattttttatgtgtacattgtagcattggaagataactgtggttgagtgtgataaactgaaactttttaaaaaatctattattttttttacaagttaagttagagccagatatgctgattctctaccattttcaaaagaggaattggaaaagggagagcttgtttatgtggtattcacaatagtgtctgctcctgaagaaaatttttggaaaaatctcatgagtgtcctcagactaaaaacagggatccagtctgttgttcatgcaggactcaggaggcgagcgagcatgtgataccaggaagggtcccatccctgccctgctggggagccctcagtggcgaggtggcgagttcaggcttcacttcagagcatggatactgctgcataggtgctggaagggtgctgcatgggtgctggaagctgcttggcatagtgcatgtcctgtttcctgccacttggaaagaggactgtggaagtcaggtcttcccagtcctcaccagtaaagcaagcaacgaatgccttcagtccaggtaatatgtccaggctttaaattctctggatctgtctttggataccctgggaaaagtcttgtctcttcttaggcccttctgactaaaagcagccaggacttttaaactgactaatttttaaagatttccaaatagagaaaattaaagcaaaaatttttgaaagctgaaaatgatctttccaacttttctcattcagagtagaacactggagcattgaaagtttgt

SEQ ID NO: 127529 - DNA, 1034 bp, Homo sapiens
aggcaggccgtgcatgaggcctataggacccagggctgcctcccaatgctgacggccctgcgctgtgtgagcttgggtaagccagttcggctcacttcacctcaggttccttgttcctatgtggacgggttgcttgtttggaggattaataatgatggggaatgcaaagtgtggttggttttgctggggaaaagagcagggaagtagagacctaggcaggtgatgtcacctctctgatgaactccaaggtctctgtcaacaccggtgcctttgtcctgacattgcggggtttgtggcatgattggagagaccttgcgtgctctctgggcagcccttgttagtgccccccaactagctgggagatccagagtttcatgagaaccctccctccgtgacaaaatccgccttcctcgctgtcaggctcaggttgtcctgtgcccccactgagcctgctcattattgattaatgaacttgtaaaatgagaagtattgttttaccggaagctacatgtttatgtggttggtaaaaatgagaagagttgcttgagaactggttctcctttccatgagtatatacaaggttcaaatctgggctttgtggttataagacatgttgagtgaataaaaatgaaggaaatgctgggcatttatcacaatttttttttttttttttttttgagacagggtcttactctgtcacccaggctggagtacagtggcacgatctcggctcactgcagtctccacctcccaggttcaagtgattctcatgcctcagccttccgagtagccaggatcacaggcgtgggtcaccgcacccggctaatttttgtattttttgtagagacaagctttcgccatgttggtcaggctggtcgaactcctggcctcaagtgatccatccgccttggcctcccaaagtgctaggcttacaggcatgagctgctgcgcctggcctttcacaattcttaaactgttgacttacagaaacacagacctgtatgaacacacagatcactttagaggtccgtctc

SEQ ID NO: 127530 - DNA, 1045 bp, Homo sapiens
aaaggggttgagacctctgctggagccactaggcttcagccggacctggaaatgttctcgcaaatgaaactggaatgcatgatgtcctggattcagcgggtcacagctgactgccatcaggaggtgtgacggagaaggttccatttctgtgaccctgtggtgatacaggtcgggacccaggcgaagtagctcagccatctgaattggcacctttctgcttttctcgctgagtgacgggtgccttgcagttggcttcagatgtttgtgaatgtgctgtgtttcctaaagccatgtcagtcaggaagaagatgcaggtattcaggagaagggagaagaaaatctgaattagaaacaacgtgaggatggggagcacagggagggatgggttacctttgtcatcagaagaacgccaggcagattttagtccctcagctaataatactatttgaaaaattgatggagaaatttaactggaaggtttcagcaagacaaaagctgcatctccaaggctggactcagcgtgttcacgtgggaactgggtgtgagtgtaattgtcagaggggagggttgtcacaggaggtgcacgatgtgaagtcacaaggggacgcattatttccatgagttctcacagttcccagggcagccacagatggtagtggtttatgtctgcctctgccttgacagaagggcagtaggcagttgtggcaagaaaaatggaccaaatgagggctgcactcagcaggttaaatttgctgtctgttagtgttcctaggtgagatgcttcaaaactagaatgctctgctgggacttttatttcccttagaaataaaaggccaggcgcggtggctcatgcctataatcccagcactttgggaggccaagtcgggcagatcgcctgaggtcaggagttcgagaccagcctggccaacatggcaaaaccccatctactaaaaatacaaaaatttgctgggtatggtggtggtgggcgcctgtaatcccagctacttgggaggctgaggcaggagaatcacttaaacctgggaga

SEQ ID NO: 127531 - DNA, 1088 bp, Homo sapiens
ttcccactattccgaaatttgtatttataattatcctgatttttaaacaaacatatatttttatcacagtgtaatgagtaaatgtgtgttgctaaaggtattttgagacatataaaaatagtatcggactttgcatggtctttttggaacttgagattttcctccatatatttgcaaaattcatccatgttttcaggaatagctacagttccttcatattgccagaatattctagtgtgtgaatatatcataatttatccactatcttatttattgagggggggtgggaaacaaggagctctttttatagacatgttgagtctgagatctctattagaaatccattggaaatgagcaggcaggtggatgctgttattcaggagagatgactgagatggaactaacagcgtgtagatggcatctaaagcattgtcttcccaactattcttagaatgatgggccatttagcccatcaactgagatttctgtgttaacagttttttgttttttgttttttgttttttaatttcttaaaggtctatctggtgttttttgtttgtttgctttttcccaaatctgcctggtcactttgttcaagtgtgacttgtaagggagtaaacaaggagagtatgagcttcaaagaaaatggggggaagtattttgccagctctcatggagttttgtgagatccaaaagaaatgctatatgtaaatttgctttgtaaactgaaaaaagttatgcactcaattattatatttgatgatggcaccttgttgggttctggttaatgcctcatattcactgagtgcttactttatctatattaacacatctcatctttataacaatctgtgagaagtaggtactgtagattcatattttacagaggaaagtacagcttataaatggtagacccaggatttgaattcatagagtctgcttctagaaggtgtgttcttagctccagtgctatgctgtcatattgatttcctgcctgccttctccttccttccttctcccctccctccctcccttccttcctttccttcttttttttttttttttttttttttttttttttttttttg

SEQ ID NO: 127532 - DNA, 3938 bp, Homo sapiens
atgtagggtttcttaaatgcagtttgagagagcaagataggaaccagtactttcaaaatatggcaagtgcaagtcacaatccctagtaagatattccttctcattttgtgcctttgactcttatttagacagacgtttaagtacgagaaagctaatggcgcagattctgctgactgtgtggctctcgtcttaatgcgttttccaaccttgaacctgagaatgccagaggattgagtctctggacgttcatctgagcagatatctgctggccgcctggttcctgagctaacaagtgggtgtcccgggcttgtgtgtgtagtcacaacagtggaggtgccacgtggcacccagaggtcgactggggctaccgcggggcttcccgatcctcacaagtgtgtcttcagtgtctgacatgaactgggaacttggggcatctttagaagcacagacatttggagttccacggcaaacctggatgtaagcactcacacagcttttaaagtgaaagcagggaccttgaggaaggaatcgccgtcatctcattgccgacctgcttactgtgctgggaaacaaagtaagttctgtttgtttctttgttagtctctcctgcgtgttttttcttgctaatgttattagacactcaatatccggcaaatgccaagttttttccccttcattgggaagtaggatatagtttattcaatagctgattgcttcttttatcttttccctcttcccatatctagtgtgccggcttgctgtttagagataggaagagattgaaatttattatcaaggagaaaacaaaaagtgttttgttttgtttctaaatggtccaagaactttgccattaggtaaatgactatgacacagacaaggcgttttgcatggtatgaccaggagcacctctagcaaaacagccccagttcgccgccctgatttccatttggaagcaggcacagtgggtttccccaggaccgatgttaacgcagagggtccttgtgcaggaattgtgcagaaactaggtgggaaggtgtcacagacaagaggctgcaatttaaaaacgcatcaggaaatggaaaagagctgcgagaatatcaattatttaatgatgttgataaaaacaaatttaatataaaaatgagatacaatgtatagagacctaaccctgtcaacagcaactaaactttactttcatgttagaaagttttgtgccatgtagatttatggaaaatgtgcttaattgcctctagaaaataatgaagaggcttcgtcacctccatagaagatcctgtgacactagcctaattctgacacatggctcctgttttccattttgtttgtttttttatgctgatcctctctccagagatgtgatgtggattgattaacttgtaatataaagttctatggtttctgaaaatgcagagcaaatagagatgaagagtggtttgtgatttgttattaaatgatcttcccttctacatttaggactgatttttactgtagaattttttttttttttttttttttttttttttgtcaacttgaacagcaataccttgaaggtaaaaggtgggagcacgactggagtgtggaactggaaagcagaaaccaggggtgttacttctatgtctagtatggaatgttgtgaatttaagttagagcttctgtgtcctgggaattcatattttatctcaaagtggtgctgataggactggaggtagctgtatttcatttgaaacattccagcctctttataggaatatctgtgaatttttaattcagcaaacatctttaagtgtgtcatttatgtatagcgttgtagtcagagctgtaattgtttcaccattaaatttacggaaattcagtttgtaagtgaaaaattaagaacagtttgaaagaagggcgaatgagcagagcattgccatctaaacagtcttgttaaagatagtgccaagtgagcaggactgtcccttctaagctgcccctcctaattaaagggaaaggtggctgccatctgtcttctttcattcaaggcagtagggggtctagggtggaaggaagcaacccccactttatttttctcccactcttttttatagtcagctttctccctagtcagtgacccagaaggtcattgatgatctgtctatctcagaatgaatagtagcataagcacgcttggcacttgcaaaaaaaagaaagtttataacatgcactgatccatttaaagttctgcttgaattatgtctgagagtattgtaatctctgtattggtgtctctgccctgtttgttaccaagggcactactggcaggaaaagtggggagttttacttttattgattttgctttttcatgaaaaaatgtttacactccactgggcataatcagaagatggcagcacatggctatgtacaggagatgtggggatgtacaggaatattgttcttatcaaaatcaaggacacctattaatgatgatacatatatgtcatctcaggggaaagcatgaacaagcatggcaacagatgtccaagttactcagtggcctgctgcagctttttggaccagttattgaaataattcacattgtttagcttttgttaagcaataaggcttttagcctttttcttgtaagaatacgttgcaggagagtttagtttggggtcatgtcttcattgctttggaaatgtagaatagtcctccaacaaaatgactgcatttgcttgccttcgtttccacctctgtaaatagaagaaatatctgctgtttttataaatatataagagaatatgaaatattttccatctttcataagaactgtgttataactgaaaaattctcaaatcttcagttatgtttattttcaatttttacacacttaagcaaggtgttaacagtcttctaaagagattcagttgttacaagccttgtttagttcccaagtagcaggtatggacttctcagaacatactggtttttagaactctctttgtgacacagaagtgtggtatttcttaaacccataacaatatatttggagagctcaaatgtgaaagtcatgtctgtaattttatttagagcttttttttttttttttttttccaaatttgtcaccaacttgcaacgagctttcttggaaacatagacgtgtttatgttgttgagtcttgagatgaacatgtgtgggcttctgacgacactgatgcccagtttgtatgattggatgatacctgaaaagtgggtcacttcctagtcagtgaagggtacacagggctgaataggcagggctttttggctttttccgtgcttttgtttttgtttttggtgtgtgtgtgtactaattttagatactcagctaggtacttgactggctatcctttttagcatgtgatttaatttggttttacccatcagtatttatttcaaggggactaaataaacacattaaatgaagcacttaagaactttctatcttcttttgactatccacagcggtgggaaatctctgtcctttgagggtaggagggagccaatagttaggtctcatgaatatggtaggtgatcaaaccactgattcaagtcattgtttcatgttataaacatggactgagccagctactacatttcagtagaaggtactgtagattcaaaagtgaacatgggtctggcatttcagaaagacacaggttagtgagataaatgactataaaaagaggtagcactgtagactgatgtcctgtaacagaggtacacgtgtgctgttagagccaagagggggtcaaaataaaaagacagggcacggtggctcatacctgtgatcccagcactttaggaggctgaggtgggaggatcacttgaggccaggagttcaagaccagcctgggcaacatagatccccatctctacaaaaaaataaaataaaataaaaaaata

SEQ ID NO: 127533 - DNA, 1020 bp, Homo sapiens
tttctgtgtcattattaacccttaaatatcagagtgagtgtctgctcacctatttgtatttggaaacgagatactgttaggggtttttcttggcccttccctttcagattgaatcagactttgctgctttccttatacaaaataatgtaccaactagatagacggtgggagtggtatcgttgcaggaatgaaaccaaaagggttccgatgattgagagagattcatttattttttaactcttctcatgatctgaatgaagagtacagcatctatcaaaaggtaacaacctaatatttcagaattgcaagtggccatttagcctttctgctgcctgatataaatgaaagtaattcctagcaggcaggatgacacttgttttatcacgaatctgacaatccagcacattttctcaagcaattttgaagttgtcgtagtaacagcatggcatttggagggtctttttagtagttctttagctagagttaattaattgtattaactctggatgtttttctttttactcctctttgacaaacaagggctataattgctcaaatatgtattttgtgttctatattttttggtgactatagtttaaggacgtgatgtttttaagtggtttcagtaaaaggttatcagttgatttcagacacattaaacttgggtttttaatttctctgtaaaattccactatcattgtaggaccaggatttagttttatttaagaagtgaatctggggagatatttgcacaaattgaattgtggcttgcttccagtggttgcaactatccgttgctttgattttggtgtatttagaaaaagaactggggaatgcagaaagggaaatgtgtcaggcttacaggagaaaattgtttctttagaaatgcaacaggcaggcacaccaccaaaagcatgttccataaaagaaaacaaataaatttgattttgtgaaacttaagaatgcagtgctctttgaaactctaaaatatacttaaataaattctcccctaggaagatt

SEQ ID NO: 127534 - DNA, 2319 bp, Homo sapiens
ggcctttttttgcttacctttcaattctgtttgctgttttttgacatataggggttttaaattttgttgcagttggattacattgccttttgttacttttttcattgcttctataaagctaaatcttcttttcccattccaaattcagaaataattttctactaatttagttttcttccttttttttttccttttatatttagctctttaatctccacagaattaattctggtgaatcttatgaagtaggagttaattttactttttctagaatattatctggttcttgtgtttattcagaatcccagtatagctgtgacatgaaccaaaacaagtgatttttcttattttagtgctttgattttcccattaggaaaaatgaggaagctgtgagtaccagtggaaggaacgagccaggaagagggactggaaccatctcagaagccatgcccctcaggctggaacttgccctgtctcctcgcagatgaggtaggaggctcagcacgggctggtgggagcagcccacagcagcagtgagggtcagtgggcctgtgagttaagaagaaggtggcacagagcgagggtctctggatcctgactgtttgacttttccatgattaggataagtagccagggcttggctagttggagagttactcgaacctcaggtgacagttgtaaggcagcacatagtgaaaaagagtcctagcctgggaaagtccaaaaccttaggtctggtttcagttcactcacctatctctgtgacatagcaaagtctgttaatttctctaattttctgattagtagtatagttgcaggaatgaaataaaaatggtcctgattactcagagattcatttactgattactctttttgtgacctgaataaagagtacaacatctctcaaaaggtaacaatatgatgtttcaggaaattagagaagttaagagactttgctgtatttactatacagatagttgactgacagctgagcccggacccaagattcatttataaaatgaaggagttgagaagtacatactctgaggtttatcctaaataaactgaagtctaggcaagtggctgagctaggtttgccatgaatcaatctgctgagtatatttcttggtaactagttcatctttccttaattcagtcaacaaatatgatatcaagtttagtaagatgatgacagttgtcatgtaatactccatctggaagattgtatgcttctcagcttccctaacttttcttaatctaccttaagcttcctttctgaaaggtttctgtctttcctaacagtctcttctttccgccagctacctcttgtgtttaagaattaaaggaagatgagctaggaatcaagaaatacgcagaactgattcctgtcactggcgccaccctgccacttgcccagagctgtggtataaatttttttaataggctgaaataaaaatatgaatagcattttggtattaagcattaaattgataaaggctatgagatacacctgctctcaaccatgttaattttttattattggtattaataaattattacttactaacatattaacaagaattgcattgagaaacaaagcatccacaggccaaatcttctgaatttcaaatgtttatattaatgcgttgtattctagaaaagtagaattgtcttaagtagctttgtaatataaagtcatctatcagcccattacacctattagaatgttttaacctttatttcccacttttttgtttctagactgagtgtacttggtctggtatttgtggcataacttacggaacacataagaatgatacagatactatttaatgatgacctaatacaagcttagatagctaaggtgaaagcttctatggccttaacattttcctcttgaagaatgtattttctgtaataaaatacagtggctacttgaaatctataaacttatgtgaggtctggataaatctgagcaactttcttctttgtgctccaggaacctacgcactatatatataaataaagcttaagtaaacatcactgcaatctgtgttttgtttgattatattacgtattgcctgatctttaaataatgatgaaaaatagcctttaacataaaccatgaatggatatgcacttgagggaaacagtttcttggataattaaactttaatttctcaccgtggattccttggatcttgtaatattttttaaaacagtcctggggatttatttttaaggcgtccaaatgaattattagttctcaaaagccatagtatattcatgggtcgatatatcctcaaaacactattttta

SEQ ID NO: 127535 - DNA, 2861 bp, Homo sapiens
atccttctccttccctgctttaattcttacccatttgttaaatgtcctgtacccagattgatgggggcctctgcagagcacgtgttccagcctgtgcataaccaggtcatcacagcactaacaagttcatggggagttggagaagagagttgtttcccactccacagaactttatgaaaatcccaaatgtaaatcaaccactcctgccccagagctcttggtcatgggctttgtatcccttccatccttcctcagcctctcccatctgtagtaaccctaccctatttctccctctttacttattcagagcatcacagttctttcctgaatgttctgatccttaagtttcattcctgtcttgtctttgtttgggtttccctagaagcagattttgaaaaaacatgcaatctggtctgacttcactacttaggagctgtgagacctctctgtgcctcaatttcctcatcagtaagattctactttataggattgtaaggaagattaaattatgcatagaaagttttaaagccctatctgacctataatggtggtcaataaagcttgctgtgataacagtgattactattattattaaaaatatcactaccttcgggttgccatcctcaaccaatctagctagaacagattagagccccctcttatgtgtactaatagcattgtatgcctcctttacattgtaattgccagtttgctacaggaaggatgatgaaatattgttcatcatctagcacctagcccagtgcctggcagagttatacaagatgtactcaagtattttttgaacaaaattaatgaataaaatgacttgtagaaagagccttccaattacacttgctttcttacctttaaatagccacctctttaaaaaaaataaaacacggccaagcatggtggctcatgcctgtaatcccagcagtttggaaggccaaggtgggcggatcacctgaagtcaggagttcgagaccagcctggctaacatggtgaaaccctgtctctactaaaaatacaaaaattagctgggcatggtggcgtgtgcctgtaatcccagctactcaggaggctgaggcaggagaattgcttgaaccgaggggacagaggttgcagtgagccgagattgcaccattgcactccagcctggtcaataagagcgaaactccatctcaaaattaataaatatattaaataaaacacaacaaacaaaatagaactcttctccaggggcttgtctttaaatctggcattgctcagtgaccttggggaagcctctttagacatctgagtcctggaacagttctatctgagagcttctgtccagctctagaattctttaaatctgtggtaatagcacaaaatgggtatcgagtacattttaaggacactcagagtttcccttatgcttatgttttttcctgttgatgagaaaatgtcatcatgttgcttggatttgtaggttctttcctagttgtggggaatttttccaagctggctattatgagagggtctcaaaaaaaaaccacaaagaagtttggtatattatgttcaaattacacacagtatcccttcttattttcacttttgatctggattttcacttctgagctgacttctataatttatatttaaagaatttagtctcagaaataaggtcatttgatgcttgcatcattgacactcctaaacctttcttgcattccaaatcggaaacttattcaggacttctaattctgatggtttctttctttctttcatatatttatagatgaaatatatatatatatatatacacagataagactatatctatatgtaaatacagatacttaaaatatatatgtatatattttaatcgtggtaaaatatgtaacagaaaaattaccatcttaaccatgtttaagtacacaggtcattggcattaaatacattcatgttgttgtgcacccatcaccatcatccatctctggaatcttttcattttgcaaaacagaaactctgtcctcattaaacaacaactccccattccctcctccccccagctcccctgaaaaccatcattgtactttctgtttctttgaatttgactattctaggtacctcaaataagtgaaaccctacagtatttgtccttttgtgactggcttatttcacttagcacaatgtcctcaaggttcgtctaatgttgtaggattacaacaacattgtagcattgacatgatttctttgctttttaaggctgaataatattccgccatgtagatatgccacattttatatatccatgtgatggacacgggttgatggacacaggttgctctcatgttttggctgttgtgaataatgctgttagggacgtgggtgtacaaatacctgttttagttcctgctttcagttcctttggatcaaataagttattgatccttctctattgacgcttctgttttcatggactcttgccttactcttttgatcatttactgttcctccccccatcgacctttgggccatttttctggtaatgtccctactatcaaggttctcatacttcagttggacctcacagaactgctgcctggagaaaacagtttgacagctaaaaaaaaaaatatgattcattatcacctcctacacacacaccaattcctactgttttctgaaggtataccagtggttcctaaattaaaaaaaatctcttggtcatagggcaaatttttgtagctatcgatactctgtattttgaaatttaactgttgataatagtagcttcttgatgtattagtcctctaattgtgaaactgttatctgtttcttattatgaaaacaatatatgacaatcacagaaaatt

SEQ ID NO: 127536 - DNA, 1098 bp, Homo sapiens
ctaaaaatacaaaagttagctgcacgtggtggtgcacacctgtaatcccagctacttgggagactgagaaaggaaaattgcttgaacctgggaggcagaggttgcagtgagctgagatcacgctactgcactccagcctgggcgacagaatgagactgtgtctcaggaaaaaaaaaagaaaagaaaaaaaggaaaaaagaagtacaagtgtgaggttaagttactcaagcatgtgcacacatagtgttccctattgttatttgaggcttgcatttttaatttcatagagctttttcttgtagttcttttttgttgttgttgttgttgttatgttgatgtaattctcaaatatttccaggaatactaataaattgggggtttttttttagtttttttagaaaaaaatctttttcttaaatattctgtttcttttttgttattgttgtttatcttggtttttctctttcatgttgcagacttttaaaatatatatttgattttctttttaaaaatgaagtgccattacggctgcctagaagttctgcatgacagcatctgcctctagcaggcttcagcctgggtacacagagccaccctgagccctcttgctggggaactgctagatgtcagaatgaggagggcttgactgtggggttctcttaaccacactagctatttagtcttcaccagacgtttgtttaattttttttagaaaattatctcccttttcttatttttgctctgaagtggggaagctataaggtttttttttataaagacaggaagtagtcatgaaaagaataattgttatttccagacttttcaattactcttctcctttctacctttcttgtcacttctgtcacagttcttacttttcctgagtctggagcctgtttggggtccatctgaataaaatcaactcttcactgccttggcagtacccgctcagaactctccgggctgtaagctgcctctgctcagcttcatcgctcagtgctctccccacatccttctggcttcctgacatttggtgaaatctctcaggcccctgaaacttgttgttgttgtgggtctacataccccttttataaccgt

SEQ ID NO: 127537 - DNA, 1876 bp, Homo sapiens
ccctggagttagaagccacaagttgtcctgaggaggctttgctgttcttgtcactcctgacttcagcaggaatcaaggacaaaataattgaatgataaaggaagatggaagcagctataatcagctgttcagttccagtaacaggaaaagtagtcctcaaactttagaggacataagaatgacctaggatgccagttaaaattcattttcctgggctcctccccagagattctgagtccaaacttaggtaattcttagtttttaatgttttggttgatcactagtatagcacaaagattaatatatttttaagagtttttaccactctttggtaaagtttgctaccctcagggagccccaaaattacggcttagaattcttggcttaaaaaatgagccaaaccatccccatacctatgtatgactctcgggcagtcatgtaacacgaacaagctttggcagtggtgtgagacttatttgtaaattgccagtgtcaacataattcttttctcattggcattgcctagttaaggagtcaagtctcactgtggtttgttctctctgtggtttccgtagggttggggagaaggctacagaaaaacgaaccctttctagttttgactgtctagggagtaaaaaaaaaaaagcctgtcatctttctgaattaggatataagacgcctgccctgaaggtggcaaatcagacttccacacgcattgccttcatttagccaatagcccgctctgaatgtgtatattacgatgtgcagtttcattcatcaaggggatttcgggctccagcagcacgcagcctccagtcttgagtgactcctgggctttggctcagcagtaactcctccataaaaacaagtgtgtgcatctggctgttagaagaattcatgctcatccgggtaaggataaactggagaaattattcctttttttccctttgggtggttttgaggttttagaaaaattgatcctctctttgagaagagttcagaactatttgtctgaagtttttccatccaaactgctttatcgtattatccactgtcttacccttttcctgtgaaatctaccctcttcaaaacatagtttcattttcaaattttaaaagataagattccatttttctttccgtgcatgaaactttaaaaattaaatcaccacagttgctactggcttagaagtggggtcttatatttttaggaagtatactttaaaagttaggcagaggggaaatctatgtttgcatttgatttatgaaacagtgactgttacattaaagggcggattttcagacatactacttgatctgctctgacaagctatgagctctctctctctgccacttttctcccgaactgtgttctaatggtggaatcagctcatcttttttccttaggcatgtggtttagtctgtgtacattcagcgcggtggcatttttcttgaagaagtgactaaggcttcttggatgaattctgtctttgaaagaggtagtagaattgcatcagaaaggcatttacagtaaatggctacccccccttcctgtaatgaccgcatgtgaaagaatgcattaattcttgttttgaggaaatgagagttgtagagttctatgaaaaactcccttttttatcattagttagccaggtttgaatgttcacattttaaaaatcaggctcattttgtgctatctaaataaaagtcacaaagatacagctttccactccatgttctatgtggagtaaccaatcatcctgaactcaaaaagaggaaattatgttgaatatggctacagttaatggcataagcctaaactaaattaatttcttcatagtctttttttatattaagttactgtgcttcctagctat

SEQ ID NO: 127538 - DNA, 1139 bp, Homo sapiens
acaggagtcttctctgaaatttctgagaggccacacaatcttaggttgaataaagaaggaataagaataggaaatacggggccgggtgtggtggctcatgcctgtaatccaaacactttgggaggtcgaggcaggtggaacacctgaagtcaggagttgaagaccagcccagccaacatggtgaaaccccatctctactaaaaatacaaaattagccaggtgtggtgatgggctcctgtaatcccagctatttgggaggctgaggcaggagaattgcttgaacctgggaggtggaggttgcagtgagccgagatcgcgccactgcactccagcctgggcaacagagtgagactccgtctccaaaaaaaaaaaaagaaaaaaaaaggaaatacggaaagatgatgatttgttttaaatacatttccaacagtatttctctgtttccttttttagaaatcctttctgttcatagggcagttggggtagaaatggacacacttagccagcacggcttcttccgtggaggatgcaccatgtgtccctgctgtgagatgtagacacctgagtttgtgtgttcagatactttcgaagaagtttttttggtgagacttctttggcaaagaaagctgcatataaagttgttgatgcagtgtctggaacatagtaatgatcgatgcaggaggaagataagggggaaggtccctggagagtctcccaccagcctgtgcactgggaggaggggatggagcctcaggaagttctcaccctttgcagctaggagcctggcctctcctgttcctgggtggtgagttgggattcaatctgtgagatgggggcctgttcataaaaactcatcttgctttgctgagagtctttttcctttttgcccaatagattccataacccctcacccttcaaagggtctgtgtgcgtaacttttcctggtcatgtgacaagaacccagttttttctacaatagtaaggaatcagtgagcattagtattctttctctttttcttcctcttctctttggcagtatatttttcgctttccagctgtagcatctgttagtgtaatattcatatttgccctcaagtactgcattttccaggtttctgcagcttggacttttctgtctt

SEQ ID NO: 127539 - DNA, 1037 bp, Homo sapiens
tgcattagggtatcaaagtggaaaagaggctatctgtagcatagactatggactatacttgagcagcaggagaaatgaggacagacagcaaagcacaagcagtaatgtttccttcatgtgttttttcccttcttttctctccagtgtgagtcttaatctccattatggatgattgtggcattaactattaagggtacgatacagttgggattaggattctggacccagacttcctaggttcagatactggctctgcctcttaggcaactgacttaatttcttagattctttatctggaaaacagggataatattagtatctacctccatgggattattaaggggataaaatgcgttaatgatgtaaaaaatacttaaaatactaccagcacataacaagcactcaatatatgttaactattattatatgactgtatttcatggatttttttttttattttctcaaattttatcctctccccataaccccttgtggggagagtagggaccacactgggtgaatgagtgaataatgacttgcatgatatctttagaattgttgatgattaatgtaaatgcatcttgatttgtgggttggtttccaagttaaggacatagaagcatagcactgattaaaattaaattcacacaagatccactcacctaatttcaaacgtgatttttaatattctttttcttttttttttttttttttgagacggagtctcgctctgtcgcccaggctggagtgcagtggtgcgatctcggcttactgcaagctccgcctcccgggttcacgccattctcctgcctcagcatcccgagtagctgggactacaggcgcctgccaccaagcccggctatttttttgtatttttagtagagacagggtttcaccgtgttagccaggatggtctcaatctcctgacctcatgatccgcccacctcagcctcccaaagtgctgggattacgggcatgagccactgcgcccggcctttaatcttcttttctagtagtccatttttcctggaactcac

SEQ ID NO: 127540 - DNA, 1025 bp, Homo sapiens
cagacactactctcttctgatgatcttaaaaatgaatcctcttggtcccaggtgcagctaatgaaacagggtaaatggggcagggaaaatgcacatcatcacccaaaaaagtcccagcatgttaataccacttgcaaaatgtgtcatattaattaagtgcagacattactactcttttatccaaaagctgtatatttcttagaagctgatagactagataggtacatacttgaatcatccttttatttttttttaaactacagagaatctgtccaagcccatgtcaaaagtattggttttaaacacaaagaatacttggtagaaataaacggtttaatctgtttattgaaagaaattacctaaatatacctaaaaataacttacagttttacagtgatgaatagtaaaatcatatttcctgcttcttgaatgatattgacactggcgtgtagacagtattattcaatgagaaattttattttcatagcactctactttagctctattttccaaaggaatattaaactttcattgtcttcattttagtaagttatttggagaatgtatatacaagcaaattatggtaaagccttgtcacagtctacttactcctcagattttgtcttttttttttttttttttttttttttgacacggagtcttgctgtcacctgggctggagtgcagtggcacgatctcggctcactgcaacctctgcctcccgggttcaagtgattctcctgcctcagcctcctgagtagctgggattacaggcatgcgccaccacgcctggctaatttttgcatttttagtagagacggggttttaccatgttggccagactggtctcaaactcctaatctcacgtgatccacccaccccggcctcccagagtgctgggattacaggcgtgagccactgcacctggccagattttgtcctgattatctgcatatttcattgtgtttttaaataataccaaattattctaataatttaattctccacatcacaatgtgctgtcc

SEQ ID NO: 127541 - DNA, 1086 bp, Homo sapiens
ttttataagctacactaaaacttgggttagcaatgggtatttttccccccatttcgttcttggttgatcaagtcaaagtattatctcagcataggcagagtccggtgcttgggaagtggtattaaagagatttcagataaatacttcaaagccacttcattggaatccccaatttaaaaaaagttaagaaatcataaaatgagtctttaactagattttggtggttgtcatttggaagaaattctaagagtgaattccagcctgtttcctgatttcctgttgtccttatttactcctagtacatggtacatgactggaatccagtagaaaagccccagaatgtgtattttagtccctacagccaacagctttgagaatgtacagaaaaggaggctaaatccttgcccctgctgtggcttcaattcataagcttttgtctcttctctgttccatttcaaaagctaaagctaagtgtcacaggacaagattgtagtggcttcagagaatggtaggcttgagaaaaagactattgatgattcaaggggataaattatggtagaaatttaaacagtatttggggacataaaatactgtttttgagttgagtaaccccaaacaagaagaaaaacatgtatttaaaaaaatattttatatttttcccatttttttctggccatttttctttattcattttctgagagggaaatggaagcgaaaatagaaactattatttcttttttcaagacaaccaggtcgatcatgaaaagtgtaagaggtcaccatcaggtagctaagcacttcttttaaacctatgaataaaggaaaaaacacaagatgttaaatagtaagtgtgtatggttgctagttttgaacttcagtgcttaacaatgtcaaagtcaaagtgttcctgtgttgctgtgaaataagtaccaatacatgcagagtagctactattgttgccacatgcaaagaaaagacagcacactcagtaaattcttttagttgtgtttcttatagttaaggaatgttgatctattttatgtttttgtggtgtaacttaacatggcaaagaaaacaatcatgtta

SEQ ID NO: 127542 - DNA, 1045 bp, Homo sapiens
gatgctgtatgtcctgctatccgcctcgtccccagccttgctgtctctcctgccagctccccttcagcccctcagcatccctttattcagggtgggaaaagatgccagagatggggctgagagttgcatctggtagttagacttttctctcatggagtttatgttgcatcttcctcggccctgacttctgcttcataatttacatagtttattttaaatatgatgatgtatgttttaccatgtcttccttcggggattttgggatattacctttgacagttatgtttctgttttggaggtcttgcagctggcattattagcttgagggagaggtggggcactgggggtgcactgaatatctccatggctttcagacctttttattagaacccccaggaggaaatacctgttaccttagggcccagcacacatatttgtacatgtgggtatgtggtttcctgaagcttactttatgcaagctgggatagagttttttaattctatcactttttcttttccctttttctctctttttattgttcatcataaccagcaaagtggatttcttaacctgctagtcagtcggttgtcctttgacaagcttgcagtatttcagtgctatggtagggacgcatggtttcttgcccttctccctgtattcttcagtaacttctacagcatttttttacccctaaaaatgcctcaaacctgccttaactttattctttatgggccgagctctctccttccttttgtaataagcttctgtttctattttctcacctactgttcccttctcaactttctgtctgaacttgaacattcttctcctcctgatcaatacctaagaatgcttttgtttaccgtttcgaataagatcaatccttctgtgctgttagatacctggttatctcttggttggtgccatgggttgtagagagacatctgctggcccaagtgtagtgttgcattgtttttctgtgctgaatcaccttgtcattttttagtaccttaaactttcatagtgtgcaagtgagcttgtata

SEQ ID NO: 127543 - DNA, 1561 bp, Homo sapiens
aaacaaacaaacaaagggtttactctggacacattgtgcataatgaattggaagggagaaagtgtggaggctgggaaaacagcaagaagtgttttgtatttgtccaggagaaagaacaatggcagcttggactaggatggtggtggagaaggtaggataatgcttggctagagagatcgttttggaggccattggcatctaggtggtgactgctccgatatgctcactgagcaatctgccgtgaatttggcctaatctttgcctgcctgtgaggtgcctatgccttggatttactggcttccaaactggacggagcaagtgtccaggatatctgacaattacatttttcactataagtcaatactttgccattttggctttatcagtctcttgtgagctttgttagcatgaatcagtattaatcaacatgatcatctctggcaccttagtgagagagacttttggagccagagatttcagggacagaacctagacactcatgagttcccaaaggtaaatgtcacctgccagagatgatgaacaattaccttttctgggaaataacctcttttttttaacaaatgctttccattatcattttttaaaaattttcagtaaatctttaaaatcaaatccaccaattgtttctatctttagaacagcaattatttcacctagtgaggaaacatactgcccacctgaaaaagaactgcagagggagtgtggtttgaaaagtcgtatcaaatgtagaaggattcaaagtccaagagaatcttactctgtttccctgtgcatctaactttttattgtgtcaccttaatttcttttgaagccacaagttatttgtttttcaaatctcttattatctgtgtatgtagtaattatgtcttcttaagattctatttaggaactcagtaaaattaggcaggtgaaataattggctaaagttcagtgaagcccttttggcactctgagtttggaaaatagcaaataataatgtaaaacattttgtgtgcatttgtacctactcactaacgatattctcctcctattttgcaggaggaaaatggaagaaacggagatacttttagtgaagcagaataaaccactgaacaggtaactgagattagtagttctatatacatttattaaataagttaatatttgtaaaggcctagaatagtacatagcacatagtaaatagtatgtaggtgtttgctgttataaagttcttttaaatatacgtaagccccaaataaaccaattatacaaaccaaaaatacccaacaaaagcaaactctcctcctaaggcaagtgcgaacatcattggtaagttctgacgtggcctctgtatagtctgttgtcctggctctgagaaacgtaacttaaaacctctttgaaacgtcttaatctttgagcaccctaagtccttgagcacccattcatttttgtctttgaccttctaagtgtcagattggtttccagtttgaaaccaaacaaacttctttgaaattcttgaagacgtagttccaggggagcatagcatagcttccaggtggct

SEQ ID NO: 127544 - DNA, 1470 bp, Homo sapiens
gtcatgtcttgaagtaggttgttgccttgggtgttagagtgtgagaaaatgaacaaatggtaaaataaaacttcccagccatctcggtggctcatgcctgtaatcccagcactttgggaggccaaggcgggtggatcacctgaggttgggagttcaagaccagcctgagcaacatggagaaaccccatctctactaaaaacacaaaattagccgggcgtggtggagaatcacttgaacccaggagttggaggttgcagtgagccgagattacaccactacactccagtctgggcaacaagagtgaaactccgtctaaaatcaatcaatcaatcaatcttcccttattggtactaattagtaattaaggtaaagtcttgtctgaattagggaaagtttggagactcacttcactttctgatattcagcgttctaacataaaggcttataaagtgttgctgggtagttttgccagtagaggcccctgtgcttgttttaatgatacagagttattccaaactgcagtgaaatgctgtggacacattttctgcaggcgtctcagtaactttgaaagatggtttttagtataaaaacttagactttatttacactgctaaatactgacatatatatgagtaaaagcaaaatattgggactgtttctaaacagctaaataacaataaatggattgttaaacatacataaaataaccttaatgaaggccacagtaattcatgtctgtgtagaataagttcattgaaatcaacattcctctcagtatcagagttccttctacagtatgcatagcagatgataatttaggcatcatcatctctctctttacccacctcccctcttcttccttcctcccatcatccagtgcatgctgtatccaggtcactatggtcagcactgaggatacacagggaaatagcatgtggtcctgccctcagagacctgacagtctagatatttacagcagagggagatggtgcaggggagaagtacgctgagcgggcgagaagcaggctagccactctgcttggaggagagagagcacaagattcacagaggaggttgggttttcaagtttgcagggatggcccagaaatgaaaagcgttgtaggcacagaccatgtgatgcttgcagtcgtgaagctgtctggggagtggcatccggcttggcatgtttacagtgtacagtactggagaggaacagggtggcaggtggagactatctcaggaatgatgggagctccttactttgcaaaaagaaaagttctgtgtcccgagaagtgtattttgttagaaggtatgtgtgtatcacgcgacacgggccacttcttactgccactttaaaacctgtcagatgacgtggggcacagtagctcacgcctgtaatcccagcacttggggaggccagggcgggcggatcacctcaggtcagcagttcgaaaccagcctggtcaacg

SEQ ID NO: 127545 - DNA, 1918 bp, Homo sapiens
agtgagattctagaagccacactgatgctctggctattgattgtcagtgaaattttaagacagagttaaataaactctgtgaatatggtattagattagtggtttcttttctttctttctttctttctttctttctttcttttttttttttttgcctaagtttagattcttacctttgtacctattacaaggaaattactgaggaaaatggtccaggaacacgtgtatgaaaacatcttctccaggtgtcttacagtcattctacagactgatgtttgaggaacattaagagaagttttcaaacttttgggaagcagtgaatcctttcattaactgaaatcttacatgaaactctaccatgtaaaacagataaagtgctatcttactaggataaactctttgaagtttacgttcatgaagtttatttactgccgtgtcagtaagaacaatgaggctgttacgaagacagaaaacattttaagtcaggtgttgttaacttatcatggctatattcacatcatcttctttctttaataaaattgtatactttgctttaaatgcaggatatttttaaagtctgtttttatagaaaattgtttgcaaactataacagagtttttggtttggtttaaataccttgccttaggatcccaggatacattttagttcagctcgtggaaggtagggagtatttgtttcaaagctgtaagagaaaccctgtaactgaacttaggaaacagttgctcacattccttatcataaatctagtcatacaggaaacatctaattcttagaataaatatttactctctctcaagtgggatattatcacaaaggactttatggtgccatgaaagcaaggccgtacagatggccctgagccttgcctggcatttaatcgaagcccacgctagggtgtggttttgtattcatgtgcttgcttgaacaactttaggagagcagacgctgcaggcaggtatttctcacagggccgagctggggctacagcttccctcaccaatgtcacacttaggagaagttcacatgtgagcaagcacagagcgggcagagcagcctcctgtgagggctgcgaggttgcccggcctggccgggtttattggcacacatctcattcatgggcagagatctgcagtgcgtgaaaagtttgcatataaaccatttcaggttgttttcttaaattaaagcttaaaaaatatccaaaacatatttgaacatcagaaacagatgtttgtggtatccttggagcacttccacaggagtcttttaaaaaacagcctgatttttactagatgcttggtttacattgggaagaatgtgtggttccctgtggaatacagggaagaagttagggacaagttggtagtgcacatgagaaaaataactacagttcagaaaatgaattgtgtacaagaagaaagaacaaagtacctttgagtacaaactggggagtgacctcttctggccagaaagccagggaacatttcctggaaaagaaggcatttggggaggactttgagtacacagaggacttggataggagactgttgggagaaaaggtgatgtcctagggcacgttacctattgggagagtataattttagggggaaattacatagacatcacttccttcttaagccatttattaccttcttcattaggtatattagctctgctgcatatgcattttaaaatataatctttaaaaagaccattctctacatatacaacttaaacatgcctgaggtctctttcagctgttactatctggcggagatttacttgttcacatttagacttttaatgtgataattttgcctaacttggctgcccctgtgatacctacgtgtgtcataggtttgccctaaacctagcatctgcaggaatgacagccattcat

SEQ ID NO: 127546 - DNA, 1989 bp, Homo sapiens
cctctcctagcaactcacatgccctcttagcactgtaaaagtctaggatgttgagaaatttgtttaactttatttaacccagtttctgaaactgacttaaacatggaaatcaaatctttttttttttaatgtgatgacccgtggaactactacgtgcattttctgacaagcagttaacagtgctctcggaaatagttgtgtgagtaggttgagttcctgagaagacgctagatttgaatctgagagtctgggacttttcttgctgtcctacttgcttttatttgccaatctatattgtctacacttgagtgtgcttgctcatacgtatttcacagaagcaaaactttgatacttgagaggccctttgaggtcatctagttctgccttctcatttgctggttgaagaaactaaggaaggttaagtcacttgccagaggccagtaagtgagtatgctggagccattcagtgtgccattagtcaatctgaagtggaaattacttgagttagttccttactttcaagactttcatactgatatcttgagattaggatgggataagaatgaaagcattgctgttggatttcctgccaaggtttgggatgggtaaaatgagcaaaagaaagtgccctgggtatagatggtgcttaataataggactgctgcagaggaaagcaagaatccagatcaagactgccccccaaaattaacttatttgtgtgtctaagaatgacttaaaataggctcctattgcaaaagaatgtaggaagtgcggtggtgcaatcacggctcactgtaacctcgacctcccaggttcaagcgatcctcccatcttagactcccaggttcattcatttttgtcctcagagtggaacacttaattggccacaagcacagcaaattcccacaggtgtgcaccaccacgaccgcctaattttttttattggtagcgacagggtctctctgtgttgttcaggctgatctccaagtcctggactcaagctgtccttctgcctcggcctcccaaagtgttgggattacaagcatgagccactgcgcccagctgcttctgagtggctcctaagcaatgaactgatgaacaactaaacagatgacattgtagctattgccacatttcatagcatggcgactaccttgagcctgtcagtgctcattagctgcaggaggtaacgcttgtttgtttttcatagagttaaaggtatgaaagcatgttttttggaactttctgcaaggcccatgttattgacgtccttaagatccaaattattttgcattaacttaggtttttttctctttcttggtgaagttagtagacccttgcttattgattggtatatgaaattggatcattttattgttgtgagaggttcagttttattaaatatcagagtatcacctttcatacattttttggagctaattttgagtgtttttcttgtattttatgaaatactatctatagtcatctaacgaaacaatgctgtttttctgttacaaagctttctgttcacgtgtctacatttgaagttactgcattcagaatgaaagccatacatctgacctcacaatgtaaggatattcagttttcttcctgatagcctagaagaaggaaaagaatcacaaggttgtagcattgccctgtttctgttagacaagagaagtcctctaatggcaaacccttgatggtgtgcagtttccaaagtctggtccccgttggagcctctcacctcccatagagttaaagagagatttgcctcagcaactggaccatagccatcaatgtctattgaaactccaagaataagtttaaattaaaccaaacatgcagaagatgagaaaataagtcttatttctaaaaataggaggcttccccccccccaccccccaatggctgtagacctgagggcttttagtaagtaataatgaacttttacagtaactgtaatttgagtcagatagtttttctctg

SEQ ID NO: 127547 - DNA, 1021 bp, Homo sapiens
ccaccatcttgaaccgtgaggttgaggtcacacatgggtggactgccatgctaaccttcctgggcacttccctgagaaggaaacttctcttgtttaagccactgatattttgggtctcctgccaccctgagccaaacctaattctaattaatgtaggttccaatctgctaggcaagttcagcttgatgttacttaaaacttaaccatcctgtgagctgggtatttctgttttcctttaatggcttacgggactgggattaaagaaaaattaagtaacttgcctcagtacttcccagccagctaggacagcatttgaatccctgtctgacctttctgaattccagtctccaaaagtttaatccttgctgtagtgattaacatgaaactgaaggagggcatgtgacacatggttttgcaacattcacgttttggcagagccccaattttgtggaattttttttttttttttttataaagacgttgggtttttcagagaaattcatttgtggctttttgaaagtgacaaacatgttaactgtatttcagtcaataatacttatcagaaaagctttttttttgtttcaaagaatcccacgtggttcctctaatttctagtattaattgtagttcgctaattaggagagttctgtgaaaagaaaatagttggaagagagactgtggttcattttctttagttatatctacattggagaacatttcaagacaattaggaatttttttttttttttttttagaattctctatgcaataattccaaaatgttaccaatatttattacatgattatgtagaaattaggatgatagtggaattaaggccataaattgttcggattgtgacatgggagcagccactgcagccagtgtttctgcaaagtttagtcagaggagaacagagacctaggatggccccgtgctgtgctgctggggcctgggaggctgggtgttggggaaggaagctggcagcggatgcctggaaggccagtggggcccagcaggtct

SEQ ID NO: 127548 - DNA, 1031 bp, Homo sapiens
acactctagcctgggtgacaggatgaggctgtctctaaaaataaattaataaataaaagaaattccctattcgcccacttcttcgtgcccatccaccttgccacaaaaatttattccccacctgtacctacattaagacctgtagtctgctgtttcctttacttggtgccttatccatcagtttcttcccacttttatttcccttcttttttttgagacaggatctcactctgtctcacaggcaagagtctatagccttgacctttcaagctaagcgatcctcccacttcagtctcctgggtagctgggattacagacacgtgccaccatgcccggctaattttttttttcttggtatttcctgtagaggcagggttttgctgtgttgcccaagctgctcctgaaccgctgggctcaagtgatctgtctgcctcggcctcccgaagtgctgggattacagccgtgagctactgcacccggcctattttctttcttatacaacctagaatccagggtctggactgtaaatcactctctagacaaagccccccatttcctgatcatttgattcttttgctcatacctgggctgccaagcactgtgggagaaaatcatacacctgggcagattggtaccggtgcatgtcaatttcaggcaatcactttggcactatgcagtaattgtatatgttactctggttagctgtcactcttaggtttcatagtgactgttacaagccaagcccactctcttcagacttgttcctgcttctcttccccgcttcctcttcacagatgatccaattttccacttcatagagcctagcgaggctgtcacacaggagataccgcacctccttgccaccgcacttcaaaacttaaaatatccccctctgccctcatcctcactcagcagcctgtttcttctctcctttgcatgcagacttggtgaagggtttctgcaggtcatcttcttccttgccttcccatgcactgcactcctgcagtaggtccctccatcccacctgccac

SEQ ID NO: 127549 - DNA, 1266 bp, Homo sapiens
atttgcagacattttatttcatcctcagttgcaggcattccattaaggtggactgattaaagtgtcttttcagaacattagaacttcgtgtttcctcttcatggggttactgtcaacttatttaagaagaacagtagaacttcgtgttccctcttcttggtgttactgttaacttattttaaaaagtttgagtatgttacagtattttgtctttaagccagtcttgggatctagcaccaagggaaaaagttcaaaaaatgcattttaacaagtcttctcacttcatggtcacttggtatgacgactcaaaacaagaataatgttcttaatcaaccacaggggaaatcctttcttcggcccttcaattctacttttagtcagtcaaacaattcttaatttcatgcgggggattcccacacgttctgtaagtttcttttaaagttttcagatatgtgtagaatgtaggatatgattgcattcgtctcatatctcagtggtgtgaggtctgttgagtgtgccgctactttgttttaatattactcattcttttttctaagtatggatgtataagaatgagcatgataaaatgaaatctaaaaattaattgatttgttctcaggttaaaggcctattaaatataagatctttggatatattctgagtctttttattttttatgcagcaagtaaagaaaattttacagagctttggacacaaggctcctccttacctgccttttactgaactcaccatgtcttccctggttagctgtaggctctcccgtgctccaggctcagcagtcagggtgtatttttattgctcagatctgacaagtatgcttcctgcagttactgttgaggccagtttctaaggctttgaaatgaccttcaaaaagatgataaatgttgagtcccttttggaaaaatatactgagataaagaactgtgataaatcaaattataaggtagatcatcttgtaattagcacactataggaaagttagttatgccaggcgtggtggctcacgcctataatcccagcactttgggaggccgaggtgggcggatcacttgagaggtcaggagttcgagaccagcctgaccaacatggagaaaccccatctctactaaaaatacaaaaaaaaattagccaggtgtggtggcacgtgcctgtaatcccagctacttgggaggctgaggcaggagaatctcttgaacccgggaggcggaggttgcggtgagctgagattgcgccactgcactccag

SEQ ID NO: 127550 - DNA, 1078 bp, Homo sapiens
cagcctgggcgacagagcgagactccgtctcaaaaaaaaaaaaaaaaaaaaaaaaaaaaaaaaaaaaaaaaagatatttcttcatcaacaatttaatgactacatgaccatccattatttagctagtcagtagtttacaccctgttaacatttaaattaacatatttcacaatgattgtttcgaactcacatatttcccatcatgaaattatatgtaaatattcacctgttttattctagtagtgctaggagttgtatataattaagtatttgagatgtatttgagtgtaaaatgtgagaaaaatatctttttccccacacagatagccagttattgaatacttcatcctttggtctgacgttgactttttggttttgccatcaagtaaccatccacagtgcccgtacatagcaggcactcaataaatgtttgaataaatgaatttgagtatttattttgttttcagatgttttcttattttccgtggacacgtctgtctattctagttctactgccatgctgttttaattatcagagctgtataataaatgtttgtatgtggttgaacatcattattgttattgttttttcggaatttttctgggctacttctgcatcacttttctctcggataaatgaaaataatttggtcaactttcttgtaaaactatgataattttgactgatactgtattaatttattttccttccttccttccttccttccttccttccttccttccttccttccttccttcttttctttcttttccttcttttcctttttcttcttcttcttcttttccttccttccttccttgcttccttccttccttccttccttccttccttccttcttttccttcttttccttcgagatggagtcttgctctgtcacccacactggagtgcagcagcctgatcttggctcaccacaacctctgcctcccgggtccaagccattctcctgcctacccagtagctaggattacaggcacccagtaccacgcctggctaattttttatttttagtagagatggggttttaccatgttggccaggctggtcttgaacttc

SEQ ID NO: 127551 - DNA, 1017 bp, Homo sapiens
attatggtacatgttttaaaacacgatatacattgtatctgttgcaagtcaggttccaagggaaatggaactcagaagattaaggctgggggccaccagtgcctcatgcctgtaatcagcactgtgggaggccgaggcgggcagatcacttgaggtcaggagtttcagaccagcatggccaacatagtggaacctcatctctactgaaatacaaaaaattagccaggtgtggtggtgtgcacctgtaatcccagctactcaggaggctgaggcagaagaatcacttgaacctgggaggtggaggatgcagtgagccgagatcaagccactgcactccaggctgggtgacaaagcaaaactccgtatccaaaaagaaaagaaaagaaaagaagattaacatgtaggaagtttgttaaggagattttaggattcacacttgtggaataggaggaagcacaattgggccaagggagaaattgggctgtggtgtccgatcacaagataggcctcagctgatcccaaaggggatgctgaaggtggggtagcccttgaggatggtaccacgttggggtgaggggccaggccttggtagcttcacattgaccagttatgggaagaaggctacccctgaagaagggatgagaccttggtgaggtgactctttcaactgagggctgttaacttgcaacacccctagaaactgggggataagctcttcagtcctaaagagagacctgagcagccacctcagtattcactacagtctatattgtgtacattgtctgagcctgccctttttgctgtatattatgtttttggagtttacttatattaatatctgtagctctagttcatttattttaattgttttatggtattcagttcttcaaaatatgtcacaattttaaaatatattttcctattgagagacttttaagtttttacaatttttcactattaaaaaatgttgctatatgaattcatttatatttctccttagtgcacacaccagagttc

SEQ ID NO: 127552 - DNA, 1033 bp, Homo sapiens
tgggattacaagcactgagccagtgtacccagccttttttctattttgttcttgtcttgtatattttacattttatagcttttcatgtttctgaaaccacttaccacatttaggccaaaaggcaaaataataaaaaataaaaccaacctcacctaaaaaaaagtttaaggattaagtatttccatataccagtgttgaacagatttgaacaatatatttgattttatgctctccagttgctaaagtgaggaaaagaaacagaattatattgttttcatgtgctgacagccggaagcatgtaaacatctgcagaaaccaaacgtttcctggaactaagcttgagcagaaatctatcacgtggacctttgtttaaagaaccttgtgaaaaaccacagttatgtaaaagatccaggagcgcagttcatgtggattagattctctaggaggcagagagtctaaggagatcaaagaaaacaacgacttgggaagtgcatgtgctgagcgctggagccaaactagcagaaaggagttttagaggcactgaatccaggcctctggtttttggggactgtagtaaagaaaggagttgaggcctggtgcagtggctcatacctttggtcccattactttgggaggctgaggctggaggatggtttgaggctggaagttcaagaccagcctgggcaacaaagcaagaccccttttctaaaaaaaaaaattaaaaaaaaatggatgtgatggtgtgtgcctgtagtcctagctactcaggaggctgaggcagtagggtcaggaggcagaggccggagttgaaggctgcagtgagctatgcgggtaccactgcactccagtcgggtgacagagcaagaccctgactaaacaaaaaataacaacaaaaaaggaggcaggggtttagaaaataccatgattgttaacaggaccatcagatttcattttttctaaaatattagatattgtcagtgtggtttttatataggtgctgattctgttctgttcgtcttcaagtaacaaatgc

SEQ ID NO: 127553 - DNA, 2022 bp, Homo sapiens
attttgtttgaagaaccttttgttagaatttttaaaaacttcaacatagtaacacatttatcagtcttttactttataatttctacttttgtatgttattttaaaaatcattacctaaagagcatttttttcctaaaaattgtcaaaattttatttttacatttaagcctatagcttgaaaatgtgtctctatgatgtgagataatgattttattttcttatagttaacttatgtctcaggataactgttgttcaatagtctgtcctttccccgctgatttgcagtgctactgccatcatatatcaaatttctgaacatacgtgagtctttttctgggtgctctattgtttttcatttatctttactgttttgcttatcattgtttcatataacttaaagttttagagagtggctgcctgttttcttcaaatttgtcaagactgttcttggcccttttttcttatgaattttaggatcagcttaccatggtccatgaaagaccctgtagggattttgattgtaatcatgttgtatttcagttcagtttagggatatttattaagtcttccatccacaaatataatgtatttctcaacttacttggctttataatgttctctataaagctcttgaagatttttttgttagactaattattagaaagcttatagctttagttgctgctttaaatgataggtagcttttcttattgaaattacaatgtgatgttttggcttataggaattatattaattttgtatcttgatcttttaacaatactgatgaacttattttttattagttttaatggttttccttcataattctctatatagataatgattacttggagatgaagacagttttgttacatcatttaaatttttatatttcctttgtcttttttattaatgttgactaagtcctctattatgttattaagtaaaagtgatgattgtagtcatccttcttgcatttcgtagcttttgaaggaaatactcccattatttaaccattaagtgtgattttgttgtagggttttgtttttgtttttaagttaagcaagttcttttctattcctgatatgtgggattcttttttttttttttttttaatcatgaaggttgctaaagaattaacgaaagtgaccgggcgcggtggctcatgcctgtaatcccagcactttcggaggccgagacgggtggatcacgaggtcagagatcaagaccattctggctaacacagtgaaacctcatctctactaaaaatacaaaaacttagccgggcgtggtggcaggtgcctgtagtcccagctactcgggaggctgaggcaggagaatggcgtgaacccgggaggcggagccttgcagtgagccaagatcgcgccactgcactccagcctgggggacagagcaagactctgtctcaaaaaaaaaaagagttaacaaaccatttttcatttttttaaggacaaatctgaccttagattaactctctactcagttctcctgaacccctggtaaaagggaaatgttcaccatgttaccaggcaacattgttgtggtgaaagtgacctctgtttggtaaacatatctggactgggaggaactgtaagtgaactctaaattcctgattagaagctgtagcttccccagaagtactgacttttcagaaatgggtatgtcctttgtgggaaccttggacgccgtgactagcaccgttatatgatatttggtttctgcttggggcacaaagtttctaagccagcatgtctgtgcaccacccttgtgattttattttatattattttgttttatttgagacagagtcttgctctgttgcccaggctggagtgcgatggtgcaatgttggctcactgcaacccccacctcgcgggttcaagcgattctcttccctcggcctcccgagtagctgggattacagatgcccgccaccccacacctggctaatttttgtatttttagtagagacagggttgtaccatgttggctaagctgatc

SEQ ID NO: 127554 - DNA, 1037 bp, Homo sapiens
agtggactgtatttttctgtttgctttgatgttttgtttgtattactttgttttttgtttttgtttttgagactgagtctcgctctgtcgcacaggctggagtgcagtggtgtgatcttggctcgttgcaacctccacttcccgggttcaagcgattctcctgcctcagtccccctagtagctgggattacacacactgccaccgtgcccggctaatttttggagatggggtttcaccacattggctaggatggtctcgaattgttgacctcaagtgatccgcccgcctcagcctcccaaagtgctgggacgcctggcctgtttgtattactttgtggtaactctgccattaggggagttgaatcagactcatctgatatgaagatgacttaatcattaattattttagtacacaattattgagtctgtttttgcacccattatgggttccagcactagatctagtttattagcactgaaagtaaattaaagactaagccatattggtggttggctcacagacttaggagtttggctggctgttaaggatcggagtctgtaatattagaaagttttcaggcaaaatgaaagaaacaaccagataataatttggtaaataataaaggagtggtgaagttggatttccttagctgactcttttgctcagacattgtggtctcaacttacttatctctaaatatttaaatagattactgactggcctgggatgtggtttgttctttaaaaaaaaatgttatgtaatatttgacccatacaaaaggttatataattctgtacaattaataggacgttattaacacactgaagctaccgtgtgaggaggtgcctcactcatgtactgcattattatagcttgctaaacataccttggttaataaggaactatttcttgaatgtcacttccttgtctcctgccacgcatctggtggtgggcccggagcccttgttgaccaataggctcaatatttgtgagggagacctggacagcagagtagaggtgtgttaggacacgctgg

SEQ ID NO: 127555 - DNA, 2200 bp, Homo sapiens
tttaaactaaacagtttctattctaatcacaaataggaaaggaagaaactttttaaaatgaaaaatatataaccactcatttttgaggatctcacaaaaacaaagtattatgcaagtaatctgaagccaaaagccacaggctgagatttgccatgctgaaggtttttttttttttttttttaatctacaaatgtttctttgaattcttgaatgctctatcctgtgccagtgaaagatgtttttctttaaagatcttagcagtgactgacatatcactgtttgagcagatgatcctgagaaagtaaccaaagccatttacagaacaggcgtttctgtaacttgggccctttacggaagtaagccagtgggcttgcgtgttgtttgaagactgggcttatctttgttcagtgttttgctttgagagcacgactgactttgagtttcatctgcactctgtgaccaattgtgagacagacccaaagtctgaagtttgtgttgactttagaaagtcattctctgaagcctttttttggaatgagtttaaagaaggaagagtaccaaaagccaggtccagtcttgtagtggatgttttggaaagaaaggatcatggttctctgggaccatcagagtggatcagattacattctaatgtaatgatgaaaacaaagaacaataaatcagagggactctaaaacatcctaaaatcttccctcaggcaaataataccaaatcttcgagggtggataattgttttctctccattttcttttttctttttccttgcagattgacagaattaaaaatttgacaagccccatcagtggttcatttaagtgttttggtatacaggtgattagaaactataaaatctcttctgctttattttaaagctattgtcttgctcagactgcgtaatttaaaggcaactgtgttaatgtctgtggtgaaaaatttctgatcctaaaagtcatggacaaaaagggggcatttgcctacctagtgtcaaggagcttaaactgtaatcagaagtccatgcattattgttttattcaaatgtaaagggaagatgaatgctcaagataccgcaaaggatcttcttaaaatatgcaatttgtgtgactcttgctgagtcagatgagtgggtgatgctgggcagagctgtagaagaaaactgactttcagcaaggaataagaatccatgctaaacagtacagaagtgaggctgagaatatgctcaaggagagtgcggtggttggaatgtttgtcccttccaaaactcacgttcacatttaatccccagtgtggcagtattgagaggtagaatctttaagaggtgattgggtcatgagggctttgccctcatgaattgattaatccactcatggattaatggattaacgggttagtggattaatgggttgtcatgggagtggggcttgtggctctgtaagaagagaaagagagagcaacactcagccccctcgccatgtgatgccctgcactgcctcggagtttgcagagactcacgaccagcaagaaggctctcaccagataccgtctctcaaccttggacttcccagtatccagaactgtaagaaataaatttcatttctttataagttatccagtttcaggtattctataagcaacagaaaatggactaaaacagagagggaagcctctggaagggggaagcctgagtggttaagtggtgagtccagcagctgaggagaaaacttttgacctgaaaggactagatctgggacccagatggaaaacgacttcctctttttaccttggggtttgagagagtgctcagcctgggtctaggagtggaggtagaccagcctaacagaaaggactgagtccaaggaattgctagccagagggaaaataaaataaaatcatggaaggcttgggagatgccttttgatactttaaaccaagcttgtccaacctgtggcctgcaggccacatgtggccctggacagctttgaatgcggcccaacacaaattagtaaactgtcttaaaacattatgagattttttttttgtatgattttttgttgttgttgttagctaatcgctatcattagtgttagtatattttatgtatggcccaagacaatttttcttccagtatggtcccgggaagccagaagattggatacccctgctttaaacctaccatgataattgg

SEQ ID NO: 127556 - DNA, 1097 bp, Homo sapiens
gtgtctgtttgtgtgtttgttttcgcttctctgagggaggagccaagtctcatccgtgtagctccacgtgtaataaatgtgagtcgagtgaacgaatgaaagatttccccaagccttgtagtggacgtgcttggaccatggtggtccatcagtgtggcagtggagtccctgagcattgaggattgggagacgtgtgactagagaggtagaccacacaagccatgaagcatctaggggtgactgcaaactgagtgaggcaggtcttctggtcctgtgctgctccacacagaaggtttcagggatgacttggaagcaagaaacaggtaaatgcagtgctgcgtgctaagcgttgcaacctcctgcacaaactgctctgggcgcttcaattaatttggactgtgggggttggtctgggaagactggcgttttgagttgagtcttcaagagcgtgcagttgcccaccaaatggagaagaacaaggagcatgtttcagaagcagcatgtaccacgctgtagaggtgggaattgtcattttcttgagaagttgtaatggagcttaaggttcaggggcgttgggaagtgggaaagcagcaggaaatgagattggagagggccatgtgtgtaatgctgaatgactggcctttgccccattggctgtagggaaccactggaagttttaaaatcaggggaatggcggagattcacattttagaaaaatgcctggcagcagtgtggaagatggactggaaggggaagactaaagagaatggacgagttaggagactgctgcaaagtccaggtgagcacggggaagggcctggattaggccttgacagcggcgatgtggcagagaagactaagttgcatgtgattttgggaggcggaatttgcgtgacataccagagctgcagataacagttgtgggagggatggaagaatagagaaggaagctttttttaacctatagccattgaatgggagagtagaaaggaaacattgagtttggttctggacattttagaatggggcacccaaatggagagaaccagcagacggaaacatattcacatgtgtgtgaatgggtgagattatataag

SEQ ID NO: 127557 - DNA, 1650 bp, Homo sapiens
aatcaacatttattatctctaacaatttttgtacgtcagagatttgggatcacattaacagtgttcaggcttggggtctcttgcagtgaagtcaagatgttagtcagggctgggcatggaggctcatgcctctagttccagcactttgggaggctgaggcaggaggattgctcgagcctaggagtttgagaccagcttgggcaacatagcgagaccccatctctattaaaaaaataaataataatttttaaatagatgttagccagtcttcagtcatcttaaggctttactggggctggaggatcctcttccaagatggtgtactcaaatggctggcaagttggtgttggttgttggtgggaggcctcaattcctcctctatgtgggactcttcacagggttgagtgtccttatgacatggcagctgcactccccagatcgagcgacgcaagaaaacaagacagaagcttcagtgccctttttgaccacgccttggaaatcatcccccatcactctcgccatgttctgttccttagacacaagccagtaaattccgcccacattcaagggaaggggagctaggtttcaccttttaaaaagaggtgtgtcagagaatctgggaacagattttacaaccaccacactgtcctaaagaggagtgatggtgtaattttgaaaaggaaaaaaagtctgggatccagacaaagattaatctggtagtaatgtcaaagatgaatggaagaaagggagaaacagaggtggatcgtagtgctgcgatctagcagtcaagtgatggatttagttgggggcagtgagagggcagaggtaggacacatggaagggaggcagcagaatcccttccctgtgatggttgaggtttcaatgactgagtatgtagagaaaatcagagcagtgactttggggaaagccatggtttgggatatgattaggaaggggagctggatctgttgcattagagagaaagaagagccagttgagttcctgcaggagcaaaaaaagcagagtgatcaagagcttcagatgttgcagaattcgcagagaatgatgtttgaaatgaatgcatttgcttgcaaggttattataggtgacagcagtttaagtggagtagagcaattttggaaattggattataacatttaattcgatgattaactttttacaaagtgctagaggtgggaggatgaggggctggtataccattcaccactcatattttgagatcttacatctttctgcctcctgatagtacccccaagcctccctggaatggcacttccactcagctcttggattgagggcaatggaggaggattttacctcactcattttcagggattcttttaactgcattggaaatcaacttactttattatttttttactttacatattgcttttaactatcatgtgtgctctcccctagccccactcatttccctccctttcccttcttcctggtcagtaagcatttaagatcatgatccagtacaaagacctattcttctcccttacctcccaacttcaagcatgattctattattcatatgctttgttaactgaacttgcagggatgcaattgatatataagaaatataattaaaattgcaaccagcaaatgtaaatactaaat

SEQ ID NO: 127558 - DNA, 1113 bp, Homo sapiens
taacattgtattaatccattttcatgctgctatgaagacatccccttgactgggtaatttataaagaaaagttgtttaattgactcacagttcagcatggctggggaggcctcaggaaacttaacagtcatggcagaagaggaagcaaacatgtcctttttcccatgacagcatcatggagatgtgccaaacaaatgggagaacagccccttataaaaccatcagatctcatgagaactcactatcacaagaacagtaagagggtaaccacctgcatgattaaattacctcctactgggtccttttcatgacacgtgaggattatgggaactacaattcaagatgagatttgggtggggacacagccaaaccatatcaaacatcatttattaaatagtttttgccttggtgattttagatgccaccttaataatatacaatactaaaacttcatctgcacttggatctgtttttgaactttctgtattattctgttggtttgtctgtctattcatgtgtcagtaagacacttttcatcatggaggctttagactgtgatttaatgtctggaagaactcggccttccctctagtgtgttagtgttttcctggctgttactgcacatttatttttcaatacaaggctcagtatcaattgtatgtctccattaaaaaaacttggtttatttatgaggattacattaaatttctaaatttatgatgaactgacatttttatgttaacttgttctatctgaatataagagatgtctgtggttaaactcttcatttgtgtctttttaagaatgctttaaagttttcctcagatgtgttttatacatttcttttaaaatttattcttaagcactcaattttctttgtgcaacttgctttgtttccatttaatgtatcatatatagctgaacaggtcagtacatgttgatctatttcattttaaaaaatggatccatgataagttatctctgtgtatctattagtatgggggaatgtgagggtagcataagtcataatttctatcttaaataactaaaacatagttttggaaatcagacatgtttatttatgtacattaaaaactataaaaaattcctgtg

SEQ ID NO: 127559 - DNA, 1031 bp, Homo sapiens
gaaattggtgagcagggaatgggaagacaaaaatggaatgttgtaagtttttaaatgtcctgaaacttttaaaagacatattaactatgtcaagatgagtcaatagcacagggttctttgttagaaaataataaatgaataagttttcctttttgtttctggtgaatacttcgcaatatcgccaggtgctattatttgactcatgtcaaatgcctttccaaagttatgcccagaattcatgcaatgcttacatttttagattgctttatgatcgttaccttgtttaaatcaagtttctggaaggcacacatgaccgttattactaggcgtgctttatggattaggaaacaaatcatttgtatagcgcagaccacgaagctgggttgagaccatgagacttctctgcttttcacactaccagttttagttttatcttgaaattgtatattgtctcaccgcttttataagaggattgagccttaaaatcttaagagttgatttggcatacgcgtaattgatttgagctatgtttcatggacccagctttagattttgatcacctctttctctttgaaaagagctacgtgtgatttgctacccagatctgtactcatttcttgactcaaatatgtatctgtgacataatcttcgtagttaaatctgtgaaactttcaaatccttcagacttgacagtgtgaggctggggttggcagtctgcttaacaagatgctgggaccacctctgaattagtgaatcagggagctgctgtgtgatcccctcctccaggctttcttggagtttgtctctgccacttcctcaagccctttaaaaaggctcctgtgctttagagagttaggatgttaatgaccgttcttttttcttgtactttattaagtactagtcttactagactagtgcttaagtggcagtgtctgcctttgccttctcccatctctttatgctcctttcttccaacttctcacgtttctgtttctcgcacggccaggtgtccagcatcccatgctgacttg

SEQ ID NO: 127560 - DNA, 1051 bp, Homo sapiens
gctcagtctgaggaacaggcaggttcccacattaccaagtatcttccatcaccatggtggggcaacactgtcctggactagagtatacatttctatgaagataccttcttacctatatgacacagtgttcatgtactgctgtatttcctctcctgatatataacaaataatctagtgaaaatttcccactaacttacccagggaactataagtaggccaaatgaagcttttagcacactttctggttgctgataaaaatcagcaactataaacccaattgctcctatttccattagagctgctttccagaactaggtctccagttatgtacattaaaagtttgccaacccacttattttcttcctaaatactttattatatgcaggatggcttgggcttcatctacagcaaacaaatatatgtatatatttgccagtgggccatcagaaacatctattgattgtctatgtgtacaagtaactgagtctgcaaaattgccttcaaaggctaagtctcttgtattctgcccttactgagagtctgtactctcctaaggttaattggcttatcatattctgcttttgtgctccctagtttaccatgatgcttggggtttttgcccctacgcttttcactttgtcttcctgtaatttattacaaccaacccttgtgtttttttttttttaacagttttggatctgcattaattttttagtccccagaggaacactatgttcccaaacattatgttctgcactctcatgctcatatcactttgtgtagtgccagacacctcctgggatctcaagaaatgttgtttctttttaaaagatgggtgattactctaggaggctcataaaagatctttctcagttgagttactttcactgtttatgtatcccaagtggcttaggtcaaaatattggttaatagaaagactccaagtctttggagaagctttactagtgtctcctcatctctgtaaaagcaaagatgagtattgaatggtcttacaggagtgttggagagaaatgatgaaaagcattagaaa

SEQ ID NO: 127561 - DNA, 1006 bp, Homo sapiens
acagcaaatctgctggtaatggaaaattagctggccaaggctaagatgaccacggccaacggctattgtcatctgttgagggcaggcgaagttgaaacacttttacttttggaggaaagtattttccatctccgtgaaagttcacagctggctaggtatggtggctcacgcctgtaatcccagcaatttgggaggctaaagcaggaggatcacttgaggccaggcatttgagaccaacttgggcacatagcaagactccatctctacaaaaaattttaaaaattagctggttatggtggggcatgcctgtagtcccggctactcaggaggctgacgtgtgaggatcccttgagcccaggagtttgagactaaagtgagctgtgattgcgccactgccctccaggctgggtgacagagtgtgaccctgtctcttaaaaagaaaaaggaaagttcctttttgctataggcccgaggggttgctgctgaaatgggcaagttcatgaaacctgggacggtggtgcttgttctggctggatgctattctggatgcaaagccatcatcgtgaagaacattgatgatggtaccttagatcgcccctacagccatgctctggtggctggaattgaccgctgtccccacaaagtgacagctgccatgggcaagaagaagatctctaagaggtcaaagatcaagtcttttgtgaaagtttataaccacaatcagctaatgcccacaaggtactctgtggatatccccttggacaaaactgtcatcaataaggatgtcttcagagaccctactcttaaacacaaggcccgatgagaggccaaggtcaagtttgaagagagatacaagacaggcaagaacaagcggttcttccagaagctgcggttttagatgcttcgttttggtcattaaaaattaaacagaaaaaaaaaaggaaagttcacagatggccaaacttttccacagccatggtaccgtcctagtgaagtacatttgaga

SEQ ID NO: 127562 - DNA, 1011 bp, Homo sapiens
cacacattattacaaaggccggtaacagcattgttctatacggactgcggaaatgacatgattgtctcccgacatactgtatctaggccccctgaagagcaggtatttgtgacatggctagacataggtgtagagtatttgagtggcacaatttttcttcaagtaactgacacagaaatcaaacccccagactccgccaattcagacaacgtaaaccaactgaactatctaaaaataattttggttgattacgtatttatatgtaatttgatgactattgtctcaaatgtacttcactaggacggtaccatggctgtggaaaagtttggccatctgtgaactttccttttttttttctgtttaatttttaatgaccaaaacgaagcatctaaaaccgcagcttctggaagaaccgcttgttcttgcctgtcttgtatctctcttcaaacttgaccttggcctctcatcgggccttgtgtttaagagtagggtctctgaagacatccttattgatgacagttttgtccaaggggatatccacagagtaccttgtgggcattagctgattgtggttataaactttcacaaaagacttgatctttgacctcttagagatcttcttcttgcccatggcagctgtcactttgtggggacagcggtcaattccagccaccagagcatggctgtaggggcgatctaaggtaccatcatcaatgttcttcacgatgatggctttgcatccagaatagcatccagccagaacaagcaccaccgtcccaggtttcatgaacttgcccatttcagcagcaacccctcgggcctatagcaaaaaggaactttcctttttctttttaagagacagggtcacactctgtcacccagcctggagggcagtggcgcaatcacagctcactttagtctcaaactcctgggctcaagggatcctcacacgtcagcctcctgagtagccgggactacaggcatgccccaccataaccagctaatttttaa

SEQ ID NO: 127563 - DNA, 1371 bp, Homo sapiens
gtttattgaatgaatccaagttcctaagaagatatcagtcctcagctcttatattttcttaattatcccctgccttttcctttgtggggtgatctgcaagcagtttcatctgcacgtggaatggaggacatgctaaaagtaaatgtagctttgtttttttttcctcccccaaggaattgcctcagtaggaatgggtgtttcagatatatcattctgttacaggtacaaaaaattgtttccaggaagcactgccatcattatctctgagaggcaagtcagtagaaattgttattttccatttacagatggacaaatggaaggtttctttctcatttaccaattacagaatgtccactctgtttaaagtactgtgctaagatttttatgggctacaaagatgtacaagacaaggttcttgtttcgaataagaatgtcataatcttatttggataaaacaatatttatataacaaaagaactacaactcaggagcatatagtttgaggcatatgagtggtcccaaaaggagccccaatgggccaggcacggtggctcacacctgtaatcccagcactttggaaggccaagatgggtggatggcttgaggccaggagtttgagaccagcctgggaaacataacaaggccccatatatacttttaaaaaaattagctggaagtagtggtgcacacctgtggcccagcttcttgggaggctgagatgggaggatcgattgagccctaaagattgaggctgcagtgagccacaatcgtgccattgcactccaatctgggtaacagagtgaaatgaaaccctgtctcaaaacaaaacaaaaagtaccaaagggaatataaaaggcaggcaaaagaatgtccagctaaagtgatcaggtatatcctcctgtcccatctgagatgaacaggttttgtgctggttattctccatctggctcctgtcctggttttctgtgactgccgtaacaaattactacaaactggataggttaaaacaacagaattttattttctcacagttccggaggacagaagtctgaaatcaagtgttggcaaggccacactcctgaaagctctgggggagaatcttctccttgcttcttccagcgtctgggggccccaggccttccttggcttgtggccactcctctgaggtcacattgcctcctccttttatctcttaaagtttctgcttctctcttataaggatacatgtgattgcatttagggcctaccacagtgatctaggataaggtcctcctctcaggataaggtcctcctgaacttaatcacatattttgccatgtaatgtaatattcccaggttccagagattcggctgtgggcatgttttgttggc

SEQ ID NO: 127564 - DNA, 1056 bp, Homo sapiens
tggcggcgagctacactttttttctaaatgggaaaagggttaaatgagatattctattagttttaaaagcaggtaagtgctgaaaatattatatttctctctccaaggagaaaaaaatctagctcatagttagcactccttaaatcctaactgtaattatttttcttataatttcctgtattggccccagattccttttttcatgtagttcattgaccttcaccagaaaaatggttctctgttcaattctgacaacagcagctgacatcaatgtaaaaagagaaacaagctaaaaacagtagttgagtgtatacaccctgaattgaatattcagttgcaaaatcatcatgattattattgtaattacagagaggaggcattgcaataattgttcaagtgtcttcttgaggaaataactaaaacagggccagctgtcacaaaccaccctacaataatgatccctgtgtgtgcatcttcagtattcatagtgaccccataataacaaatttgtgcactcatctaatatcctctttcaaaagttttaattttataaacaatagagacagaatctcgctgttgttgcccaagctggtctcaaactcctggcatgaagcgctcctcctacctcggcctcccaaagtgctaatctgatgcccttaaacaactgaaaaaataacaaacctatgatcagattcagtatttcgcttgatagttgaccctcgtttctaaatggtgtccatgaacagccttagaatactaaactaccaaacaaaaattgctccatcgatttaataacaaactagagtgggtagtccagcattcacctgcaacatgagggcaacaaatctaggtacaagagtagagtggaagccaggcagataggtcagcagacaactaacacacttaggagaaacatctacaaagacaggcgtgttttattgacttgaaaactgtaaacaaacaagatctgtgagaaaagagggaaggccttgttttttgtttacttgtgaaatcagccaaaagtatttgaaattttctcttcccaagatacagctg

SEQ ID NO: 127565 - DNA, 1072 bp, Homo sapiens
acgcgctacacaagtggagctccttttcctccacctaccttcccgagtaagtgccgggccttgagctcgtgctgccccacccttccgcgtcagcacggttgggccaggggtgcaatggagggcagccgagccgagaggcccaggcggggcctgctgagggggacgtgcggcctccggagtcttagttcagctgctgagagcgttgctcggcctcgctcgggaaggggttagggtccggagagcgagcccagggagaaggggcgaggtgtgtggcggatccggggcgcgcacaggagaaccggaagcccagcggttctgcgcttgggatttgggggttgaggttgaggagggcttggggggcggacggctctggggcaggaatcggagttggcggggccctgcccgcgggcaaactaccccgaatgtctgaggtcgtccgaggtggtcggcgtcgggggacagttcagtcgattgctgccgggacaaagtgtaaagccgaggagtgtctattccagagtggggtcattaaaagtgattagctctagagtagtgttaaaagtcacggaaggctgaaaagttgtggaatccatctgaatcctagcaggcggggagaacttgtaggattggcagacgttgtctttaatgcctggaagttctgaaaaagatagggagtgggaaggagggacgttaccgaagaatttcagtattacggctcattagaagatgggtttgtatggacacagacacgtttcccagtccggaaactcaaacatagaaacatctggctttaatgaatttgattttcaacaccggctttgtcttgatccctgatttaggtgttaaaaaaattcagttgcattgttaggtttttgttggtggtgtttttttctctagcaaattccttctgaaatgctgaaaatactcttacatagtatcttatttatctttggcttatctttgaaaggaggagcagatctaactccaattttacatgctagtggaggaactggcttagtaaagggttaagatctgtgcagatcctgaagaaaagtgctagttgtccctctaacca

SEQ ID NO: 127566 - DNA, 1052 bp, Homo sapiens
aatgtataattacttgattaatagctatcttcccaactagaccaaaaactccatagaatgtatggaattttcctccatcatccttgtagtccaagcataatatttattaaatgagtaaatgagtgaattaactagccattttgattaattttctctttttagtgcagttttggtttaggactgtaaggagtcatactggccatattcagaatgtcacattagtgttttaagtccattctgtatttttttcaatgagtttcagcaaaatctgagagtgtcttaagtgaaattggttatatctagggtggaggtattatatttggaaagacttgtaacagtagaaagctttttatttaaatctttgagttttaaaatatttttattatgaagttatttatgattttataggtaatatttttaatgagaccttgaaaaatttatagagtgcagtttattacagaatctgagttgcctaatagtttttaatagtttttgagtatcagtattttgattaattttaagttagggatcatttcctctaattctttgaacataattatttgttggttgatttttttttttaatgtaacagtgtttttgagatgtaatttatgtaccatacggttcttctactttagggtattagattcatggattttttgtacattcacagatgtgaccgtcattgcagtcaattttagaacattttcataatctcaaaaggaaaactgtagcctttggctattatccacttattcttccatccctgagcaaccactaaactacttttggtgtgtatagatttgcctatttaagacattttctataaatggaatcatataatttatggccttttgtgattggcttccatttaggatgttgttttcaaagtttatattgtatcatgtatcagtactacatccttcttattgctggtaagtattctgttgtatcgatataccacattatgtttagccgtttattagtacagtggtccccaacctttttggcaccaaggactgactttgtgcaaggcagtttttccatggatg

SEQ ID NO: 127567 - DNA, 2262 bp, Homo sapiens
caaagttgtattctgtgctacagctatctatattgtgatttgccatatgacatatctcttattaatatatgaagagagcattaaaacagccttgcctatttatcagatatgttctaggtgttaatttatttgtgaattttatgcgaacagatatatatatggaaatgagtttttgaaagtccagcatacaactacagccattaatcaaggacacatgtagaaaataattcatatatatgcagagatgttgggagaagttttattccaaagctaacacaaaacaaggtacacaagtttttatagaggatattatccattgcggtaatatttgatgtataatacttctgaattttttaatagttttaagagttaactatagtcgttgggttttttttttttaaagacagggtcccacaaatgtaatttaaaaatatttgtagatcctctggagtatctctgaggaagagagtttgaaaaatgctttaccatgggacttagggcattggtcaaagatacctattatgggtatgagaggagagttcttattaagtaagcagatttggattagttaatattggtttgacctgtcatccttagtacagtttaaattattgtattatactgtggcaaaagctggatctgatgcaaaggaaaacatgaaagaattgagacagtatggtatagagagaacactgacctaggactgggacttgagttctaatcccagttctaccaccgattaattggtagttttagatcggtcatttaatttctctagccttttatttttttctcatacaaaatgagggatttagattctgaaggtatttttttgatgcaaaatagcaaacagttgatattacagagtaattttttaaagacatgcaccctcccccacatccacatgttatagttcatattaagctacattgttgcccaacaaagatattttaagaacttgatataattagatgataatgattattttagtaaaattaattacatataaatgaagcctttgagagtgcttagaagcagtttgatctcttaaatctatcttttttttttttgagacagagtcttgctctgttgcccaggctggagtacagtggcacgatctcggctcactgcaacctctacctcccaggttcaagcagtcctcttgcctcagcctcctgagtagctgggactacaggtgcgtgccaccacgcccagctaattttttgtatttttagtagagacggggtttcaccatgttgaccaggatggtctctatctgttgaccttgtgatccacctgcctcagcctcccaaagtgctgggatttaggcatgagccgccgcacccggccttaaatctttctaatccctctgtgaatatattgttatattgtctgaggtttgaagaatgtgtgtactaagcagtaaatcattgccagatcatgtccaaatttaatgatctttgcattaggtagaaaagggatagttctttgttttgaaatatattctgaagggtcatttaatttctgaaaagattgataattcaagccttctgagatattcagcaattgaggactatttttatatgagtgtctcagcagatagatttttttgttttggggagacaccaaatcatgttagcgagctttttagtttcatttttgtctagtgagaatttcctattttatcaaacttctgtataggaatgtttgttttattttgttgccattcttttttcctagtggtcgctccattcattcttgtggagtatgttgtaggtatgtgttcccaaagtgttttgaatccttagagataattactacatgcttattttcagttgcttggtagtgataagttgacttgagttttgctttgagtgatggtaactaacgatactacaatggtctgctatttgctaggccattgacattctgtaattttcaacctgtatttgtacccacctctctttcttctggtatattttaaagtaaatataagttatgttattttatttctaaatacttcagtatacatgaagaagaggacattttattagttattttttatttcattttatttaaaatcttttttttttttttggtagagttggggtctcgctatgttgcccaagctagtctcaaactcctgggctcaagcactccttcacctcagcctcccagagttctggaattacaggcatgagccgctgcacctggccttcgttatctattaatccataacaaattgctacaaacttagcagct

SEQ ID NO: 127568 - DNA, 1033 bp, Homo sapiens
tggttttaaattgtcagatttgactgtgaattatttttgaatttcattcttaccgttgaaaattttatgttatattcagttatccattcaggacactaggccctgtcacacatttttaaacaccgtagctacattctttataatactgaacatttttcattaatcctcgtataattaagagaatccagttataatgctgttgatttgaatgtaccggttttgacctatatgcccatgttcaactacttgtttatattgtcttggtcataatattttgagcatgagtttaaacttaaaacctgagtgtgcattaattcgtgttctagtgcatttactaaattatgaagtcagatttaatagccttatttttttcccacagtggcttaaagaatgattataacaaagaaacattcaccttgaagcataaaattgatgaacagatgttcccttgtcgattcattaaaataggtaagattttagcattctgaaatagaaacaaattcttgatatcatcagtcagcaaactatagcccatagaccaaatcctgcaggcctcttgtttttttaaatacaattttatgggaatattgctgcgctggtttgtttacatattgtctgtatctgcttttgtgctacaaaagtagacttgagtagttgcaagagaccacagagccccttaaatttactctttggtcctttacaggagaagtttgctgacttctgctttatataaattcattactaagtggcagttatttcaagtggaatcttttccaaatgttttctcatttgaaagttttcttagattttatgggatctagtgatttgattgccttaattttatggaaggtttatcacttatactaaaacaataatattctaaaaccaaatactgataaaatccttaaggcagtatattatggttattatcagttgtgttcttttattttatttatttattttttttagttaaatgctggtcaaacccattaaattgatttaatgacccatcgataggttgcaaatcactgtt

SEQ ID NO: 127569 - DNA, 1326 bp, Homo sapiens
tttcccagtaggtttaatttttaaggtttttgatgctttttaaaaaaatctaaggaaattttttattgccttatattgcttatatattgagggtttaaaaataataatgtatttaagtcatcaaatgtgttttttcttttattttgttaacgtggtagattatattaatatagctcctattatttattgaaccatcatctttccattcctggaatgagatctgtttggttacaatgaaaatctgatagaattttttgcaacttttctccttttaatttgtatttaaatatgtattcatagctgtgattggccttaagtcttttttcttctgatttggatttcagggttgtgccactgataaataatttcagtctctttcagtgttctgatgtagactaaattctaaagtaattttttgctgcttgtacatttgataaaatttacctgttaaatcatctaattctggtggcatttatttgggggtagacatgtgcacatttttaatttatcttacagtgtttttattaactaaggaaatcttatggtggcatgggtcatctgtttcgttttactgttgtagccttagcaccatgctagtcatataaaagatgcccagaaaattcgttgaatgaatccttataaggttgaatagtgcttttactttgctaaagttttatttgaactgtgttaatatttttcttcttctttttgttttttctccttaaagttccactcttgtcctggggacccagctttaactttagcatctggtatgttgaacttagtggcattgatgatcctgatatagtacaaccttgtctcaactggtatagcaaggtaggactgtgttttaaatcctgactttaatgcctataaaaggagaaatatgtcaatctcttatcttcattgagaataatttaaaatattcaaaataataataacaacagttagctaacattttattaagcacttccagtctgccagcttttaaggaatcctgataactcacttagtcattatcactctatgagacaggtgcacttattatccccattagtttatagatgaagaaatgaagaacagagagattaaatagtttgcctaggatcacacaattgtaaagtgtttgagccagtatatgaattcaggcagtttggctccacagtctgcttttatgttattatacccatttgactctgaattttgttttttcacttgtattcatataaatacttaaaacatagtttttagtgggatagttttgcagcctaatggaaaatttaagatgtggatgtgatttagactcctaaagtagtcaacagggtt

SEQ ID NO: 127570 - DNA, 1047 bp, Homo sapiens
ttaaaagagccaaataatgatacctaatgaatcaggttagtaaactgcttggcacatagtgttaataaatgctcagtgtagattagttatttttactgttgttattgtttcctacagtatcatctaaccaaatctcttctttccatacttactctgtgttctagtagtaccgtgaacaggaagctattcgcctttgcctaaaacacttcagacaacacaactatacagaagcttttgagtcactgcaaaagaaaaccaagattgcactggaacatcccatgttaacagatattcatgacaagctggtgttgaagggtgattttgatgcttgcgaagagttgattgaaaaggctgtaaatggtatgaaacttagattggttattagggtaaattcaagtacatacgggaaactttttctcaaaaataatataggcttatgccagttattactgtaattttttttcttggttttttactcggttaaagattgttatctctttggattagggacttctttcatgtaaaatagatccatgatgtaatgagacttaaaaaattgaaatgtacttgaactcacatataaatttaagttgtcatcttgggaaaccatgcacttacaaatgattaactagcattaaactgtatcagaaataatattttgatattggtagccaatattcattaacagtgtagttttgaggagaaggggggctagataataaaaaatgttattagtaaacaattatatataaggaacaaggagatttgtattgaaaacaacttccttgtggtgtgaatgctatataattgctgattttcttgtgtgacctgtagtctggctttgaaagaaatgtgaatagttgaacatctgtattatctcccagggtattggctttggagggtaacactcatttggatttttaaggtctgatgtgttttgttatttaaactaaaaagggactctgttgttgcttatagtatgacttttttttttaatcttcctcagtaactttcatagtgacaaacaacagaatagttgcacaatat

SEQ ID NO: 127571 - DNA, 1293 bp, Homo sapiens
tttataaatttaaagttaacttaaaatgaattgctttgagctccactttttgaaatatgacaaatctgcttctaagccttgtgcattgttattgcttacttgattgatgatgatacttgcaaataaatgataggtatgtttgaaattgagtatattttggagtataaacaaacaaataactaatctcttaacagactttaaaatgctaccaataaaaaaaaaatatatatatatatatatatatgccatttctaggagtgaattctgtgggttttttttaacctcataagatgagggaggcataggtaattttagggcttttttgtttgtttcagatatttatcagtaaggcatttgataccattttgtgaagggaaagcaaaacaacagccacaggcaactctacagttaataagctaaaaacagttatattttaaaggtctctttagtgacgtactcagttggttaagattagctgataaaaatcttgtgcagttttgatatctacagagacttaacttatcctttggctctagaaaggaaccaagtttagagaaattagtagttgctcaattcttgaaacttacagccacatcatagtttttgtactgtgaatactatgggctttctaaactggcctggaacactgttagttaataaacattcctttcagggttgttctctttgcttctgatctcattgatgatgatttgttggacaaataaggaagtaaacagtgcagagttttttggcttctgctctattaaaaacatagcagagaaggacaagaagttcctgcctgctaaataggaagatctagggaatcaaaagagtctctgtcaagcttcttgtaatggaggatacaaaagctacttttagtatttttagtatattacttagtatgatctttaagtattttctgtattttaagaaagtgtaaggctctatttatttctgtaataggctttttgtttgtctagaaacatcactgtatttacatttcattttattagaggtgattttggaaccaataattgctactacctctttgcccatgcaggatccagtgatgataggcaaaagtaatcacctagggacaggaatgttttactcagacatgtagagattgtactgaaatccaccctttgctgagcttatcttatttgctatagaaagaaaaattttcttttgtgagataagggaaggataaagtttaataaggtagtcataaagtttcaacctgaaatctctacctttctccctttgtctttccctgcttctttcttttttctg

SEQ ID NO: 127572 - DNA, 1078 bp, Homo sapiens
attaaatgatatttttctaggaattgtctataattgtctataatcaaaaatttcaaatttatgggtattaaggtatacctaatatcttactgtttgtttagtgtttgcaggatttcttgagatgccccttttttgttacttatcttgaatatatatatatttttccatcagcacatgtttatcaagtgcactagtctcttgagagaaccaatttttggtttgttcatcttttctgcaggatttcttgagatgccccttttttgttacttatcttgaatatatatatatttttccatcagcacatgtttatcaagtgcactagtctcttgagagaaccaatttttggtttgttcatcttttctgttatttcctgtgtccttgacttatgctctgtttactgttgtcttccttctctttttgagattaatttgctgtctttttataacaactttttaagccagatgcttagctcattagttttcagactttgaaaatttcccttatatacatttaaatatataaaatttcctcctcttgttctttagttgtgctatgaagtatttttatttttgttcagtttagtattttcattatgaaatgaaatggctctttggaagaactgtggtttttaatttacaaatttgtggcgatttactacttgttttctttgttagtgatttctggcataattgcataggggccagagtgcatatcctgtatgtttccagtcctttgaaatttaatgagacttgctatataacccagcttattcaatttttataaacatatcatatatatttgaacagaatgtgaattctttagttgttggagcagtgttgtatatttgttcagttggtcagagttgctaatcatattgcacaaatctttatcaataagaattttctgtctgattctcattactgagaaagatgttaacactttccactatgatcatcgaattatatgtttcctatagttggtccaattttactttatacattttgatgccatgtttttaattgaaaacaaattttaaattattttgaattaaatcttttattatgaagtgcctttttat

SEQ ID NO: 127573 - DNA, 1044 bp, Homo sapiens
atgattagtttagaaattgcaagtatgcatgattaccttaacaaaattgatcagtgccttttctctcttcccatgtgaggatttagtagactttcagcttcatattctcaccttctaattcattattctattgttgtcaattgctctattgttgtcatttattttgataccatgttcaaagaccctataaaatatttgtcttatacagcaattgttcattaattttacccaaatatttactgggttttttttctcttcattattgtttgcgtctttaatcttatgtctaggattgtgttcattccctgtgccgtaagcccatcctttagaatttcttctataatgcagctcaactctctcagaattgatggcctgaaaattttgtctcctttataggagggtatttttgctagatgtagaattccagattgacacttactttcttgaaatacattttgaatatcattcgactgttattaaccagcttccttgttgctgttgagaggtgtgctatcattttcaactgccattttttaatataatctttttccctctgactgtttaaatattttatatttgttttagattattttgtagttacattaacaaggctgtccgaaactccagtgtggcagccctgttaactattgtctattttggttttctttcaattaaatatatgttgcctttgtctatcatttattttctcctttatcttttttaactgcacatttctgtttaatattttaagcttctctaaaccctttatcccatttccactactatattatttttagtgtctctttcttacactttgaccttcagttctgtgatattttcaattttttcattcctcttttctctcatttctaacaattccatttttgtttcctttggttgtcttgccatttcttttccaactatttagatgtctactttccaactgcttatatctctaatctgtactcatgtttcatagagagagttgcttttttttatttgtggaataaatttgtggaaaggtatttggctactttcatctat

SEQ ID NO: 127574 - DNA, 2728 bp, Homo sapiens
tataaatacatacaactaggcagcagtactataatctatgtggatttttttggttttgttttctttttaattctgggcaagagatttgaaattttttccccttttggtgaaagcttcctaaatcatgttttttaaatcatgttgtatgtgtatgtgggcatgtgtgtgcaggcaggatttctgtgttgcccagactggttttgaactcctggccttgaatgatcctcctgccttagcctcccaaaaccctaggattacaggtgtgagccaccaggctgggccatcatgtgcttttttaagagagtatccactattattggagaaaagaacagcttgtgctcagtgaggactgtatgaaatatatttattatagtcataattataggagaaaaaatgaagtgatattggacctggagactctagttaaatagtttaaaaattattaacaactagttcttagtgtgctttctcctagtgatattttaatttcttttggatagttttaattttatctgactgttctgatctcttgctttagatttttgtcaaaaatagacttacagaaatattagcaactgcctgacttcttctttaaacagaaataatttttgaactcacatggttcacaggcatctttaaatttcttatttactaatttgtttctaagattttcaaacagtgtaatggatgtcatatttttatagatgagaatatcattgtttcaatagagaggctgacttttgctgaattatatatctaaagcaagcctaccaaggcaaaaggccttattagcaagcgtttgcaagaattagaaataatagggagcatggagattatttgggatgcagaggtgtcaactctttgtttttaggttgcgaaagttgcaggaagttcttttacattaaaacaaggtagtaaaagcaatgcatttttttaacctttaccctgctttagtatttgcagtatttactgactttttgcaagaattttgaaaagtctcaaaggcaaagaagaaaggaaatttggtgagcgtgcctgtaggatggaggtttccagttaaagccagctgaaaagtcttgaaagcgaaagggttggttacaactgagcttcataattacccagaaaagaaagattagggggagtgctctaaattggttggtctctggtgaatatataaatcgcagaaaacagttttacttttaaattgagtcacatgacagagtttaatagtaaaagtaactttataaattatgatctatttgggtgcatgtaaaagctagggtttctagcttaaaaagtaaggaaatgttattgtagcacatagcaagaagtccagaggtaaggcagatttcatggttggttgattcagtgatcatttctttctttctctgtgctgtatcatcattatagaattgactgcattcttgtacttcgacaaatttgctttaatatttgtatacattacatgcagatattccagaggaataaaagtagatttttttttctgtatgtctctttagaagtaaggaaaaattgcctagaagtctcccagaagattcctcatgtttcattagccaaaattgggttccatactgttcttaaactaatctttgttgagggccatgggagtagggcttcataattatttaggtgtgtatgtggggggatgtatgtagggagttcagtctccataccattacagtaactagtgtaacaacttaagtagattatgagtttatcaatacagcagaatcaggagtaaggaaaacatggtagaactttagtaccagccccaccatttaagagctgtgtgattttggttaagtttcttactttttttaaatacaaatttctggatttataaaacggagatgataatgtgtagttcataggattgtttttagaattaaatgagatgagacagcataaattctaacatttggtaagtgttccataagtatagttttattactgctgttagtacttttatctttatgtagttttgtactcaaaactgtataataatggaattcacatgttaaagttagtgttcccttttcctgaaaatgtatcaaggacctagaccaaaattattggagctctattttcttctctagttctcttggatatgggtggcaaaaagtactggcacaaagcactgttgggggaaagagattaggatccaatgaatccatgtcattataggatgtaaagattaagaatttcatagttgaaataaagacaagtggtgggagatcacaaaaagaaaatataattctcctaatctttagttatcctttcctcttcttaattatatttatgataatgatagaaatgattttttaaagatatataagatcttttttcaatgaagtagaacatttattcagattatttatttttattttctcctgcttctattttgcagccttaaattgtcttatgactttttttcccctcccagttcactcccttttccttctttcaaggtctctaaccctctgataatgtcacatacgtgtccgttgaatgcaacagtgactttgtatctaatacatacagtgatgatgagaaacatagtacgtttaatatgagcttcccctaaagcaatttgtttgcatggttgtgtcaattaatattttactatttatatttgaggtagcatgaagtgaaattgaagtgatgcatattttatgaaaatgtgcttttgtattagtgacatattagt

SEQ ID NO: 127575 - DNA, 1051 bp, Homo sapiens
gggggaggttttgtcacttcttcatctgtactcactgctttgccagataattaacatagtggaaagtgtagcaatttcttaatgcaactgtttgtgttaaaggaaggcagttctatggatactgagcttttttcattgtggtcttcatatattactaaggacttctctttagttgtgagaaagctttctcctgatagtattgcatattaatatgcaggggaaaattgcttaagaacctccataattgatgttacatgaacatcattctcctattttatcagtcatgtatgaggtaattttcttcaaagacacacatattatagcaaacagacagtaattgtgtatttgcaaactaatggattcaacatataaaatacaaacatactgaaaatgaattcattttagtgctttcttttttccctcagacctctcaggggtgaatatgctttctaaatctattcttaaagatggcgatacggtactgactgatgagggaaggaaagaagaaaagggcaaagcttcaatgataataaattgcacaatctaaaggcttaactattaggataaaggatttggagggaacttctggatgattagccgctgaatacagtagtaatgaaaagcttcagttttgtatcttattttctgtatataagaactgacatttcagtcattttcatagcacccttgtaaaattagtataaaattggatattctcaattttacattaggagaaagccaatacagggaaacttattagccaaagtaatatatttcaactaataggagaattatgaagaaagccttaggctttctagttcatatcaagtaagacattagaatcttacaaccttttgaactactgaaattaatttataacttttttttttttgagatggagtcttactctcgttgcccagccggagtgcagtggtgcaaactcggttcattgcaacctccgcctcctgagttcaagtgattctcctgcctcagcctcctgagtagctgggattacaggcacccaccaccatgcccggctaatttttgtatt

SEQ ID NO: 127576 - DNA, 1079 bp, Homo sapiens
aataacaggataaagactttgaacttgactccacacagacagtggagaagccacagaagatcttaggcagaggggtagcaaggtaacatctgaacttgcagcatacaggactgactgaaggagttgagaatgacagggattggaggtaaagtggcctatgttcgaaacggcaaacaaatttcattctaaaacactgagtcaatcaccaatcaatctatttttcattacttaggccacaaaaactaaaattcaaccacattctttggtatagtacatgtaccaatttggtaccagtataaaacaaaccctggagctaccgactaccagtagtaccaatctacacatcttatatgcactaaaaataatgtagaaatgtaaggtatataaagacatctcagtgtctttttgcacaatggaataggctttttatttttagtgcccaagtgcaatatctgtcttctactttgatttttaggataaatcagactgtgctgattgcataatcctccacaagatggcacactacttttgtaattaaatcagtttttccactctgacactgtataggatgtgtatactacgcattgacatagcctgggcccaaaacttagacaaaattcatgtatcaaaaagaagaggcaggggaagggttaacaggctggtgaaagaagttaccttaattcttagttaagacaccgagagaaaaaaattttttaaaaaaaggttttaagaaacaaatttatctttaagatagaaataaaactctataatatttagatagagtctgaatgcttctaaaagtgaagttcagtaagacttaaattaacatgacaatttttgaagacagaaatatttttgaattttttgaagaggggaaaaatattttatatgctctttacctttcccttcttaagccatccccttgaagtatcatgacccagcagatcatcaactgaattcactgcctccctttttaaatagaactgtattcttacataaagctatgattacaacactatctaaatcttttgggtgaattcaacatacagttactttccttactaaaaggctgaattgtt

SEQ ID NO: 127577 - DNA, 1572 bp, Homo sapiens
gtcggtagctccagggtttgttttatactggtaccaaattggtacatgtactataccaaagaatgtggttgaattttagtttttgtggcctaagtaatgaaaaatagattgattggtgattgactcagtgttttagaatgaaatttgtttgccgtttcgaacataggccactttacctccaatccctgtcattctcaactccttcagtcagtcctgtatgctgcaagttcagatgttaccttgctacccctctgcctaagatcttctgtggcttctccactgtctgtgtggagtcaagttcaaagtctttatcctgttatttaatcccttccatgatctggacacacctgtcttttaacctcctctccacctcctacctatgtgttcttttaaatcaaacagtgtatttattcatcacacagtttaaccatttaacatgcattatttaatttaatttaattctcacagcagctttatgggatagatactgtatcacatcttagagattaagaaaccaatagttaaggaactgtgtggtggtcacatagctgtggtgatagagccaggattgtagccaagatctgcctgactagagtacatgttcattaaaacacttttgacgtgtttttctgtctctatacttttgctattctttttactctgtttgaaaagccctcttttttttttgttctgtatcctgccttcctgctggtgcataggtcaaataccactgttaccatgaaatctcttctgagtcccctcagccagatatactgtcttccctcttttgaaccctcatggtgctttttaccttgtttatctttcttatgacatttagtctgccctgcgttatgttgctctatttgccttttgatattcttggctagattgtaagttccttgaggatagggactggggactatgtcttctttcttttgaattctctaaagtgctttgcgaattctcagtactcaaaaagtgttgaataaacattcctcaaagtgctgggagaaatggatagacactatagcctatatcccattcagaaaaaatatagagaaggggtgaaggggttgctccttgaagaggatcgtactaccccagatgtacatgaattattatagaacctataagcatgagaatgggcttccataaaccaatctactaccctactgcaaatattaatgctttcttttttctttctacttccttctctctacagttctctccaattatatccataatttttaaaggtctttgatatcctttgtgcattaaataataccttttctggtgtctgtttctggataatagttcttctttgcatgacttaaataattagatgaattaattaaaatttttgttacgcattttcattcaggtatgtcagaaggctcagtttccatccgattcatttaattttactattaaacttcagctgggaccacaaagctttcatggataggaatgacatcttggcttaattccattaggatgcttactgcgtgccagattttattttgctcagctatcaatgaggctgttgtggaaatgtgggttttctttgctgtg

SEQ ID NO: 127578 - DNA, 1031 bp, Homo sapiens
ttcattattcactgaagaagaaaatcagttttgtcagcggtaaagtctgtgaatataatagacatttcagagtcagaagaaaccaaattctcaagatacttagaatgacttaaaggataatttctgatgagttaaatgtaccacaatatatctggaaaaatttctcccagtttttataggaatatcaaagctgtggatcactttttcttaagatatctaattttaacttaaagctagttttaaccattgtttttgatatagcaatagagagaaattgcctttaatatgacttttttcaaaaacagctaaatgttcttatgctgtacttttacactatatattcctctgggggttttattttttagaatctgaattaaaaaattccatagtggataaaaagtggctgcattattaaaaagctggtaaatgtaaagttttcaaggccaaacacagaaactccaaaccagctgcacgttaaatttttctgggatactttacaaatacagacccatttttacccattgaaaacctgtggaatcagaatcttgggacatgcctcctagttatctgtatttttataaatctctcaaaataatggttctgcagcatccttttcatatattcatgcctaggaaatattagtctagtatatatttgagaaagttaccaggttaaaatttttattttaaaatttatttagatgtagcttcttaagtggccttagaaacagctggctaggtttgggtgcttatgcttattttgtccttttttttttacacatatttttctgattttcatagagactgtttatttgtttggtggctgggatggaacacaagatcttgctgacttctgggcgtacagtgtgaaggagaaccagtggacatgtatctctagagacactgaaaaagaggcaagttctcagacttttcatacatctatattacagaaggggcgtagatgtgcacttgtttttcggcatgattatattcttcactaatgtctgtcagcagtagtagcaatagaatttg

SEQ ID NO: 127579 - DNA, 1080 bp, Homo sapiens
gcactctccatttaaactgtttcaggatataaagtgacaaatgagctataacaaaacagtaggagcctcaaatgaaaaggagataaaacggcctaattcataacccactgattttgatctaggaaggccatttccaaagatctagtgctgtgtcgttaatcctggggaactaggttcttgcttactctgaaattatgttaataaaaactgtccagggattaatcactggacagtttttattttttcaaatagatgttgaaattctgatttacttttcttaccccgggaaagtatgtgtaagtggccttcctgtttcagtattgaagtactgttctctgaaatgattatttctgtcttcaacaacaaaagacaaatcttaaattaaaaaaaaaactaacttttttctactaaagtattgtaaatctaaggcgatgacatctgtaattattcttgtgttaagcctaggtttcatcctaaaatcctccctcttcttcagtgaatgtgtctaattagtgcctaagatccaacagttctccaagtgcctggcatgatccaacaggtcatccaataccacatttcaaatgtcttttcctctccattccttttagcagttttttcaactttatggtttcttacgctttttatatctccattgttgacctattctgtgttcaccaacacagtctttaaaaagcatatttgggctcggtgtggtggctcacacctataatcacagtactttgggaggtcaaggcaggaggactgcttgaggattggaggtggagactgcagtgagccattacagtgtcattgcctccagcctcggtgacagagcaagaccctgtctcaaaacaaaaacaaggccgggcacagtggctcatgcctgtaatcccagcacttcgggagagcgaggccagcagatcacctgagctcagtagtttgagaccagcctgtgaccaacatggtggaaccccatctgcactaaaaatagaaactagctgggcatggtagcaggtgcctgtaatcctagctagctgggaggctgaggcaggagaatcccttgaacccaggaggcggagg

SEQ ID NO: 127580 - DNA, 1077 bp, Homo sapiens
aattgtaaataacaacaacaataataaaacaatttatttatctcacttccttttgcttagagtaaaaactcgaaatttctcatcaagatttgctactcaattacttttccagcctcatctcccatgtgccagttaaagttgctggaattattcaactttctcgcctgtgtcctttggcaatgttgttttccttgtttggaattaacagagggaggctctccccctaactttacctaataaatacccacttattctttaaaactcagttcagacttcactttctctgtaaagcctttcttgaacttgccaagcagaattaaaagcttcctttgatgtgctcacttaaccccttttaatacttggatggcttactataatgattggtttatattcatgtttccctatctgaattccttaaaggcgtgaatcatattctttaaaatgtatgtattttaaggatgtgcacgttcttactctttagtgagtaagtaggtgaggtaagttaaatgagaaattaatactagagaaaagggaacgataaatacaaaatccagagagggtagggggtttaaaggtaatattaaatgttattcttctaaagcttggtatgggtagataacttcattccgttatttttttataccatatacatatgttgtaagtaatatttataatgcaataagtaattattttaaaactcatgctggaaaaatatagagattattttgatgagaacactttctgttagttcaaagtcagtacagatgagtaaagtggtgattcagtactggagctcagatttattatagttaattaatagactcataaaaacctccgcctcccgggttcaagcaattctcctgcctcagcctcccgagtagctgggattacaggtgcctgccaccacgcctggctaatttttgtatttttagtagagacagggtttcatcatgttgaccaggatggtctcgatctcttgacctcgtaatccactggcctcggcctccgaaagtgctgggattgcaggcatgagccaccgcgcctggccctcaagtggcatttttgtatagttttcta

SEQ ID NO: 127581 - DNA, 1002 bp, Homo sapiens
tctctcagcaaaaccaagagctagagtaaacctataactcccaatgccttgtaagtttagccagaaacaactaaaatactcagaacttttgttgaagcccacaacagtataatagggagacctgggaaagcaaagggagcctagcagttgtatgtcacagtgagaagtgtcagggacagggcacaaattgcacccagggcagccactagaagaatcagtgaattaacatgtgtaaagtacccagaaatatccagaggtgatatgtgtcagaaagcattattttgtaaaagtgaaggaaacacagtgggaatgatggctccttttgcaatggccagtaagaaacctggggagctcaaagcttgagatcagccctgtaagccagatgagagtcatagaattagagaaggtatggcttcaccggaagtgccatattttgaaggagccattcaattcagtagcaacagaggaaggagttcttgagcgagaacatccaccttctatagaaatcctctgtgaagttatctggtccagggaaattcaactcaattacatatgaaaaactaaaaagcaataaataacaaagctttagagagacattctaaagaaaaacaataaaaagaaaaataacaataaatgaaagttatatcccagtacattacccctttcagaaatgaagacttatctacaaagagcgtaaagaagaataggtaatgatcatatagcataggaataagataaaacaaagaggtaaaaatgattaaccagggaaggtaggcagaggagagccaacatatatatatataactggagactttaaagaagaaagccaaaacaatggaaaaaacaaatatttatcaattgaattcaggaacattttcctgaagaaagattttactccgcatgtcaaatgggcatactatattcagaaaaagttgacccaaatacttaactctaagacatatattaataacactgactataaaagataagagatcattttat

SEQ ID NO: 127582 - DNA, 1014 bp, Homo sapiens
aagggttttataaaaataaatgcagagaggtgaatttagcttcaccactcttatttgcatatctgatcgcttagtaaatggtagtaatattaataggatgcttgcctagaatgaaagaagggaatttttataaggagggtatgatcactattcacccagaatataagtattcactcttacatataaatcaacgcctcatgtatcattggttgattttgataaaaattatgcaatttcaagaaagcagaaagctctttattccaacatgtttttaccctcactgacaaaaatgacaacttgaaaaattatttagaaacttgcatatgataatcaggggtggtatttagtgtcattagggacaaagtttagggtttttttgagaatgtaaaactgtacatgttggttttgttttagcacatatgacaggaacaaactaaaactattcaatctgttgccttgttctgatagatgtgtatggactcagaaaaacatatgatctacacttttggtggtagaattttgacttgtaatggcagcgtagatgacagcagagccagtgaaccacaattcagtggcttgtttgctttcaactgtcaatgtcaaacctggaaacttcttcgagaggactcctgtaatgctgggcctgaggacatccagtctcgaataggacactgcatgttattccactcagtaagaacattccgtacattgcgtaaatgttattttgtcatgtatatctagataggaaaagaagtggtgaaatctaattctttaggaagagattagtgtagcaatgacagagaaagacaaaacttctttaacagtgaactgtttgctaattatgagactcttcccatcaacctggtaattcctaaatagttactacctggctaccaacctgggcaatcttatgactaatttcactgcttatgtagattttgtagctatgttcctttcttatgcctttccacttacgtctcttagtaattagaaggacaatttcttactctgttc

SEQ ID NO: 127583 - DNA, 1243 bp, Homo sapiens
ctaggactacaggtgtgagccaccatgcctggcctatttttgtgtcttttaaggttaaaatcctgcttcataacattagttgctttgtctgtctataatagctttcacagtaaagaaaactaacaacagaatcactgagtgctgtttaacgttgctttctgattatttttctgtttaggatttagacttctagggatgggtagtcaaaaagtatgtattaaaatcattagaaatactatttctgtgtctgagtatatctttatatacagataggtttatttgttggattttttttgcccaaattttagattttttttttgagttaattttgtcttctaattaaataaaagcatatacattgttctaaagtcaaaaccatacatcaaggtattatttttggagaggtcttcctgctctgttcctgccactataggtaactgtcttttattaggttttggtttatccttcctttgtttttcaaaaaaagaagcaatctctattctcgctctcgcttgcgtgctctctctctcacttttcccctctctcacattctctttccctctctccctctctttttgtctgatgcacagatattccttcttctccattcctacacaaaggaagaaggaacctgtatatattattctgcaccttgcttttcttctttaacaggatgtcctagagatccccttttagcaatatgtagagagcttcctctttcccttttattccagcatagtactccattgggatctgttataaaattacttttgtagaggtttaagtttttaaaggatcattctgagttcttcatggaagtgataagttactcctttctttttttttttcttctttttcagaaaaatcgttgcttatatgtatttggtggccagcgatcaaagacctatttgaatgatttctttagttatgatgtggactctgatcatgtagacataatatcagatggcaccaagaaagactctgggatgggtaagggcattgagtgatttcttctctcatgtcttaactactttaggtagaaaactgcagttcattctcttttctttctaatcatttttcaccctttctttatttctttaattgagtaattccaagtaagagaaagaaaattctaccagcttattcagttctatctatttttaaatatgggaattactatttccttcaagcagaaaatatgtgaatttctaaatgaattgtgtgtgtgcttgttggggggcgg

SEQ ID NO: 127584 - DNA, 1085 bp, Homo sapiens
cctcatcttctctctattcccattgctgcttcactatgaactagtttgggctaacatcacctatttggcctctgtctctagacttcctctccctatgtacccctccctgcaacccattctccacactgcaagcaggatacagctattctgtgttaccagtaaagaatagaaccatatgccttaacatttatagagcagatattttttggtcacctactaggtgccagacaataagctacgcactaggagtacaactgtgaatgagggccctatcttcatggagttatggttgtacacagagaggaaaaataaagtgacagccttacctttagattagtgctagtgaagaaaagaacatatttttaaaaatacaaacctagtgggttttcttcctcactttaaatcttttaatggtttctccctgccctcaggattaagtctaaacttaacataattcacagactcttttatgatgtgccccattttagttctccagtcctagtcttggtgtctgtactcttcttgccaccaactctgtttcacgaccaccgaatattaaatctttatagatagtgtgttttaacttgcctttgagagttgcccatgctattcctcctacctgaatcactttcctctcccctccaaaatctagctaacttgtactgcttacctctcagatcttagcttgtagatcgttgtcgcccaaaattctctaatgccttaagcccaggttagaaatataaaaacatgtggctctagccatcattgttaacgcaattctaggtattcatctggctgtaaaatcttgactgtgcttttcaaaacctatacaaagatcagctgaaatacacagacttgttcatgatttcttaaagagcattcagtggtttcagtactctagatctcctaaaagtcttttactgaactaaattagactgttcagaaaacctcacatcagaaccatggtatattatattgtcctcccatagaattattttacctcacttttaaaaagtacatttttttctctcttactagatttttattgtaagcagtgaaaagtacttttaagaaggcagaatact

SEQ ID NO: 127585 - DNA, 1067 bp, Homo sapiens
ggtcctggcatttagttgagctttttagcagttgaatcttaaagtttttaaaatcgtttatgttgcaggtcttttgtccttccctcctcccccgcaaatatacccattagaaactgttaaattggccaggcatggtggctcttgcctgtaatcccaacactttgggaggccgaggcaggcgaatcacctgaggtcaggagttcaagatcagcctggccaacatagtgaaaccccggctgtactaaaaataaaaaagttagcctggtgtggtgatgcacgcctgttgtcccacctactcaggaggctgaggcaggataattgctggaacttgggaggcagaggttgcagtgaactgaattcacattattgcattccagcctgagtgacagagtgagactctgtctccaaaccaaaaaaaaaagagaaaagaaactgttaaaaattgaaaagatagccttgttttcatcttgcaaagaaaatcagtacagaaaactattaatagttttgccatattagaatgaaagctgctttcttggttttgacctttagttttttttgttttttgataatgccgtttttatttaaccagccttcatttttattattataattattataaaagtaatgcagttcacatgatcaataaagcaaaactcaaataacatagaatgctataaaatgaaaagtacttctgccaaagtagcaaactgacacaggctgctgattcccttccccagaatcaacccagagaaataaaattgagagcagctggattccagaaactccttaaataagactgaaggctcactctcccccagattacccttcagttaatttttaccctttcactatagaaactagcagcggtagcctagcccactagtgtcagaattcggtgggcaaacattatgtcagtgcagaaaccctgctggagttcagagttgatgaaaacatgtggactgaccatctgttctcaatagttcatttcttcttctcttctccctttgtccagggagactgccttctccttcctctttaaacccttgcctgaagggtttaaaggtaca

SEQ ID NO: 127586 - DNA, 2192 bp, Homo sapiens
tgtgttagaagttaagtatgtggacacataaagcagaataaaggtgtattgatcttttcaagagaaactagtaggggctggatgtggtggctcacctgtaacaccagcactttgggaagatgaggcaggaatattgcttaaggccaggagtttgagaccagcctgggcaacatagcaagaccccatctctacaaaaaataaaaaaattagctgagtgtggtggtgcatgcttgtagtcccagctacttgggaggctggggcaggaggatcctttgagcccaggagttctaggctgcagtgagtcatggttgtgcctcactgcacttcagcttgggcaacagagtgaaatgctgttctttaaaaaaagaaagaaaagaaaggaaggaaggaaggaaatactaatctatctaatgtgaatattttcatcttatttttttctttaatttgtagttccaatgacaggatttacacagagagcaactattgatccagaactgaatgaaatacacgtcttatctggactcagcaaagataaggaaaagagggaagaaaatgttagaaattcattctggatttatgacattgtgaggaatagttggtaaggaactcttgtctctgctgcaatcccaatgtaataattatttgaggttgttggtttattcaaaaaagagagaaatgagagtattacgttaatttgtgacattgtatatttaaaagtcagtattggaaaaaaatcaatatcggtacctatgtatacaatgatgttcagtgaatggattttacctctgtgtttttcaagtagtagatggttcctggcctgggactcaagagaattgtattttagtctaggttccgttctcaagtagatgtgtgaacttgagaacagtgctgtttctttaatgttcccagatcttagttttcataaaacgaagaggcttgactatagcaaggaggggacagtattacttagcatttccaaaccatgacttttgtgtcatagagcatcccacagaactggtgctgcacattttgctttgggaaaacatggatccagctctgacattctgtgattgctccataagtgaatattgtgcagaacagaagcacttcagagagcttctccattcataatggggaatagtgctctgcagctaaggaatttattattttctaaataggacatttatttacagtcaaatgacagcaatgtatactgtacatttttattgtgcatacatagacaagatagcatctctttcagtctttagtttgagctttcatgtatgctgtttgtatttcataacaaaaagtaggatatgtgagctatttactggacatcaaaagaactttagaactcagttctaacaaattccgattgttttatgaataactagaactttaagatacgatgtgaacgcatttctaaaattttttgttagtaattagacatgcagttaatttgcttgctacagttgtattatctttgctgctaattctctagaatgccttaaaagcaatgtcttgcaggtcttgtgtctataagaatgatcaagctgcaaaggataatccaactaaaagtcttcaggaagaagaaccatgtccaaggtttgcccatcagcttgtatacgatgagctacacaaggtatcctaactacattgacctgtaaactttccatggcctactatctgaaacaatccccaaatatatctttgattgttttaaattggatttgagtaaaaagttaaaatacatagtagacattcaatagaataacaaacacccaatatcacttctccctaaaattccttaagagaataagcatttttacgtagtctgtaattcttggtacttttccttttttgaaaatagtcagtggcagcttcttagctgtatagatctagatacatgacatagcctattgtttctacaatgtgactatccaagtaaaatatgtacagttgtcagcatttaggtaccttgttccgtgatataacatggtttttggttttagattttcctattgtgtgcgaagtctttttaatcttaattttcctgatatactagtgatacctcttttaaatcagccttgtgaaatggtcctctgttgtgaatttttagtgtcatagtgttgagagttctttctttatttctgtcttaaacttaaccatgtacttaagtgattggacttaga

SEQ ID NO: 127587 - DNA, 1122 bp, Homo sapiens
cctgcctcggcctcccaaagtgctgggattacaggcgtgagccaccgcgcctggcctaaaatttttttaaagtttctagttgacctgttgactgttaacttttagtgattcagcatttatgtcagaatttttaagatatttgttatatgatcaatattgtgattaattttatccccattatttgttgtcctcagcaaataatatcttggattaacttcttcctatcattgtttttgtttcataccttccactgtcattgtagttatggtaatataactcactttggcatatgtgcagttttttaaagtagccatggtgctttaaagcaaaatagaaatgagaaaaatcaagagaagcttttggtaaaaatgcagtataatttttaatttttttatttgaatgggctcaggaagttaacctgttatgcactgctactagaatatcttgggtatgcatgcatttttaaaaatctggcttattttgcttattataggttcattacttatttggtgggaatccaggaaaatcttgctctccaaagatgagattagatgacttctggtcactgaagttgtgtagaccttcaaaagattatttactgaggcattgcaagtacctcataagaaaacacaggtatgaaaataattcactgaaaacatttaattaacattatcagctatatttctcttggcaaatttaataatgagacagtgtaaatactatgaagatcatgaattttgtaaatgccctgttattccacttatttttgctttcgtttttcaaaagaagatacaaaatacagatattgatgctaaaaatttataaatacagaacaagtgaaattttgcagctgttaaaaaaatggaaaataatttctgtgaaggtgacatgcctacattgaagtaactaaaagctaactacaaattagatcagttctaacttaatgacacgtgcctgagcttttgataactctcttaactgtgaatgtagtgatatagttgactataccatatcttcctaatttgatgtgtcacaatacaatttcaaagcttgtagttttatgtcacctttattattaaattgcaaaatcatttaatcaaacattttcatatatatacatat

SEQ ID NO: 127588 - DNA, 1049 bp, Homo sapiens
aagtaatcagtgttaatgatattcatttaaaaataccctgcttatttcagtttccaaggtatctgttaagcatctccattagaaaatacacaaatctaagcaagtgtttttatttttatgtctacttgttttggatgaaacacattgggattttctgaagttctgttttataaaatacgtagtatattcactttgtttggtagttggtttagtgctaccttgtagttttaagagaagataggaaatgctcctacccagtctctagcaccacagctgcctgtgaccacctggcattaccattacatttccaagaactccacaactacactatctacctggcagtattgttaattctggattcctaaactgacattttctaaatatccagaacaactcctcatactcagtataacagtgtattttattccaggtctgaaagacatttctgatattttctcataactccagataattatccttgtgtacattttctaggtttgaagaaaaggcccaagtggatccccttagtgctctgaaatatttacaaaatgatctttatataactgtggatcattcagacccagaagagacaaaagaggtaaagaaaggtggtaataaatttcagaaattaagtatttttaaatgtcttcctaacttatatttaatgattttgctcttgagtgtgtaaaggaaaacgaagaaaatatgatgacatcagtaatctttaaaatgtcacagagcaggtgaaataaaaattgaataggcatgttttcgtgtgataagattcaagtcaccaaaaacccttggtccattcagaaaaggattatcaggtataaagttttaacttagttttgtgttttggaaagcaaatagaaatttttactttgtccatagtcccatgattattttacttaaggattacataatggttcaatataaacttttctgtggatagttaagatcccccaagagaggaaagaaaactcccctgttgcttagggagaaaatgaagagaggttggtgggagttagaatccttggtgccttaat

SEQ ID NO: 127589 - DNA, 1033 bp, Homo sapiens
agagcaagattccatctcaaaaaaaaaaaaaaaaaagaaaaaaaaacaccatgccctcaccctaaggttctcctctgtctgctcttaaagaacagaaaatagaaaacattcctgacattgagaattactggtccatagtattaatattttgttttaaaatttgtgaacatatttaacttttaaaatgttttatatccaacagtctgtttggggggaagaaatcctctggtaacagttcacatgtatactcacgatatttgtcagtgagacatgtagatctcattgtaggaaatcattccactcattgagaaggggcttactgttcttcattttctatagtaacttgtttttgttctgtttatatgttttacagacatttaatgttattaaatgactttctcatttaagtctcaaaacacaaaaagtgttttttagattttttttttcacagttgttatgatcatcatcattgtgcctgttgtcaggacattgacagctgactatcaactatataacaaaaaaatgttattggcttcctccagtcttcagaacatgggttctgaattggtgatgaacttacaataaatcttataaaaaatgatatttttttctagaaaagccatgagaaaaggatgcctaatcaattataccactttcagagaagacttctataatagagaaggaatgagaataagttttcagctacaataacacattttatattcattacacttctgcggagtttccagagtgctggtgtcattcatttaacagttgtgtatcgattccccataataggtcaggcattctaggcagaggagctgtatcagcaaacccaacaagatccctgcccaggaggtacttacattttagtggagaaagacaataaacattaaagaagcaaattatatagtacattagaattgaataagtactgggccgggcacagtggttcacgcctgtaatccccgcacttcaggaggctgaggtgggtggatcacctgaggtcaggagttcaagaccagcctggcca

SEQ ID NO: 127590 - DNA, 1408 bp, Homo sapiens
tgaaagaaacgactcaaaggttttggcctgaaaaactggaaggatggagttactatcaactgaagtgagaaagttctgtggggaactggtttgtggggactcctgactggcattcaggagtttaaatttggaaatgttcagtttgagatatctatgagacagccaacttaagatgttgaggtgactgttggatatttgaatccagagtttgggaaagaggtctgtaatatcccttggtatgtgttaaaatccttaggccagtacatacagttcacttatttaatcagattgttaagataatagttttctccttatcctatatgtagagccaatacaatttatttttcaccttaggagttagaaaagaggaacaaattcaaccccaaataagtaggaaataagaaattcatgaaataggaaacaaacaatggagaaattttaaaagtgaaaagttggccttttgaaaaggtaaataaattgataaaccccaagcaagacttaccaagtgtattagcctgttctcacactgttgtaaagaactacctgagactgggtaatttatgaagaaaagagatttaattgactcacaggcccacaggcttaacaggaagcatgactgggagtcctcagtaaacttacagtcatggcagaaggtgaagggcaagcaagcacctttttcacatgatggcaggagagagagtgacaatgaggggggaaatgccacacatgtttaaaccatcagatctcatgagaactcactatcacaagaacagcaagggggaaattggcccctgtgatccaatggtcccccaccaaacccctcccccaattcaacatgagatttgggcaaggatgcaaatccaaactatatcaccaagaaaaaaagtgaaaacataaattatccacatcacaaatgaaaagagggcatcagtttagaccctacatatattaaaagtaaagtgggtatggaaaacttcattgacaagccgcaacttgatgaaattgacaaatactttaaaagacacagtttaccaaaactgacacaagaagaaatagaaaatcttaaggaactccatatctactacagagattgaatttgtaataaaaaattttctaacaaaaaaaactctaggcccataatagcagtaaattttatcaaccattcaaagaaggaagaaaaaaatacaattttacatagactctcagaaattagaggaaggcaatacttcttaaatccttttataagccaggttaactttgatataaaatcccaacagaagctgggcgtggtggctcacgcttgtaatcacagcattttgggaggctgaggggtggatcgcctgagcccatgagtttgagaccagcttgggcaacatagcaaaaacctgtctctacaaaaacatgcaaa

SEQ ID NO: 127591 - DNA, 3326 bp, Homo sapiens
cccaactactcgggaggctgaggcagaattgcttgaacccaggagggggaggttgcagtgagccaagatcgtgccattgcactccagcctgggcgacagaggaagactccatctcaaaaaaaaaaaaaaaaaaaaataccaagactgtaataaagtgggtggtctctagaacccagacctttacttgggtgaattttcaagggcattttcatcaggataacttatgatagcttcattttttaccaagataatcgtcttgaagtatggaaattcccagctttcctctggtcagtgaatgcatattaatcccattgatgctggtgcagttattatttgccttagagttgagcaatagtattgaaattttccattgtatgtaatataaatactattttttatgtttggaataaaataacactttgggatatcaatttagtttcttcattatttgaccttttatctcttgaaagtgaactgtacctcaaagaaaaaagagtatatataattctggtgcttttcactgggatgaaaaaatagaggtgttcttgaggtcttgccctttatccatagcgagtgattgaggcttctcgactgatcaaggcaactccagtcctaagttctaactccagaatatgtaggattcctcaggactagactgagcagactgctataaacgtgactccagaaggttctcctaagaatttagataatgatttaccactattcatacactcgagttgaagaccttaggctactagaaatccccagtctgtgagctggagaacctaggtgtaaacattattttggaaagttcatgcccttctgaattctagcatttgaaacagatgtactgatacatgaattgggggtctggcatatattctgtttaaatgattatgtgccttatgtctgataccacagcccaggcccattattttatttattagtgcatagcactaaactatctctaactgacttatttttagcctttagaacaagaatttcttggcagcaatttaaatatatcaattagggtggtgtcagcaaatattttaccttcagcttaactcctttcttttgactctgacctattcactgccaactaatatattttgtcaggaatagtttgttttatttggattctaaacaaacctcagatatactgagaacaatacaaacacaaaaagagaaaaatacaagcaggggaaattcctgtgggatgttgtttcctgtcttgtctgaggggaggtattatatagcctagtgattaggaggttggaatgtgagatggtggttgagagtcaggatctcttttaaaagtgatcttgagcaagttatttaaactttctaattatcagtttctttatctgtaaaatggaggtaatgggaatacttacctcaaattgctgagagaattaaatgaaataattctgcaagatagttatcacagtaaagcagtaaatgctccattcagggtaccattactattgactgccttaaaaatttaatcttctagccaggtgcgataactcatgcttgtaatctcaacacttttggaggccgaggtgagatgatcatcttgagcccgagagttcaagattaaccagagtaacatagcaggatcttgtctctatttttttaaaaaagtcacctttgtaacactggtgaatttggataaggagcaaattcagattgtatgctaattttaataatgagaaatttgatttagtatttataaacaagaagtacttttcataaggtttcatgcctatttagagttcctggttcttgttcttattaattttctgtcagactgttctatctttgtgccaattagaatagaaataaaatgggttatttactgtacctttcattgtataaatgaatatttcattttctaaggtctgcaaaaaaaaaaaaaaaaaaacctcagccgaactttctgaatgacttcctccagaaataatccaatttatgttcatcccttagtgagaattaaataaaagtattaatattgtatgtaaaattttaaagaatcagaaagatggaaggtgacattatcttagttttggaaaaatgagtgatctcggagaaaatctccaaggatcttgattttagagcttctggtggctataggcacttttaaggttgaactcagtcactttgctaagtttaagagctatatcttatttctagaaagtatgaattggagcaattaaacttattttcagcagggtatgtgacaagtaggaaaaatctggtctgtaaagcatgttgcctatttatttatttattcattcattcattcagacaggatcttgctctgatacttaggctggagtgcagtggtgcagtcatggctcactgcagcctggacttcctgggctcaagcaatccttctgcctcagcctcccgagtagctgggactgctggcatgcacaaccatgctgagctaatttttttttccttttttacattttttgtagagatgagatctcactgtattgcccaggtttgtccttttttggtcctcacaactctttttagaagtttacagtccaaatataaagtttagtgttagaaataagaagtgtacatttaataatgtgtatgctaggaaaaaaatgagaattcatgttatttctcctttaccacaagtaggaaaatccagctacgtgtaggatgttaagttaaaagtatattcctagccaggcatggtggtgtgagatggaagaatctcttgagcccaggagtttgaatccagcctgggcaatgtagcaagactccatctctaaaaacaaaaaattactcctaataggtcactttctttttagagcagtcattgtcatcagtcatactactagtgatatgctgatagctaattaatatttattgagcacttactgtggggccaagtgctcttctaagcactttgcatgtcttaacgcatgattatccccacagtagccctatgaagtagctactgtatgatccccttttgtatatgaagaaactaggttacagagaggctaaactaacttgcccaggcatagtgctagtgaatggcaaaccaggattaaaaccctgtcagtatggcttcagagcgccttttctaaaccactaaatatgctacctctcactgagctttaccagtttccactgctcaaatggttacttcctctttccattttactttatttatgaaaataaagtaagataaacatagtgattaggagcatgaggtttagaatcaatatcatcacctttttgtcctagcagtgccatttaagtagttgtggtactgttgatgagtttcctagatcccc

SEQ ID NO: 127592 - DNA, 1685 bp, Homo sapiens
gttgaaaaagaagcaatttggaaatttcaaaaaaaaaaaaagcataaaataggaagactctaatctcaccgttcagagataacctttgttaatattttggagtatttctttccattcatttccatgatccgatagtgggctttgttaaactcaagctcatctcaagtaaacattctccctcaaacttaaaacaatatatttttaaaaaataaaaaggaatgtgctgttcttgaggtattgtttattttccttccaggaaactggtatccttggcaatgttatggtctattcctgttcttttacaagactaaaacaggttggacctaaaatggtactctaagttgaatgaaaagcagtctgatctgaagtcactttcactgaacaccatggcatatataactcttgatggctctgtttctgtttctcatggcatttagcagcgctctcatgtctcagctatttcagggataggggaaattatttattttattttatcacttaaatatctcatttgtatgtaagaaatctgaagcagctgagataaaccaattgatgaagacagcatctcactgaatattcctttagctggaatgaacttgataattgaatgtttattagaggttaagggaaaaatcctttagattaacagtccctaccttttaaaaatgtcatatgctttctaatgtgtatcaggataaaagtagttcattgccttattcctcacataatgtgtgcctagcatagggcctggtacatagtagcataaaggtatagtgttatgtgcagataccattctgcatattgtacatgtatctccctcagtcgtctctgttaccactcagttccctgagactacttccagctgtctcagagacattaatgattttagactaatttctaaagacctctttcattttgattttattatatttttgttactaaaaaacttttttagtggttcagaagcattaacaagtcagaaaagacaagtggaatttcctcagtggaccagcagagaaaagacctaataaggaaaaaaagagagatcagtattatttgtaactaaagtgccagtccttctgctagacgcttttcatgtaactacatttaatctgcacaataactgtatgaagtaaacaggattatcacatacttacagctgaggaagcaaagtctgaaagccagaaagtctgactaatttatctaagatcacaccacagccaggtagtagaactggggtcagatcagtagtgtctgcctggttttgaagcctgatttgatttctccattataaaatacattgctgctggtctcaactagtttttctgttacatgttttaaacacaatggatgtttctttgtatcttcttcaccaggcttttctgatgtggatcacacctatgctcaaagaactcagctctttgacaccttagtaaatttctttcctgacagcatgactcctcctaaaggcaacctggtagacctcatcacactgtaactgaagagtcactggacacagaaatggaaaacaggagtcgattttccgtcttttggattgcagctccactgactgacagtaaagctgcagtgattgaggactgcaccagagttctgaagggatcttaaccatcacaagtttttaccctcttccttcatgcctgacctcaaccccgctctcctcatcc

SEQ ID NO: 127593 - DNA, 1099 bp, Homo sapiens
atagcaattttaggagaaaatgactctttcgtccagaagagctctgcagaaccagggctcccgtttatcttgtgctatctctgtagtattttcatttgagagaggaggctgagtttccagagctttgctttcatttatttttatacacattgtctctctatatctgcttgtggatattgttattttgaagagaaatggtttgtggttgtccagtggtatacaactgacaggcatttcattaagcacatagaccagactttgtgaatggttcagatattttttcattaaaaaacaaggtatggcagatggacttttccatgggtcaaattttttgtgtgagagatagaggtacatgtcttctgatgatgtgctgtggaatgcaatgtgggaaacctacatctggctagtgcttacatttgctcaaaaagcatgttgtatgaagctgactgccaccatgctaaagcagattcatattaagaagtgtcggtcgatccagtggctcttaagagtgaatagctttatggaatcaagtatgtccctgagtagcaagattaggcctcaccaaagaagaaattaacctgcactttcaaaaagtaccatgtataggaatgaaacattgaggtcccactttattctgtctttagtacatggttttacttattttggggatggatagaaatatatttttgctagttctaggcttgaatcatgggctccttggctttcctagcatcccaaagcagtcaacagtgatttcttaagcaatttgatctgtacctttacttgtgaaaggtatgctatataattcagcaagtaccaacttgtgtagctgcagaataaccaagtggctatccagtcaagtaaatacagtttgcttacatacttcaacagtttcataaaacgattcccctgagtgacacaagaacataaaatgttaatatcactaatatagcctgttaaatcttttgtggagacaggtgcaaatcagaagattgacaaggaagaacttgagcttgctaaataagacttcctaaatttaaaagctctagttttgcttagtgtgaattctggcactttaaaaagattaagcaagtgaaat

SEQ ID NO: 127594 - DNA, 2531 bp, Homo sapiens
atgtttaaatggggttgaatcatagcgagccatttgctcttgccaaagtgagatagatgtactgaggagataattgaaaagtcagactctgtactgtggggctttaatcggagcactgctggaaatgattgcagagaatgtagtgcttcatatatccatgaccaagattgacatgttgctcacaacatgtcacaatttagtgaggagctacatgtatttccaagaattccagcatagattataatttaaataatcgaatttggtatttaggtacattgtttatatagccaagtgtatatgctttactacctaacaattattctagcctaggtgaatccctaattgaaacacctggctaacactttagacacataaattaagtgggatacagttttctcatttgtattatctccagcttcaacctcatttatcctttttcctagtataatacattgttttcaaccagaaattaaagtagatatccaacattattttcagtgcttgtacttcatgagaaataatctgattttcaagacacctcttaagtgcatttgcattttattttggtaatggcagagacctcatgtggccagtttgattgattgaagaatgtatcactcttattcaagcaaaggaattcagacttaaatgcctacctctgtgctgaagctgacagacagtattaactcttatcaaggccatcttttagacctgattttcatttatatgaaaacagacctgtccatgtctaataagtaaaaactgatagaatacattaaaaagtcactggtttatcatagaaaagtttgatgggtttagagctcagtgatttaagcttgtaaaactgcattcttgggcaaaatatttatattgtatataaatggttggcagcttattccagttgatctcttcacatctgccttaaaagtgctatgtagagatacattaacagagttataataaaacagtgttttaaaatctagcctataaacaaaaactagtttgaggcacccaagcatttagtgagagattgagaatgatgcttaatggatcaaaaaagcaattaggagtatgttcctgattttattctctaaattatactcaatttcatggtaattacatgaagaagttacctgcaattattcttaacactacatggaattcactgggtaattgtgggtcatttatttcctgaaagtcacgtgaaatccttagctggttgaatgttgcacagtatttgagaattacggtttgaagtgatttctgtgggagggaatcattgcaatgtatattctaaataaagtcatctaactattaaaaaaaaaacacccttcctaacccttcttttcttaaaattccacattcatccacaatctcatccctttgtagaaattcttgcctgaattctcaccaagttttgaattcctaaggtagccccgatctaggatgtgaaggctgcccagaaaaagtttatggctggaggagtatcatacagtgtctacatatgatagtacttacagattaggtctttggatgctttaacacaaaagatttttgttatccttattagtcaaataacgctattcttttgtggttctagaccctggcttctatctccctgtgatttgttttaatgctgaaatgacttggctatccaaagcttctagtctagaggtctgttggttgaaggcagacatttccaagtttgttgaaataatacgaagctgactagcttacgtgaatgatgttgccctcatttgttttgggtgaggactcattactgcagtatattgatctcttcaccaaatgctttttctttttctgaataaatgctgtattagaggttctatttatatatgatttttaaaactttggtttccttctatccaccaaatactgtgaattgtttttccatttatttttcttagctaatgtaactttattcttcacttttttttagccctagacttcctagattttctgtggcattctgtaggacattgtattgcttggaaaaaaaaagatcaaaatcattctggggcaaatgctctattatccttatttatgacaagagaataatgaaattcataagaaattaataacattcagatattgctataaatgtacttgagtcattttcatttggggatagtaataatggctgtggcagctttaatggagaaacctgtgttggcctctttttctggcattaggatctcttgtcatagaactattggtaaagtacaggtttgatagcagagttcctgaattcagcatatcatcagaatttccatttaccttttgtcttttctttttattgtattttttaacctttttgtttctattcctacctcccatgagtaacattgatttctgctgaagttagaatttgtgttaagaattgactttaaacttctgaaatagttgaatattagaagtggcttcagttgccatgaaatgattgcttttctttttctttttttttccttaaataaaaataatgcagccttatatatgtctcttcccctcaa

SEQ ID NO: 127595 - DNA, 1443 bp, Homo sapiens
ttgttttttagccaggtgtggtggtatgtgcctgtagtcccagctacttgggaggctgaggtgggaggatcacttgaacccaggagtttggggtgcagtgagctatgattgcgacactgcactccagcctgggcaacagagcaagaccctgtctcaaaaaaaaaaaaaaaaaaagaatgtgaatttagctccaattccaaatgactaactcttaggccagtcatagccaatgaaatcatctgacggtagcttctgtagcccttaacctaaggagtcattagaggttatagtaaattagtttctctagtggtgcagagagaaatgccatcggggaaattatcactgtctttttggctaaagttttatattgtgaactggatcccacttaacagcttaaaaacacaaaaatgaaagggtagtcctagtttatcttcttaattagaatcattatttggaaataagatttgcaatgtgctgtctatccccaaacactgctgagcttgctggaaaacagaatttaacatgaatgttgtctgaaagctgtaggatcaatggcaaaaaaggggaaatgtttggtagggaattggaccagttctaaggtatcacttttaattataaaataatgtcttcctttttatctgcttttcagacagcctcagtgaactattaaacatttgtgtgcaaagtcctattttgcttatctaaggcattttgacttggaagtattaaacttcaggaacgagctagagaagacaatgagggtatgttagagaaggaaaaataggagctttttgcttatggattttagaggtccacaaatcgaaaggaaaaataaatttcttcatttctaaccctaaaataattttgttaatgagatgctgggaagaagactaccaaaaggcctcaaagctcatgcttctagaatattcagtaattctgaatagtctttgggaagtagcatttcttgggaagtagcatttcccttcttccaaataactgtttgagatcttaaaacagaaaatccagtgttaatgggctctagatcttaaactaggtgagcagcttcttacatacaaccagttccttgttaaggatccagcaggaaaaccagccataaaacatttcaacatgcagtttgggggctcccttgcttattcactgagtttaagctcttgctgcaacatagctctgtaccatctgggatgctagcagtcacagcagttagctcagatatctgagctgtctgccacacaaagcctgaggagatcatcattcttcagtttcattcattacttaatgaatgccaaattaattggcaggaagaagaaacactgtgtgatatactgaacaagcctgtgtgcatgaataaggagccactcaaaaagccaattttgagctttatttctccgttgttaacaaatctcaagaaagcctttgttacag

SEQ ID NO: 127596 - DNA, 1697 bp, Homo sapiens
acaaatcatccgttcagaaaaataaaagtggacttcctttcctaagcattacaattagcctgggcaagaggtgttatgattgtcttattctttaagccggcttactttttggatttgtgtgaaatgtcttttgaaaagaaagtagatagtatagtattaattaactactttgtatagtcttctgcataatttagagttgaaaataatgtaacattttcctgtgaacagattcctttatgcgtacatactttataaatatacatacatacacatacacatacatttttaaaatgctctttttaaagagattcttatcttgctcccactccaaaagctatgtacagttgagttattagcctcagaggaagagtacaggaaagcgaagatgaggacctccttttcttgtgttggtcttgggaacaaacagtattccgtctttcaaatatggcatatttctaaacagtttgggaaagatgttagaattttttaaaagtcagctcttttataaattggaagtactcagtagtcagaaattaagatcccctctgatagagatagattctcaaaaccaaaattggactgaaaattagattgagaagaaagatacaacttcctccatagccaataaaatctgtctttccaagtctgcttattaatgctgtgaatcgctccttctgtttgtgaaaacatctcctggactggaaatgtggtgctgtaaccagctgagccgaaagttggagaatgttaaatatcttatatgggacttacgataaaatgtattgatgttagtgattgtcaaaataggtttatcatttaaaaaactaggaaattactaagtataaagaagaaaaaccagtattaattaagtgatgagacctgttcattttgttttccctgacttatttccattaccaaacatagtaaaggccagaaaagattaaaaaaaaaattaacacagccattccattgttttttaccacatggagaaaggaccaggctggaagcatatgtccccccacccttatttatattcctttgagcattgccgttttctagacagacaatccgaaaataattgtgttgataggtctgtttaagcctgaactctgggtgtaaaatgttatccagaagctatagggagctgccttgctcaggtcattggaaatttcaaccctaagactcattggaatttctaagtccgttatgcaccattatgggcatatggagcatattcataccatgaggaggagtctttgtttatgatggactttttaatatggccataattaaactcacactcaaaaaggatgagctattgtcaaaagccaaaagaaaaacagacaaaatgaacatgaagcaaggagtccataaaacaagagttctttaccacgtttaagcaaatgtctctcaaaaaaaattgtatttctgtgcacattagctgagattcacacattttgcacctcagtagtatttcagatgagactcaatgtgtggagaaaaccgctaacttgtttggttctactcttaccccctcttctgtggcaatgtggggtcagggccgtatcctaaagtatccacatggtcttaaatggaaatcatgggactctggaaagctggcatgagctggttggagcttttaaacagaagtgctttatgggtatcagatctcttctgacatcaattgtttcaaatcattg

SEQ ID NO: 127597 - DNA, 1383 bp, Homo sapiens
agctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttcaagctctagtagtttcctcggacttcttaaagccttcacttgtgtatgaggctcatcgccaaagtgcctgagaatgtcggctcacacccgtagcacaggagcctccgtgctgagttacacttgtccaactctgcaggcaaagaaattaggcaagagaaggagagaaaccggaagaaaaaaaaaggggg

SEQ ID NO: 127598 - DNA, 1230 bp, Homo sapiens
gcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggc

SEQ ID NO: 127599 - DNA, 1017 bp, Homo sapiens
taatcctggcttcgaatccctgccctgccattgttggcacaggaactcgggcaaatcactgagcccctcggagcctcagtttccttgtttatgaaatagggatgatgccgattccttccccagaggattgtgaggattcagtaggaaagtacctttgaggcacccagtcccttgcacaaagttaagtgctcagtgaacgtttgctgcggctgctgtgactttgccgggttattccactggcttgtcataggagtccacttcttccgtctctgtgggaggtaagaccaaagaacctgggaaaactattagagcaagaaaagattgtcctcttctcgcaagggtgcactcatcttttctcattaccctcgttttcccaatgacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggtaactccagcaggggtggggcaagtaggagaacccagactcgggtagaagaggctttaagacaaggttttctgttctttcctccaacgcagggcccctggctggggctttgagcagcacttacccattccctcctccctctccctggttagcctggtcctggcttgagctgccctcaagccacgcagccaggacatacctggctctggaatgggtccagccatgcctccagcttgccgtgaactctttcctatctgggtcaccccttagttggggggaaatgtcaaagattccatgactattagcccaaaccttaatctcagtggcttcttccaggcaaagtgtgaggatcttgagacacagacacagagtgagaagcagctcgtcctgaacctcacaggaaacaccctctg

SEQ ID NO: 127600 - DNA, 1036 bp, Homo sapiens
cctcagtgcggggaggcagggttagttggagaccgcagttttagatgaaggtggccagggtgggcttagctaagaagccactgagatggcgccccctgccttcctattcctgcctggtgctcctcagctcacccctagggggcactgcccttcactttggggctttgagtcaaaacagactttttttttttttttttttttttttttgagacagggcctcactgtgttgcccaggctggagtgcagtggcacgatctcgactcactgcaacctccgcctcaggagttcaagcgatcctctcacctcggcttcccccatagttgggattacaggcacctgcccccaagcccagctgattttgggatttttagtagagatggggtttccccatgttggccaggctggtcttgaattcccggcctcaagtgatccgcccgcctcagcctcccaaagtgctggaattacagacgtgagccacagcgcccggcccaaaacaggctttctgaagccacctgcaccccgatcctggcagccccctaggtggttagcccataacgtggttaaatgcagtcttccacctcttggctctctttctacctggataaatggcgcttgtgattgggtaatcagctcctggacacgcccactgtacactccctcctagccctgggatcccagtctccctttcactttcctttctcagatcatccaaccctgagcctaccccctctcttgcaccaaattcctcttgatgccatcgagccaggcagtgaagcaggcagtgacacgatgttgatctttctatggccagctctccattttccttctcaggaaagggagggcatgggggaggtgcatggagctacagtccaacaactagagaaaggaatatttcctcacaaggccgaaaagtgggaggaagataggaagggaaggtaggaagtactcacagatctgccttgggggcattgctctgtgcctcagtttacccacatggtaagtctgggctagcaccatatgaggttttttattttac

SEQ ID NO: 127601 - DNA, 1059 bp, Homo sapiens
gcatcccaagctcttgcattgtctctgagtcctggccctgccctgaatcgctggagcagcagcaagcacagaccctcagctaagagggtcccccagctaaggttggcccctgggccacctccaaccatccccacccccttccccgacatatatcaccaccaccctctcttcttttgtagccttattccccttgggaataagccacctcacacttccgaggaccagggtgtagggtggcacctcgtccaccaattgtcatggccagaaggctatgtatgtgcctccactcagggggaagagaattctaaggagcggctgagagaggcttgctatctggccctggattggggtgcagggacctcccagagccaggcccctagggatgtgtggactgacctggggtctacgctgtctgatttcttaaccttccagctacctgaccctgatcagagtagaagggacggcagttaagcaagccggtgaggagggcactctgtaatttttgaacatactggctgtgtgtgaggctgaagccacagctccttcttacctgaaattcatggagctctgcctgaggactgagtccctttggtctccatccagccaggttcccatgccaacctactcccaacacactgattggaaccacagagccctccagctggggtagcctgcctttgcatgacctttatctcacagaccattccagagaggagaaactgaggcacagatgcaaggacttgcagtagatcatacaaccagctcttctcccaatatgtacgtggttcactccctcacttccttcagctctccccatgaatgccactttctcaaagaggcctaccggggctgctctgcttagaaacccctcccccccagcacactcttttcctcctactcgcctttattttctccatagcactcgtcacctgatatgtgttcattggtttgtttgtttgtctgtctcttccccgttagactgtaagttccatgagggcagggacttccattgtgctgtagccacagcacctagaatagcacttagctcaaagtagctgt

SEQ ID NO: 127602 - DNA, 1092 bp, Homo sapiens
gggagaggatgatgatcatgatggtgatgatgatttgcatgtattgaggccagaaaaggcttgtggggggcatgttgcggcaagattggtctgttcagtagctatggtgcattctacaccaccctctagggactcagtaaggccagctccatccctgtccttctgaaggtgtggtcgcctgggctgctgtcatcgggaatagcataaacactgccccccatctgctggaatcctgtgatttgattcaaagcaagaaagatttatagctcgagtctctgcaacaaaggaattatccccagacaggtccatccctgcccctctcccccagcttaccttccaatatatgggcagattatgcagcctacagcaaagaaagcattcaccttaagggttggacaattcatcagaccccctttcagtgctttttggtttgataaccatctggcagaaccacaatggtaagtcacatctccgtgcctccgtttcgttatttgtgagatagaataaaagaaccaaagggacctctagttccaccatgataagatatctggggttccgtgttccctcagctactgaaaggacaagctgattcagtactctcaatctgatgttcaatggatgaattctgggcaacagaaaggcagcttggtggggtggaaacactcagactttgggtcagagagatgtgcatgaccatggacaaaatagtggacctccctgaacctcagtttcttcatctataaagtaataacagccctaccttgtgggttgctatgaagatgagcgagtatatatatcatgggcttggctttacgcccaactcaggatcaacactcaaaaaatagctatgatgattagtaagcatatatattgagcacctggtgggtttaagggaccccaggcattgggatcctgccaatgtttgtgggtatcagtggatatatgataataaaaactgaagccccagtgccactctgtgggagagggaggcatatggaaaagagtataagatttggaaggggtggtctggaggtctggagaaagcttcctgaaggaggtggggttttcacatagggattttaaaattaaaag

SEQ ID NO: 127603 - DNA, 1024 bp, Homo sapiens
caagaggaggaaactaaagcccacctggcaaggtgagggctcggctccgggttccccagccacagagggcttaagcctggccctgccttaagctcctgggagcaggggctctttcctcaacctttcagctgctgcctgggatctgaagaacttgccccaggaaagccgagtgggtggggttcccccctggtggggtgggggtgatttgtgcaacacacgaaggtagggacacagaggtcgaacaggggccagcaattgggatgcctggcagatccagatctactggctgcccctcgcgtggtctcgttcctctcttccttcatctgtgtgcccatggggtgtgttctgtgttgccttctcctcttgcctcctgtctcctttgcctcctcttctctctccctcctctgttgagcactaatgctggcaaggagcctgcccttgcctcctgatccattttggttcccagtcagttttgttctgcagtcaccagcatggactgcgggagcactgtgaggagtgaggcacccggagatgaggcttccacctggcagatactggtatctatggggagagacatccatccaacagatgctcatgtgacagtaggcacatgccagactctgggctaagcatggcctgcccccggctcaccctgtagtggggagatggacacgtgtacaattaaatcaggtattaaagagaagggggtgagtgctccaggggtgatgatcctttgtaggaacagctcagctctcttccttccctcttctctccctccccttcatcctccgtctctccttttctccctccctccccttcatcctccctctctccttttctccctccctccctctctcctttctttccttcctctcgtcctccctctctactttctttccttccttccctcattctttccatagtctcaaatatgtccattgagctctgaaccttaattgccagcttcttgccagacacttccacctggatgtcccacggacatccccaggcagcatggcccggc

SEQ ID NO: 127604 - DNA, 1074 bp, Homo sapiens
gtctactttagacatccactctgtgtgggggtgggagagccatgaaggaatctgccaattgccttctctttggaaagttcctcccacctcaactctcaactttgtataaacttgaaaaatagaattggaaggacagagaaaaatgaagtttaggaggaaaccaaaagttcttctctggaatcacatggccaaggtcttggcttcataatctaagtacaggtacccttcctcaccagggaggaactcaagaagagggtggcaggctgtgggttcagcagggtttctatcagggagctggaatagagggtgccagctccatcacccctgctctgcccttccttcccaacaagggcaacttgagctaatgagcagaatggaagctgggagactgggtgctggtgtggggtatgaggagtgggggacaggaaggaagaatacaattttaaccattattcagtaagacacattccccatgctggcatcactcctccaaattggcagtaattggtgccctcccaccattcctgccaattgagcagcagggaggaaagatggcatggggagaggagctgcctctcctctagagcgtggattctagatccaaactgggcaagcatgggagggcagtgaggatggcgcgtggcgaggaggctctggtggggacctgaggacacccaaaggggtccagtctctttcccctaaggagtccctaaggtgcctccttaggactttgtcttatggagactttctgagaaaggccaggaaacagtcttgtttgtctgagaggcagcatcattcagaggtaagcaggtagttaaaaacttgagcccctggttgatattgcatctggctgggaccctggacctagtcttcttggagcagggttgctacttggaggtagcatggctgattatcaatatgggatgctgccattgagaaggggaaggcatggagagaccaaccctcttgccagaggaggaactgtgtgggttaagagaagagtccacagatccttccgggtgcaaatgccagaagcatgaagggggccacctcagtagaagacgctctggtcga

SEQ ID NO: 127605 - DNA, 1021 bp, Homo sapiens
tccacttcccaggttcaattgactctccttcctcagcctcccaagtagctgggattataggcaggcaccatcacgtccggctaattttttgtattttttagtagaggtggggtttctccttgttgatcaggctggttttgaactcccaacctcaggtgatccgcccgcctcggccacccaaagtgctgggattacaggcgtgagccaccgcaccaggtccagaccatagattttagcaacaaggctgtactgctccactgtggcctcaccacatatggctacatctccttggagttcattacaatggactttgaccttcttctacactgcacaaagccttgtataactttctaggtggtacctttaagagtctagaatctagcagcagtctgttttcaacagctgtgaataaaggtgagcatcactctgtcacttgatgagtgttgaattagttaaaaaaaaaggcaacagggaaaaaaggagattcgacatgggtcatttttttgttaacagcaaatgatctattgagtcagtactcttgatggtaaggtgaaaaatacaaaaattatgtatccttctgaagtacctgctctcagtaactcactttcatgccaagagcaatgaaacaataaaagagctgatgtcttgtgttatgagaagtgctttgttgctgttttctccaaatttatgtaactagctttcattaagttctggctgttatttaacgcgtaaaatatgtggagagctaaaatgaagctgagaggcctgtgatgctttttcactcttgcaacgtagctctagctgagagtctggagttcttcgctttatgtcatttcctgttaaaacctccatgttttcttccctgggaactttgcctactccaaatctagctctcagacgttctctgtgcagccgaggtctttggatagtgagccctggatcggtgaggagcatgtggagtcagtgttatctgcagggtccttcctccatgggactggagcctgggctggaggggatgtgg

SEQ ID NO: 127606 - DNA, 1007 bp, Homo sapiens
cccagaaggaaggagaagttcacaaatgtagcagccttcttcagcatccctctagctgcagaaaaacaaggaggcctttggctgtgggttgtatttcttccgcatttccacgtctcactcatggctttctgccaagaaagtctagccacaaaagacctgggagaggggctcactgaaggggcatgactgttgccaaggagaccgaaggacagtgaggggagacacaggctcctctgtccaccgttaaaccttcataggagaaggaaagatggagagaaagtgcaggcagtggaccactccaccctccatccagggaggccacagacaggtcccttcatggagactttcccataccaaattgccacccaattcacctcagtggcctgtccccaaagtggtattcatgctgtatctagactcaattcagcttgtggaatgtattttaaaggtagagaaaccaaagcctggcagtgatttgaccgtagtgagtcagtgactgctgtgcttctctcaatggcggcttttcagagaccacagagcaggggggaagggcttggcaagcaggtgcccctatgctaggagaccagcctcaatagtgagccagaggtctggctaggccacctgtacattcccaaactctggcggcactttctgtgttggagaaagctgctggaacccacgctgcagggagctacctcagggggtcacttttcctattttagctccatgagactgagtgcccctggctccttgcccagtccctatatagcacccatgaggtccctgggggttgtggccttcctgccctcttcctaacctaaggtctctggtggatttccagcctctaagaagcacaacttgagagtagaaggatcctgggtcctatagctttcaagtaatatctgggggtgttgtgataaaacagtgctgtccagtagaactctctgtgatgacagaaatattccctgtctacgctgtccaatacatagccactagccacatgtggc

SEQ ID NO: 127607 - DNA, 1056 bp, Homo sapiens
tcctcctccccaccacaacccccagaactaaggaggggcaaacatgacttttgttgatgaggaaacagaaattcaagtaagggaacatcatgcagaaaatgagagggttaggcctgataggaccacgatgatcatgataataataacaacaataattttgtgcactactatgctgcttactgggtgaaggaatttacttgcattggggtaggttttacatctgcaatttctggatgaggtcagtgaggctgagggggtcagtagctgtcctaggcacaaggagaatgccaccttatagttgttcaccagttcttcccaaagcctatgcttgtgatctgacatggaaagcaactcaaggctgtctccacggacattctaaaatcagagagaagcttcctttccctgccgcctccaaggccccatgcgaggaccctccggctggtgctgtccaaggacctcttccctggtccctcctgccttcctcgagcagtattcccctcacccccatcctgctccagcctcagccagtaaccttggtggattttcactgaatatgttgcctccaccaccaacagcatttttatttgcacttccttggggatgccttgcctggaggaaggagtctgtgggattgtccagaggtaagagggaaacactgcgcagtgggagtcccagcaggggcgaggagcaggggagatggccggaggctctgtctccaccctcctcttaccactgcccatttccaggaaaagacaacccagccagagcagggcagtggcacgacggcttgctagtgctgtagcatacctggtacctcagtgaattttccgggacatgagaggcccatgtaataaataggtcaggaaactgagccacagagaggacacgggacttagcacaggggaaaagagtggttgaaatggaaccagattccaggaggcctcattcccagtcctgtactcttcctgcggagacaccatgctttgaaccaggctcgaagttgccaaagtgaacattttaaaacttttcccagggctcaagagatggccgagtaaa

SEQ ID NO: 127608 - DNA, 1042 bp, Homo sapiens
tatgtgtcagcttggtaaggctgcaatgttagacactaaccatggtgtttcatagatggggttagcatctactgtcagctcacttcaactgatggagattgccctctatcatgtggcggggcctgatccaattgattgaaggctttaagagcaaaaactaaagtttttccaggaaagaagaaattctccctcaagactgcagcatgaattcctgcctgagtttccagcctgccctgcagatttcatacttgccaactctaaaatcacatagaccaatttctcaaaacaaatgaaaagtaaatatttttacacacacacacacacacacacacacacacacacacacactcctgctggttctgtttctctggggaaccctggctgatacagacaaacccctgagcataacatttttattctccttagcaactctgacccaggaatggcaggtgtgatgacattggtggtggaggtggggggaaggttgaggctgacatgcaaacacacatgcacacacatacattttttgagcctgtgtcatgtggacattatctgctgcacgtagtaaagagggagggtctgctgggaagagcactggactggggagccaaaggccagagctcaggtcttgattcatgacatttactgttcttctgtagaactggggggaattccaagaatgatcagggaaaccaaataaaatataaaagttacagcattttgtaaagcactatgcaaatgtcatttggtatctcttaattttttaaaatgcagattcattccacaaatgatctaagttaattatttttgagagagaatctgaccaataggtggaaatggacttggctatcttccctctgagtgacagttcagcactgtaaaatgagaagagaaaaaactgggggccatttgtctgaaccaaaggaaactgtcaacagactttaaaagagttttatcaaggatgtaaatatgaggttattgaacttgctagaaggtggtattggggaaggaaagattcccactggaaggggctttgacaggt

SEQ ID NO: 127609 - DNA, 1042 bp, Homo sapiens
agcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccccgccagtagaaagccaggcaggagaaagaatagcaattacattccaccatggagatgctcctgaccttttcatctgaatcctagtagcagaaatgtaacacagggggagaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctcc

SEQ ID NO: 127610 - DNA, 1043 bp, Homo sapiens
gggtttgatcttggaaagggacttctgccagatgccagtatcccccatcccttgtgtaaatatcttcttttttaattttttttttctttttttttttttttgaggcagagtctcactctgttgcccagactggagtacagtggtgcaatcttggctcactgcaacctccacctcccggattcaaacgattctccctcctcagccacctgagtagctgggattacaggtgcccagcaccatgcctggctaatttttgtagttttagtagagatgggatttcgccatgttggccaggttggtctcgaactcctgacctcaggtgatctacccacctcagcctccctaagtgctgggattataggcgtgagccaccatgcctggcctcgtgtaaatatcttctgagggaaaacatatagtggcccagggagtcttagtcagctcccttctccttaagccagcttgcagtggtcagaggattgctggcctctcacctgtgcctagaaacatctttgagatagagaaacaagaggcagaattcttgcttggggttgtgctttcaggtttattaaaacacacccttgtctacagcgtgatattttaagcccagcttaatttataataacaacaataacaatcacagaagcttcttattttatagccaagatgaatctgtttgtaactcattatattcacagaacctttattggactaagcatattactatggttagtgaattctcttgttattatcagcattgttattcatacctttatccaactttattttttttatctagttgcctttttctttactttttagtaatgtcttacaggctttatttttatttataatcataaattccctaacagcaggaaatgctttttctgatgttgtgggaaggaagaatagtaagagacagagctggcttaggtggtctccttgaagccagattgatgccagaggaaaatccatgatggattgcttggttaatgtcaccccctgcctcccttgatgccagtgcttagaccattaagatcatttta

SEQ ID NO: 127611 - DNA, 1047 bp, Homo sapiens
caagatgacatggaagatgtgtaagcactggccatgtgggcctggaaagcccgatcagtctctgccccaccaggtttctttcctactctggccttgcccaagcctctactagtaggactcaaaatcccagctaaagtgtctgtcttggaaaaaggcacatagatgaaatggggacatcagcctcagaggccttactaacatgagcttgggttatccaggatgagaatgcagagggcggggacagcctcgcctttcttggtcttctcacacacagacttgtgcacattgtccatcagacctctctgacaccttgaaaagaacacacagagagcttgtcccacagcagacagggtagttgtaactgactctgggtggcttacccctcacatacattttccctgcagaaagctggaatgcttttctggctttaagagtgaatttgttggagttgatagtgaaattgctagataaaaattatatgctctctgttggtgcaagtgcctcacactgattcattttgctagtcatgacttttctgttttcttgggggcaaagctggcaaaacaggagtttggtagagctagaaactgttgttagcattcgagggttcaacaagtggtgactctttggcaatcgtgaaagaatagcccagaacctacaccagctcctgggacccacagatactctgggtgtgttcctctctgcagacatctgatggatgcgttctgatacccaccagtagcttctaattaccagctgctcaccctttccttccctccagcctttgctggtgtaggcctggcatctcccaacagctagcctttgacaccctgcttgttttgtgaaggagcctgtcgtgtggtattaaggcaaggtggatcagcccctcagaactgagagccagaccctggatagaattgcatgtgacaggaaagatgaatttatcaacatcagcggctcctaatgaacacaatctcccagtgctaatgggaaccttaaggagttaggcatggatgaaggccacggaggctttcaaatgcagatgcc

SEQ ID NO: 127612 - DNA, 1060 bp, Homo sapiens
gttcatttttagtagtgtggaaaaggacacggccttcctcaggaacaccagtggcccaggcactgaatcctgtcttttggcttgtggctttgattgtgcaaacacagtagagaatccagaggataaacaggaggctgtgaagcagtcgccacacccacaggaccaggggtgaggaaacttcctcaacaaggaggcctgggggctcagcaggcagtcccaggtgctccgttcatctggagagagggcagtgctcgatgatggacaagagatgcttagattttgaatcagtagctgccgagaactctgtgtggccatggagaatccatatcttctgcctttggcctctgtggggaggcacccagcatcttaggaaggggtcgtttccttagtgtttggggctggcagaaaagaggtggtgcagagggaactactgagctttgaacaccgtgtaggcaccaggattgttctagatgttttcacatgttacttacattgattgtcacatgtaatcctcaatgtttttttttgggggtggggtaaatgttacaccttccattttacccaggagaaaaggggttgggtaactccccagaggtcacacggtctaatccgaggttgtcctgggacccgtatcgagtaatatcacagactctacctaaggcctggctcctgggctgtagggtaggtcacctccctgatggagggaggaggtggtggctggacctctggtacctaccctggagcctgttgctcagaaccctcctttcattccctctgttctgtctctgccctgtctcaggccctgatgtccatgctagggcggttgaaactgattttcccctctttaatccatcttcctgggatggattaaagaggggagcactttagggacaggaaaatcagtttggatggatcctagatggcagattcagcttcctaaagcagttctaatcctctcacccttgtcaccaagaaaaacaaaactggacttgtctcatccacccttctgcagccccttgcctgtagctttgcttgcatggaagtggacctgacatgctga

SEQ ID NO: 127613 - DNA, 1033 bp, Homo sapiens
cttcaaaactcttgcagtgatttggattaggtgaggcctctatactcttcaaaggctttcccatgcagaaagactttacttacctacctctctgccccccactccctggcagatagtctctctcctgggaggaggcttatcaggcaggcagtggtcactgtccctttgttgagaggccagtctgcttcgaacataagcttgccttcaaagtaaattacatttatatatcatggctttgaaatgcaaacatggaagccggaggtcagtggtcagttgcagggtaccactctgcttagctgtgtgcctttcttcccagacttgccccagcacagagcagcctgccaggtctggagtccaagtggctcatacttggggagcctcctgcggactccccttccctgtcaggtctgccctcctcactgcccacagcacagattgaaagcctctgttcattctctctctctgcccctccttgcaaatatataaaatcgaagtcgagggcccgatgacttgggccaactgcctattatctgctgcctgtgcagtccaagggatgagggtaaaaccattttcttcacttcatagccacaagccgtgtttctcagtcagcatcaaaccagcaacaccatgccagcctgcacattttagcttggctttgcatctccctaaggtaatgtgcatcccggtctcagaagcatgaccatgaagtcattgaaaacagtattcaacctccagttgaagtggcattgttgttttatttcaagcttggaaggcaggctgcagagcaggggctgggaactccacttcagcagagggtgaataggatgtcgggtaacctgctggcaggagtttattttcagtcacctccgtgttcttaaaatgcctttgcagcagctgcatgttaaatgtgaacccaaaataaaagagcccacactcctcaccctcaggtgcttaacacagaacttagaagtatcagtgactaaggcagaaggtgtttttcttctattggaaatgagtttatcagtgaagttag

SEQ ID NO: 127614 - DNA, 1096 bp, Homo sapiens
ccatgcccagctaatgtttttgtttttggtagagattgggtttcattgtgttgcccaggctgatttcaagcttctgggctcaagtgatctgcccactttggcctcccaaagtgctaggattacaggcgtgagctactgcgcccggccttgttggggttttcaacccatgtggtggtgagaggggtcatttaaagatcatattgataaagcaatggtgttgattaaaggagcaatattttgagaacaggaagcatatgccttgttttctgtgtttttaaaattagatatttgaaaagcaacacaaatcatactaaatagttagtgccatttattttttgtcctctcccggtggtaaaacttactctttctgtttttcttgcagagcatgcttgagaagggaggataaaaactttcagaatgagcaaaacaccatcaacgttaattccagagatggaacattttttttcctagtgagaaaacaacccatttgaagagaagaccactaatgagaagaccactaaagagagacatcaagaatggattcagcagaatcatttcacgttttgaacagcagcagtttgaagggccaaagccttgatcagggatcagtcattaaaggacactcttgagtattagtaaaccctcttatgatgattaaaagagaagggcagccctctccaccttttggtactttctattcaacttgcactgaccataaaatgtttctcttctgaacaagccccatcatttggtgaacctccaccctaacaaagtaggatggggttgggggctaaattaattggagtggggcgaggagagagccagaaaacatagatccgagggcagcagtgctgggtggagagagccagaaaacagatctggaggcagcagtgctggatggaattgtctaggctgtggcatgttggttttgtctttcttttctcctttgattatgtaagagctatttcattataacttattatggtgattatacaggcaagaagacaaaaaggagagaaaatgtacctcttctactggaataatgtttatgattacaagtgagataaggtatttttatcaatatgaaggcaacctt

SEQ ID NO: 127615 - DNA, 1076 bp, Homo sapiens
tggcaggtcacataattgcctatcatttaaccaatttaacagttggatatggttgttctgagaggcagaaattgttggaaacgttgattccttctgctgacaaactccatagatttgaccttctaacccaactaaatctagtgtttaagttacacagcatgcctttctgcagtctaatttgatgtagttataataatatcacttggtgtaaaatttttatactctacaaatatccgacgggagggttagtattatctggatagctggaaaataaagtaacattagtggaaagaatataatcaagatttattaaaagcctatgttgtcctcaaaagcctagtggctggcagcttttttctgtttcttgcttgtagctgcacttgtataactcttagtagtatgccagggatccttttcattaaaggtctttggtacaggtaatgttgctaatgttaagttagtacgttttatttgtcgaaaacagcttctgatatgctgttaataaaccccagccttcaatatgaatatgaactgaaggacttgagactcgtaggttgattcatggatttttctaacttgataatagtgccttattgagctggtggtcagtggaaaagagtggttgtgacaaagtgtatgtttcaatgctggtctctaacatacgtgcctgtttgtaccatgtgatttgtaacattaccacagtggcagctgcaggggcattgggagtgctgaccccatcctgcctgtctgggttgtgttgaattatctacatatagtcttgtgacatcaatggtatatatttataggataaagcaaagttaacttgtgacaaaagcaaatacgccacatggcgcgatagtgagtttgaatctggcagacctgggtttgtaccctgtccttttaccagctctgtgaccttggggcttgagttttctcatctgtaaattggggtaatgttgtgaggattacctttatataaagtattcagtaaatcttatttttccccttctttcctcagttgcattattgtgctgaaatttactaaacaggtcagccaaaagcatcaaattattatt

SEQ ID NO: 127616 - DNA, 1273 bp, Homo sapiens
tgcagggccaggcagcggggcctcccccaagttcatactccgtctctgctgttctgtgtccagctcctttaggagaaccttcttctcatgtactgcttttttctcatgcgtgggcttactcaccagaatccctcttgctatcagagcactgacccagctggtgaggtttcccacccagcaaaccatttccttccactcctccccatctcaccagcctcattttgtaatatccttcactgtggacacccttcttaggaaatcgaagtgttattccttaaccacaccaggtctgcaaggaccatgccctcctttctgcctgcccttctttgtctttctttcaaagaattgaaaactcactcttttcacactaccttccctgacatcctaacttttaagcacatttttactggttcctctacttgatgggaatgtcatggtctgcttgcagaatgtgtccttgatgaaagtgttttggctctttaatctgtatgtaaatttccatgtgaatcttaaaaaaaaaaaaagtctgttagagatgtcactgcctccagctctagccttttcttctctcttcttttgctgcctttccttcatttacttgtctgtctagaatgcctttgtatcccatgtctaactgcctaagccctttccattcttgaagaccctagtgaaattccattatctcatctaaaacttttcctagtcatctccagccagatgtaatccttccctttggtattttactgttgccagatgtgtccctttaaagcagttcttaatgggctagataggtctgcctgactcagtctcttggtcttgtcccacagtgcctagtatctcacaggcactctaaaggatatggaattgacctcatcctgccacctccatttcttcttcactgcccactttcttctttaccaatttctacctggcttctgcctcacgctctctgctcagattctttctccagcttgctatggagcacattccttggccatttatcagtcttccttctttttgactgtcttctctgtcgtgaaactctggtctccccagccttgtgatgctgtgttacaccagttctctccacggtcagttcccctactgctccatcttccttccctgtcacccccaggtatggactgttccccaagcttctgctgtcctttctgccctttgcctctatgctccccaccacatcttgcagggcattttgacactgcagctgtagccctgccatcatgctgagctccaactccacgctttagatcgt

SEQ ID NO: 127617 - DNA, 1128 bp, Homo sapiens
tctcacatttattagctataaaatacttcgaaggtgtattttcttctagtttttatatttaatttatggaatattaagtaggaaaatattagcaactacttggatgcatgctgcacttattttctaagaattagtaaataatgttatcatgtgtgattagttgtgtttaatgctagagatgagatattacgaattagcaactcaccttctaagttcttttccttaccagttaccttaaacatatccatttcccaaatagagaccattttctcatttccagggactttcaggagattaaaaggttaacatttacaatgctctgatttcaagactgcaaggcactatgtacaaaattcgtatgttgtttgagcactttttttaaagcctctatgttcaaaccttttgaaatgaatttagttcctatggaaacttatcgctgctgtagatagtgcccttatccaagagaagaaaataaaatcaattcagagaatgattttataattgtataacatagcttgggaatggacattaggaatatgtgcagttgcgctcttcggctgttatactggttcatattagattgtgtttgaaaacaaccttgcaaatgtcaccatctgtccttcactttgaggccagaataggtaatagtggtttaacagaaatttcagtgggtactctttcttgcaacatcacaagtaataccttgtgaggaggcaggggatatgataaatattttggaagtaaaattagctttggtaggtggaggagagggagaaggaagaatgctgttgactcctgggaaagattggcattttgcaggctattcattcactagaattcgtgtagatgaacacaaaaaggaggcagctgaggcagatagactatttgaaagttaagtaatagtagtgtatgcttgaagtgataacttagcctatggtaaggatatgggaaactgaggaatgttaaaagtgaaaggtattttaaaacaggaactaacaatctcagtgacttcttgaaaataaagaattagccggtgctgtggcttatgccatatcctagtactttgggaggccaagaagggcagatcacttgagcccagaagtttgagaccagcctgggcaacatggt

SEQ ID NO: 127618 - DNA, 1830 bp, Homo sapiens
ttcggaggctatgacagactcagcctgaaagaatgtcaagattgattagtgatgtctgtcactggcttaagcattgaatgagtaggcatttttcctttgtatttgctactcctgctttagaagcatatataaaaatttgttcaacccttgactgacggtgcgtaaaccagaaataggaaggatctggttggggaaggggagagaaaggaggaagagagagaaggaaaaaagaaggacgaaagcctaaaggactgtataatgcaattttcatatcttttctctgttctcttttcactttttttcctaccagcaggtttggtgaaatgaaatatcacaaaacaggactctttattttgttacctcttgtcccagtatggctcctagtaggagaactcgttacttctccctcatttcaggcaacctgagcaccagtgaaactgtgactggcatttgcagggacctaaaaggtaatcagagtaagaacaactggtaaaatgtcctttatgtgcagtcattcctgccatttcctttgtaattaataagagaatatattaacattccattttgcttagcatttgtaatatatgcaaacatattaacctttggtacatttttgaaatagtctcctgggcaaaggccttagtttataagcagggaaataagacttcagtcagatggcctcactcctaaatactggaagaaggaaatgctccatctgttaaacagttctttcagtctaaatgttggcacttataaccaatattggagatctaaaagtggctggatttgatggtgtctgataaaaattaatattataattgatttgccatcacgttgaaatgccttgataaaatgctctcattgctttatttcattatacagtatgtggttgtgataaaaattatctcattatgctattcaatttagataacaaaaccagttattcagaccttaaacgaaagttatcatcctgagcagtacttaagtctttctctttcagggtcttcagtcctagctcatattggagttgctggccataatcctcctatttgacagttgacattgattaaattaggccaacaagtctaaaatttcagtttcatggtctgctgtatagccacagccattacatacctctagtaccatgatatgatatatgatatgacatatgatctgatttgacaaaactccagattttacaggcttttcacataataatttagtaatgtgtaattaacttctgaatggtaatcaatccacacatactgtgattttatgatgtgtaaggcttcagtttctcactcatccttcacaaaggccagtcactcaggcacagggaagacctttaattttatctgggttttctttgcattcagccatggtgcatttatagaaaggagaatcctcctagtccatcttcttccccattcctgcttatgagttggctacaaggccattacaggcagtgctgtcattacctgtcaatttaagaccatttgaaaatgaaatcatcattagcactttcacatttctccctattatttctaaatgtcctttggtggttaaagcttttgggagtatggggtaggggaagggacagacctcacaacatgaataaactgaaatgttacccaacattttagtaacaccggcatgtctaggcctcctccagaagactgctagcgtggcttcacaaaataacatgtatgaccttaaagatacagaaaactcacaaaaagaggctgaaaaccagtttctggcctgtttgaatactggtttaacagtaatagaactttaactgtgtgggtttattattcttgaaacgtccaa

SEQ ID NO: 127619 - DNA, 1123 bp, Homo sapiens
ttcttgagggcaggaattgtattttatcctctttatcgatctgcccaagcacctggcatatatactgtgcttggataatacatatttaaataaatgcattcagcaaattaggtgcctgtggctatgttgacatctctgtgtctggcctaatggtttgatttatctggctgttaatggtcttcattacaggctgttaatacagggctgatttttgttggacattagctaattgccagagttcatctctagtacatgccagatagaagctgggcttttctcttgacggtatcaataggataattaagactatagcaaaattcaaaacatgatggagtatttattacattaagacttgtcattaattgggaattccttcagttcagatttctatatagtgtgaatttttgtcaagggaaagttattgatattaaaaatttgttgacttttgctatttttaaggactgttttttttgcttctgttcatgtagacagatttatatattttctagtttgaaatttcaacttgaaaacacagcatcttcaagtcaggtaactgtctatcaagaacaccaattaaatacttcataacaagttttcttcttataaaagcctacccacccactttcccccatgaggtttctattgtctgttataccagtctatattaattataggcattttctgagcaaagcactgatgaaactaagacatagaggagaaaattcctgtgtactttaaggataagagaaccattcctttttctggctcaattaaaactggactgattgtcaagtcccattaacctagtgggtcactaccttgcttgcattagtggcagccccaccgtaatgtggagcagtcttgccacgtcgtggacacatttatgaagattgataacagctaaggttcagtgttaacttttattgtcaggcaggctgtacaagaaactgtctggtattggcttttgctttgatttatgaaaaggttgccacatgaagaagatatcacataaaacagcactgctggcagcagcgttattcggtgcaattgtaaccatagcaaataataactaatggtaattaggttcagcatcatctcttgctactttccatagtttggctgg

SEQ ID NO: 127620 - DNA, 1110 bp, Homo sapiens
acagttttagtgctttttgcacagatcatagtttgttatatagcactctagaatacttggaagagttttggggtggttgagatgggggccatgttatctgctatactggaattcagatgccaagacaaaggcatttgatgaaagcttgttacaaatccatgtattttatgaactagggggaaattgaaagcaatggtaatagtattatcatttgtaataatatataaaatagaatgctcttgattatgaaggtcatgttaaattgctactgtattaagggaaacatagaaaccattcacttttgtataataaaatgatgggcatgtccaaatttgggtatctgcctttctcgtggttaggctgttttcatttcttcacatgtaccttgaaaggctttaaatcatagactttacctggcccttgattatgaaggtgatgttaaattgctacctctcttaatccttggagtgtttaaatgaatgttctgtaattgatggatcaaagtgtccgtgtcccatagctttgtactttccctttgctgccagttctcacattaggttagaagacatcattcagaatttttctgagtatataaatagtcctattgtgtaacctctattagtagcacatgcgcaaattagtgaagcaaaaaaagttgttgtgacagctttagttgaaagattgcatcgggctctgacctccttccttgcacatgtttacaagcatttgataaaatgattaaaccctaaggtggaattactactttctgctacagtacaatttgtgtgttaatggatattagtgttattgtaatgtggattaaaataaaattttttaaaaattaaaggtagtttgaggtttatttaaagagccaaagcccttcagccttctgtagtgaactatctctttagaggcagcagagagagaccttccaaggatgggccacaagtctcactattagagattaatgtgagatcttaagaatttagacatattaatagaactggttatagattttttaagttactctacatatattattttaagttaggtgtttatttttctccctaatgatataatgacttttttttaggtggtaaaccttttttt

SEQ ID NO: 127621 - DNA, 1075 bp, Homo sapiens
ataactgtttcagagcttctgtgcctggaattgtatctgcgcagcaattaatgcagcattaaattgggtccccaagcgcttaactctcacctttgggaaaacatacttgcctacatctagctgattatgtatcatagttcctgggtgaggattataacaaaaactataattaagacttttgaatctggctactcaacaatgggaactgccgttatttgacattggtgtttgtggcaccctggacctctttgttggaattggctgccacctagagtgacacttgtgtttgcttgtgttgtaggaggaagaagaggcctgcagttgttagcagtaactatagaccagtttagacacaggacagtctcaccttcagccagtgtggtattgtaccttgaaggtacaggaccagacttgtttctgccaccattctcttggtgctaaggatctgtggagttgccaccatccttgaacggacaggcaatcgtcttgttcttttctgggaaatagtgtcaggccaccagaatttaaattgtacttcagccctcatgtgttacatagtcatgccctaatctccatatgaagcattctataaaagaactgacaagagccagttacatttttcttatgacctctttgatttgttctttttgtacatgcgatgggtatgatcatactagttataataaaacaagattcagaatctgagaaaatattgcacgaatactgtgtgtgtatgtgcatgttttcttttgatcaaatttagaacttgaaaacagatagttttcaaatcgagcaataatgtgtatctgtgcatgtgcattttaatatacacttttaaaagtgagactttctgaaaatggaaaatggcagtgtatcgcacattcaaaatcctgggccacggccagcccagagaaacttgggaatgatgcccactcttgttgattctcgtttccttccgtacggtctagaaactttgttcttggggatgaagataccagatgggtaaatcccccccataccccaaattagtttaaggagagattggaaagaaatattggaatacttgcatctaaaa

SEQ ID NO: 127622 - DNA, 1063 bp, Homo sapiens
gacattttttaattcttcctgttctttgttggaaaaggagagaggcagaaggaaatggagattcctgacaagtagaagtgaagcattactgcaaaggagaaagttgcttccagtgtgtcattgcatttgactttattgaagttattcatgaggtgtacaaaaaagcaaacatcttagggcttacagaggtctattcctgattactttcaccctgtctatcataaaaatagaatggctgacataagaagtagatttttttcttgtttaataaaaggctggcatggtggcttcagtgtcatcagagccccagacacctattattccattgcagcaccctaacacaggcttttgctctttaaggtcagcttatgtcccaagatggctgctggagctctggccatcacatcaacattgcaggctgagataaagggctgaagagatcccctgtcagcttagatcaactccctttaagcagcctactgggaagttccatataacacttctgcttacagctcagcctcactggcagcaagcttggaattctagttttgtttaccatatatctagcttaaaactagggttatctaaggaggaaggagagattttaagataaaccagtgagagtcttgtttccataaggaatcttaatttggcttaactatggaatgtaataggatttttgattcattagaaactgctaacttggttatttattattgatgactggtgatatggatttgaaaaagaaatagggctgagacaaattatgattcactcatccatatacacaaatgattattagcagaaatttagggatacttaggataaataactaggtttttgagttcagtgcttacataaaacaaatagcaatgctgaatgttagatacatggagatgcagtttgaatccatccgcttgatgattgttcttcaggttcatgcagagttgcataggtaaatgaatggaaatccaggctctttggattacctagggagccaagggttgctggcaagaatggtattgtgatggagaaccactgccttccacaaggagaaaccagg

SEQ ID NO: 127623 - DNA, 1123 bp, Homo sapiens
tttggttaagaaataaatataaaccctccatggtcaacaaaaggcatgacttagtgaagtactctgtagggtaccatctactgctttgtactgaaagaactataatattttaaacctcaagacctaaggccttctagctctggacttagggactgatttatttctggcacttaatatcttatggaacaccagcaaatgtgtgaccttgtttaaacacaccattcctggtaggtaaaataaagatagtggcccctaactttacttccttcttggctggtttttatcataaaatcaaacgatatgaacataggaaatacttgattcctaacaatatttgcttttggacagtccaagactcaaccagctctcctatgctttcaactcttgccctgttagaattgtgttcccttgtataggaagaatctccagagcctcccttctttccagagacttttgaatatgaatgttagagtacatctcagtagatcataagcagtggaatcacataactaaatttaaaaaaaaaaatctaattcaggtcctaggaccttactctgtagaagttgcattcagtaaatacttgagtgaataaaaaatggacattgacccacttaacaaatggcagaagaatttcagagataccaataataaatagggctttaaccttcataatttaaaattggtttgtcccccaacccccttttgaaaattaatccccactctctcatctgtattgaccttgtggttgcataggtttgtactgtgccaaaagggtagatttttgtttttacttttttgttctagaggagagttggtacagtttggaaaatcataagaaactgttgcgtaactgtccttattcttatatctgttcaccaagggctaaaacttaaaggaatttaaacatttcttctctccttttttctcttggggaaagggggaaaaaacaaaccaaagtctaagcagccctatcattccattatatgaataatctattagttactttagctattttctgtggctaaatacttgtttttcatttttcagtatgatgaactccacaatgaacaaatttttagctaaatttttgtatacattcatgattatttcacatatttccaga

SEQ ID NO: 127624 - DNA, 1042 bp, Homo sapiens
agaaggtcaaggctgcagtgagccattatgtcgctgcactccagcctgggcaacagagcgagatcctgactctaaagcaagtcatggagggtgggggcagcagatttatcttatatatatatttgctttcgaatttggcaaattgtgtatatcaaagttagaagtctgataatttagtgcacataagcttaggtctttctgtcatcttttgagcagaggctggtttgaatctgcatctgttttgttgaatcaccctagctaatgagtgggaaatttaaaaaaagaacagagctggttgagctttcacttctgcatattcaatcctttggtatgtttattaaattctatggtattgtaatattgcagtctagctcttccagaccaaggaagtaggtacacagagaagaaaccaggttctagaggttgtggttgtgacatttggggatggcagtgttaaggaagtagccagggtgtggggactgtgggactgtaggagaccttagcatcagaggaaatgctatacaggtgccctctaataatgtaatgtgagcatgtcttctggaatttttagttttgtgtttgaatgttccatcagaagtgtctgacttaggatatcagtgcagaacaaggatttgctttttcgtgatgcattttgggtcagtttttttttgttgttgttaacatcgagtaagtacagactgagttatattttccatcttctccattaagatgaaatggacaacaagaggaagcaaacatgaaagcttgggtgagggtgggtcaccaggctgtggtgggcaagagcaaggagccctggggaaagtcgcacagcagttactctccgacagccactgagctttgtgggacagtgttcacaattgtgaatagtcctggttaaaaggtcttttcttgaaaaccaagcttttcatttggattctattccagaggcacaaaacaattctggggtcttggctttggcaaaatgacattgggatgtttatatcaattttctttagaaatgaaattttcatttctaaagaaa

SEQ ID NO: 127625 - DNA, 1043 bp, Homo sapiens
acccataataaattgtgaactgtctattctctcatggtgtagttactctaaattgtggaaatttggcagacgtccctagaactatttgttaaaattcaatagtatgtaattaaagacagagactgccattttgctgttgggtacattaaaaaattatattatgtatcatttggatttgaccctgaacttatttcccaaaagattaatgccagaaagacaaaagtatattttagtctaaatagaggctcaagttatataaagtaactaaatttatggaaatatcagttagactctagctatttaagagtaattatgcaaaagatagttttgaacgaatattcctctagaaatagccaaatggacactgtaattatgatgaaattctgtgcttcaagtcttgccagacaataaaacaagactgctgatattttaagcctatatcattaaaactaatattgatacaacaacctggataatatgtcagtgaaatggaatattttatagatacacaaaagtatactgctccttgaaacgttagcattcatctagtataaaattacacttttttcaagcaatgaaacagaaacctagaggcttgaaaattgtttttacgtggttgggaaagggaatggtggcactatttacctagttatgattatctcatcagataagttctaggcaagtgagtgggtgtttgtctgtttaggttcctgcaattgatttgtgttggggtggccctcccaaatatagacaagtggatatggattcatatattagacctcctagttattggctatttattcttagataaatcatgtaacctgtttgaccctcagatccctcatctgtaaagtggccttcatattgtacttccttggggatgtggagattaaataaaatattatgtgttaatttatacatactaaattaggataaatatcagttatcagcaccagtctctaggaggttgataattatacagctgtttgaggtagcttgttgcggggagaaagccctagaatagagtagagggattgaatctg

SEQ ID NO: 127626 - DNA, 1412 bp, Homo sapiens
gcctctgtcttcctcctcaccaatggcctctccctctgtgtcaccagtggtggactattaaattttcactttcagtctcatatgattccactccccttttcatcctccccctcttcatttttatttatttatttaatttttgagacagaatctctctctgtcgcccaggctggagtgcagtggtgcgatctcggctcactgcaacctccatctcctcagttcaggattctgctgcctcagcctcccgagtagctgggattacaagcgtgcaccaccatgactggctaatttgtagagatgggatttcaccatgtctgcccggctgatgtcgagctgacctcaagtgatctacctgcctcggcctccctaagtgctgagattacaggcataagccaccgagtccggccctccccctctttaaaaagatttttggtggaggtgggcctgacattttttgtttagaaccactagagtcaagtaacagattctcaactgagtttccctcagcaacattcatacttggttttcttccataagctaagcgcccattgttttatttaatagtgaatcttgtttaaagagaagttgaaccagctttattacagggcatgattagatacagttaattagtacggctatagcgtataggctaaattgataggaaaggtgctgaaagtaaggaaattgtaaaggatctgtgaactgggtcttattcctctgaggggatgcagagaaaagaagctggccctgtactgtggggaaatataaccagaaattgaagtcacaagcgaagccaaatcagcccaggtaaaggtgatgacactttctgagatggcaactagtagctcttaagtagccttgaaccatggtgtccacagcagcccagcacgcttagcttgctatgcggattgtacctgtggaatcctggggcataacttcctgcaaatttaggtttagtcacacaagtttactgtcactttccattctaagactgagtgtgcacttgtttcaactctctcgtttcaggtcagagatgtttctcctatcctagaactatttgaacttcaacttccccaggctctgcctcaaaattaactttagtaattaatgaccttcagtacatgtaccactcaattaactaccctcaagccagccgtacttttaaccttcctcgatggcagattcttgtccatctcctgccacagcattccttcctaggagatctccatgcttgcgttctctctgcagattgctctgcctgtgttgggcatccccttatttttacttttttttccccaactttatttttgtttgttttgtataattgacaaatacatccataatgctttatacctctcttgattatagtcacattttgtttataatacttgtgatgagttgtagatgatgag

SEQ ID NO: 127627 - DNA, 1056 bp, Homo sapiens
ttaggtgtccattgattcaagcttgcattattccaacctcctcagaattgggagcaatgggtagtggggtttctccttgatcttcccatgtcaagattcagcaccatgcccattaacccaagagttgtacatacttgcctgaagaaccaggcgcaggtttcagtagcatgccaccaatggaaagtctgaaccagaatattcttcccttttatgaaatgaagtaggaaggtaattaaattggataaattactcctgtggatctctacaaatcttcccgcaagtgttgccaagatatggtgctgaaggagcaagtgaaagagatatcaacatcttctgttccatcagagcctcaaggtttctgtgaccctctagaaagaatctataggacttgctattcttttgtgaggaagcagtaaggtttacttacatagcgtagaaagtgcgcctttgtatctggagaataagtttgatgatggtcagtaatcacatgctctgcaatttaatttgtcttcgtaaaacgtttagaactggagttcagagagaatggcatgatcaccacactgtccccttgtgacttgtagtgtttgtataaactctataaaagcagggaccttgtctgttccctgctgtatccctattacctagaccagtacttggcacttagcaggtgcttgttaaatatttgtcgaatgaatgatgaaggcattttcagcgggtcaaaaatgtccacgtagcctagagatgcatcttccaaattgcttagtgggcagctcgtctcaagttagaccttattctgcaggttttctgaaatttaggtgagggtccttttgctccagtcatgctaacttctgctattaatgcaacaacataccttatttatgtaaaattaaacatcagtgtaattactactcctcaagcaagcttttgaaataaattaaattatttgtctaagtgatgttcttatccattacttttacatgactggggagaaggtgaataatgatgatgatgatgatgatatcaattttatccacaatctttaacctaaatagaatg

SEQ ID NO: 127628 - DNA, 1019 bp, Homo sapiens
catggattgctttcagttttcagacacctctggatttcagcagcaatttgcatacagactgcaggaaatctcacagaattaaaagggagagagaattagataagctgggcaaaagagaataatacaaagagaatggtgaaaaataaattgccattaagaagaaaagtatattactagtttgtcacctgtggagagagttgctaattaaattctaaggtcatgcttacatcaaatgagcaatttttaaaagtctctcacttatggcagatgacatgtcttttattgcatcataaagtgttgggctcatctgtatgattaattggcttttgattgtgtgtgacttcttctttctcaattagtacctttgcttctgtgctcctctgtgtgaagcttggggaaaaaataatgccaacaatgataataatgagaaatgacaacagaacaggttattgtcagcccagagtgcttcttatgggaagaaattatgtatttttactaccaggtgaagtctgtcattgtaaaatatttcagtgagtgaagctggatcaaccttttcaagggattaatgcaggatggattcacaattagtctactgacatctgagatactaaaatataaacagtcgttttttggagatggggagataacttaaacttggtttatgggattaagaaaccgtttgatattcccccctgcgacgtgctttctaaacagttgccaatgattttaggtgatgtggttaactcattttggccctgcaatgtgacagagtaaatttaacatgagagttaaaaatgtaacttcctggtagatgtgcctacgtgggttatactagtttgcacttgtcaacctagagagatagactattcctttgacactgggaaattttgtactggcttcttcattcatgtggagatcagggcagattccctgtggtttctatagttaccgagagctacacaaacagagatgaggttctgtagtccacaggtttggatgttgaagttaatagaagccta

SEQ ID NO: 127629 - DNA, 1050 bp, Homo sapiens
aagggaaatagaacaatgtatgtatttatttgcaggtaattaactgttcttaaacacaagatttatgtacaaaatgttatttaggcattacttttttgttcaaaaaagagccatgtatcttatgcccaggataaaattaaagtttcattgtacaaaatattaatccttgaaattactctttgatagggaagttaaataagagtctgttatgtgctgtattctgacgtttcctaatatatttggacaaaataggacacagctgttacagcgggaaaaaaaatacaatgcggacttcttctttacatttaaatacagcaatcatcatcttaatgtttttctatggcagagacctaatagattgcaaaaatcttcagatttgtattcttatttctaatgcaatttattcttgacttttgctttgctgttgctgctttttcttgatatagtatattcctcatttctttttttaggctaggcagctggaagagaaagaccgagtgctaaagaagcaggatgcattctacaaagaacagctggctagactggaggagagggtatgactattttttatcattgattctattaccacatctgctgttttcttgtatatttatttaaaaattaataaattagaacttcaactgcttttcctggttgtaaagtggccaggaagtgaagaagcaaagcaggtagttagttcgtcctctgtaacaatgtcattttttctttggtcactttggaatggttgcgttatttgttcactgatgcattttaccacttgggacctaccgcaaatacttttcttatatgtttagaatctacatagcctccaggtcagacagtacactgctactcttatctctcccagacattgactaaactttagtacactcttaaaaatggtagtgttttaaaggatatatttatcttcttttatcttttctttttttgcttttttctttttgaaatggaatctcactctgtcgcccagactggagtctagtggcatgatcttggttcactgcaacctccacctaccaggttcaagtg

SEQ ID NO: 127630 - DNA, 1033 bp, Homo sapiens
atttagtaggtaatacaatttccatgctatctataactgttcaagttgttaaattttttgaattgttaatataattatttaataggttcactcttttagatgccctcagtgctacatttccatctcatagtcaagtgtaaacatatggaatattgatgtttaaaagattttttctgatcacagaagtactaactgttcattataggaaataagaaacagtccaaataatatatcccactacatatatcataactactataacatcttaccatactttacacttttttccatgtccatataaacaagtactcaaccttctctgtccctcccttctgctcctccctcccccatttctcatgcaaaattaggagcttagggcacatgctattttatgacgtgttttttttctcacttaatattttgagttttaaaaaattaattttctgttacgatatcagctttcaaggactcttactgtttgattatatggctggatcaaaatctttataatcaatatcctattgtcagattatatcttatttacccaaacatctattgttcactcttagttgttgctttaaataatgctggttgcattttcttagatgtaaatactcttatattttaatatttgctaggattgaatgcctggaagtgaaattggccacataagaagattaatgataataatgatttatacacacattcacacatttatagttattattataaattttagtatacttaatttatattcatttttaaaatttatgtagttaaattcattctttctgatatacagttctatgagttttgacaagtgcatgtaattatataaccgccaccacaatcaagaaacatattcatttgctcaccttaaaaaatttcttccttttgccccttgactataaagtatgtttctttttaattctgaacatataaagaagcaaaaataagaaaatagataccgcccataagtctaccagtctgctgtaacctctgttgacattttgtaaaatatccttctgctttt

SEQ ID NO: 127631 - DNA, 1012 bp, Homo sapiens
aagtttctatcagcccagtatgttatattcataatcccagttttctcttgtataaactttattatagcctttgttgtaaagccccttcaagtctattctgaaaagagacaagtctttaaggaagtaaacatacgtacttcacttttaatctagctatcaacaccaagttaagacatcaaaatgttcgtgttgggttccttaaacttgatttccatattttctttgtttctcttgaattataggatattctagttttccataatgatccacttaagtacattgtgtcacattttccagcccagttacgttatcccgaatctggcaagatctgaaaactattcaatacatatttcttctaggaatagcaaatagtagatggggaaaaatgttttatattattttttcccaagatatggttctatatcaataaataatgttgtagtcctctttgtttttatttgttcatttacagtgattctctgttagagagctctacggagtttcatttccttgcagtaggtttactacttttttaaagttgaatgtgactctccatcctcagcagctattagcttagtcaatgtattctaggcttatttaagtttcaggattcatatcgtgtgacttttcctcctagcatcatattaactgtttcaaagcaatgtgctattaaagtgttgtggccatgtttcttactttgttattcttcccagtggatctcaaactattgattctgtttgcaatccagggaaagatgtgtgctgctggcctataacttggtggtgttgggtcttaggaaatattgccctctttggtctttagtgtacacatctgagctttggacatgttattttaaactttttcaaggatcatatcttagaaaagtgagtgagcatatagctgtacaccctttatttaggttgtaatcagctcttcaaaattaaatttgttgattgatgcggtgtcctcagcaggctcaagtgttgaattctcttagtgttttctaaataat

SEQ ID NO: 127632 - DNA, 1834 bp, Homo sapiens
tgaacccaggaggcagacattgcagtgggccgagatcatgccactgcactccagcctgggtaacagagtgagactttgtctcaaagaaaaaaaaaatcctgtcttatagatgaggaaactgacacacagagaggttaaagtaacttgcccaatatcacatagctagtaggtgggagagccaacatttcaagccaggaaggagctctggctatgggctaacatgtaatttactcccatacttcactgccagcatcattttacctttaaccactagtagtttatctgtcttcttatttcagagaagggaggatgtctcagatcagaaccttgggccaggcaacagttactaaccagaaattgtttccattatattttccctattatcttccacttagacagttgaatctgattttctaattatggtagttatataaagacttctcataattattcaacttttgaaatagagctaatttaaagaaaaatatcaagtgaatagcagtaggtattaaatggtggcctatataacaaaagtcctgaaggtgatacattacatattaatggataggatattgtgagtagttgcttacagagggtgaagaattatgaatagggcagctttctggtttggccgatgtaattcacgtttgttgtgtttgcaaaggtaagggaacctaaagatggaaaacttagtagcaattgaggggataagagggcatagaaaggacatgggtagacatgttaatgttccattattaacctacattgcatgtgtattcaattattcagctccgatttggtttatatttagtgatctcactcataccaagggggttctactggatagcaaagttttatacatttgacttgctttgggcaataaacatggggacagatgataaaagaagggttatggagagccaaaaggcagttgctatgaagccatcacaaaagacactaaaccgatggggagcagagcaaaggtttgtctggaaaatacaagttaggctgaagttgggatgacccaaggtaagttttaaatataacggtacatgctacttgtattttcccaaatcactacttctgcacttctacaacaaacttctgctttctcacaggacttttatggaaggaagaaaagtaatttgaatcccttaggcctttttataggtccattgtcagcgtcttgtgtctgccttgacccatttgcattctggtggttgctgggaacagtaagataacctatgaatagtccttgtccttccagtgtgatctgaaaggtctttgctgctctgtgcctgaagagaacattgacaggtagttaatgatgttctcgggttgcttctagctctttgtagatgggggtggccagtcatctcatggctacttccttgactgggaccccttcccatattgttcctattagtttttaattccaagagggtgggctgctctctgtccttgctttagtgttgatgtgttcatttagacactgggcatgccttgtgagtctactggactgtgtttgtggaactcccatctcttcttgcccttttaacccttattcttcatgactgagaatgggccatgcttctttttgagcctaatctgttattgcatctgctgctcttaattatgctccttttatgcccttaattactcctcttggttttctgttagtttttcttctccttgtgttactctttcacccttagcatatctgacagtcaggatagtactgtggcaaactgtcagccagctcccgttgattggtaatgcttacgtagtgagctgtgttgggaaaggttgtgtagccttactcagactcggtagg

SEQ ID NO: 127633 - DNA, 1109 bp, Homo sapiens
attttttgtatttttagtagagacgggggtttcaccgtgttaaccaggatggtctcgatctcctgacctcgtgatctgcccgcctcagcctctcaaagtgccgagattacaggcgtgagccacctggcacccagcctagggcaggtatttttaggtccatttttttaggtgaagaaactaaggttcaaaaattaaaatgaaccacaagagtttagagtttaaatatataggaaagatccacattgcagttgaaaagttgaataaagaaatgtttggctgtataatacagatacttagttaaaagaggagagggttgaggggatcactttttcctactatgtgcagaagtatgatatagaggattacgactggctcttttctagttatgtctgagtatgggattaatttttttttttgtaagaattcaatttcagcaggggggatttagtttaaagatggaaactagttcccccttagatggaaagtctgttgtttaatctttttccatagggttgtatataacagttttagattctgtccagattcaaaataataaactagacagcagggtccaaagttctgccattatatctaatgattgtaatttttaaaaacaacaatgcagtcataaacttggattcagtctgtaacatttgcatgcactcagactttattataaatgcagtaatcttcccttacccactgaggattccttccaagacccccctgtggatgcctgaaatgcagatggtaccaaaccctatatgtataactttttttctccatacatacatactgtgataaattttaatttataaattagggatagtagccaggcatggtggttcacacctataatcccagtactttgggaggctgaggtgggaggactgcttgagtcccagaaatttgagaccagcctgggcaaatatagagagaccccatctctaccaaaaataaaattagctgggcatgatggtgcacactggtggtcccagctactcaggaggctgaggtgggaggatcacttgaagccccggaggttgaggccacagtaagccatgattccaccactgcattccaacctgagtgacagagtgaggcctttt

SEQ ID NO: 127634 - DNA, 1114 bp, Homo sapiens
ggaaatggtgaactgagtactgatgattaatgagcacagggattagtggtgatattagtaattttgcttggcacaggtcacatttaatgcctatgaacagatttttgaggcaggagaggtttggtcaacccccttcttccttcttaagggtccagtgcttgtgctgtacccgccctttgtcttcatgtctacccacaggtctcaggcagcttcccaggcacacccatgcttacctgaagccattgcctccttttccacgtcctacctcctgcctaccaagctgggaacagtttttttcctttactctgtccatttctctttgtgagcttaagaaagctggtcaagtctagctcagctatacatcacatcaaggaaaagctgtagaagtgaggcagctcttctctgcacttcttatggactgtttctagccgtgaatccttgggtagtcatttgctcttgttaagtctttctttcctcctctgaatagagatgtggcgtaaagggaaggatttctcaagtcctctgaaaatataaattctttgtctgtggaaatcataagatctgtagggaaattagacttctcaccaacccagtgtcatcatcctctgagacgtggtgataagaagtgcccttcaggctttgcaggctgccttaggaccattttctaatggaaaaatgcattcagaattccaaacacttgccttagaatttaatcctcagaaaatgacttaatccttttttgtgttttgttgttgttgttgttgttgttgttgttgtgtgtgtcatatatttctgttttgtatttaataaaggtctcaagctcttctttatttcagtatatttacctatcaattgggattgttgatacctccttcaaataaatattgggtttatttactgtttacttttaggatgagcctaatatgcagagacttgcagattattaatcttattactttgaaaaagaactgtttcaaggggtgaatactgaaacttgtcccagtacttggaattttcttgcttttattacatttcctaaatgaaatttcagagcctggaggaaagtagtggtgtaagtatatttcaagtatatataattggtttgaattctttg

SEQ ID NO: 127635 - DNA, 1834 bp, Homo sapiens
tgcaatacccattaagtttaggctgaaggcaaggcaacttcttctgtacctttgacatccacccacaacccagataggctacctgaaacaagtccttcacccattattattaagaaatcccactggcacactctggtcctgtatgtgtgtccccaggacctggcacattgtctcttcttctgctcagacatgagagcccttttgccagtgggcccctttgcccagggattcttttcacctttcctgtgcctgagtgagtaataaagttttctgttatgtactatcattggatcagatgacatctagttttttaatggtgttttttgttaatcgagtacatttatgagattgggggtacccaagtttgggctaagtcagactatggatcatctttaacagaaatcttggttctcagacatcactcccaaccagtgaaatcagcatctctgcaaattgggacctagtatttttcaaaactctccagtgattccaaagggcagctgagattctagagggaaaatctattttatgttgttagggccatagaacattttagaagagccttatgataaagtctggctgatgttttgcacatagtcattgaaatacatacttctcgtgatgtgtatggcatgctgagcacaccatcagaaatcacgtggccccttcttataaaactatggcagaactgagagcagcagagcagagtaaccagagttaaatttgagtcaccataatgagattaccattagattctgtggaaaatgtgttgcaacaaatatgactcagttgataagtgcaaattgcattttgcccttgatgcaaaataactgttctgtttaacgttcaggatgtttttgcctgttgttttcatctaactcagaacggagtctgcttaacaaatgtatgaaactggtcaagacctcggttttccatctgaatctgaaggtgacccttgtttaaaacttcatactctgggcggtctttttgtgtcagccttgctttttgccattttctttttcagatgacacaaaacagacaagatcagctgggagcccttcaaagccagctctaaatggaattaaaagaaggtattctgaggcaggaaatagttgttagatgaagggcctcatggggaatgattttgaggtccttagattttatgaagttggataagtcagggctctgagtcatggtttagaagaggagctcaggtggaaaaattgaaaggaggtctcctcaattttgtaggatgtaaaaatgagaaaatttagcaaaaaaggtttatgtgctaataatgagcctgatttgaaatattggccttccagcactttgatatgtgtctatcagtggtctgcctttgacgtgaaggccctgtgtgcggcagcttaacttgtgaatcctcactaaaggggaacagtgggagacggcagcctcagagtgcatgaatggcagtgattggctggcaagttgcgtaggccaataagcagtgccttccagggtaaagacctagggaagcgccttgtttttgctttgtcttagtgtctgcatgtgtttgacaagtgaacaataaaatgtgctgtttgattccacactgtcttgattcttttctgtgtccctcctgcaatctttctttttcatgtcacattacatgaggctcttttcacctctctctcctgaccctgagttctagtgttcattgctctctctcacccaggatgtgctctaattggcaaaactataacctggtagcagcagttcactattttagtttcctaattggtgtcaggggctgctggcagagcccggccatgttggattgattgatagatca

SEQ ID NO: 127636 - DNA, 1028 bp, Homo sapiens
tatgccaaaccatctctttagtataaatgtgttttcttagtataattgtgaacattaccagttcagatataggcactatatgaaatatgacccttcttggtatagatggatatttacaaaaattttaaaattacaacctgcaagaatatattttacatcctgacccagagtacacacagattttaattcatacataggaagtactactacttgtgatttattgttttctgccttcttaaagtttctattttattgtattttcatattaaaaatgctagtgtgatatgctaaaatgatataatagtccaatagtaggtagcaacctccagtctgaaaaatcactgagagtcagtgctggccttgtagggttcatgtggctgagcgaaatctgtgttccactagttttacttttgctcatgtgctgcctcaggtacttgtacttctaattttgttagttttctaattttgtgaggccttgaatagttttgccagtaggcatttgtgagtgattggattctgaggcaggattaataattttcctgaggctgtctcttgccatttcatcgtggtcctttgggggtccagtggagtttggattacacgagtatactcagaacttgtctttccagaggcttcctccctttttttataaagctcttttattccaggcatgttcattatggcaactgaaggaaactgaagtacaaaaatattatttctccacttgtatcttttccatattgtgcgggagatagtataagaaatgtgttataaatagaaattgagaagatgcagaatagtctcatctttatcatcttgtaccccttgtcagacctaccaaagtactggctaaaaggctagactaaggttattgccccatgtgtctttgcctagaatgaactagcagtgtaggagcggcatcacctagcgctcttttgaaataaggtgtccatgtcatctcattcagtcctttttgaggaagcaaacatttgttgagtatctactccatgatggccctgtttcaggct

SEQ ID NO: 127637 - DNA, 1786 bp, Homo sapiens
ctgaaagcttccattagtagcttgaagtaggcactgctgcctaatatttcagtcagtgaggaaaggcaggtaatgacattatgaatacaattataatgcaggccaatttcttctaaaatgcatggaagtattattactttaccaggagtctttgaaatatgatttatttaatgcattccagcccccataatattaagatataattgagatgtgaagtttaaaaaattgtatgcagtcagtatggtacatgaatcatagactaaattgcttataattttaaaggcacttaggggaattgtgaaatttatataatgcattcttatgtttggaaaaggttataagaacaatagtccagttattttagtatttcagtcccaaaaataggattttttgagttgctattaaacctaagatagctgtatacatgagcaaatccaaatctttctatgtccagttctcattcactactttttgtgagttttttctttaaacctctcatatttatcaaagctgttgagtggtatataatttctataaaggccataatctagtttttataaactgtacaactgaatgaatgacagcaacataaatgttgccagcatgtttaagaagggaatcagttaaatggtacttggaattttgatgattattgctttgaaaagactgaaaatcacaggtcttggctttatagtttaattacttgcttaacaattgctagtgattcactaaatcacaaggcttccaaacaaataacatcagtaactctgctatgcctgagcaactccaattttcttgacaatggctaccaaactgtgtttagcctaatataaactgttagtttaactgcaagcaatgggggcttcaagcatgctattgatgagatgccagcaaattgagccctttgccactggtgacacttgtgtcaagaataactttagcacgttttatcaagaccagttggagaagcaaatatagtaattatccacatcctttttggatattaggtttaataataatgagtgctgtccagctttccagagtttctaattaataattggttcttaagaacacagcatgtggtttctcacagtttgaataagattgggaaatagggcaagcttaaggtcctgcatacttttatgggcctgatagaaaaggcagtttaaaagaagagcaagttgtaggaagacattcaggtgtgctggtgtgaaaatttaatttgtgcctttattgacctctgctccctgaccttgctgtgtcttaactttgtggcatttccatgagtacactgctcttccttcttgcccttttgcaaccgcaagcttttgatttcaaatggactcttccagaattagatgaatttctcagtttttactttggtagcagctacagtcttttgctcacttgaaaatgatcttatcccctgttctttagtactttatcattgaaataatggaaaataagcatgttagacctgcatttaagaggggacaataatgcctgtcatttatcgggtgcttactcatgccgggcactatactaactccacgtacgttcttaaattgttaaagcatgaggtggttgtattcttgtgcctatgcaatggttagaatgtcccttctaaaactcacatcaaaatttaattgccattgtgagagtgggcctctcagtgcactcgtgaatggattactgctgttatctcaggtgtaggcagttgtccaggcaatggtctcctgatgaaaggataagtttggcccccatcctctctctgttttgtgtgctc

SEQ ID NO: 127638 - DNA, 1844 bp, Homo sapiens
attggatatagtctcaaatttgaggagagaaatgcaaagaactgttgcctcaccataacctttttgttacaattgaacacatagatcataatgctttagtgggtagaattgtgtaagaatgaataaaatcaggcacatataagatcggaaagcatcagttttacagtattttgagaggaaactggccactgagaaagtggcttcttgggttatattggaatttggatcttggatgcagagtccaagatctaagatttcccctggactcttctactaaaaatgaaaactgacagggcgggtggaacaataccttaactcatccactcctgcatggtaataaaacttgttcagtaaagccatgtactttccacctgatgccccatgcctagctttattgacacctgtcaaggatgtctttcttaacaagctcacttatttccacccaagtcaatggaataaactcttagactgaagtgaataatggaggcttgtgattgttagaagccatcacagcagtagtggaaaaaatgactgctgaaagccagacgttgaaggaagagagaaaatataaaaagtagaaactatattaaagtgcttcagtggtgaatattcctaaggacggccatggtttattcctacaacaaaaccaaacccctgaaccgctccaccactttcaatccaattgcctgtaaggatgcagggaatgaaatactctgaggaaagatttcccttacagatggccacaaaatttaatcagggattcacagtgtatcaagggataggccttggttatatagaaaatgcacttaaatggaacaccttatttcccagggatgccagataattgagttatacctaaaatcttgaactgtctgactagcacacatgcatacacatctagcttctgtgtgctgagaggtgttaaatggtttggaaactgtaattaagtagctgaaattgtgctgcagaaccactataagcattgcctcatgtagtatttcaaccttaagtgctaaaatttcatctgagtagctgtgactaatctagtctttatttgtaacacattcaaattaggaggtgtatgttcttgtccatgtactttctcattagcactaatattgctaatgggagtgacaaatgtattatgttttttccttcgatcactcacgccttttagataactagctttttagaggaggtaattttccttgtgatacatttatggagctctgtgtttaacagatttactcaaaagaatatgtccgtagggactgtttattagttgataggctccggggaaaacaagtttggattaatcagtttgaatcacagaagaaattgtgatggcagttagtgtaaatgggaatagcacatactcatttgttcctaaatgtctttccagcattttccgcctagtttatttgaacttggaaggttctttcctaggctgtttactttgacacttgaacacaccctcttcattcttcctttccaaattttcgtttgttcaaaggactccttaatgtttagagagtcactgaacagtgtttggtacagtcataaataacaaagaagatacattctgaaaaatgcatcattgtgtgaatactagagagtgtacttacacaaccctaggtggcatcggctactacacacctaggctaaatagtatagcctgttgctcctaggctacaaacctgtgtagcagattcctgtacttaatacaattataacacaatggtaactctttgtgtatctaaacatatttataaaggtacagtaaaaatatagcataaaagataaaaatggtatacttgtatagggctcttaccatgaatggagct

SEQ ID NO: 127639 - DNA, 3524 bp, Homo sapiens
cagttttaactcagatcttgagcaaactgagcaacaccatagaggagctcttctcagttatgttcctgccctagtagtttaaaactggctgatttttattctatagtatttatagagtacctactatggaccaggcactgcttggtgcttatttttatatatcaggtacatttcaaaggtattaaaataattttgaatttttcactgttctctttctctttctctctgtctgtatataacagtgagaaatgtgtgtacattatatgtatatgtgtgtgtatacacacacacacacacacatatataaaggccaagtaaatttttagttaaattgaattattccttaatggttacgtgagaatatcttatcaagtctaaatatagtaatcatcagtatgattttttatgtttgatgtaataagaatgtgtctaattttatgcattttataattattgaatgtatctttggacagtgtgcatacagatagttctggttatcattttcaataaaaatgtttatctgaacttttgtaactctgccctctgaagattatgcttcatagaatttctcatgttcatgagcataattgctaactggtgtttatgtagattgcattgaacaatctttaggaagaaaaaagcacattataccattttcttttcaaatttaattgagaaaatcttgtgagcacctcctgtgtgcctagtgtcaatgcctacattttagttgagcttcaagatttatctaagtatcttagtttttctttttataagttcttttaaaacttttattaaagcaagatgagtgttattaaatgggttgcacaaatgaccactaactcgtagtaatgttaccttatcagcttactctcatatgtgttttcttcagacccctcttttggtcttttccattctcatgcttcctacctatcacttgtaaagaagtttgaggtcatttaatcacatctaaaccattttaacttttaatagacaataggaattcattttggtgcttggcaaccccattgatatgtacttgtgtgaatatgtttatacatatatgtacaatattaaagaaatctcatccattcttttatatttatttaccacaaaaataaagttctggaataccatgccttacttgaaaagcattatttctgagtattttcacatttatttaattaattgttttaatgttaggtagtgctggcttaaggggaacctttttgaaagctgaatttttaaaacaatgaaaacccaagaagtcttcatgatttttaatggcaattttaaaaaagcactctcattaatgtcaggaacagattaaaatatgcattctttatatttttcaggaagtactaaccaatgccgttagacaagagaaaaaagtagaagggaaaacatggaaaggaggaagtaaaatttccattatttttagattgtatacctgcaaaatgaagaaagccagctgacaaacttttataagctgagagaattcagttaggtaactgcctataaagtcaataaagaagttctttatgtactcataagtaacgagaacaaagaaagtttagagtaggctttcattttggaataataattttgtaacatattgacagttatattaaaacaaatgcaaatgtttattatacaaaatgtttattatacaaaaatttgcaccagtagatttgaaaacgtaaaacatccataatcctaccactcctgatgactagtgttaatacttgctgtttgattcctgtttttaccatgcatatatacttctggggagtgtatggataggatggaggaggtacaaatttcggctcatattttactactatttatacatttttttttacaacaatgtaattattttattacaacaatattttttacagcaataaaaatgtaatatttctattatagcaatgtattgtgactatttttttcatattactaatattccagctattcttttaatgtatattttggatatttgaccatttttccatttttggatatttgtggtgttttcttttttttttttctttatccttttttactattcccgacaatgctaagaagaatgtcttcttggctaaatcttagccaatctgcactcctgctctctcagatcactcagccctgctagagtcttgatagaggagcagttggagaatcaagggagatgatgatattaaaaccaacagtactgtgttcctaatttttgggttgccagcagttgtaaggcaccctgtgtcaccaagaagtcagcaattgattggttaaaggggaggatttgagaattgtacattgattgctaaggagcaattaatgacttgatattgatgacttattttctgtttttgataaatttctaaaagcaaatttgctgtttaaagagtatattttaatgttttctttctgtacatgcatgctagtaggagctcatgcccacacagagaaaactttctctcttgaaagtttctatcagtttatattcctaccagcaatatgtggtgggaattacttgcctacttattagcattgggtgttacaagttctgttgttatttatcagtttgaaagtgaggaagatttcacttttatctgtggttcttagatgaagagacagatagtgaaatagagagacatcgccagacatatgtggctaacctgaattgctcattcataactttccttttcagtaatgtcttaacatattttttataagaccccctcattgtttgcatatataagttttacttttagatagtcaaatctgtcagtcttttccttttatagtaactatatgcttagagtggtttgtctccctttaaaatttatttaagtcatcactgctttatttgtacttttgttttcaatttttttactaatgaaattttaattcagtcttgtgtttattttggcatgtggtatctcaccagctttttctaaacagttttgccagtagtagctttttgaataagtaatttatctattctctttagagttgtcttggctattttatattaagttctcatgtagaattaaggctgtttctggtctttgaattctgtccaattggtatatttaccaattcttgaaccagcacaacattattatttattgtatatttacactcaaaaaatatttgtcaaggcaattccccagtcatgactattaattttcaacatttctttgctagtatgatttatctgttcttgaaaacgaacattagtctcttttcattaagcattttaaatactcaagtctctttgttgttctttgtgcatttagatacctttatgcagtatctggaatgtatgtataaattgaaatttttgtgcttctaatatttagatatagtaggtagtttattcatgaaaaggtctatttcttagagtatgcttaagttaagacaaaaaataggatcttttcatgcttattttttatcctttattttttcttctcattgttggcttgggttcctttctctctgtttgcaaccagaccctttattac

SEQ ID NO: 127640 - DNA, 1059 bp, Homo sapiens
cactcttccaccattttcttcccctctttcttttctttctgtctatcaagagttgcatgaaaaagcacatctctttgaccagcctccaaggtgataaatcttcatcagctgagaataaatttgatttttggaaacagccagcagtcagagtcaaggtcagtgggtaataaaactatagtaacattttgagttagagatggggagtgactgtaaagtagtgagcccatttttcttgagtttttggaaggcaaagaaggaaatcccaaaacaggaaatctcagtttattgtgtatatttgttaaaaacaaaagaaaacaaaacaaaaaactagtcttgtttgataatgacattgcaagttttgtatattatttatttatttttgtatttgtgactttttccccccaatggttgtgtctttcaactgactgtgggatccttgtcacacttttattttatgttgataatccttttggcattttaaatgatatctgtatgtcatattgaaatacagtaattaaagtggcacaacataggaggaaatcaaatttcatttaatgtttaattacataaattgactacctgatagatttttttttaaatttggagtttaacatttgaaaattggcaggaaggttttaatgcttgttttaaacatagtcatcatctagatctgtactatcaaatgcaatgatattacttattataacattatcaaatgttatatgtagtgccatcaatttatattgttttcaaagtgtaacttttaaaaatagagatattcagcagttatactaaacatttgagtctttcaatgtctgttaaatgtaaaacttgatatttattaaaagagaattttaaacttagaaaaacagtggttttcatttctgtatttcctttgaatttgtttggtatctcattttttcaggctataatttagaaactttttattttacatgcttactggccatcagaagagttttttttctttactccaacttcatgtgtaaagttttaaaataaagtgaagatgttagtgaatttgttttgaaaggaaggaag

SEQ ID NO: 127641 - DNA, 1026 bp, Homo sapiens
gaatctgttcattgaattgaagaaaagtatttttccatttccagagtacatctcgtacatttttgcattctggaacaattactgttatgctacttaggcaaataaacataggctcattagaagatggaacttgtgattttaaacttcattagtatgtatttttgttcatttctcatccacagggtccaagaaagctcagtatcttcttgttccgggcagtgggattgagtaggggagcaggaaataggcgtttgtcctctctcttttaagatgagtcctgggaggcgtgcttgtcactttccttcacattctgttggtcagtactcagttgcccatacatatccagcatcaagggaagctaggaaatatcttgtttttccctaggatgatatgagccatgcaaaaattcagaggccctgttatagatagatatatgaagagttagtatctgccacagttatatggtcttcaaaaatgatatttgagctttctgatgcaaagccaattttcaaaactatttagatatttaacatttcttgacaactcctttgcgattgtaaatcacattgacgttttgattatatgtattcatttgaaagcactaaatactattattttcctagttattgtggtgctaaagagttgtcagtaaaatctagaatctttaaataaattttgaaaagggatgacggaccaaatggaattctaattacttgatttcaacacatttctctttcatttgaatcttttaagagaaaagtgaaaagcaacattatccttgagaatttctctctcagcatctaagcagccgttttaattacagaaaatgtcttcaaaatctgttttgccattttaaagttttggctgtgaaaaagtcaattgtcagtgtgtaatggtggaaaaaatatcttaaaaagccattgatatagtatgttcagtagacatgtgttacttgaacactagtagttgattttccatagaaactttttcctcttgagtttgggtatcgttgttggtaataaacat

SEQ ID NO: 127642 - DNA, 1053 bp, Homo sapiens
tggatattatcaccctggcattggcttcagcaatgatcctattcagtcagctccttatccttgatgtttcctcttgatacttttctattcgctgatcccccaccttgctccttggttataaatctctgctcttccttgttagaatcagaattgagccaatctcttcccctcactccaagacctcattgcattagttcctccacctattgccatgggccctcttgaataaagtctgctctgccgtcttaacaagtatgatgaacaactttttctttaacaggcccatccacattataaaaggtaatgttttattcaaagtctgaagatttaaatgttaatcacattaaaaaaaaaaaacaaaaaaccccaaaaaacaaacaaacaaaaaaccccagctagactggtgtttgaccaaacatctggatatcgtagtctagttgatggacattaaattaactgtgaaagcaattgcctccactttctagatgaaaaaaactaacaagtactttttgccctgcattgcaaatgatgtagaaagctaggcaatcatgttcgtaatatgcacaccaatggctgtagagtgtagaggtgtttgctttgttcacgaccatggttgtgggtcttttctgcataggtagggaagaacaatagttgattgaggaatgtcttccagcccaccccgcaacacacacacacacacacacacacacacacacacacacacaccctctgagggaaaaagcctcctttctaccttgacgttgttggtgatgtgccctgccacacagtgtgatagtttgggaccctatgacttccctgggctaaggcccatttagagaagggcctacgctgactcttccccagttgcagttaccgtttttgatggcttcccactttgcaattccttgatgtttttgctcagagaggaaacccatctctgcggtacatggtatggcctccatttttgaggaattttgtggaggacaaggtcatggagcttgagacacatgcagtctgtgatcaggcttatgctttatctgagtaggaccacaa

SEQ ID NO: 127643 - DNA, 1080 bp, Homo sapiens
gtgggtgaattgaggaaaaaccattgttttggaaattttcttttcatgaactaaaaatgctttcagcatctgtatagatcccgtatcttcaaaatgcagcaggcatccaacttgcatcattaaaaactgttagagaataaactcttcctattttttgacaatttttgaacaataatttcatctgaaatagccttctctctgtccctctgcccttcccgtccaggtacaactccatgtaattttaggcaaattgcttccttttctttatgccctttgtttccgtctttttaaaatgaggacaaggtcgttaatgtagttctctttcaagtctcttaccttgatgaataaatatctaaatataggagttcttacagaattcgaagttctatatacgtataaattgagtttttataaagtaattttgttttatgaataggttaccaattccaagagtcacatttattttaattttctttggttattaaaaaagtccattttagaaaaagaaaaactgttaaagttgaaagcctctattttcttggctaaattggaattttgttattgattacttattctgattagtaaaagtggtttagtcacaggccgggcataaatgcttttagacagtcactgaattgaaagtgtcaacatgagagagggatccttttcttggaaatgggagcatgggatctttctgctaatacgtgtttgttggcttagaatgaagactcagagctttgttaggaaaataaacttaaattggcaacatggtgagtgtgaacctggagggcattatgctaagtgaaataaatgagatacagaaaaacaaacactgtatgttctcacttatatgtggaatctagaaaagttgaactcacagaagcaaagaatagaaaggtggttgccagaggcaggggactgggagaagtggggagatttggttaaagggtacaaagtttcagttataagatagatgaataagttctgtggatcgaaggtacagcattgtaactatagttctacagtatttttaataatactctattgtatacttgaaatttgccaagggaatggatctta

SEQ ID NO: 127644 - DNA, 1971 bp, Homo sapiens
gagcaggaatctgtttacaaacctgcagtatttattacatacctcatttagcccattcatcattttaatagaaaaatgagtcattttagatgattctgaaataattcgaggtaagctacattgctgcaggcagaatatgatttacacagatagcaccatgctattttgaaaaaaatacagtggaatgatcagcaccaataatttatgattacttgtggtaaacttatcaaatgtcttcattgtcatagaaatttgttgattagataaagcatttagagttttctagctagcttttcccccttcttccatcttttatgacaaatgattacaaagttccatacttaccctctgcctgtttcaaacactgactgtaaatttaattccagatttgtttttaatattttcttgataagaaataacactagtcactgtcatgggccaattttattggagatgataaaacctactcatatacattttctgcttagaaattaaacttcatccatttacagtttctttagcccagtgtatgcacatattttaaatcctatcttacctatccataggttacatatttgactctcaggaacacaggtaactcattgcctggaaccatagctctgagccccaaaggcatcacaaagtgattctagttagtgtcttgaagcttatgagctttgctgataagcagcatcacagtaaaagcaatatttgtttttagatttagttttttttttttttcatttaactaagagccttcaactgtactatcttcttgggtgtttgatatgggcaggacatctatcattgattcctattagagatgataaagcaaacattcaaagagactgtgaaactaaatgttgcacagagatagagccagggttacaactctgatcttctgtgccgaggtgatcttattttgggcacaatttagcaaatttagttttgttgttgttctttgtttttaacgtgtaatggatttgatttattacattagaaagggaaatggacttttaggcacgtggtcaaagcagaaattactgcagctaagagtagaaagggcaactaatcgccatgcatgtgatgcacactcacaggaagtaaaacacacacacacacacacacacacacataaaacccatagcattatgagcctacttagcatagaggcaggcagccgtaactactcgaataggccttgtgtgttcttgcttagtgaaataatgtatgcacaatcataatgctatcagggattgagaataatttgtttaccagcgtgggtgagaaatattagcactaccatttccatagaaaccattttgcatttaaaaagttctggcatgtcaaactgtaaatttcagtatttaaaaacattctcttatgtgaatccctgtattgcaaaagatactggtcaaaggaagtgctatttgtacactttcgtcaagtcatttttgaattttcttatttaaagaaagtttgccatggcctgtcatactttgggagaagtggttgatatagacacaaaaggacctggtttgtagcaattatccattcccttggcctcaaaggaatactagtatataaaggcagaaactttctctttttcttttgagactgagtctcaccctgttgtctaggctggagtgcagtggcgtgatcttggctcactgcaaccttccgcctcccgggttcaagtgattctcctgcctcagcctcctgattaactgggattacaggtgcacgcctccatgcccggctaatttttgtatttttagtagagacggggtttcaccatgttggtcaggctagtcttgaactcctgaccttgtgatctgcccgcctcggcctcccaaagtgctgggattacaggcatgagccactgtgcccggcctactcttttttatgtctaacataaagtcttcatttgtgcgggaggtaagagatgattcaattatttttgtcactttg

SEQ ID NO: 127645 - DNA, 1013 bp, Homo sapiens
gtccctttctgcattgtccttcgtcatatatttattaaacacctactgtatcctaggcagtatttcccagggatgcaaagatgaattagatctggttgcttttcttcagagtctgaagttaagtgtcaggtttgtggggaaggttattcttgccttgtgtattttgtcccaacttaagctataatttttgaatttgtaaaaccttatactgtttagaaaaaaaaaaaacacagtaaaaaaaaaaaggatgggtgaatgcataaatttagtttttgaaaatttaagcgactgtttctccaaaatgtcacttttcatccccagtttgccttttgtctgaaatgcaccagtgaagcaatcaagaagaagaattgattaattttgtgctgtatgcctttcagttctgtattttgtttgtgcttcaaactgtgacagttgaaatttcatggtaaaaaagaaaacggttttgaatttgggatatagagaaaaatgactaaattaaaggaagcagataagaacactactgctgtccaagtgaggttctatccaacgaggaagggaaacaactggggttgtaattttgaaatgatcgacatggtttatactcaaaagttctgtgtaagagaagagtaagagtgatcacttggggtttttagtatcactgaaattagccaggtgaacgaaattgcagtgtaagcagtggtttcccgggttcttttattgggcatttaaagataattttagaaatctgttgtttttgggtgcaatttagacttggattataacctctgttaaaactctctctggttatgtatgttgtgtactggttttcttgccctagacactaacctccaattatttggatatgtgtagagtattagtttgctttgaattccaaaaatgaagttaatgaattcgagcttttgcttttgacaactattgaaatatggtatttccacgttgaattggaaggatttgggccatttaggtgttagacatttttctcagtgttattg

SEQ ID NO: 127646 - DNA, 1473 bp, Homo sapiens
aaatgtgaaagtatcaaaagatttgttactcaacataactaaaatattaagcaacatgttttgattggaatagcatatctgcagtctgttctgttttacctaataaatcttgtctattgtctgtctttactgctttgtgtagctggtgaagcatgagaaactggcctcgtacattctgatttgtagatctcttatttacagattctggttgtgtggtatagatgacaaattgtagtactcacaactcctgtatttcagcatctgttgtaatatttgccaaatagagccctcaaagcacttagggaataaaagtggaatttatgccataggatgacagctgattgagagagtcccttccttcccagagtgttgtcagacatttgcatggtctgccatggccacagcaacatggctgccagtgacatttagttattgggcagttcccaatttatttaccagatttctccctttattgttgttatttattattatggaagacatacatattcattggatcaagattagaaaataaatacaaagggatactaaaatcactcaatgtactacaattcagagatagttactgttaacattttggtttgttgtgtttatattcctttttacttcccactgagttggtataaaacatttgattttatgtgtataacggtatttctccaaacatagataatagtatacactcttttgtataactgttacaataaccttcacattaaaacatttaggccatgtggtaaaagtttttatactgataaatacgtttttgtgtggtcacattttaatggttgtgtttcactgagttttccactaattactaaattaatacaagaatattatagaacacttggaaaacaaaaaattacaaagaaaatcagtattgttataattctgtcatctatcattaatgtttagaggtataaagttctttctcccttccccatatgtatatattttatacatgctttagggtctcagattatgtatcccaccaccctccaaaccagtactgtgcggtgtggacagtgatcgcaagcctgctgttgtttgttagttccttgatccccagctggagaggtgggcatcttcagaacccataattgatgtgggagtcaccccagaaaggttagcattgctcctgctattttggagggcccctattgctgccattcttaattctaatatgtgggactctttgagtaatggccaagcattgcttcgttcctctttatttagaactcaaatgttgcagtctgcaggaaagtaaagattgtgtttcacacatgtgaagtaattaaaaagttgtctttcaggagagcgagggtgaaagcacgggagctgatgtgatgttgggactgtgaaataaaacgattcccaccccttaccccacaccccccacatctttctggctcactaacagctgacatttaggtttctgtctccttagatgtgagt

SEQ ID NO: 127647 - DNA, 1017 bp, Homo sapiens
cactgaacatttttctgaaatgtagtttttaatggctgaataatgttctgccttttgtattcaacataatttattaagcaatttcttattgttatttgatagataaaagtggagctgctctgggtgaaacctggagtgttgactgcttagcctccacttcggccttcctagaaacccagatgttactcctcggaacctttagtcctcattggagcacagttgggaactcactggacagggaaaatgggaccatggaatggagaactttgaactgaagagtgagggggattttcctagttcactaggcaattgggaaacactaaaactttctaagaagaaggctcatttctagtctctcccattctttaccttagtcacttctctgaaagaccaacccatgaccagctgcaaacagagaacatgaaaggaagtccatgcgtaatgaatcagtttcttcagtgacaaatctggggtcccggttgcatgggcaaatagtgaagccagaatagaggtggtagaccaagaaagaaatgtcagtggactgactggcagctgccctaagaacagtacatgtgttgagtggaacaaagggaataagagaggtggaagcaaagtcagtcattgtgaaaggggaataatttcagaattaaagacagtaagttttgagtaactcaactgaaaattaaatttgttgtacgtctaagctgaaggattttttgaggaagctgaaaaaatatcaggtcagtgggttgaaaagtcatttctatgtatattaaagtctccaaatttggaagctaaggatgtagtggaggaggttaatagtgctcatgtttgaggaaggtacgagagcaaaactcttagtttccagcgggcagaagaataccttggttggcatttctctttgcctcccagcttttactcttttgaatcttatctttgaagcactctttctccacctctttttgcctgaatttggacatactgtcttactctcttagtttatggagaccagcaaga

SEQ ID NO: 127648 - DNA, 2067 bp, Homo sapiens
accaacataacaattttacttttcctttttaaagcatagctataccttcagggatatgatggtatagtagggttattctctcaaagaagaaaaggcagtcagaaaatctttgttcatgagattagactgaaatcttcagtgattcagtgattactgaatgcctctatgtgccaggcactatggcaaaaatcagtgccaaagtaatttatctttatcatgtacaatgaggggttttagtgggttgtaacttaatatgatctaattgtgtgatgaggctactgagaaatctaatgcaatcttatgcttcattaatagaattagtattgtgtacagatctagggaagtaagattctcctgtcttagtttgctagagcatgtctggagggttaggtttagtttggagctaacagatcgattggagtcattccagaagtgaggagccctgcagttgaaaggcgtggtcatatttgcatatgaggattgttggaaaataggggtaatatactgggaggaaagatgtccttattagttccataatgtctggcttctctgctgtgctgtaacatccacaatgacagtgacctgtccatcttgtttatcgctgtgtcctcaatgcctagcacagtgcctggtgtgcattcagtaaatggacgagttgagtaagtttggagaaagagacgatggttaccttcaaatatttgtcatgtagatggcttttttttttttttttaaacggagtctcattcgcccaggctagaatgcagtggcatgatctcagctcactgcgtcctctacctcccaggctcaagcagttctcctgcctcagcctcccaggtagctgggattacaggaatgtatcaccacgcccagcgaagttttgtatttttagtagagacggggtttcaccatgttggccaggctggtcttgaactcctgacctcaagtggtccacttgccttggtctcccaaagtgctgggattacaggtgtgagctgccaccacgcctggcctagatggtttgttaattacttaaattttcagaggccaaatggaagcaccagggatggaatttttttggtgggcagattttaattttacataagaagaactttgtaaaacttagttatatttggcagccaaattaataagcttcttcatgtatttgaatttggttatttgaaatgcttgagtggaggctgcatggggatttacctctatacctgcttttttgatagattatgggccaagatgatttcagctgttgacctttttggctatgtgtttctatttttaaattatttcatttgatagaaaataatgtcaactaataaaatattttttctaacttagacaattcttgtcattttagactaaagcaagccaaagagctggaccgagagagggctgctgccaatgagcagttaaccagagccatccttcgggagaggatatgtagcgaggaggaacgcgctaaggcaaagcacctggtgagtattaaaaatgtaggagaaattttcttgcctacaaggaaatctctgatgtttgggaagagctaagtactctgtgccagcttttagtgttgataatattattcatgttctctttgctcagattttgatttttgccttttataagtagcttacagtttaggtttaaccatcaaggactttaaaggcaggtaactctggaagtattgaagaccaacatgcagacatgtgtacatgtttcacacctgaaggattgttgtctgcttttttttctttttctttcctttttttttttgagacggagtcttgctctgtcgcctaggctagagtgcagtggtgcgatctcagctcactgcaacctccgcctccggggttcaagtgattctccagcctcagcctcccgagtagctgagattataggcacctgccatcgtgcccagctaatttttgtatttatagtagagacggggtttcactatcttggccaggctggtcttgaactcctgaccatgtgatccacccgcctcggcttcccaaactgctgggattacaggtgtgagccaccgagcccggcctgtct

SEQ ID NO: 127649 - DNA, 1007 bp, Homo sapiens
actttcttaaaaacttgaggttctttagagtaaagtcaaactggctagtttttaccctgggactaaaatatagagaactagattttatacctgctgtccatgaaagttgaatgttttataagtagttaatttgttttcccatttaaaaggacatgtaataatatttattataggagatttggctggcttttaggaattcattttgctggtgtaccttaagtccctcgcctgattgacaatatactgaggaaagagctaagttgctagggcttgaggtctaagggcagcactgactggtatttgtttcattaagcttaggcaagctatccaattacttaatgcaaacaagaaaagtttacactaaactcctacttctttgcttgaaactctagagaatttaaatgaggagagatatgtatttaaaagaaagaaatttaaatgaaacttaaatcagggacttaatgtagaatatattagagcaggagatctaaaatattaagtgggaaatgccaataaataaaaaaggaatgtattctctaagatacttggcatgtttagttttgttttgagataattcttaaatctttggaaacccaagttaataatgagagacttattttatctcctgcctttacatataaagtcctgccttcccttggtcagtgagagcctgggtcttctctccttagtgaagtgttcccaaaacaacatggcttctgattttatagctccactatctgggcagtagttttcagagaggcccagatggcagggctgtcttatttggttcaaaaagagaaaaattggttgacagctcatctaccttttgcagatggctgttgaatagtatagctccatgcggtataaaaccaaggggccagagaggaagctttgaaagtaattgggggtttctgaaaacataagcagtttttctttgcaaagtggttttggctcagtaaagaatttacaggaaccattgaaagaggaaacttagaagaaaataattg

SEQ ID NO: 127650 - DNA, 1027 bp, Homo sapiens
agactgaggcaggagaatcgcttgaatcccggaggtggaggttccagtgagccaagatcacaccactgcactctagcctgggagacagagtgagactccgtctcaaaaaaaagaaaaattaagatgccatattcatgtttatgtatttattttggaatctcaatccacatatattttcttccaggatttgaaacgatttgagctgagaagtgttaagcttctctgttcccttatttttgtcaagtcttattaatcaaaaactgtatacgtgttttgtccttatttttaatagtctaataattacttcattgaattacccagcttagctcttctgtttaaaaatggatggtaaacagtatcttgaatgctggttcggcaggttctgacaaaatatgatgcgttaaaataaaattcattgttagcattaaaatgacctttgaggttgtcgtcactcatttttctctttcagtgtttgaaatagcctttctgcatcaagtgcattgcagtatcttgtatatattgcctatgtataacggtcacggttcaactttagataagtcatttagtcaaatcactttatctctagcaatctccgtttcccatttattcttacccattatctgaagttcttatcaactttctctccatagtgtaatggccttatgtattacatttataaagtaattttctaagctagaattgtatagaattacttatgtgtcaacctacatgaagataaatctgagtatttgtgaatggccaaatgagcagtatccaaattcagaaaaacatttagggccattaaaagccaaaccactttgggaaaggggtggtaataatttagactctggcaaactctgacttagtgtagtatacacaaattttaaaagagcctattttaaaataaccgtgaataatgtaagatttaaaaactgtccttacatgaccacaaaggtgagtagtataatggaaactaattcctataggaaagtttactctttaagatgtttaagaagtatgactttgg

SEQ ID NO: 127651 - DNA, 1578 bp, Homo sapiens
gcatcacatacgtgttatagttgaatttttgtataggaagcattttgtgttgggatatttggaaattaccgtaaagataaaatggattgcagaggaagccagatataatgaatattcatcttctgtgtaacatctgctatacatcttaatgaaatttatagttatccctgaaatttttcttccttgacagtatttatttatttttaaaattattttaaccgggagttgaatatgagttgataccattctagctgcatataaaatgacagtattggatgcagggaccatttttcagatctccatgatagccatcatctccacagaattgaacttagacctcctgtgaaccatagagtaactgggaaacttttgatattcgcagagtgtaagagagtgatgagttcaagcattggtctctgacaaaatttgttctggattgctgtgaacacatttggtctcttgctgtttttttttttttttttttttttttttttacaaccctgttagttacagtgagaagccataaaattcttcctatgcaggaaaatggtagaagcattttttgtgtctaaaattgttctttcttaaaaagaaaagaaaagaatctttttctggtgtggtaacaaaaaattgaaatagcaaattcaaatagtagaaagtgtaaaaattcacaactgatgaggtgatagcatacttttttttggtacagtgacagtaatatagcttatgagctttatctgaagtaggtgaaatactgattatattttacttgagctatcattgacacaatggattagaacttaatgagggggaggtagtttgattttaaaacatccttgattacatagatttttttggaatggaggacagattaatcttcctgtgatatgtggatcaaaaactatataggcagccagtgggctcatcttgaacacctacagccgttctttcaaaaatgatagaaatggatattgtgaagtaaataatgaaggtggcatagtgaattcctgctggcagagagttaaattattcattttgttagtttagctaacatggttcatgctgcgtgggatttgagcactatgtcaatgactaatattgcataattaaaaagcctcagttcctcgggcttagaatgtagctggaatttagaaatggttgttaacatcgtggaaatatagttttatttgtataagtagatgctgtttacctagccgttttgaagttttgactttatgaaacatttgtgtagcatgtaggcagtatgccgaagatgtttttaacgatagttaatcttgcagtcccttccccttgctttgcgtcccaccccacggtgtttttcttcttgaaaggctgctctgtagtaaatggtccgtttcgaaagcctggtgagcacactccctcagcatcgcaccgctgcctcttccctttgcttatctcttccacattaggttgctgattagcgacagggcttggaaggattgccaattctgtaacgattcaatttgggggactgcataggcactgatacctttacaaagcaacgccgacattagtttattaccttctcaattttag

SEQ ID NO: 127652 - DNA, 1045 bp, Homo sapiens
aagttaatgtcttttggagttggagagatctgatttgaatgccagctttgtctcttagtaatctgtgatctcaagtcagtgatttacccttccaggcttcactttcttcagttaggaagccaagttaataagaatatctaccagataagcatgtttttcaaatgaagattaaataagataacatatataaagcacctggcacatattaaacttttgatacaaaatgcttattcttacagataactcttttctctctttgaagtgaagatcactagagtgtgatggttaagagtgtggtcctaggagtcagaccacttgggtttgaattccagcttcatgggttactagttctgagaccacttagtaaattacataacttcttgagggctcagatacctcctctgtcaggtggaggacaatgataactctagatgcctcatctgtaagatggaggacaataataactcttacctcagggttaccttcagcgttgttttgaggatcagatggttcattccaggtacagttcttagtacagcacagcgactcacacagaatcaaagtaaacgctctgtaaaaatgattatctatcgcatccatctgtgtattcattcatttcagagaatcgtttcctagttgtatagtgttaaaaatctgtctgctctcttctacatttgccctttttcattttttcttggctttatagtttctgaagattgtaaaagatctctttgttgatgaaaatggaagaaaaactagctaagtgaagctagatgagctttttctcttttgtaggagccattgctcctttctggaaagctatgccatgtgtaattccaaaagtgctaagtgagagaaataagaagactttttttcttatcagattaacaagtaattaaaaaaaacaacttagtttttagtttgaaaaatattccttttagttgacataagttttcactttgctattggtgctaaatggttgattgttgtatattgcttttttgcttgttcagataatcattttcaagggcttggaggccctctg

SEQ ID NO: 127653 - DNA, 1039 bp, Homo sapiens
tcataaaaatccgtaaattacagggcattttgacttcctgatggggttgttggattaaaaccaaatgataccaaaaaaagtaccccacaaagtcaactgaaaccactaatgtgacaagtgtctactagttaagaaacacttatgcaacagagtttctgcaattcttccattatttctaccgaaccaggtaggtttgacataggaaattcattccttaaacaactgaaaacatggatattgtgtttgtttctttaacaaaaaaaaagaaaattaccagggaaatacatacctataaaaggaattcagtaaatacagatgaatagttttctgtctccctcctttcccttattcttactccctacaaaatcatttatacattcttaccctagattatttatcattttgtttttttaaaacaaaatgagcatgttatataacgtgcttttttctactcagtcatatattgtgatctctcttcccatgtcagcatatatagattcaagtagaccgtctatctgataataaatgccatttaagaagactttgcctaagaaaagtaatattactactactaataatatgtaatagtaagtaatcatttgtaatagtaatagctaacagttttgaatacttcttttgtcctaagcactggtccaagccctttgcacatgtgattatttaaccttcatagcagccctatggggcaggttctgacctgctagtctcctcactttgtagatgaagtagccgaaacacagaggtcacttgcttatagccacatagccagaaagcagaggagctggaatttgaacgcaggcagtcggcatctggagtcacccatacttaccatcactcgatcagactgtgtttcagaggctaaattattttctgatccagcagtaatgttacctattatatgtctgtctgaatgtttttttttttttttttttttgaggcggagtcttgctctgttgcccaggctggagtgcaggggtgtgatctcagcttactgcaacctctgcttcctgggttcaagcga

SEQ ID NO: 127654 - DNA, 1122 bp, Homo sapiens
attgattaaggcagtggttctcagctgggagagcatttgatccccagggggcatttgacaatgtttggagatatttttggttgttaaaatttgtcaaatgttattggcatctagtggatggaggccagggatgctgtttaacattctgtaatgcacgtgacagtcctcacctcctgctgcccgccggcccccctcttatccgttctccccccaccaaaaaagaattatttggctcaaaatgtcagttgtaccaatagtgagaaacccagggctaaggtattcttcaaaccagcccacattggatttaattgttctggatcacttttggactcagggtttgatgtctttgtttttccacacaatatcatattctatgccgtcaaaacctcggtgacacaacattccttaaaagattgctccactcttattcctggaatttttccgagctgctgacagcagttctgcaaattttgatgcttctgtgcaagcaatgacaacagcagcaggactgccgcctggcagatagcaattttcagatgcttttaggtttgtgaaaacgtggaaaaatatgcatcctagaattgataaaatgcagtccatgtacacttcagaccataaaatttgtcagctcggaatgacttcttgaatgtcttactttaccttctacttaatgcagaagccctttttaggcatctgtgactggtagggccacatgcttttagattccattcaaaatcatcgaaactgatgatatttcattaggtcatctaaaatttaccccaaccccattaaatctccactcctaaatctaatgcagacctgccatacttaaaagttgccttagaggaggtttcttactaaggccacagtgacaatacagttgctaattattagcatgatgactatatatattttcatttttacaaaacatttacatatggactcccaattcattttgtcttagatttatcctgttttatggggatcttaagtgatttgcttccacaatcatgtcccgcacaaatcgctgatagattagtgcacacacgaaaatttttgggtctaatttgaaatcatggttttgcttatcaaaacatctagtagacagaatagttgctcagc

SEQ ID NO: 127655 - DNA, 1014 bp, Homo sapiens
aatggataataaacatgtttatttctaactcttgagatttatcctagtcatcttttggctcttcttccaatcaaaccctgtagcttttagaagataaggagcaggacaagatttatcctgtaacctatgctgttagtcatttagctctaatatacttggtgttgtatttcattgattgcatggatgctttgattattattttcttaaacaataattgctcttcattttaatgaatttattgaaattataagattaatgagtatttctattgagctgaaaatttaatttggctatatcttatggtataactttttgctcaactatctcaatcctgggagaatcagagtctttatctgaaatctgctgcttatattatgcaggtacatatatttattttgttctcttggaagatcttcatggtttctctttagtgtgtttaaactagcacatgaaaataatagactttacaaaattggccatgacctatatcagcaaatggtgaaaccagaaagaaaaatacattaaaggaaaaatcccaaaggaactgatatttctctaagaagcaaggtataacttttattaagcaacttaaagagattgtttaagaaatactgtaattggggagggaattatagtgtaaggattatgcaaaaaaaaaatgaagtaaaagggaattacaagtgggaaaagttacaaaggaaattagtatgttccttgaggttcagggaatctatgtatatttcagatcatggttgcattttcagtcttctgtttttcatggttgatgagttcatcaagtccttccatcttttggagtcatttctattcaccattcaaggatctatctaaaatgtataattatgtctccccgtaccattccctcccttcatatctttagtttaaccagtttcggtaaacacaggaatttgagcatcacctgtcacatagaagacaggtgatgtgtattgaacttatgttacactttctttgaggaataagaatttcctcacattt

SEQ ID NO: 127656 - DNA, 1466 bp, Homo sapiens
gccactgagaatgcaaaggaggaagtgaggcgaattctggggctgctggatgcttacttgaagacgaggacttttctggtgggcgaacgagtgacattggctgacatcacagttgtctgcaccctgttgtggctctataagcaggttctagagccttctttccgccgggcctttcgcaataccaaccgctggttcctcacctgcattaaccagccccagttccgggctgtcttgggggaactgaaactgtgtgagaagatggcccagtttgatgctaaaaagtttgcagagacccagcctaaaaaggacacaccacggaaagagaagggttcacgggaagagaagcagaagccccaggctgagcggaaggaggagaaaaaggcggctgcccctgctcctgaggaggagatggatgaatgtgagcaggcgctggctgctgagcccaaggccaaggaccccttcgctcacctgcccaagagtacctttgtgttggatgaatttaagcgcaagtactccaatgaggacacactctctgtggcactgccatatttctgggagcactttgataaggacggctggtccctgtggtactcagagtatcgcttccctgaagaactcactcagaccttcatgagctgcaatctcatcactggaatgttccagcgactggacaagctgaggaagaatgccttcgccagtgtcatcctttttggaaccaacaatagcagctccatttctggagtctgggtcttccgaggccaggagcttgcctttccgctgagtccagattggcaggtggactacgagtcatacacatggcggaaactggatcctggcagagaggagacccagacgctggttcgagagtacttttcctgggagggggccttccagcatgtgggcaaagccttcaatcacggcaagatcttcaagtgaacatctcttgccatcacctagctgcctgcacctgcccttcagggagatgggggtcattaaaggaaactgaacattgaaaaaaaaaaaaaaaaaaaaaagactggatccaattgctgaaaggacttgaaaagaattatagatgcatttttttaaaagtatcatatatgtttagattttactcatccttgttgctttcttaccatttattctagatagtttaatattatatgctttagtgaaagctaacttatttttgctgtttatagagaaattatttcttattataccctcacttccttaatttcaaaaaggaatctctgtgaattattataagttaattcaggatgagtagctttaaatcctttttctttttccttcattataaacatgatatggccttattgaactgtttgttcagtattcattctgatattgtcatatataaaacatagttttaaatggtcaagcgctatcctgtgtagataattttgatgggaaatgtgtcagcttgaaataaatcgatgtttggg

SEQ ID NO: 127657 - DNA, 1658 bp, Homo sapiens
atctataaattccttgttatttgaaatttgagtgttatttatatagggatttgggtaaagtaggtttatgggaactaaaatgtaatctaatgaggtaatggtatttatcagaaggtgatataattctcacaacaatcttattacctggatacttgtataattcccactatacaagcaaggaaactgagttacggggaagctaataaacttggccaacaatatacataaacacatggcatggcagggttttagatcgaggcattctgattctacaggcgaccttcttagctgctctgctgtgatgccatgggcagagaaccacagtttcagaaatacatttaccagcagggacactcgaggtgatctaattcatggccctcattttagaaataataaaagggctcttcgactgcgactgaatggcttgttttatggcttacttaccctgggatggaaaaagcattttaatgactctttaatttcctcttattatggatagctgggtagtataggggagtgagagatcatctctgactcccctttttgctcttgtgtaaatgggctctttggctggatctgcaaactaaattgacaccaggcatattaacaagtgaaaagcatatacatcatcgacgtgttcatggggatcttcataagagagtgaatccgaggaagtaaccacagcaagatgcttgtatacttttttgacaaagaacaatgaatttgagaagaaatgacaggacaagtaaactttggtgaggggcaataaattttctaggggagttactgagatatatagaggggtgtataaaactagtggaagataagggttacttcattaagtatatttattcaggtctgttgcagccccagttctcaatgtctggtggtaagggctgttttctcaccccagtactggaagggtacccctcccagaggaatcttgatggcttactgcatgcgggaagagaaaggtcagctagccccttctgaaactacaattcctccagtgttttcaacttgaaatagtcaataggccattccagcatattttgggatggcatgtccttcactccttcagtagggataatgaaaaaagagactttcctggggcagctataggcttctgctctgaggtctcttccagctcttgcaagtatacccaacatagctgatttttagcttttctttctaagtctgcatgtttttgaggctatcctttgattcttctaggtctgacaaagggtagagttggacatacgttttagtaagatatgtggggtcgaatataggttccactgttctaatggagaccctaagttacatggctcaaaaagttaaaattttatttttctctcatgtaacattttggataatttgatgattccctaatgttgggacccagtcttttctgtcttaggctcacaactatccttgagcctgtgtcatgggggatgactctgaagctgcgtgcaccctgttcattcacattttcttggcctgaacttagtcactaggctattcctaactgcaagagaagctggaagatgtagtcttccttctgaccagccatgtgctcaaccacaaattgagtttcagttattggagggcagaaagaatagatatggggctgctttgtaggctgctgctcggggcag

SEQ ID NO: 127658 - DNA, 1034 bp, Homo sapiens
aataaaagactgtctcagaatgtgttctcttggtgttaagccttggaggtgtgtctttgtgagtattcaaagggaaacgtaagatagttggagagaatcttagggacatgcagaaatactaccgcagtgtgatgaagagaagcctttttaagattgtaaaagtataaatattgctcataaaaaaatagatgtgtttcaaccaagcttgcttttaagtgaatatgtataagtggattatagttctccatttacatcttttataaaattggacatgctatgctggaaaaaaagggcccttggatataatttacatttcctaggaatgtggcagttctgtcattgcatgcttaaaaataattattttcttacagaactttacactaatgccaaaaacattgccagcacctcttatgtattcgtattttacctaacttatgcccaggcagactgctttagacctgaactatgtttattttttagctgatagtcgaagtcctcataggactattagcgtatcaaaggcagtattgaattagagcagttgtttgctttgggtcttagaaattcccagagtttagcagcagaacatagaatagtgaaagtgggttcttagatggggacagccaggacagggtgttctaaatcacattcaagttttgcgtatatgactggagtagatggagatgggggaataatgaagttatgactcaatcagtcctttcatttcattctgcttagtgaattttgaataaaagaaaacctgtgaaaaaggaagatttaggaagatttgtactggacccttgctgctattatgcagaatggtacatgggaagaaaggatggaaaaataaatcaagagcatcgcttcacttaggttttcagcaaacattgggatagctgagacattttttcattaaaggttagcttgccagaaaggtggttgagagtgagtgaattattagtatgtaggtactatgattgttagattatcattaaacaggaagtagatgactggatggagccttgaagaattac

SEQ ID NO: 127659 - DNA, 1541 bp, Homo sapiens
acagaataaacaattacaaaagcaaaaatatatgcaaacaatgtaagacctcactaaaaaaagtaagattcaggcttaagtattagttcttgcactgctataaagaaatacctgagactgataaagaggtttaattggctcatgagtctgcagtctgtaggctcatgactctgcatggcagtatctgctggcttctggggaggctttgggaaacttacaatcatggcaggagatgaaagggaagggggtacatcacatggctggaggaggaggaggggcagcgagaggtgccacacacttttaaacgactagatctcatgagaactcactataagaattgcaccaagagggaaatcagctcccatgatccagtcacctcccatcaggcctcacctccaacactggcgattacaatttgacatgagatttgggcggggacacagatccaaactatatcagcatatacatatgttgcgagatcctggagggtaaaaattaaaatttacttaatttaaaatggttagaacctataagtttaaattatttgtgtttcttaatgttctagtcagttctctgcctacctctcccctaaagataaaatgatcatattgaagtttgttattttcttcattaaaaagcctttgccttctatatttcagcttcttctgggcaatttgttttaatgagggtgactgtcatagagagtttcagttcagttctccattagtgatgactggtaggtagagcagagacaggacctgaaatagaatgttagagtgcactgaaatggcatgtctctcctgtgcgtcgtgtaagcctgaaaaggtttgttttattgcttttcactgggtgagtctgaacctcttcgtcagttgtcaggcctgacagcttaagtgtattgtagttgcttccatccttacctaaaatctagttctactctttcttttgttaattaaatgggaggcattcacttaaatgcattttatttcctctcttaggtggggaatcataagctgtttcttctaaactgttaagcccctctgtctgagttgctccagagatactaagtaactcggatgctgttgacaggaaaagctttaggtagaggggaaaaaaacgactgagcacatttaccgctcagcagggttgccatgctcccctaaccccgcatcatgcagtgagtatgtgcgttgctttccccaggccagcatcctggatcagagctgcaggacttgggaggcagtgcctcagccctgctgtcagcctcatctcccgcctggggaggagagctgcagatttgtgtgagcttccatgcagcttcctggattccctctcccaagtctgccctgcagacccatccagtggactgctcttctgccatatacattctctcccttgactctttccagccttgggctttctaatcattaccaacactttacagtctttttgtatttcacaaaaatagcttgcaaaagcttttggcctgaatttttgtaacagtcttttgattacaatagggctggagaatactattaact

SEQ ID NO: 127660 - DNA, 1955 bp, Homo sapiens
ttttctgacactttatcaccagagtcattctttaggacacttagcattattatgtatgcatttttctttttcatataattgccaactattttgaagaatgggatgcttcagattaacgtcttgggagggagacacaatctacttgaccctgatttaaaggaatagtggaagtgggtggttcttcaccacacatgtgattgttactagggattcttcatagactctgtcatagcaaaagtattatatttggcttctcatgacgtgtcccgtgactagcagagtgttgctcagtggaatggcttgggctgaatcagtaggtctttccaagtataaatttgagtgctcactagaccagagagaggcagaggcgtcaggatttggtgggagattctctgagtgttgcaaatagtccccatccctcctgtgcatgacccaagagtttgctctgagacacctattgaataaatggccagccagcactgtggttaggtgaaaggagcacgaatattgatagatatttaagccctgacgtgactgagcctggccttcagctttgcctcttactatatttgtgatgtccaagagtgacaggggctaacatagctataaataagcaactattaagaaattgtaaaaagcagtgactgccaagagaaaaatatagagaaaatgccgtgtgaatttggaggaagtttagagtgataggagctgtgtgccaaagccactagtctttcttgggcaattcccattatggaacaaagggatccagaatgcattttcccaaagaaagaatgagtacagatgaaatattgttgttagaataattcttcaggcttatcatgggtttttgggttaacttggaaacccaaatagcattttactttttaatgacgaatatacaaatgagctatggcacccctgaagagttggcatggttttccatagctgcggtcaaggttggctcctttctgtacaggttttccatatgtcttgtgagagggtttgaaatatcaactttggattccaacatctgagttcagttattgtctctatgcagttttgattacaagcaaacatttgtatacatacaaatgtgtgtctgtgtatgtgtgtttgtcacttaagaaaataatgtgtcaaccacagatatgttagtatgagcattttaacagttcgttagtcactgaagtttttttgcagtacaggctaatgccaaaggcaagctttctcctgcttgctgttttgcccagggctggcatggctggtcagtgacatcaagggattgtaacaattcacttttataatagttgatataattttggttggcttttgtttattcactatttcaagtatgatggtggtggttttttgtttttgcttttctctgcttcaaagctatcaacgattgcattcctctcctccactaaactttatgtaggagggagggaggatttagtacctgcacatggaaatactttgatgctgtgtcgggtcatttttcagggagacagaggccagagtctgtgaaggtctgtagctgcagaatggttagcacagaggcaattgatacaatgagggggctcaggttttgggaccagccagccctgagtcaccatggggctctttataacattggaataatacttaactcagggctaacctaatgcctagaacattgtagaatcagtagagactaaattggcatggtattggattgctgactagaaatacttctatctcaaccttataaccaactggctgttttaccttgggtatgtttctttatttctctgggccttagtgttcttatctgtcagatggtggaatggactgttatctctaagattcccttgatagattctgagctttttagataagaaccattttcattcgtctttgtttcctaacactgcgattatacttggacaaaacatttttttgaacgaatgattaga

SEQ ID NO: 127661 - DNA, 2271 bp, Homo sapiens
ctgcaagggtcactcgcagaccttgtctgtatttgatgagtagcagtagagccttgctctgcatttcccaatttattatgttacgctttgcagtttctcccatccctggtgtcattgccctagtctggccaccattatctttttcctgcattaccctgacagtctcttgcttggggtccctgcctttagtcttgcattccccggtctattctcactgcagccctagtttctttccaaagcatgaaactaatcatgccattcctctgttagaaacttgagccctccaccccaccccggccttcctcttaggatgcagcccaaatctcttacatagccagcaaggtcctgtacaatccatctcctgctcgagtcttctctgggaatctcatgggattgagcccaaatactgcttttgtacaagaccttgctggcagacagacctttgtctgttgtgttgaacttctttgtctagtcatattgtagttcttgtatatcctcagacttatccttttgagtttttttatttttgagttggagttttgctgttgttgcccaggctggagtgcaatgcctcaatcttggctcactgcaacctccacctcccaggttcaagtgattctcctgcctcagcctcccgagtaactgggattacaggctcccgccaccacgcctggctaattttttgtatttttagtagacatggggtttcaccatgttggccaggctggtctcgaactgctgacgtcaggtgatccacccatcttggcctcccaaagtgctgggattacaggcctgagccaccgcacccggcctccttttgggtttttgaccgtgttgttccttctgtctgaatactgttccaccttctagccctgccccactgctatctcacctcttacctgccttttgtctagcaaactcctgctcattgttcagatccctgcctagaaaccacttaccccaggaaacttttaatgacacccagtcctggtgagatgccccacctgtgtgggcctgtggtacctgtgcacgtctctcgtagcacacgtcacgtggttctgccattgcccgttacacacccctctcctccagatcccatagcttctattttctcattggtcctcccaggacctcctcttctggcacttccttcagcactcccccttgctttggtgctgagctctctttgccaaggccgttatagaactgtgtgtgtttgctgcaggtaaacattgacctgttgagaccagataattaggcaaagcaggaaaagaagaagtctcagagggtcgaggagatttccttcaagagccatttcctcattttctcagtgtggactttccaagttgataccattttgaagagtttccttttcttgtgttactaattctctttagtactgatccttgtaatagtatgtacttcattgtgttacaattacatgtttacttgtctgtttttcccatttgattatgagcctttgaaagaagtgtatgttcgcttcccatgttctgtacgctcagccacagtgaccgtattataaagttaggtgcctcataaatgtttgtggaatgcgtgagctaaagcaaatcagataatgaagcctgatatgtacaagtgcctgtgtccactaagaggcaagcaggaaaaggggtctttctcttaggttggttccactgggcatgggtgtgagtgtcttcaccaggctcctgatggtgcttatacaatgccagtttcaggtctcaatcgtagcagacccaaggaagcccttttggaagaggcactttcttgagtaccatctggggaaaagtacgagtctgtggaggagtggctagggagcggggctctggatttggaaacattgatgtggaggttcatgtcctcctcctagttactaatttagtttagaaaggaaatcatctgtgtagacttgacaagttttggtgagtgctgtagtgagttgggattttcccttctcggaccctcccgctctcagttcctgctaccctcctcactttcctcctccattgggtcgaagttaatctgacattagtacctttgtcccctggaattttaggctaggagttttaggtgaggtttggttagggtgtctagaggtaggtccctaacttggaaaccaagttacccctggcttccttttctagtagaacccgctgctctcttcctgttgtcaaaactctgggacacttgagagtggagcttttcttcactctatcttctcctgtgtggcttttctcgtgtctgatctca

SEQ ID NO: 127662 - DNA, 1060 bp, Homo sapiens
tcagtccttttctccccaggcctaggacaccttttctctgtgctacttgattcatctctatgttggatttatttttgagaatccagaaaacctttaggctgactttattttaaaattgagaggagggcatagaaaacttcctttcttgtcattagcaatgtgttttgtattccgtggtattttagaatggtcaaaagggagtcacacaaagaaagtgctgcagtgggagagagaatgaactagagataaagcttggtaggttctgaaacatcagtgagttacatcttccgatcgttttctgtgactaggaacttccacccattgatttcctagttaacggattaaccactggcttcagctgctttatattatgtcttcagaggtccctgcccttgttactgcagggactttgcattggtgcttctaggtggtatgaaatcaagtgggccggacactccctacttgcccctaagttactagaaagaagcaactgttttcttaggtaggttgtataatgtagattagaaatatagtaatgtcgtggagtcacagtactcaggagctggaagttaactcgggagttatgacctagtaatttcaatgacagcagagaaaaaagacgctgttttaaagaagctccccatttttgctgctgtagattctggacactaactttaaatggaattatgggatagtggattgtattttctcacagaacaagtgttgttatttgtcataaccaagcaaatcatgggtgtcaccaaaactatattaagaaaactagataaaacagtgatataaattttgtaatcatgcttcaagatttgtgaaataaaatacggcattggttagtcaagcaaaactaatagaatataaagcataggacatatacttagcaatactatttttgatttaaatttcatacatttgttgtaaacaatattaacaatatttttgcctttcttggaatttgacagatttgagagcatcatctggatggcccaaatctcttataataagttgcccaagggagtttcaaatgtacattttcctattgcaa

SEQ ID NO: 127663 - DNA, 1561 bp, Homo sapiens
tcgcatgtaaagctgtttgggcaaaataatatactgtgtgacacacagcagattgtaatgccactttaataaatgaatgtgctctcaataacttaactgtgtccttgctgcctcaatttttttgctgcgttatctcaactatattggtttgcttttataccagataatttttttcttaggctgacataaggagatgtcattgcatatagttataaacttaccttttcattaacatcttgcatcttttgattttaaaaaatcaattttgggtgctgattgtttcctttcaacctgatcttttagtttttctggcttataatgaggtcagacctctcatggttgaccctacctaccgctgaagaatctgtccccaaatcaatatgaagaaacagacaggaaatgatattaggagatgttttgttgttttcgtaagctactggcaaccagataaaaatgatgaatctggaaaaaaacaagacaaatgacctaacttttattatcatcctcactgtagaagtttctctgtaaatttctcgtcattgtgaaaaataagaaagatttgccagtttgtgttaagtatatcactgagatcactaagtatttggcagccttaacaaattgcaggaaaccaatttgagcaggaaataacacagcctaaactaaacagccaattttgggaaacagattcatgtataagttctgtgtatttttctcccagaatctggccctcctagttatttttaaacagctctttaaggctcatttagacataacactgtagggagagttcagagaaaataagcttattcctttgactcgagttacaagaactgaacatctaggtttccaacttttaatatgtgaaactttgtggatgccagtgtctcaactgtgtactttttttgtgggctgtaatggttgatttgcctgactgttcctaatagtaagaaacctaattgctattgaattaaaggcattaaatctaattctctaagtcagcatattctgctctgaaaaagaaatctgccaacagtctagggttgaagaactcatggttggttccatcagtcaacaagtgttagcatggccgccatctttgaccttcaaggaattactagtttggtcaaagcatatttaatgttacagtgtagtgaatgagtactagtttagtcgcctcctctgttaatatttttgagaaggtgaatcaacatgtgagtgagatagaatgtataagaggtatggaaagtgctttaggaatttagagaaagagtgtcaggagctttggcaggcaggcctggcatcaggggaagtgaacttgagccaaacttgaggctaagagggatgggaggggggttagagtagaaggtaatcctggtagagttagcacacagaccagattaattcagataaaggtttcttgtagggtctcatgggtgggtaggttgaagtcaatgagtttaattctatcctatagggcctgggcagcttcagagctgttctatctcattttaggatgcaagtctggaaagttacattagttgtgccttcagatatacccaga

SEQ ID NO: 127664 - DNA, 1373 bp, Homo sapiens
attaattattttgcccaaagtcacacagctggtgagcaatggagatgagagttacattcaagtttgtctgactccagagcaaatgctgttaaccactttgtcttattttaatttgaatgacatcttgctttagaaaggacgtgatagaaactagttggaatgaaggagctgctttttagtgatgttctgcttgaactaaggaaagaacccgttgtctataagtaattgttggttgttctagctttttcccatattggcctgagtggaaggagagaaaatgttttctctcttgggttgttttgatatttcgagagagtggggatgggtcgggaggttttctatgagtgcctgtggtgtgtctggcccgaagagcatgccactgatgtgaagagttctggctttgctgagggacccatcccttctcactccccatttgaaatgactgatgaactctttggtccatgaccagctgtgaccagcctgggcactgaaagctcttagaatgccatcttgtgggccaggcttggtggctcatgcctgtaatcccatcactttgagaggctgaggtgggaggatcacctgaggtcaggagtttgagaccagcctgcctaacatggtgaatccctatctctactaaaaatacaaaaaatagctgggcgtggtggcacatgcctgtaatcccagctactcaggatactgaggcatgagaatcgattgaacctgggaggcggaagttgcagtaagccgagattgtgccactgcacttcagcctgggcaacagagtgagactccatctcaaaaaaaaaaaaaaaagtatgccatcttgtgttttagtggtcaggctagaactacactttccaaatggtagccactagtcacatgtggctcttaaaagttaagtgaaaattaagtcgatcaaatgaaaactttagctctgaagttgcactcttcacattttatgctcagtaaccgcatgtggcttttgactaccatattggaaagtgtagatatagggcatttctattattgcagacagttctgttgcatagctctgatctggaacacaccagtgctttttattttctatctgcaccatgatgtgaaaaagactcaacaaggctcataggacaggttctttgagtacatgatttctctcaccctttccaacctaacccaagaaaagaactaaaatttggcatgctattttgaaatgatcttgctttaggttaagaatgcaattcaactatgtgtaaattaacaaagatttattcttcttagaattaaaaaaataggcttataaaagcatgaagcttgaacatttatgttttgttctgagtttgtctcatttaggagttttagttagtactcaataa

SEQ ID NO: 127665 - DNA, 2667 bp, Homo sapiens
aatgaaactattttcaaacagtctttgaaaattttgttttctcttcccactcttgaatcctctactaggctttggaaagttacttcatatctttttgtgtaaaatggattgcttatagggatattagagatttaggaataaatatttatttaaaaaatcgaacttagaaaatattgatttgctattttcaaattgtgaagtattccaaatgattttattttctaataaatttcttctaagtttataaaaggtttagtttgtcacagtcagtcttagttattgatggaaatgtggtggtaaataaaatccataaagaattattaagcctaattttatctgtaggtcctgctggataagagacttaatgctgtttcttctcccttttctctctcctgccacactcatctgtttatccagtattttactaagcaccagctatgtgtccagcactgttcttgatactgcccagttgatggatagatacgctatttattgtgaaatggcaacaagaaaataattgggatgattaattttggactaagtgagattttcctgtacttattagaaagggggaaatctggctatagactgtgaaattgagaaagacgagatcctgcccaaatgccattcacttgggccaattgtgaccccccccgccccgccccttactaatcattaagtcagtaaacatgaattgagcttctgatacgtttagaggaaagggtaccaagatgaataagaatgacttcttgcccctttgaagcttcttgtttagtaggagagttgaggattcacagttaattaacgctagatagaaagtgagcatgccttccttgttagaaacccttgttttggcttctggaccacactcttggttttcctttcaccctacttgcaaccctcagtccagggttctttgttgatttctactaagtaatcttgtcccaatatacggttttgaaatcgttatctagatgcctgtgactcccaaaattatatctctagccctgacctttccctgaaattccagacattataatagacaactgcctacttaaaatctccccttacagattcctcaacttgacatatcccaaatcaacctttattttcacccccagacttgcttttcttctctgtctttcccactaaatggcacaggtagtcaggtccccaattggggattcatccttgttttcttttttccttacaccttacatcagactgttagctagtcttgtcaactccatctctaaaacatgtctaaatatgttccttttgcatctgtctcctctgctatatctccaatccagatagataactgtcgtcttctgtggaagtctcttaactggctccctgcttcactctttccccctgtgctgtgcacacagaagtcctcacaatcttttgaagaaaagcaaatcaggtcaagtcatgtcccagtggtggctctccatggtacacagaatatagtctgagctgcttccctgggcttccatcatatatcatgactggtccctctctgccttccaacatcatcacattattcatcatctcctatcacctttcctctacttattcactgtgactgctatcttcactagaagagaagctccagggaccttattcctcatttgtttgttcacagctgaattcttagctcctaggatagtgtaacctgcttcttagtaagtgcttattatcgtttgttgaattaatttaagggcattatccattttaaaagtagctacttttgttcattctggagagttctatacatttaattcaggtgacatatattgaatgtttctattatgtaaataaataagccacgtttttatttttttttttcttttgagatggagtctcgctgtctcccaggctggagtgcagtggcgtgatcttggctcactgcaagctccgcctcctgggttcatgccattctcctgcctcagtctcctgagtagctgggactacaggctcccaccaccacgcccggctaattttttatatttttagtagagacggggtttcaccgtgttagccaggatggtctaaatctcctgacctcgtgatccgcccgcctcgacctcccaaagtgctgggattacaggcgtgagccaccgtgcccggccaagccaggtattttgaaaagatgcaaaaataggaaaaagttttttttgacagataaactacatatataacaagactgtaagggaggtagaaacatagtataaaagaaacctaggagatactgaaaataagtttatcaaatattttggcttaagaagatgccttgtcgtgcagaaacaaatggctgtccagtttattaaaatgcccaacaactgcacttccagtcactcgggtcttgcatataaataccactgcatacagtgagcacatctagctgatgataaatatacctttgcttcctcctcttcctcaaaatggtgaatctgttcttatctacatgtatgaacttaaaatacggaaaatgttaagggagcaaatggtttgtaactttgtaagtacttatgacgtgtatctttttgcttatgaatattctgtgctataaccattgtttctgtagtttaattaaaacattttcttggtgttaaaaaaagaatgatgatatatggatacatttaaaattggaatttgttctaa

SEQ ID NO: 127666 - DNA, 1334 bp, Homo sapiens
attctcttgcccatgctggagtgcagtggtgcgatctcggctcattgcaacctccaccttctgggttcaagcgattttcctacttcagcttcccaagtagctgggactacaggcacccaccaccatacctggctaattttttatatttttagtagagatggggtttcaccgtgttagccaggatggccttgatcttctgacctcatgatctgcctgccttggcctcccaaagtgctgggattataggcgtgagccaccacacctgaccgcaagatacttcttacacagaggctgccatcgcagaagcttgtgttgtactatcgacccccattttgggtcattttttatcagaaagatgagttgttctgcagctacagattgcgtgtataatcctggccagcatctctaaagcttgtcagctgcttcacgagtgagtacccctgttcacagaggagatcaggtgagtgtgcaggtctgaacttactactgcaatgggaaggtcagctcagagagcattaactttggatacagatgataacacaacaaaactattacctcatatctacgtcgctatgagcagactgggaatagggtaatagtgcttggagttggcagaggtgcaacagtagatggccatgggtgctgctttggaagggcctaaggatacagttgttgaatgattgtaagaacaagagaaaggtggagtctcaataaggcagccgtacaatatgtttatcaagccttcaataggtttagtatatactcctttggtgcatgcttacaagtttactgaactataaccaaacatcccactgggaaatgttttgaattgatgtgagaatttgacattaagtagcaacttgggacatcagagaggcctcaaaaagaaaaaaaagttaacaagaaattagtgattaggttgaaagagacattctactcctactacctagagagcatagatagagaaaaataagcaccttctatacccataccaggacttaggcagctgctgcttgcaatagctgcaggcctggtcctcatgcaccttacagagaacgagtcagtacaagctcagacccagttgataaaaatgaaccaaaatgaattaaaaagtccctgtggttggagctatatgggtaatagctttaccaaatatttgtgtagccaattgtagtttatggtgcaaaacactaaaatccctccacagaatctctggggtaaacattattttcatttttttcagatgaaaatagtaacttttcagatgaaagcttatagctaacacttgatttttgagatttatatatattatatatcagttaaaatagctttaa

SEQ ID NO: 127667 - DNA, 1050 bp, Homo sapiens
ttttggctaccatcttaagttatctaggattttataaaggtagggataatggtttctactaatgacaaatgtaaagaaacacagacataagctaagcattacatatttcatatatatctatcaacatatatatgggttccctctccccctttctcttaactaactatttgggagtaatttctcccaaataataatggcagtttttggagcctatgtcttaaaaaggtaattgtgaagcaaactaatactcacacagaaaatgacctatgctaagtggaaggaggatcaagagagaaaaaatgggtctgagttcttgaatcaatttgctaggacacatctggaagaagataagataaactaatggaggcaggaggctgatttatttgtctcatgtggctcataactttacctcttagaagggccactgaagaattcctctttttttactctgttacctgggagtagaaatactttctctttgtccaactcacccagtctcctgtttctgagaaaattctttcttttggattggtgggtagtgtttctggcacggattttggataagaccaaacaaggtgggtaggaagagatgagtgggaagactgtaggagatgacacatggcctttccccctctgtggagcacattggtgtggtgagtaccacaaatttaaacttggcaagctctgtttgcttaaatttgtctttaggagcaatagagaatagggtggacagtcaagttcagtgggctgaatatcggcagacctgcttcttttgattgccccttatattagaatggtggctcttttagttcatagagcactgtggatctgtaagctgtggattctggccagaaccatgcaataagcagacagttttgcatacagttgagtaattgacccacggactactcagtctgtggacctcagggtgtaattcccagtatcaatgtgtgtggggattatttcactattctttgctacaaataatttctgtaaattgcccttggtatttgccttgatgcagattccagagatgtctggaaagcaagt

SEQ ID NO: 127668 - DNA, 1877 bp, Homo sapiens
tgcgccgaagttttggattaggcccagttgcttcaggactagtgtctgccagtctgataggggctgagatgggtttgcagtttttcataccagtagaagtaatgtagtcatttctgaccaacgttgtagagcactttttttttaatgccctttgcatgcacctgatacataaactgaaaacctggtttttctctagggtgtcagtataccagcactaacttcattaacacactctccgctgcgcctgaatttggagcctcacatttttggacgtatgatgcctgaacctagtaaataaagcaattttgacttcagaaagttttataataatttatatatttttttctgttatcaaccagcgtaaataaattacatttgtaaattatttttaacagttgttaccaggaaataaaacttcttaaatatttaaaatgtttaaaaactttttcttctgaaactgttaccttgagaataatttattaaacttttcttcatagaaactcagactgtcgaactcagtttttggtctgtgaccagtatttctttatatcatgctaattaatggtagtactacattttgtaataaaatatctgaggctgtattctttgagttattgtgtttcagttagtactctttggagtaaaaaattactgtaaactttaagttttatgcagagattttaagactcttgccattaggctttcagtacgcaactcagagtgaaaaataattaaaagacaaagcaaaataagttttgagtgagaagacattggttagaaaaaaatgtataaatccatattctcgtgctttagtacagacacagtgctaacagcaaacaaaatcgaaagagaatgtggccacagcacagagattcatatcaagtattagataaggttggatggaataactgtgacagcagggataggtattctattaaaatggaaaaattgtctaaaaaacctttttaagatttttgttttttaaaaagaaatgtcctttggtcatataacttgacagcattcctcatttttttcctttcttatatagtacattttacctgtattgctaacagttcaagcatgatcatttttacctctatgcttttcttcagaatatacccttcacctggaatgcccttgcgctggtctccattgcttcaaatcctccttttacatgaatgttttgcaatctctctgagcttcagttttcccatctgcaaaataatgcaactgagtacatccctcagatctctaatattttccagtcctgaaatcctgtgagtctggtggcactgtaagtttcttgtagccatacttagcccattgcagtttcctctagaagtgacatccattgaagtattgagtacacagaggtcattctgatttctttgagctcatgatcaaaagagtatcaacttgaaattaaacagacctcagtttaaatctcaggttagatatttattacttaacctgattgcctgtgtgatttttgtctgggtcttttgtagatgtttttcagttgatcttagtatttttcttggcttgaattaagcagacatcagtttaaatcgcaggttagttatttattagcctgtggcctttgacaattgacttcttttatttccttatccataaacggtaataccatcacttcccttgattggttattgtaagaagatgaggtaaggtatgtaaagcacctggcacattgtagattttcattaaaaaggcagccattattatgatagggttcctttcacatgcaaagttttaagattctttgaaagtgctgtgctgtgtagtggaaagagcatgtgccttggaaccaagcagacctgggttggattctatctctgcctctcactagcggtgtcgct

SEQ ID NO: 127669 - DNA, 1070 bp, Homo sapiens
ttggattaaggcccacccttataacctcacttaacctttattaccttctttgtaggctgtgtatccaaatacagtaacagtgagagtcagagattcaacatttgaatttgggagggacacagttcaatttgtaacaggtggtaccctgggcactcttattattttgataaaatatcctaaactgcttctagagtgagaatctctcatcacctacagatagtcttgaggctcgggcaagagccctggtcaagctgttaatttttcacaattgtttgtcaatcttactgcatgcttttctggcttatattaaaattaataaaacataatttgatctatttagtcctgtaagttcctgaaattctagacttaaattaaaatgaattgttggaaaactttgtacctgggctgtattcagatctttcaaaatctctaggcctgaattgagttttaatgttatgttcttgaaggaacttacaagaaatggccatgtaagatttgtgactttgtctgttttcagaagattgttaaggacatcttttactatattaggtcttccatgttttttaagtgaaagatttcttttagaatttaggactagttcaaaatttgcttccttaaaggaactggagtccatattttttgagaatgagaattatatcatgtgatgtgtctccttttgcctgggctgctaggaagctcagatttagtttgggggctcacttcatattaactttgcttgcccatatgatctgcatagttgtcttttacatttatttggtggtgtttagccctgcatctctttagtcccactttctcatttgtattttactttttattgtttatattcttgcacaagccatctcacatcttttttgggaagaggtgggatataattaaaatgaaacttgaatgtagatattgttactcagtttcacaattaaatactggttgaaaggttatcaggctttggctgggtgctcttccccgagtagtttcatagaacactcagagtaaaagctcacaaagttgggcctggtctggctcccagttttctccttgattcatttcct

SEQ ID NO: 127670 - DNA, 1124 bp, Homo sapiens
aatctagagtgattcaataacttgaatacatcttgggttggcaactttatgccatttgtcctttgatcatgtcttttatttagctcatgcttttaaatcttgcccagattcaagactgttattactaaaaaagctgcttggtgctctctttccatccctaactgtctgctgttctctttacatatgaactgtggcttgatgagagtatgtgtcctgcagctcaggagttgaaggcaggaaagataggattttgtaacatgtatagtagaaagagcatggattttggagtcaaatatacttagctttaatttcaactctgatattaactatgtgcatgtgtatattttactttacctctgtgagcctctgattccttatctgtaaaaaggctggtgataatattttattatactagactgctttgaggattgtcttagattaggtatgcaaaataaccactgtattgcctggtgtattatagatgctcagtagtttttatcctgtgtctcactttcaccttcctttccaaacatgtagaacacagggatgcatgtaaatttctgcatttagttttaaaatttcacaagtggaggatgagtgagagttgacttgtcagcacttactgtcaaagggatcttggataatttttggactatatttttaaaaatggaatgtagttttaggctatattattagaaagatagtgttcatgttgtgggatataaaacctctttctgtttggaagtatgttgtattcacttctcagcacatctgagaggcaggttagtgaagccattaagagccatatggcccaggtttgaggtcagactctgctccttaaagactgtgccttgaataaaaaactccatctctttatctctacaaagagggataagtatggtactgatatggtttggctgtgtccccatccacatctcatcttgaattttaactcccacaattcccgcgtgtcgtgggagcaactcagtaggaggtgattgaattatgggggtgggtctctcctgcgctgcactgttctcgtgatagtgaatgagtttcaccagatctgatggttttagacagggtagtccctgcacaagctctattctcttgtctgctgccac

SEQ ID NO: 127671 - DNA, 1230 bp, Homo sapiens
ttctttcttttctctttttctaatagcctctagttagggtgacttgcagattttgtgaaattgtagctattgctgaataggtgattatgagcaactgtgaagttactaaaactctgagaaagcaaaggaaatttgtctctgacttgatatcatggtttgaacaaccttttcacccatttgttttaggaagaaacagagtaacataatttttcaatcttaattatacttataaattaaatagaatgaaatgaaaatactgtcatcacatttataaaagtagaacagagttttgagaaataaatgtttcagtgtaatttgatacttttctaacatttgaatgttattcattgatgggtatagccctgttcctattaaaaaaacctttttttttaatttttaaaaattgacaaataaaaattacatatgtttgtagtagagagcatgatgttttgaaatatgtatacactgtggaatggctaaaccaagctaattaacatatacttcacctcacatgcttatcagttatttgtggtgagaatacttagaatctaccttttcatcaattttcaggcatacaatacattgttattaactgtagtcaccatgttgtgcaatgggtttcttgaacttacttctcttgtctaactgaagtattgtatcctttgaccaacatcttctcaacccgtcctctcaccctgagcccctggtaactactgctctactttatgcttctatgagtttgactttcttagattctacatgtaagggagataatgccaatattcatctttctgtgtctggctgatttcacttaacataatgtcctccaggttcatatgtgttgttgcaaatgacaagagttccttttatttttgagacagggtcgcactctgttgtccaggctggagtaaatggtgcagtcggctcactgtagcctcgacttactgagctcaggcgatcctcccacctcagtctctctgctatctgggaccacagatacttttttgtggagatgggttttcaccaggttgcccaggctggtttcaaacccctgggctcaagtgatctacccacctcaggctcccaaagtggtgggattacaggtgtgagccaccatgcccaaacagatttccttctttttaaatgctgaatggtattccattgtgcttataccacattttctttatccattcgtctgttgatggacacttacgctgcagtgatcatggg

SEQ ID NO: 127672 - DNA, 1026 bp, Homo sapiens
tcttcagtgaaacctcaaatgtcactatctgtataggtcttcacttggaccagttcactttcccaagggagaagccatatgtctcttgtgttggggtgaaaagtcaagctgtcagtgttttggagcctaactattgacggagaccgagggtccatgggggctttggatcgtactgtttaatatgtcccactttgacttcatcctcctgttttctgtgcagtgtctcatgcctccctctcaaccatgcctggcatttccttgtctagatcctgtccaattcagttgctcccaatttggccaatgctgtgggggaggaaattacccatgtgtgtggcttgatggggatttggggctcagaatactcctatagaaacttttaactcagtacccctgccattagtatacttggtgcctcctttttggtgttagtaaatcctactccaggctaaggttttcagatttctctggcctgctaatttagttgcctactgtccatcttcttgctagcttccacagttttgttaccatcccttatttgctgttcttcctctctgttctctctttatgcttcaaaaaatttctttggtattaccttggtgggattgcaggaaggagtagaaataattggaatcatcttcatcagatttacaaagaggtctatgaccccccaaattaataatcagtctattatatatatatatatgtatatttttttttgagacggagtcttgctctgtcgcccaggctggagtgcagtggcacgatctcggctcactgcaagctctgcctcccaggttcatgccattcttctgcttcagcctcccaagtagctgggactataggcacccgccaccatgcccagctaattttctgtgttttgtttagtagagagagggtttcaccgtgttagccaggatggtctcgatctcctgacctcgtgatccacccgcctcggcctcccaaagtgctgggattacaggcatgagccactgcgcctggcctactatacttattaagagaggttac

SEQ ID NO: 127673 - DNA, 2695 bp, Homo sapiens
ctttcttttggaagctggggttacttttattttagttaggttgagcactctgtttcttggttttaaactttagctggagttctagagctagaagcttggaccaagtgacctatcagctggataggaaatttgcaagcattggggaaggtataatagcatggactctcacattgatcattctccttttagatatattaatatttatgaggtacttcatattttcagagtgctttctctttagtaatgttttctagattcactcaaaggtaggttgggagtagttttctcatttcatgggagtgaaattagagagaggtggagatgtgcccaagtgagtctatgtcagaaccaggattagaattttggaggcagaccaaggagaataagtggcagtgggaattaggaactgctgcatacagtagtaccagtgaagactactaaccagattataggtttagactggcaagactttggactgacccaagaccgaatctgttttattgtaggtaaaagagaacctgctttcatgcaagatgctgctgcactgcaaacgggatgagcttcggaaactgtggattgaaggaattgagcataagcatgtcctgaacttgttggatgaaattgagaatatcaagcaagtgcctcaaaagctggaacagtgcatggccagcaagcactatctcagtgccactgacatgttggtaagagaacagcctgtgctaagggtcatttttgttaagatgtaaaagcactctcttttattctctctgaatcctgtaatgcatgtagcacattacaaactgccctcttgggattcatgagcccttgaaggtgaagcctgggtatttctctaattccagtgtttgaaatggtaggtaattattatttatgtattatctgtctttgtaacaatggcaagaaatataatagtaagaaaccagtacttaaatcaggttagaatggtaatgagaggtgttttttagcttcagaggaagatagttaatgaatcccattttaaacaatgaaatctacatgagacagaacttctgaagatttatagactagtgttccacacattttttgaaggaatttttacattagggctttgttcttttccttgaaattgataagaaataaaattttgggagactaatactggaagcaactttattgaccaagagtactccacaatctagcctttagcctccatcttagtccattgtgtgtgctcctttttgaattgctgaaagttcccagaaggatgcaattggtggttcatgtggctgagcgtcaagaagatgaataaaaagtagaaatacagagtttgctccctaataatcctctttcccaaggcctgtggctcttagagagggctgctctttctcccttcccttttacccacccagtcccacttccatctcattcagagttggttaaggaagctctctataggagctctgagcagcagatgggctgtatttgaattgttgttttttccttccccacagtaggtgaaagtcctttacctttgtttcaccaaattagattggctttaacactggaaaaaacactgaggggaattggtagggacacagattaaatgctctaagtggttctaattcattcagacttccaagaagaattttgctaaaagtccttcataagaagctttttaaaggaaatttggtaaccaaggagtgagaagtgccatgatattctatcagatattaaaacctggttatgtgataagactgaatggtcaatttccacagtggaaggagattaataatggttggcccttggctgggagtttaaggctgcagtgagtcatgatcaggtcactgtactccagcctgggcgatagagcaagactctgtctcaaaaagaaccccaataaacaacaaaaaaagattgactcttgggaatgacaaaagaattggttattttcagcatcttattcaaagtggcagcttctttaataataatgactatagggtgtctgatagaaaaaaattacttttcacctttagtgttgatttatgcattatgaatgcatacttgtcctatattctcaagattcagcaatcagaatagataagcaagtatacatttgtgtagcaaatatacatctatttgaatcatgattttttggagtgggcttgcttttaagtaagtgccacagattaaaataggttgttagaatttatttctgtgttaattatgttcatattaggatttcagatttttgtgttacggtctttgttcttaagggctaatttatttacttaagggctaatcaataatgaatactgtccctttttttctgacatattttcctcaagactcattaaataacttctttaaattcttggttgtaagttacagaaattcaactctagctagcttaagtaaaaataattgtttgactcatgtaaccagtctgccaaaggaataggcatgtatgtggaatgtcacctgtgtgttttctctgcatgccctcttcattgttctgctgaagactggtctcttcatgtgtgagggaggaggttgggtattgagggaaaacagggggcataggctatgtctacatctttccacctttacagaagaaaataatctttttttttttcataattcagaaatctagggttaggagctagattgagccaggttgggtatgataatcatcaataaa

SEQ ID NO: 127674 - DNA, 2086 bp, Homo sapiens
aaaatctaaggcatctcaagggtccaaatcgaaatctttgctaaaagacatcagaggaaagtgaagacaaaacaatctagtccttcaaaaccccctgatttccttggatttgtttgtcagaagattttgcatttctattttaaggcagatgcagatgcttagtaatttaatccctactcagaatagattaataaatccagagtaaataactccatggtgacccattgctcttggcagctcctgctattcctactgcaccatcagactggtctggtagctataggcttggcttttaggtgagatatttgtttcttcttttgatatgataaccgagtattgcataaaataattaaattgtcatgacagggaatgtctgcaaataggtctggccttttgtttctttcttcaaggtaaacagctgctgttggcttatgaaaagctaaaaatgatccaacaagaagcctgtatccgtcacattgaaatcagagacttgattaatattgtagcctgtagctttgtgatatgtacggtttaaattagacctttgcagtcattgtgctgggttgatgcaagcacattaatgacataatttctggttgcagcatcacatttctgcagtctgtcctttgtattccactcacattaattgaagtaattttgccagtgaagcgtgtttcaaacctctgcatttaaattgaaattttaattcccttattgtcttgaaaagacggctgaagatgccttgttacaggtttcattatcactcaaaacactccagctgctggttctaatgtacaaagagtgattaattctgggaagaattattaatataagaatagcagcttcttcccagtggcatgagccaaccaggaaggtatttcatgatagttaatattttcataaactttttttaagggaaaatgtgtgtagaagtctgcatcaaactaaaattgcacagatgagctttgaaaaccacttacacaagttctgatttatcatcccatagaagtcaattcataattgcattcaatcagtggaaaccaagccagtgcaaatagttttgaagcactttagctgacagtcacaaggcttgtgactaaaataatttcatttctaagccttcctgagattgtagagattttgaatgtctcttaatcattttgtctgtctttatttatatgccttttaaaaagaatccatagctgtatagtcagataagggttattatgataattataataacaacttatatttatatatctgccttcttcccagaggatcccagagtgctttgctgagagaatggtgtaatgaaattatttcacttacactgtgtaaatgtggccatatctgggataaagaaattagggcagctatttaattgaatagttttctaagatcttatgtaataaaataaatatatttgtagtatttttagttaacaagatcctttggaattggataacatggtgggttgtgaatgtcagcatgggtcttaatttgggttaggtcgtctgatgcttgaatcccagctttgactcttagtagctggatgacttatggttagtaaattatctttgctgaaagctggagttaagaataatatgtatctccaagggttgtcgaatggattaagtgagatattaaactgtgtacataaagtatatgcagtataaagtttttgaaatgttatttataatcgataaattttactgatattgtaggaaatgatatgatgattgcttccatgttataatctcaaaaactgcctttgaggtggacttcttttgagctagtaaaagttgaagtagggttggattaagcagttttgattccttttcttcttggcctaacatggatgtacctaaatgaaaaaccagcccaccttttttaaaggtaaaggaactcttgtgggtggatagggtttttctcagaaagcaattctagtcttctctaacaattctgtgttacatttctaggatttggcatggacaaatttcagattatgtgttatcaattacttactcggcttacattaaaaatatgttcatagggtacccattgattgtataattctgagcaatgt

SEQ ID NO: 127675 - DNA, 2087 bp, Homo sapiens
agtctgattatttggtcaaatcggtttagtagttaaatgagatgatttagtagttaactcacttagtttttaaatgagatgattctccatgtttggactgacttgcactctttagaactgtcattttgttgctctgatttgtgcatctttgctgtgggtcctgatatgacctactgcagggatttaatggattgaaattagagaatatgtttattaatttacaagtggtgactatgtatagtgtgtcatagtggaaacaaagtggatttaaaagcaagaagttcttaattctagtcctgattcaacaacttaccagttccttgagcttagataaataaattacattatctctctgttttagtatccttatctgtagaacagataaacagatacttacctgtctactttatagaatggttatgagaataaaagtgaaatatagtacaggaaaagtgctttgtaggatataaagcagtataaaaatttaaaatggtgtaggtatcatcgtcgtcatttccccatgccaggtaaaaagaaaatgcaggagtctgggcttgtttacactgagcagcatttctattctggtgctaccatcattaatgcataccggttttaatcagataaaccaagtgtgactgtgtttgcacacttgagtgtacaggaagaatgctctaagtcgagaataatacctaagtcgtttgctgccatcctccatcatatttctggtttcaacctcacatacgacctttcttgaacagatttttgattggtcagtctgtggccagatgggaactagatgtttgtgtaaattgcagctgatgacaacccatgttgttgataggggacttcagtctgaacttgatgatggtctgagaatgctaatgagtagcttttgcttggcttgacaagataggaggagcttgttaaagaagtctattttctctgagattcatcccaatactaattacttgtggttgcctagctcttgaaatgaaaaacgccatattcctctatcattcctttgtgggattttaatagttcacgttagtaaagagctgtgtaagtgctgagcatttctaatggatttggggctcttgcagagtgtgggcgaaattgtcttgattgaagtgcgagcctgaagtgattctgagacctcctttgccaactcttaaaaagagagttgttctgtaactttttcttgtcccagagtaacaaataacatgacatggtgagtgactttaggacgcttgttaaaagagaatggcttttctagtggtctcttctattggattttgtagtagaaacctaggttttaatgctctcttacagagcactgatgggaactgggaattgaagggaccatgaggttaggaacaaaagaggttttttttctaagctttcctatgagcagtttacaattatctttctcttaccgtgttacgtatagtttaatttcttcaggaaggtaattgtgaacagatctgttacaaggccttttagaagaaataaggctctcaatgtggaattatgcatcagaacccctagaactatgcatagcttaggacttgagatctacttctagaattttattttaaagaaagaattaagaattataactgttttgtgttacaaatatgtatacaaggatacttatcacagtaagatctatgaaagtaaaaagattagcaatgacttaaatatggggaattggtttaagtcattgtatagtcatactcatggactagtatgaaaatactaaatataatgtttagggataggcacatgctcccagtgtattgccaaatggaaaaaacatgtttaaaaacaagtatttttgcaaacactttgcatggaaaaatgattggaaagaactaggttaaaatattatatattattgcatcagatgagtgacaatatgatgatatttttcttttgtaattttctatgtttttcaagttttcttggttgagtaggtattatttttgtaatttgggagaaatgccaagcttaagaaaaaaataccattctaggcctgacttttttttaatctgtgaaattagggtgggaccccagtcttgaaaaccttt

SEQ ID NO: 127676 - DNA, 1494 bp, Homo sapiens
aagtccgcatttcatggtagtaatagggtgaaatctttcatgaaggaagaagtcacatttgatcctgttttcgagttttattttccgagatagatctgaagatactttaaagaataaattcacaagtaaagggccttttctttgacagcactttatcttgcaggcccccctcccttcattcacttatcaataacttcatctaatttgccttatcctgtaaattccattatctccctggcagtctattgcattaagcccttagtacctaatatcgcctcatttacattgacatatgcttgacctcagtccttctcctctctttgttaatgcaccaacaagcactgatatctctctggagcattatcatttgctgttagctcaactaataacaacccctcatttgagctgatgaaggtttattaaataaaaacatgcagtaaccctggcagtaatgaagggagaagggaggtagacaacatcctttttttaatggtgagagtacaccaagtctgctttataggtattgggtttcctaagggagatagggcacctgaatgggtctgatcaatattattttatcagggtgatttaagaatgggcatttttgattgtcttacttgatcactgttgattagcatataggctgaggagttaggagaaaaaagtattcttgctccaggcacttggccttgctcctgatgcagctgtctttggaactctgtcttcagtaccagactgtcaataaccctgcagctttcaggcagtggcaaagcttggccatagggagccagacacatcatcttagtcttctccagtgaaactgaaatcagaggttgtttttcccatagatcccgcaagagtccctgaaatcttcacaatagccctgacccttgaatgaatcccctttattttccctttcacgtcccatactcttattcccccgaccaccatttgtacatgaagtccggtctactggtgtcatgctgtaaacaaaagttacgtggatgctgttattaggtttgtattaacagttgggaattttgggttcacttgcttgcacatttatgtcacatacatatatattgtggtatattctactagtaaaattgttcctagtttatctgatgcagttaaatacatagagttctataaaggctacaatgtactgcaaagagtgctgtgatgtcccagatctatcaaagctttcagacttgctgctacagctgttaggttggaccataggaaataaccaatatttgatcatttttaacttgtaaaaacagtattttcttatggttcaagttaataatatgatagataccattttttttttctaagcttcattgtttgttttactagtttctgtctgataaagataaaaatttccgacttgggaaaaataagatgtagcaatgtagaaatagttggtgaatgaatgatctgggattcttggctcctgtgtgataaatatcttcgctgcttgcttagacgtga

SEQ ID NO: 127677 - DNA, 1445 bp, Homo sapiens
agtggtttaccaaattatttttcattttctggatctcagtgtcactgaaagttaatgcatcctctttctctgctagagacctgagttaaaatccattttagggcataagtataaatgaatttgttgttgttttttcctccttggggacactgtggtcattttgtgaggctgcctttccatttggaattgctggcagcttgctctgggcccaggggctctcatagcaggggcagttgcaagtcagcgtgaaaatgaactggtaggcttcagagggcagagctggcccagggcttgtcactctcccattccttgattctttcttggttaacttaaggaaacttatttgctactgacatttgattatagcacatcacaaaacaagtgatgtggttgtggataagccatcacattttctttaccatttcaggctggtttatatttggcagctacaaaggtttctctgttcactgtccacagactcctagatgactccttagactgctgtagttgtgtgatcaacatttttgatcaccaatgtgtttcatggctttaattacctattgttttagtgtaaatggttcattctttaggagcgtgtttgtatccataattacatttaagggttttaccctgaagtattattagttatttcctttatctgtacctattaggaatatttagtataaccaaagcagggaataatacgcatagcatttcatccctgagggagctcacttgtgttctttccctctaagctcatcctgtcatttctattttctctcaaagaatagcacctagagtatgctctttaagttttctttgaaaagatacaagatctttacacataaaaacaaacataattttgtgtacatgaataaatgggatcatatcatgcatgctgtcttttttttttttttcctttgcagatgtcactttgagtttcaaagtgagttggttgctccaggttccctgaatccttcatgttctccatttattgtaggcattcctataccagtttgatttatccagtccttttgtcttgaaaatctcccaaaccactttgcaccgggagtatcttcctcttcatgttttgtcttccagtcaccattcatatcccgtttcttctatcaaactgaatcaggacaaggagaggtgatgactactattgtccatttgtagcattcatgtaaaaaaatgtatttacctctgtgtgatgtgtatttgaaaaagagtgagagagagcccgactcttggtaagcacaaagagtcatgattgctgtgagaacaagttctttttaaaacatttatatagtgtgcttttttttaaagccttagtttaaaaaagctaactttgagtaaaagttgattaaaccattagtacatgggattcttgtgagaatgtgaatgatagtatcatttaaatagggaggtctttttacacgtgt

SEQ ID NO: 127678 - DNA, 1863 bp, Homo sapiens
acggagattaagcagctgagcacacacagtcttagacaagccacaggaagggtctgtttgggttgctatttttgctggcaccatgcccacaatagctggattttaaactcctctgtaaatgatctctaaatgtccctgcatctttcctttatctcgtcaagattcaaacttctggactcaggcatccagtttgctgagcctgggtaatgcctggactccttcagcttccatagtaggaagtggggccttctttttgctttgatgcagtcagtggggatggactgttcagatgtttggtacccaagacaaacacccaacaaatttctactgcaagagaaaacaaaggaaatcacatgaaggcacttacgtataaagaagaccagatgtttttgaagtagaagataggcagtagaattgacaaatgaaagaaaggtacatgctcacatacaaaaaataataaaaattttacttggaggaaatgaaacaaataaatggtgagactgtccttgttcttagctcatgaagatgtcagttccagttgaaaattttgaaactgtcaaatgaaatctaaagttcacatggatgaatacatgcgtaagaattgtttaaaagaattgtgaagggaggttatgaggggggcatttcttatgtgatatcaaagcatattgtaaagctgttttagtcaaaacagtacagacatgcaaaaataaatttttttaaagaaaacagtgcagacatgaagtagaaaatcagatgggtgagacaaaatagagttgagaaatagaccccaggatctatagactttagtattttgaacaatagttcagctggggggtaatgaaggctatttaatatatagtgttcagacaattgactgttgatttgaagaaaataaatttaggtgtctacctcttatgtacaaatgattcagccagatttaaaaatcacatagcactgtattagcattaggaaaacgtgtaggaggatatgtgtggaggagcctttttcaagcatatcagaagacataaagaaatatattaaatggtttaaccattaaaaaacccaaaacttatcttcaggaaaacagagtcaaaggataaactatactctgaggaaatatatgtatgtcatataacgctttaatatctaaagcatgcagatatttgtaagctcagtaaagcgggatatagactgttcatagattaaaaatacaaatggctaataaatataagattgttcaatatcatgagtagtcagagaaatacacatttgaaaaattaaatgcagttttttgttcataagatgatcaaaatcaaagacattgatagcatgttatgatagcaaagatggcggaaatgcgtagctttctcttgatggtggaataaccaatatgcctttttggaaaataaatttgcatattctttgtccagagaattttgtttctaggtctacatcctacaaaaacagtaccagttcataaaaatatatgtaacaagatattcattgtgacattgttggtaagaagaacaaaaatattcagcttaaatgttcatcaagaggagtatggtatattggtaccatgtaattacagaatttcagtgataatgatctctatgtgctgatatagaaaggtttctaaggtgcatttttgggtcccaaaagcaagttgaaaaatagcatagatagtatgaacctatttgtgaaagattgaaaggatagaaacttaaatatgtatactttatatattggtataaatatttgtatgtgtatagaaaatgtcagacagataatgtcaaaacactgataaaaggaattacttgtgagaaatggaaatgtgaggtggggaatagggaggtagaaatt

SEQ ID NO: 127679 - DNA, 1046 bp, Homo sapiens
cccatttattgtgaagtgaaggaacagaaatatgttataattaaaaagtagatgtttaataagctgtcagcacttctaacccctcttaaaaaactgttttcgtatcatgaaatcttgaaatctaacatttagaagcagagctttactagttggatgttggttaatggccaggaagtccttgaggttacagtggcagtggttgttgcttgttttgggtttaatttgttgtatacttttcctgtcctctaccatgttgctattggcaaaatgcattcagtcacaatatataattggtaattttggggggaccattttatactagcagggattactgtacatcagctgtcttttgatctcagctatgaatgattctgaatggatttaaaataaaaatttgtaatcatgtatttaaaatgaaaaataactgtcagtatttccaaaataacgttataatttttattttattttttgttttcaaaaaatgctttctctgagggattaaaaacccgttgaaggtattaattaatcaatcccttctcagctttatctctgatatgtggtgagaagaggtctttttttctgttgtgaaatggaaactgaggtccatattacttaatgcaatattctacaatagcacctaccttatgctgagcttcattcatgtctgtagtcacaaagtgagtgggtgtgccccctttctctggaacttttgagactaagtcctttcataaaacagcaggagaaaaactaaagtcatttccagagttacttgcctttgggttagtgctcaccaaggagaaaattgaagcttaagggaaaattttagagagagagatgagtgtatgaaaatagttttgcagtaaattgactttctaaaagtttattgatggagtttgagggcccttctggctctgataataaaatcagcaggttatatttttcagagttgaaatggcaagctgtttatcaccctaaatttaactgaaatatgtttttaggttaaaactgagaaaataattgtaggatttaatctagagtgatgtgca

SEQ ID NO: 127680 - DNA, 1094 bp, Homo sapiens
tggatgctgaagaattgttcgagtaatgattccctgtttccctgtaacaagtcaaaagggagacgttaatgactgtcatagtgatcctcaaggcctaggacagtggctcctacattatttgtactcagtgaaaagaataaaaccttatgtgataatttcactctttaacacagtgtgaaattatcacttgaacccgaattatcacttaacaaactttatttttcaaagatctctgaaaaaacatgtttgttttttattggattataaatacacacatacctagcacatttgttccaaaaggagtgtgtgaaggagatggggatatattgctgtggtgggggcagatgttgttcccaattgcacacatccttccttccttccttccatttgaagaaatctttcctataggcgtggtctcttctctgcttcccctttgcctgctctagccactgctactgatgatgtatttcagtactaaaaagtgagaattatggcttccacttccctacccttggatttggcttcgaggggctcttctgttgtagatagtgtgcgagatgattccatttcttgagagcagggcatagggtttagttggcttggcatagcctgcattctttcacttaacaggtattttgagatgggaattaattggaaattttgttttttatagttttcatgatttaaaattaatgtgtttattttgaaggaagttgatttatgcgtttatttaaagtttattagtttatttaaagttaatcattaagatgaggggcttggccttcttaggaaaggtgaaatgggtaaatactgaattaacctgtttgagatccttaaatcattttaattgttgtgattgtccacgtcatgaaatttatgagtctcttttaaagaaaactgaatgtagtaaacttccggcatatgtcaaaaactatagcctgaaaaacacaagtaaacactagttaaacctttattcagtatcatggcatgttgtcatttgatctttctttgttgataaattaatatttaatacagatacaaaggaggacagtgaaattgcctggcatagtgttattacaaggtggttatccagt

SEQ ID NO: 127681 - DNA, 1093 bp, Homo sapiens
ggactacaggcgcccgccacctcgcccggctaattttttgtatttttagtagagacggggtttcaccgtgttagccaggatggtctctatctcctgaccttgtgatccgcccgcctcggcctcccaaagtgaggtattatctttacaatcactttacagatacggaagctgaatgcaggaaggttgagtggttggtccaggttcaaccaagatgataattgttggagcctggcctcatgctgttcccagtctaaatatgtagggcatgtattttgcaagcctttctcttattctcctcagtcacagtattttgtaatgcacagagaaactaatgtctaatttagatgtagtagttcaactataacttaggtagaaggatgggagaagtgtggagaaaagccaataattgtagtaaaatgttggtttaagcttttggactcccagtatgtcttttcatttggcaaactgcctttggaacattttgactgagtagttactcccagggaacacaggcatttcatttgtggcctctttattcattttattcatgcttctgctgggatttcgtgaatatgactataatgaaactggacttcttagttcttttcttttgggtacaagcataggttaagcagtaaaaacctaaagagaacacaaattaaatgatttttatgctgctattttcttgatgtgcattttattccataaagtgttgctctgagactttatatatatcttaagaatttggaggccgggcacagtggctcatgcctgtaatcccagcactttgagaggccaaggtgggcagatcacgaggtcaggagatcgagaccatcctggccaacatggtgaccaaaatacaaaaattagctgggcatggtggtgcgtgcctgtaattccagctactcaggaggctgaggcaggagaatctcttgaacttgggaggcagaggttgcagtgaggtgagatcttgtatctaccaattttgttgcattattttcaaaattctaatagaatatttgaaaaaatatatttgtatattttcctggattttgtatgtaaacagtcagtgtctgcagttaaggcagtgttg

SEQ ID NO: 127682 - DNA, 1112 bp, Homo sapiens
tggttttagatcaaccttaagttcatcactaattcccttctctctttgttatagtttttcacattctacctttgtttgcaataaggccttctggcagatcagggacagaggaggagcatgagatatcacttgctgggattaggtgtctttttcttatttttatttacagttgttttggattttggtcagttcagttttcaagtgatcccgaggacatggtttttgtgtagttttgctgcttatttttcttgtcctctattgcttctggaggaaatattgaaagatggagacataagcaaccacctttgtcagcctgagagtttccaaagctgaatgttttaaaagtgcatttttaactatttttcttcattttgagttttgatgttacattttgtcacattatctcattaaatttgcacatctctgagctacacatactatctccatttcatgaatgaagaaatcaaggtccagcaagattaaatgactcaagggagatcacacaaccagaaactgatagagattctaatcaactctaaaattgtatgatgccaagctcttgttctttccactacatcttgccatctccctgagtaactgaacttagaaagcccatgcattaattaaatactgcaacctaaaacattttagtgattataaatgtaaactgtcagtttattcatctgttccttgtccctcctgttatcttgcagtcctgttatatttttagtagcctcttctccactggcttctactccttgaccttctaaggtacattttctttcctgtaaacgagatcatgtacattaagtgctatctcttgaaaaaaatgattcaacagatgtcaattttgtttatttatttattttcctaatagaggtttttactctatctccccttatagcagacctaccatcatttccctcttggcccactttcacgtacgggaggacccgtgcacactcaccttgctttcaaaactcactgccctccctgcgcaaactcctcacttcatggaaatgatagccccaagtagcagttggcaacaacttttggctcctcctttctggagtgggtgttgtattgtctgtagttttctttaaagtaattta

SEQ ID NO: 127683 - DNA, 1152 bp, Homo sapiens
attataattttaatttatttatcactcttccccctgtgtgtattcatgatgtctttttctccagcgacttaccacttttaactaacaaatacaaacctgaggctaggatccagctcttcagaattctcttgcagcgccacatatggcattttataaacagcgagtgcctaataaatgtcatgagccagtggactcatggcagaagtagtagtctgtggaaaacttcccatggtgatttgtttactaatttttattgcatctgcctcttattactaactgatgggtatgatttgaggaatataaatgttattttgtgacttttggatggttactgtgcaaatataatttaattgaaaaatcctctttaattctttaagagagtaatcaaggcagtgatttcgtttattagactgctctgttttggggtttttgagtggagtctgtatctattattgttattatttaatttttcagtgagggagataaatctgcaggacatcaaggaagatttagaattggatccagaggaaaacagcaccctgtttatgggtatcctcattaagggcttggcgaaactgaagaagatcccagaaacagttaaggcaatcatagagcgcttggagcaggagttgaagcaaattgtgaagaggtctacaacccaggtggcagacagtggctatcagcggggggagaacgttactgtggagaaccaaccaaggtaggtgggagtgtattttgtatttttgacaactctatttattgcacattttctagggtggggcgtaagtaacttaccttctgttgatgttgttttcttgaacttaggatactatagcccatacaggccaggcgcagtggctcacgcctgttatcccagcactttgggaggctgaggcaggcagatcacttgaggtcagaagtttgagaccagcctgtactagtagtgaaaccctgtctctactaaaaatacagaaattagctgggcatggtagtgcatgcctgtaatcccagctgttctggaggctgaggcaggagaactgcttgaacgcaggaggcggaggttgcagtgagccgagattgcaccattgctctccggcctaggtgacagagcgagactccgtcttaaaaaataaaaaggatactatagcccat

SEQ ID NO: 127684 - DNA, 1049 bp, Homo sapiens
ttcacttttttaatgtttgaaattttcaacagtacaatgtttaaagtgtttatttccttttcaatgaattatttttctaacatgtttgtctcattgatttgtaggaactctttacatatataggaaatttgttctttgggatttattttgtaattttctgccagtttctttctcttttgacttcatgatgtttctgggcatgtagacatttgttttaattttttatgagggtatatttatcaggttttatagcttctgggttttgtgtcatacttagagcttccctactcttagattataataaaattttcaacacttttctagtacttatatagtctcattcttaatatttatatctttgatacatctgggatctgaaggagtgaccaaacgacttttgagcacacctgacacatactatactgtattgtaaggggttgtacacccttttcttttctgtcatccatgtgtctgtcatgtaattgtccatgttagctgcataattgctgaataattctaacgctgagtcgtttatcatatggtgatggttcttctcaaggttggtatttgccacattttctaaaactctttttttcctcctggtttctcagtctgtgaagactatagattttcagaaatacgttgaattattgctctaaaattggaaaaatatacttttgaaatattttttataatttggaggccagaattcagaatgagggcatactgctgtaatagaactttcttataaaatggttttatctgtgaggaagactaaaggctcaggcctcaaggatagttttatagtatgaatacaatgtttatggaaggagaaataaatgaaatattgctcatgattttttttagacctgtggctagattcaggcatgagtttctatttcacataaatagcatttcgttttatctcttctttctatattagttacccttcttctaagtatccgaaatgcaggacatggtggaattggtcattttattttacagaaaagtcattcaagagcagctttgaagcaaggtcaggcattttc

SEQ ID NO: 127685 - DNA, 1032 bp, Homo sapiens
cattattattaatcccagatttacccagagaaatgtgaaagctgaaataatttgacagttcacaaagcttgttcgtggtgcaattaagattagaagtagtctttttccaccatgtaagtttgctttctggcttatataaacatgatgtttccaacccatgtcatgggcctgattttgtttgtcctcagaaggacgatatctgtactaaatatccattttcctgcccatacctcacactgtggtcagtggcaggcctcagagatagctggacatgttgagaagcgtgaaaagcagccacagagtgcctggattttaattaggtcacttgagaatcaaattttattatctaaacaattcctctaggggcattcttgtactaggaacaatatagtactaagaacaacaaagcacttgtactaagaacaacaaagcactaagaatatgcacctaaaatcttaacttttgttatccctgggaagtggatttatggatcatttttctaatattccactatgatgaaatgttatttttggaatgggggaaaggatttcaaaagaatgatactgatactttaattcaaagaaatagggcctgggtttattttctaattttagccacaaatttggcatacatcaggattagacgtttgaggtcatctctccagaactcagaaacctgacttgacaaggagggagtaacacaggaaggaagtgactagcaccaggccccacttcagtattcttgttatttttactgtgtttcattctatattactactaattttttcttgctcttttcatagagcagatggagaattagtcagcactctttaaatagtaacccctttttacatgaagacttattaataagtggtaaaacgtatttctatcccttagaagtaggtattagataaccttgaagattaaatgggctccatgtcctatttgaaatgaaaaatagtagctcagccaggcttattaaggaaatgtgtatgagagatatgggcaggtaaaacaaagaccatttttatct

SEQ ID NO: 127686 - DNA, 1144 bp, Homo sapiens
tttcatgtatttcctcttcagtgctagagaggtgttggatcttcactctccccactcagagccatagctgctgttcttttaacagctaattgaggtataattcactgctgcacgattcacctattgaaagtatacaattcattggtttttagtacattcatagagttttgcacccgtcaccactacctggttccagcacgtttatgtcctccctaaaacaaatcccgtatacttatcagtcagttcccacccacccccagcctaagtaaccactaatatattttgtgtctctataaatttgcctatcctgaatattttatataactataatcatatagtatatggtcttctgtgaccttttttcacttaccatagtaatttcaaggttaattccagttgtaccatgtatcagtacttcattcctttttgtggccaaataatattctattgtatgaatataccgcattttatccatttatcagttgatggatatttggattgtttccacctttgggttgttgcgcataacactgctaaggacatttgtgtacaagtttttgtgtgcacgtatgttttcatttctcttgggcatatagctaggaatggaatcactggctccatatggtaactatgtttaatgtcttgaggaactgccaaactgttttccaaagcggctgcaccattttacattcccactggcactgtttgagagttccaatttctctgcatccttactgatactttttattgcttttgtttttgattgtaaccatcctagtggaccgaaattctagctcattgtgattttgatttgcatatctctgatggctaaagatgttaagcatctttttgtttgcttattggccattcatatattttctttggagcaatggatatttaaatcctttgtccatttttaagttcagttgtctttttattatgagtgtaagattttagatttgtcttttatcagattaatgatttacaaatattttctctcattttatgtattgcctttttactttcttgatgatatcatttgaagcacaaacattttaaattttggtgtcagagctgtgggttttattaaataatatgacaccgttgtgcttcggtaaggcggaagagagctttcctctcgtta

SEQ ID NO: 127687 - DNA, 1054 bp, Homo sapiens
tttagacacatgtttctgtattttgtatgtatctttgctaatatttgagtagttcttcagtaacacagatgagaaagaagaattattttagatatatgtgagtataaatatgaatttgacctttaaggattaaaaagaatcatcaatcaaaaggtagaatggcttctatttataaatacaatgtgtaacttctggattatatatgtatagtctaggctgggagtactacataaattctattgattttgtctcatctgaattacaatgtcaaatagatactagggttttaccataagatagttatgggctgtctcattgtcacattaattacaataattaggcagtaaagaagccataggaatagataatatgttgtatgtttggatgagattgtagttataaccccttatttatggtaataaaaccttgttaattgacactgctgacaagctcttttgctttccttttcaactttccaagttggtttatcagtctatttaggaattacaagctgagagccacaaaatatacaataaagctcacattgcaagattttctgtacttgttcatgctatacacattaaattcattcagcagtatttgctaattattgttctaagtgctcttaagtattcagagatgtataaagcagtgcctactctgaaagattaataatggagaagtgaggtaaagtatctatatataaagaaatatgactgacatttattgagcagcatatgtgaggctcatgtgataagttccttaaaagcagacaaaagagtatacaagttcagaggaagaaaagatgattccaggcctgtgtgatcattgaaactataagtctcagtggtagaggaattattttgcatctatgccataaatctttgagctatctattctagagctgtagtgaaaggtaggtggctaaatgtactgacatggaaatcaacttttgttctaggcttagctgcactgcaaccttattttgtgtccttgagtatataaaattgatgtaataatatgtgtccagcatatctcactgtgatgaatgaga

SEQ ID NO: 127688 - DNA, 1124 bp, Homo sapiens
ctgaggtcaggagtctgagaccagtctggccaacatggtgaaaccttgtctctactaaaaatacaaaaattagctgggcgtggtggcgggcgcctgtaatctcagttacctgggaggctgaggcaggagagttgcttgaactcgggaggcagagtttgcagtgagccattgtaccactgcactccagcctgggtaacagagtgagactccgtctaaacaaaaaaaaccttttaacagacttcttttttttttggcagactttaaaaatagaagcatattctcaatatgtatagtgtctggctttctgtcgtagtatactttacttgactggaattagtcatatattaaggtaaaaaacattaaaatattcttaagcattattttataaacatgtacatagcttaattttgttgactatttccttacagtcaacttttgcatatattgggttatatgacagaacaagagcttattttgagagatgagaatagatctgtgaggtataaatgtatcactttgcttgatttgttgaagattagaggaataatattattctttggtatgatgctgctgaaatgatatttagaaattgtattatactttttctccatatgtgagcaaaatatatttgatttagccagatggaaattagaaatataattaagagttagctgaagcaagctttgacataactaaatagaagtaacttagttagatagtttctgctaatatgaaaaaaattaagtatatgtggggaattggaaaatggaactgtgtaggaatgaaattacttgcatggcaaataagagtctttgcagaaaaaagtaaatcatgaatgtaaattatagtcattttttagaatgtagacatgctcttggtggattgaatggattgattcctggtttttcattcattagacaacttttggtacagtgtatatgctttactggtggttcagtagaaataatattggttgaaactttttactgctttgtcaattgccatgcctgtagtacatgcttggtgaatatttttgtattgaataaaatatctttatgggttggaggctggttatttaacattttgcatgttgatatgtttatccgtcttatgtaaataatgtg

SEQ ID NO: 127689 - DNA, 1105 bp, Homo sapiens
cccagctactcaggaagctgaggcagcagaattgcttgaacctaggaggtggaggttgcagtgagccaagattgtgcctctgcactgcagcctgggtgacagtgtgagactcaatctcaaataaataaataaataaataaataaaatgaaaaattcaccagatggatttagctgcagataacatactgtggaagaaaggatcagtgaatttgaggatagatcaatgtaaaccatccaaatcaaagcacagagaaaaaatagacaaaaggaaaatgaacaaagctataatatcttcaaggatattatgcagcttaacaattatgtggtttacaggtacagaaggagagaggacagagagattggggtagaaaaatatcaggagaaatggtgaccaaaaagttttgaaatttgttgagaaacataaacccacagatgcaagaaacgtaacaaatcccaagcaagataaacacaaagaaaatcaacacatacgcacattatgaaaaccaaagaaaaaattcttaaaaatagccagaggaagaaagacacattgcctacaagcaaacagtgataaaaattatcagtgacatctcatcagaaacaatgcaagccagaaatcaatgtatgtcaatctaagaatgctgaaaagaaacaaaaattgtcaatctagaattttgtgttaccgaaaatattctttaaaatgaagctgaaatagagacattttcaaatgaactaaaacttaaagaatttgtcaccactagactttcacttaaagaaatgttatagaaagtttttcagccatgcgcgatggctcatgcctgtaatgccagcactttgggaacccgaggcgggtggatcacgaggtcaggagttcaagaccagcctggccaagatggtgaaaccctgtctctatgaaaaatacaaaagaattaactgggtgtggtgtctggcgcctgtaatcccagctactccggaagctgaggcagagaattgcttgaactggggaggtggaggttgtagtgagctgcgatcgcgccactgcactccagcctgggcggcagagtgagactccatctcaaaaaaaaaaaaaaaagagtttttcaggctg

SEQ ID NO: 127690 - DNA, 3219 bp, Homo sapiens
gggaccttcaggtgattcttatgcacactgaagtttgaggacctttgctgtaggtaatatgggaactttggagatttatattggagtgtgatgagatgaaggaagattaatgtggtagcaatgaaaaggactgagtagagagggtagagactaagacaggcaaactattttgtaggctagtggagagtctatgcatatattacttgaggtattgtttagtagagaagtaaacaagacaggctttggtgtatgctaaaggaatacaaagaagggagaagaagatttctaaaccttttcagagtcttttagaaaatctgtaagatgatatggtccatctgccagcctagtttccagtatgacagatattttaatgatggtttagtgttaaattattgggaccaactatgtactgagtactggggaatagaaaaaaatacatgaacaccagagacccctggctgggaaatatttaatgttcatttatatggagggtttaggatgaagatttttggttaagtttctatgtacagttttacacatggggctgatttagttttcatgtacttgttggaggagtgttctttaggttagaaatcattcctggagaacaaaataattcaacagaatactagaagcctttagttaaatatgtaacagcatgaatgaagatgatgggatattatgatgaatagagttataagtgtttagagttcaaatttctgtatttctttgaatggaaaacatttcctgctgaaaagttgaaatgttccttgtatattaaattctttgtatagtaaattaattcttggaagagagaatactttttgatcttttaatgacttcagcagtttttttccactgcaacttgggctttccctggcagccagaacccatcctttagttggaaggctcatttgtctcagcgtgtttttgtctggagacagacagtgaggagacaaggctatagctatcatagtaacggggtgttatagtttttccctggtgtcagccctgtgaccacacaccattgcactcctttttcagttttcactctttttgaaactgtgataatagaaatacatgtttttgcccttttgagcagcggcagtaccttccaaaatgacacctacttggtgacaagtgtgtcatattgttggctgtgtgttttcaagtgtataaaagactgaggtacactagaaatacaaaatattcaatcttgttgaattctgcatagcaaaggaagaggatcactttgaacaaacccatcctccagacgttatgattctgtaaaaaatctaaatttttttcacatctcatttcaaaacacaactgtcgatttagccattgttgacttaaatgtgtaactccttggcatgctaagcagtgtctacagatggggacagtgggttctgattatactgtttaccactagcagtgacacctagaacaagtcactttactttttttagtgccttgatttcttttttctggagattaatggagacagaatgtaaaatcgttttacttttgttaactgccatataaatgtttagtgataaaattaacctcttgcagagagagcttgaagtttgctgtcaggtaagagaatccacaaaattattagtactgatccttgacctggaggggattttcaaggagacagatgtaatttctattttgaattcaggtctgaaactaggttattcttaggttctgtcgactttgatattttggttacctgaggattctataccttaaagtaaaacaaacctattttagtatttcaggccagaaaacgtatgagagtattctcgcagaaatagtttttcgtcatttctcagcctataaaactttttgataacctctattttgcgtggcatcgtgaagtcatgttgttggccaggccattgaatctccacaaaagtgcttgctcctagaatgtttcttctgtctcgtcagtggataatatgctgccaaatgaacagaatataattaacatttacaagttaaattaaaaatcttctaaattcgagtttgtttctgtagcaccaggactctccctgtgttgttttatgttcactactaattcttcaagcaggaactgatgagcagccagggagattcctctggcttctagtacagacgtagcaaatgcccaaatcagagtgctagggtgtctaatgcatagtgaagtgtgatgtcaatgtcatggacatctgaatacattgcggcaaactttagaaaatagtagcttggcaggggataccccagaataggttgatctggtaggaaggctgttctccttaaattttcacatacctaggatgggcctgctcgggcctcattacgtcttggcctagagaacacaggtgtagaaatggcaggtcttccttctccctcactgcctccaaagcttatctctgtctggttttgtctgatattttagagggtgaactgttaaaagccaagtgtccgtcagactcatgctgctaccgctcctttaagtgtgctcatcaagatttggtgcacctgggccaaggcaagaatgttgctaggatccaagaggccataataagttgtggtgattaatagcatgaagtgaaatagtgtgatgtagaaagtgtcattctgtgatttgagtgaaattaaagctactggcatgaccttcactgacatattgctcttgcctacttgagaaggttttagagcaaaggtaattacattttcctgaattggtcttttttttttttttaagcgtatttaaaaaaaaaaaacgttttctgattgtggaagcaatgagtatgtctgaatccttgagtatagcgatagttcttctgatttttttttttttctgtatgccaaattcttcagaaacttggtggcttaagacatcaaccattttatttctcatagttttgtgagtcaggaattcatgaaggctccaatgcacagtgcttctacttgacatggcattggctgagaacattcacttggccacgcatctgcagcatggactggttagaaggtccaagaagactttattatgtatctggcaccatcacgcttctccacgtggcttctgtttcaccatatgaccttgcagcagcgttgtctcagggtagttggacttcatacatgattgctagctttaactagagagcattctaaagggtgaaggctgcaggtcttttaaggcctggccttggggcattacttggt

SEQ ID NO: 127691 - DNA, 1057 bp, Homo sapiens
catactgttttatctatattttaatatgtatctctaaaaaataagaactctctttttaaaattatacctaaaaattggccgggtatggtggctcgcgtctgtaatcccagcactttgggaggccggggtgggcagatcacttgaggtcaggagttcgagaccatcctggccaatgtggtgaaaccctgtttctactaaaagtacaaaaattagccaggaatggtggcctgtgtctgtagtctcagctacttgggaggctgaggcaggagaatcgcttgaaccggggaggtggaggctgcagtgagccgagattgtgccactgcactctagcatgggtgacagagtgagactctgtctcaaaaataaaataatacctaaaaacttaatttctttatcatcaaatatccagtcagtgttcacatttccagttgtctcaaatattataattattttttacattttgtttgaatcaggatccaaataaggtttaaatattgcaatttgattaatacattaagattcttttaatctataagttcctgctccatctgtcattttatttttatcccttgaaatttatttattgaagaaactatatcctttgctttgtaaaattttccacagtgtggctggctttggctgattgctagcgtcatttgctatttatttttgtcctgtatcttggatctggcgccttgatcagatttaagttgatttttggggacgtaattacttcataggtattatgcatttttggatagaggagtaaagtagtgaaagtaatgtttttaggatggtttgtctggcagcagtgtgcaaaatgaattggtagaggagaaatggagagctgcgaattagaaggcaggttcaatcagtgcaggaaggaaaggctacagtaaggcagaggcagggaaaagaaaggcaatagagatgagagagattttgaaagaaggaattttcaataccttttaggcttaactataagaaatggagagtcggctgggcatggtggctcatgcctgtaatcccagcactttggaaggccaaggccagtgga

SEQ ID NO: 127692 - DNA, 1057 bp, Homo sapiens
tgcagaattgtgttataggaagtgtattagtctgttttcacactgctgataaagacatactccaaactgggcaatttacaaagaaagaggtttaattggaatcacagttccatgtggctgggcagcctcacaatcatggcggaacgcaaggaggagtaagtcacatcttacatggatggcagcaggccaaaaaaaaaaaaaaaatgcatgtgcagggaaattcccatttttaaaaccatcaggtctcatgagacttatcactatcatgagaacagcacaggaaagacctgctcctatgattcagtcacctcccactgggtccttcccacaacacgtgggaattcaagatgagatctgggtggggacacagcgaagccatatcaggcagctagattgatcatgggggaccaggggagaggtaagggcaggaaatagaaatttagggattctctgtctgcctgggaatagctgaagccatacaaatggaccagctcagaaactcgtgagtgaactgaggagcactttccttaagtagttcgtcagcttaatcggctttctatagttgtcacagcaaaatattacactgtctttagagactggagtttctcatgatgatgccacattttgcctttctttgcttctgcggtttttcgtcatttataggtgatatggcagcagatttttgagcagaatccagctgctttccgaagctggagattccactggggatgtagacagcttgggaggaaataaaagccgagtccataagtgagcctgggaggagtgaagaagcagagcaagcaggacagaaagtgggcggggccagctatagggaaagaccttggggttgaagggatttgatagacttgccttagtgtcttttagttccttcagaagcccagcctgacctccatcatgagagaactagttagtgagggtggggcaccaacagttcccttgtgtcctctcctgctgtttctctcttatatccagagactacagagaatgtggttaatgggaaactacaaaacttatatgtaatcatttcaaaagtcct

SEQ ID NO: 127693 - DNA, 4434 bp, Homo sapiens
atagaaaatcttatagctctcaaaggtgcagattatatttttctgtaatagttctgggcttcccaaaaatttttgttggtgttgccaaagagttgtgtcacataagtgagtggcacaaacattttttgactagccacctgaaagttgtgaagggttttgaaaatataaagtaaaatataaagtgaacaccaccactgtcaacaaaatccactgctttggatatgatttcacaggaagatgacggctgtcaccaattgaactacagcaaatgacgaaagctcagcacgaattagccagtctcattggggtgataaacgacagcacattaaatatgtgttagcaacgtgatatggcagtgaaaaaagccaacgctatttttggctgtgctgcacaaaacagcatctcgtcaccgagctgggctgatcattactttctacccagtacttgtgaggcagcatctgggatgctgtcttgagtgtaggacacgtgcgtactggaaggatagacaaacgggtaggagtcccaagcagagcatctgctgtgactaaggactttagatgagacaagttttagaagtggcatgtttaggaatgagcatggaagtaaagagatgttaaccttttcagagataggatgatgttgaggaaatacatcatagactcctcattagttggcattagtttagtacagtgcactttagaggaattacccaaatactttcacagacagcatatcagcaaaaaggggctctaaagcaaaattaagcaaggacttatttatggtcaactatgttttaatcaagagattaacattggcagtgcttgctataatgtgagaaggaatagaaagtaatagattacataagtcaggtgcttttgattggaaattcaaatgcaaatattaaacctgggaacaatgggggtgagactttatagttatctttagaaattcaagtaacaaataaaggaattacttactttccgcagtagtataggcaagcacaacagaaagaaataatttaagaaatacatagtataaactgaatgtcagggaacatttctgcagtgagaactatcggaccataggatattcccctaggaaaattgggttgaatttcattggacatttgatcctgacagaattgaatgtgtatcagtagggaaatagactgaatatccctgtaggcatttttcatttctctcttctctgattctgggccctgttgatgatctgttcacctgctgtgattaggaagaaattttatctcttgtttttctacacccaggcacattttagatgctttcctgattgacataggctaaaaatggagcttcattgccctgaggttgacctggtaccatccctcctggtgttgtagaaatttctcctttctgtttgggaggcagtgttagggtcctttacctaaggtgaatacatgtaatataaaatgggcccatgtgtatagggtcagtgtcttcttcagatatatctagtaacctaacagggctgcaagctggcctctttgggagtgaatgatggttttattttcccctcttcccccaggacttgactttgaagaaaaaggatatttagcagactaggagaccacagacttttactgtgtcctgtagaaatgtgaaaaatttcaggttcctggatgggaaagggctactggagaagagcttgactccttatgctgtgacagtggtgtgtatgccagtctttccctgtagtagtatcattgtataatcaaagaagtaaactaaaaatgcaaatttaatttcaggttcattacaaatggtctgtatttccttgttataaactagtctattggataagattgttagatagattgttatccaatcttagtctattggataagattgttttcttagcttggcattcaaatacctgtacaattcggacaaagtctctgcttttccaggcttagtttacccttttctatagtaatgctgtattccagttaaatcagcctttctttctgtcctctaaatatgactctgtcctttcctacagtagtagttttgtttattccatacatctttcctactgtccttgccctcatctctgaataccttctctgatatgctccagtcctctgtcttacctatgaagcatccattgatcatttcccttcaagaactcattgcatttcttgtttttaccactcatttgacatatctaatagttatatttttcttcctctactgaatccacatctttcctttttaatcagattaaaaaggctctcttgaggaccatttcttacatgtctttaaatttctcacaactagtctttaagcctttggagagaaggaactatggcttatttatggtgcctgtctcttcccctaaactcacagagtttggcagtatgcacttaataaatatgttttgaacaaatgagtagtagatactctatacatatctattgattgatttaagatttgctatagactgaatgtttatgtcccccctaccccatattcatatgttgaaagccagtccccaatgtgatggtatttggagatggaggctttgggaagtaattaagtcatgatagcagagccctcatgaatggaattagtgcccttgtaaaagaggccccagagagctccctcgacagttctgccacgtggggttacagcaagaatatggccatctatgaaacaggacaggggtcctcaccagacattaaatttgctgatgcctttatcttggacttcccagcctctggaaatgtgaggaatacatttctcttgtttataagctactcaatctgtggcattttgttgtagtggtttgaactaagacaaggttgaattttaaatgctttgtaaatgtgttgaactttgtagatttaaaaatcatgtagcagaagactcataaagctacgaaggtttgctatattcccaggagaccagttcctcctgctttctcctagaccagcctgcacttaaatcatccctatatgaagagtttctgttggccaggcagattgttagctcaggtttccagatatgaaatgatgtcatgaaataatgggcatgaaataatgttggcaagagaaaccattaataattgggactgtcatagtattactattatatagccaatgctcgtgcatagataatatcatttctatcatgggtgtgacaataatagatttggaagaatggtgaaaaatttgataataggttaagtgaaattaaactatacaaacttgtcctttattctttgaaaacgatttaaatttttgatttttcattttaattttcttactcgtatttaaaaatttttccttcatgtcttgctagtgaaatgtacttgctgcaaattaaatccatttctttcagtgatagctttggtttgtaattaccttctttaagtgttaagtctgtccttagaatcatcagagcttctattatgtaattctttggagtaaaccctagttaatcagagcatgcatttcactggaggggcagctcagtgagtgatgtgaaggtgtttcctctgagaaacggaaacagttatgaagtgttttgtggtcctttgggagttgaggtgctatagaaatgtaaggcttttattacaactcctgacctactatacagaaccatgctaacatcattgatgattcttttgcataatcaaagaattaaacataaaagtcatattaattttcagcttcattagagatgcaagaatcaaaagagatgtttgccaaatgggaaggcactaaattggtaggagaaagaattttaatttcaagcttcaagtgaatgttataaataacctagcataaaaaagacactaccaaaagcgcctgacaatgtcctttttaaagatcagcaacattaaaaaggggaaaatgtaaaaaagaaaaaaaaagggaaaaaagaaactataaaaatatgaaattaaaattgctgtatttgagtcagtttatggtagtaaattacttctgagagcctcaatttgaagatcaccaggtagtctatggtaattagtataattttgctgtggtcaccaaatctttatattatttttgctggtcaaacagcaatacttttgcctttttttttttttttttaacttggtcgcagttgaagatgatgaaaaatccatttactcgtgaaagggtaaatgcaacttcctgatgtgaaataggggcatttaaagcactcacattaaggaaagtttgcattttaaatataaagtagtcttaaaatttttctctacccacatataaacaccattccaatatgtgtgaagagctgttgttcatcttgtaggatcactaatcacaggattaaagcgatgaggaagtatatacagtgaagaatgatgcccttttctttaaaacaaaaatctggaggcagccagaagagcttgggaaaattcttgtatttt

SEQ ID NO: 127694 - DNA, 2483 bp, Homo sapiens
gacctctaggctgacaggcacctatacctagaataaggattttctgctagagggaactgaatgtcatatggggctgtgatgggctacagcctcccaggttaagacttatttcacatggatcaagctatctcctcactccagcaatgacacagttagtatatatgttcataactaagcttaaatgccatttttaataaatattaataccagtataaggtaaggacaaggatgcacatacagtcctattatgaaatagggctgtagcagcatttttctagtttagttacttccttccagtatttcaattcctttcaatccaggatcttagtgattttgcatgtaaacctttttcctatttcatgctctctctttgcatttgctttattcagttgtattgaatttctaatgtggattagagcacacagtagggctggttcttcattttaataactttcctttccaggcacttctcagtaatcctttctttttttaagccaggtttagagagggagctaaaagcagaacaagacatttgagtttgtattgttctgctttattttcataagttccacattctcaactgaatttctagggacgaaagagaactcgattacttttagttcctttcagtgccactctaacttagtgacttgacttccatttctctaagtggaaatatttacatgtatttcaaaggatgctctctggcttagttagtatctctacactgattagagaatgtaaagcgatgtttaagtgcttattattttttaattacatttataaaggttaaaatatagataactcaaccattattattatcctcatttagaatttgtataccatttacatttccaaagtgctttgttcatgtaaattagttggtcctcctgccattcctataaattatgtcagtactatcctctgaaatgttgccattttcagtttatagttattatttttatttcagacaactacaccttgttcaaagggtgaaagtgattaatagctttaaaaccactaaaggtaaacattcttaaatacccttgaagttaagtagatgccggaattgctgagatggctgccaagccaatgttggagaatttatttttttgtacagattatatatatatctttgattttcttcttctcctctctgtttattttgtattttttattcatataggaatgtgcacacattgtatatttttcacaaaatttcatgaactaaacctacccactaaacacttgtgtcagggaacaacacagtaccagcatcactcgttcattgaatctcgatttgagtgcgcgattctgtcttacagactgaatctgtctaaacatcagcatagctggaattatggacacaatgagtattcatgctcagatgttgcttccattataaaactaatttctgtatgttccaaaagtgttatcttactgggttaaaataacactgagtagtcacagtaagagatgcacacaagatgtgcctcatgagtggtgtagacaagatatactgttggacatcacaggagcaaagttgtaccttttcagaaatgcttcacatggaggtgaaattagagctggactgcccactagggatagagggcttagacataagtgtaggctttggtaagagaaacaaagaagagggagtagtggtggcatgtgtcccaagcagggaagatagctatgtcttgcatatgacatgttttgatgcagggagagttccagtttgtttggagtaagggttcatgtatgtgtttagtcaccattcaaatttgagagttaagtagaggtcagatatctaaggactttgaatgctagctaaggactcatagtgaactaaacacttactgaataccatctatgtgttaggcacaatgctcagcacttttatatgcattttgaatttatgctcaagacacttggatctgcgggggcaggagttagtggcactgagatatatgagcagcctgggtagaaatggagagaccagagatagaaatcgcagaagactattagggttgatgacaccttggattacggttggtcctaaaatttataatttcagctactaaagacctggttctagaggactgaaacttcatcttttcttggttattctacatataatctaatgcaataagaacctgaatgatgagtacttagttggcagatatttatcagttgcctactctatatacatctctttgttagatttgatgggctgctcactctgtccctctgcccacctgatgttagttaatctgggggacaaccatgtaataagttacttcctagtatctatagtgaccagttatttgggagtcacctgattgaccaaagactgtgtttttacagtgttgtctcctttatttttttcttaggattctttttgcttttcttttttacaacagcctactgtgtcgcatcactgaatctagtttatagtttttcgtttctctacattccatcat

SEQ ID NO: 127695 - DNA, 2862 bp, Homo sapiens
gcgattatcctgcctcagcctcccgagtagctgggattacaggcacgcaccaccatgcccagctaatttttttatttgtactagagacggggtttcaccatattggctaggatggtcttgatctcctgacctcgtgatccacccgcctcggcctcccaaagtgctgggattgcaggcgtgagccatcgtgcccggctgcaagatcctaatatttcttagaaggagagaaatcctttactcacaggaactgtacacacatgttcacacatatgcacaagcatgcctgctatccataagcatttgtcatctttcagatgatggaagctgtttgagacccttaagggactgtagtcatgactcctgtcttttcagtatccctttccccttatcactgtgatcctactgcatttatggaaaaactgctggcgggccatcatgtttgacccagagctgaagttcagaacttccttgttgattgtcagtgttagtaggaatgaatttagcccattatagtgattggcaattagaatggtaccaacattatcagttaaatcctgtctgtttgcttaactcagttttgggtgctaaggcagctgtattctccatttcagtaacttctgaatattaccattcaggtgctctgcatcaaaaagccccacattggctgggttttgtggctcatacctgtaatcccagcactttgggaggccaaggcaggaggattgcttgagcctaggagttcaagacctacctgggcaatatagcaagatcccatctctaaaaaatttttttaaaattagccaggtatgatggtgcacacctgtagtccttgctgcttgggaggctgaggtaggaaggtagcttgagcccaggagtttgccgtcagaaaagtcccacatcagttactaaagtctaacagttctacctctctctgtctctaaaatcctcttaagtctctctgtctctctctaagaccacagctttagttcagggcactggtctctctccctggctcaccataccatcctattaactgatcttctggccctattctgatatattctccatagtgcagctgggatcagctttctaaatgacaaatccctccttaacttttttttgtttgtttgtttgatacagagtcttctctgttgctcaggctggagtgcagaggcacaatcttggctcactgcaagctccgcttcccggtttcacgccattcttctgcctcagcctcccgagtagctgggactacaggcgcccgccactacgcccggctaattttttttttgtatttttagtagagacggggtttcactgtgttagctaggatggtctcgatctcctgacctcgtgatccacccgcctcagcctcccaaagtgctgggattacaggcgtgagccaccgcgcccagccccttaacatttaaactctgaaagttaagtccaaattccttgacatggcacacaaggccttccttgagtctggccttggaagctgtgcatctcacattagtttcttggtggggtcctttctttcttgcctccaatcttttgcacatattgtaccctttgttgtagaattccctaaagtgctgtgcacatttctttcttgcagttttcatcttatgttgtcattgccttttcttggctcaactgggaactttcttggggccatgactctgacctgtgcacagctgtcttactgcctggcacattagaaatatttattgaataagaggtgaaatgaaaagaaaaggctgcgtgcagtggctcatgcctgtaatcccagcactttgggaggctggggtgggaggattgcttgaaggccaggaattcaagaccagcctgggcaacatagtgagactgcgcctccaccccctgcgcccccccccccaatacacacacacacacacacgcacacacacacacacacacattagttgggtgtgataacctacacctgtagtcctagctgcttgggttgctgaagagggaggatcccttgagctcatgagttcaaggctgcaatgagttatgatcatgctactctactccagcttgagtgatagggcaagaccctgtctctaaaaaacatttttaaaaagagaaaattaaaacttaggtaagtactgtttctttattttgtctgaggtagaatttaaaatgttgaggttatggaaagtttatattaaaatcatacaacattgatttagtaataaagctttaatgatgtatgtagagcaaatatcaataaaacaaaatttgtaattttatattagtatgtaggcaatgattcatattaaatatggaagaggagggaaaagatctggaataataatcataaaaccaataataaatatttgagtaaagatagagatgttgtagaaattgtaaaacgttaaatttttccctttttgtggtttctctatttagatcatggtaaatggatataagtattatcaaaaaatattgatataattttttattttctgaatatgatttttatttgtctttggtagcaaatgtaccacattaaggtggtatttggattataatttagggctagtaaacaggaaggaattgccttaatccaaatatacagtagtcttcccttatttgtggggataatttccaggctcctcagtggatgccagaaactgcagattgtaccaaaccttatatacaccatattttttcctatacataactatgataaactttaacttataaattaggcacagtaagagattaataacaatgatagtagtatgctataataaaagttatgtgaatatgcgcttgggaactctttcatgcacacactgtcttgctctctctcaaaatattgtactatattga

SEQ ID NO: 127696 - DNA, 1773 bp, Homo sapiens
tgatggtgatgatggaggtattggtggtgatgatgggtggggagggaatgatgttggtggggtgggactggtgatcgtgggggtcatggtagggtggtagtgatgatggaggtattggtggggatgatagagctggggatggggtggtgatggtggggtggattggtgatggtggaggtgatggtggtgatgatggagagattggtagtgatgatggaggtggagagaggttggtgatggtggagtgggattggtgatggtagagatgatggtgatgatgatgatggaggtcacagtagggtggtaaggatgatggagggattggtagtgatgatggagttgaggagggggcggtgatggtgaagatgctgatggtaatgatggaggtgatggtgttatggtggtggcagctgccacttacttaggatttcttttgtcctaacctctgggatgatctaatttcacctacacctctgcatccataatttactacatgcctattaagtggcagagcttggatttgaacctaagtttgtctgacaccaaagtccacatacttcacaggaatgttgcgttgcttctcacgttatttccagtccaccatatgtgaattctgtgtattttcacagaataatgacacctgtattctggtactgtgggactagtataagatggtcaaactgctatcaatgattctattctctttgcatatttcagtatccaacaatttatttataagaccaaaagacctttctgaactatcataggtagcctgtgttaggaccatcttatataaacaattttctcttgctggaactatctggagtgactgcataaaaaaagaagtataatcaaaatcggataaacctcccagtaggttagtcaatagataaatcaccattgttcttacttataggctgtacctctgtgttgttcataagggattgtacagtaaccagcaaatttgtaaatgtttagctaaaattcaataacagaatgatcaagttttattgccactttattgaggctttgttttccgttagaaagctaccatttgatagtctactaaaaatgccagaatttagctgtattaggtttattcttaattcattgccattatggaatgttcctatagcacaagtgacaggagaaatccatgtataaatgtctgtgctacatgctataagcacagtgattcccacctccaccctccatcttctcaaagcaatcatgtgaagtatcaccagctatgagagacagaatatgctggaggctaaatttctttatctttaaaatgtttccaaaaatggccagaggagttgatttgcttttgtttccatgagtattttcgctattacctttagagatcactaactcagagcagttcatatgactttctgctgtcatcatcctgacccctgcctaaacttttcttactgtggaaaatattaacaattgaccttattcagacatttggcaggctgtggtcattattaattccttcttgcttttctacatattttaattgccctcgggatctggtattctgaagaatgctactattggccagcttgataagtttgggaaatactctcctcttcatagctctgagttagttagccttataggactagtaatgagagttgaatgaaagaactagaaattactagatctttcttataagggaaagctcttcttagctaacattttaaaataattttgcatttttttgtttttcaatagttaggctatctgtatgatgttcttaagaga

SEQ ID NO: 127697 - DNA, 1454 bp, Homo sapiens
catttttggatacaaagtcttaaatagtttgtgttagtcaaatataaagaagttgaagcatctttgtatattctgtagatcatagatcctcattgaatcattttactatagtgtagtctttaatagtttgtaatgtcattagaagtaaactcaataattcttattactatagaataaacatgctattaataagaatagaaatattgttagtcatttatgcgttgaaaagacatttccatttcctgtgcttttcctgacctcagccagtacattagcacattcgtacactggcagaatgctaactagatgttatcacagattatgtatctgtagatttaatcttttcaggacttagcatcagcaaaagtaggacagtttttttttagtctttgtattccatctaaacatgtattgacattctcaagaaagtcatttgaacaaaaatcccaacatcaaatactccagagaaggcatctccaggtgcaaattatgatcagattatgggagatttatcttcaaggtcacaaaagtatgctagctttgggggaagctgtgtcatagtgtcaagtggaacatgcttgtttatttggtactcacgcagtgttgtttatactgaaatacttgaatgtatgtgctcacctgctgtttttcttctgccttttaaaagtcttggagtacatcattataacaaagcaatttttttttgattttgcattgcaagtttttgtttctctctaataatgcagtttacttctaagtgtggctttgataggaagatgtcagaccttcgagtggatcactaaataataatcacttgtctatcagtgagcttgttataaggtgtgttgcttttgatgggctattacctgactgctgggtcaaagttagtcttgctctgtattgggcaatctaaatttaagccttgaagagtgtccagattgtacagaatttctgatttgtatctggtcaatactgtcagaattcagtttttttttttttttttttttttgccagtatttggttgatgggcattagttagctgataaaagtggtatgttgtggtggggcattgtgggagattagacatacttttattggaatatatttgggtattttaatattcccatctttatttgggataatgtccaattatttttttcactttcaggtataaagtgttgtgtttttcttcagcatttgtctaatggtagcccagctctgcaaccacacaattaatcccaaaccgccatgaaaaatcaaatattctttttagctgtggtcccaattatgctggagactgaggcaggagaattgcttgagtctagttgagtccagcctgggcaacatagtgagactctatctctaaaaaaatcagaacaaaacaaaagaacaggaccgggtcataagcctaattcatgtgacaccatcaagcatcagaaaaaagtagtaatcat

SEQ ID NO: 127698 - DNA, 1016 bp, Homo sapiens
acgatgtcatagaactgcagtgactttggtgtcaaatttaggcttgactttcagtcttgctactttggatggctcaagtgatggaagtgcaagtgactcaatttttataaacctcagattccttttggggacttatagccatgtttaatcagtctggactttgctggaagcgcagaagaatcttcgaagggttttaaataggagatcattcatatttgcactataggtcaaaccagagattttggtacccagaactttagctgtcacttcatttagagattaccaaagctgctgagagctatgttgtccaagatcatatactttcctggtttggcccatagtgactgatcagtgaagggggtataaagtccaggccatctcagacagactctgaataactttaaagggacatactttcatgacagtgtaacagagaagacacttgaagcagatataaaaatcacaagccctaaaagactgacttaaaaaaatacattaacttaaaaatcttaaatataacaaaagacattaaaacaaaacaaaatgatagaccacagactggttgtatgtatttgtaactcttctaagtggtcaaagagaagtatccaggatttgaaagaagtcatacaattcaataagaaaaagataaacaactcaatggaaaatggataaagaatatgactaggcaattcacataggtgaatgcttgaatgaccaattataaaagatgcttaactttgctaatagggaaatgaaaagtaaaaccctggtgagattccattttacacctattgattgacaatacctaataagcttgataacaccaagtgttggcaaggatgagaagaaacaggaactcttgtatattactgatgagaataaattactacaatcttttaagcaagcaatctagaaatatctggtaaagttgaagatgtccatattctgcaactcagccattctgcctttatgtgttagcctaggaaattgtcacacatagaaataaaagagacatg

SEQ ID NO: 127699 - DNA, 2300 bp, Homo sapiens
taaaaaaatgggaagagatggtgagtggagctttagctatatttgtgtcattttatttcttaaataacaaagggcattaagcaaataaggcaaaatattagcatttgttaaaattgtggtgctatatacatagctgttatattattttctaaaatatagatatgtatagttgtagtcaacaacctcaaaataatagttgttgtaatgagagtagaaaattttgccaaggaacaattaaaacataatacaagttgcagaaatgctttggtgcatgcttacattttgttgagatctgacaaacgggaagtaaaatttggtcataaaagtctaagttggagaatcatttattagtacagatactaaggaaaggttgtcaaccatgtcagatcacacagagagggagcaaatgtagttaaataaaaaacaacaaaactttatatttggcaattcttattaatatcctcctaggatgcagttttcattttaggagcaaggttcaaaatcaaattgtagggagtatacaatatatgctctatgagaaaaaaagactgtggtgtaaaacacattaaaaaggttgtcagtgaattgaaggagagaaatagggcttgaaaggaaagatggagctaagaagtttgccttgtgcatcaaatttggtgtagtacttgaccatcacccatgtgaacagtttgaaatttcaaagtggtaccacagcaacatagttctgatttagatacctagagtgacaagttttttattcatactttctctctttcctctcttttaaaaagatgtaatttgcatatagggttgtttctctttctagcactcaaagatcctttgagtaaggaataatggtttctataatagcactgccaaccacagaatatagtcagatgcataagtaaatatatcttgaaaaagaactttatccagcatggagagactttgtatgtgggaaagctgtgaaaaacatgggaagatgagacaatgtgtacaaagtgccatcaacactacctcactcatgatcggtcaatcttagtattccctcatgtctcctccactatcagatatttgagaagaaataattgaggaaaacgtttcagaacactctgaaaggaatggagagaaagggcaacagtacattttttaaagaaggatggatgaatgactctctgcttgcagggagggaagctaagccgatgttggagtagaggaggagctgaaggaatgcacggtgagtgccctcctgttggtaggaagagggcctggtggtgatgaaggtagcaatgtgggatattacagggaaggaacaacatttggagcatctttggatgagtgaagaaatgaaagacagatgtctaaatgcattgtctaacaacattgaggattcacatggatttagatagtatgaatgatgaggtctatatgattatgtgatttttataccttggaagctgggaatgaagaatagcatacagggtgtgtaatagaagggatttgcagggctgcaaggaaagatttggtggcgacatggcaatttccttaattgtttgaacagttcttttatggttaagtaattcttttaattctgttttatcataggacagaacttaggcactaaagagtctaagaaaggcaggttcctgcccagtcaaaagaaatcaccagtaattagagctatctaatcatagaatacactgtctttagagatagggagtttcctaacaagggaaggattcagagagaggctaggatgtgaagatggaaggtctgactgcgtgtcaactgaaaccttttttacacttaaggtgttaaatggttttgtactcagaacattgatggggtaaaaaaatctcatttataattaagagcagaataaatgtagtgactataagaaaccaggcgaggttagaatacatgtagtgactataagaatcaaggttaggttctacttgtacacagaatggagccaaggatctaagacaattggggaacatctatgccatagtttacgtccttttttctgcctctgtactagtgacatcaaggacagatcatatgagtaatatcccctcttgcttgctgtgatccttgaccagtctacctcatcagtacctttagtcaccatggtttttttaccctcatttaaaatttcatttgaaacaagtcattataattggcttctttaaaataaaaaaccaaggagtgttaaatttatttgtagactgtgcatgtgaaacattagaattctttatagatttctagtttttgcatgatttttaacccttggcatcaatcag

SEQ ID NO: 127700 - DNA, 1657 bp, Homo sapiens
gaaagaacatagcagatttattagtttcactcatctcataaagataatgtcatcaaacatgttatgaacatagttcaggacaagagacaactatatgtattgattcctttctttgttccgtgctttacatatttagactataggctacaatcttggagaatcccagactcgacactttttttgttgctgtggcacattagtgcccagaaatttagtattgattactgtagtttctcttgcctcatctgaatgtgaaaggaatggcaaagtggcttcattcataatgttggccagttagctctttttgcttactgaggttgtacattggttttggagaatacggaataatcaggctcagagttactttcacattgtactgctaagatactgttgaattaaagtcacagtgttcatggaaaataatgtgtcagaaattactaagaagaatgtctgaaatgtgcacaggttgtgaagtgctggagagaaaaaaatgggtcagtgcattgattctcttggggtaagggtgaggaccacattctttaaggggtgataacaggagctctagttaaaacgtttctaaatatacacgacccacctcctgaggttctgctgtagctgtcacccctagggtttgttgttttcctttattctgcatgcatcactctgtgtactcactactagtagttacttttagggttattgtgaatattgttagatataagatgaattggtgcatatcctctgacgctgggagaccattgtaattgattggtcaggtattttatagcgaacttctatgtagaatataggattagataaagcctttgtatacggtaagctttcagaatttaaattaaaaatgaaaaagtcaatggagatttatgggaatatattgtaaggatgacagataatttcagtggtgagaaaaaggtcatctttgactatgtttcaaagtcataaagtggttcaatatgatattcctggtgtaagtgaattcaaggagtgttgtacagcagaggaaataggggagacatcctctgaataactgttatttcaagaggctgggtgtgtaggcagaattaaagaaggtagaagtggagagatggtttcaagaaaataacaaggtggtttcaatttgagagacattagatgaatcatgtaatgaggattttgggtggttatggacttgtagcaccaccagcagcatatgagctgatgtatggttagtaggactgaaaaaatgtcaaggaagaggaggaaaggagactcatggtatggaacagattaaggacttatttacagatgcagtgaaggaagacgtttgaaatgctccaattcttcaagttggtattcatgattaaaataattaagaagtcagttttgagaactaacagtaaaggaattgaccacctgactggtgttttgatgtgaagcagatttaaagggataaaatctgtatgatgggagatcaggaaggcagcagtggtgcattcatacacagccaacactcaagtatttatttgagtattgttctggggagccatggaggatatggtttttgtgttttaaggggatcatagtctgattggcacagggataacatcaaaggccaacccaaatagaagacagcaaatgttggtgtgtcaaatgaatgtta

SEQ ID NO: 127701 - DNA, 1049 bp, Homo sapiens
ttttaataatagaaaaaaaatctgtagttagaattttagagaagtatgtgaaagttttatcttactacagaaattatgggaaatgcttactttttaaaaggagaaagggaaagaatctcatgttgaaaattgtcattaggtaaagtaatagaattaatggagcaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgttgaacccgggaagcggagcttgcagtgagccgagattgcgccactgcagtccgcagtccagcctgggcgacagagcgagactccgtctccaaaaaaaaaaaaaaaaaaaaaaaaaatagaattaatggagcaatccaaaatgagctaaataagtttctttgtgagaattcttctagagattaattctagaattcttctagagacttcataatatatggtaaaactaatattgctgcttagatattctgtgtcgtcttttgtcctcactttaggtaagcaatatgtacgccatagcactctctatcttactttacatcactttgctcatttggtgattgtgtaggtgtgagtatgtgcatgtgtgtagacttttgtcagtttccttcctgctaaattttaagctcattgaaagtaagaaccatgtgattagcttattattattatgtaccctgtacctagtgctgttcttggacataatagtgagaggtgacaacgtgctagcagccctcggtcgctctctgtgcctcctcagccttggcatccgctctgggccctctttggggctggcagaggctgaagccggcttcctctgctcgtggggaggtgtggagggagaggcgcgggtaggggccagcgctgcgcgcaggccttgtggccggcacgggatctgggtgggcacgagctc

SEQ ID NO: 127702 - DNA, 1048 bp, Homo sapiens
gaccaaaccgttatatttcctaaatgtatttgattgacgtctgatgcctccctgaaatgtgtaaaaccaaactgcacctcgaccaccttgggcacgtgttctcaggatctcatgagggttgtgccattggccatggtcactaatatttggctcagaatatatctcttcaactgttttacagagtttgactctttttgtctacaggaaggagatgatcagcacccacttcccgtagatgttttctgtttctggtaatgatgtttttggtgttagggaattcagccttggctattctatgttcattttaaggttggtaacatcatgccccagttaggggttatgtgtctgtaattgccacaggagcagccctgtgtgttatgcctgcagctggctctgaatctgttaaggaaagagcaagtaaatattttcttacaaatataaaaggaagagttaaacacttattgtttggaaaccaagctgatgagcatattatattgtctgaggccccagaaataagcaaattaattacatgcaaataacttgctcatgaagtgtgggataataatagtatctgtttggatgtttatggcaaatttatttacatggctcaattttctgctaattttcctgtggaaaataataaatattggttccttttgcctttcttttagaaatacatcattgaaattatgaaaactgttaccatgtcttgctatctttgctttgccaagggcaattttaaagacagtatttgtaaatacatggtgaagaaagaactattaatgtatgtaggttctttctgctgtaaacagatggttgtcatcaccaacatcattaaataatacagaggttattattgaatattaacattcagtagttcagttgacttcctgttgatctttttcatgaacatcttttgatgtcagcttcttgctgagcttcagacatttcctctcttaaggtataacagggaattgagcagtttatattgacagtgtgatccatggtctctgtctttttcattaatgagtaattggattcacattga

SEQ ID NO: 127703 - DNA, 1051 bp, Homo sapiens
ctctaaaggaaccttagcatccaatgtgactctcctgatgctcccatatgtgtggtttttttttgtttttgaggtatatcaaaggtgattcgatgagttgttttatttttttcaagataatcatttttttgcagttcattaacttggattgtatgtcaggcgcctcataagctaggggatgagtgtgggattgagtctttagttgggatgaggagtatttgtttttgtatccaactttataggctgtgctgctcgactcccagcctttctcagtagggtgatccacagctctactaggttactattttatttgtttgctgtctgtatgctaaggctcaggcattgacatcacctctatacgttttcatcaacaactctgacattttgacatgacaaccttgaaactattatcttatggaatgccagacacatgatctgttgttcataaagcagtaagtagaatggaaatggatttttcttttaatttttggtagagcaggaattttaacctccagtcagaaaggaaaacagagcagtttgtatcttggattagcttttatcagctactctgcaccctcatttttgccatctacaagtgcgttggggtgcagggagatgtggggttggcacaggaaggttgagccacccaactctgtactctgtaaattaatatcttgcttttgcatgaactctctttgccggttttctccatcaattgccgtggtagagatgaggctggtggccaaatattttcttcttgtatttccagtgggtaagggggtggtaccacacacactttgggtattccattgttcttcctttcagtttgaggttcccatgtagaaaaattacactgtgttttgataatctgattaacagaagggaaaaaatcaattggtagattttgaagagagaatcaatttccttattacagaaaaagatgagagacataactaccttgtgtttgcaaattatttgcttcagtctgtgatgctttcaagagtttgagaaatagggtatttaacttctcaacttatgcctgataggatca

SEQ ID NO: 127704 - DNA, 1051 bp, Homo sapiens
ccatttgttattccagtagccataagcatttgccatcaagcagagcacatgccttagagtgatcaggaagaagcaatgtcagaacaaatggtaatcactctgtgctaatattctattctgttctattctgttctgttctgctctattctattcttattttattataatccttggagcatatccagctttggctagttatgcacagactcaatgcttagaaatttgctgttgtagaatttgtaaatcaggaaacggattcaataattgtggcttgaagacttgtttagtataatattcgggttccttcagttatattctacatcagtgtgttttctggtatgccacttgctttcttttatgccacaaacatctgttgctgcttattgtagatgttagattttgagccagggtataccaggacttactaaagttaattttggtaaaattgcctgcagtaagtatcatcatttttcttaaatttttttcttttgtgttttgtttttccctttttctctgatcagaagttaccttatgaatgttatacatatgtgtagattagaaaattcttataatgagtcagaagttgactataggaggattgtggaaatattgatgccttggaaaggctgaagttgcagggaaagtattaagcaagagaggcgtggtttgagaatagggattgaggtgattgacagcacgggttggaagaacaatgatgaaggagaagtagtgaggatattgatttagtaagtgaaagggcactgaaagaacgaagtcttagaatattagagaaagaattgatggaaacatgacttttaatttttttttgaatcaatcttgatgtttattttggatctaaaataaggaaccaagtataagactgctttgaaatcataatctgaacattattttaaacatttcactagcaaatcatctgctttctgtttcactatgccgttttctaactttgctaagaaattgattctgttacgtattaggacctaaattttttccataatttttaattttttaaaattaaaagcattgcgat

SEQ ID NO: 127705 - DNA, 1512 bp, Homo sapiens
tttccctgcttctggtccatatcaataatattccattatatggacattttgtttatccattcatcagttggtggacatctgggttgattccatattttggttcttattaataatgctgctataaaaatttgtatgcaagtctttctgtgaatatttgtttacaattttactatacctaggaatggaattgttggatcatatagtaactttgtgtttaactttttgaggaactgccaaactgttttccaaattagctgtaccattttatattccaccacgcatattgggcatattatttgaaatgtaactgatttactaagaaaaaatagttttaccctttctatcttgccttttggacatcatctatactggaatgagttactgtctgatactttgaaaggccataaaattgtagagcttgagaggttctaatgaatccatctttctactggaatggaaaatccctgaagtttaggcaccttgtccattttgttcacttctgtatccactccacctgtgtcagcactgtaaatactaggtgcttagcaaattttactgaataatgaatctaatccaacccgtttgtttcgtaatgagaaaagtgatgcccagagatgtcaggtaactttctaaaggtcactaagggatttaatggtagaacaaggactagaattctggtcctgatttccttgccaaattcttgccttcaaagtcatcttgaattcactgttcttcctgaacttcatggtccattgctgacctgatacagaattttctgacagttttatagctgtgctttgggggtttattgacatttaatgagtgtttttgttcttgtgaagtcatttacatgtttactgctgaggctagcattcataacaagaaaaaaacatttaaataactgcattttacccagggaagataaattacagttgcctatcaataagtagataactttcattgctgccaagattattagattgtggaaggcaataaatttgtaccctcccttgtgagtcacttgccttaaaaaattcacaactaattatctgaaagtgagacaggttagtacaggtttgctatctactagtattcctttctttcctaatcactcttgcagatggaggaatccattttatcagcctttcctccttattctgctcttccagagtaatatatgtgtaaattaaatgtagcatagcttaagtaagcatagattaccctgtatctgaggcgttgtttttagagccacatttgcatgttaagtggagttgtgtgccatgagggataggtttatagaccggacccgtaatgaagttgagaatcattgtgcaaaagctgcagactacaggtagacattgagagcctttgaatgtggagagcgtatatttcacttccttttgacaaagactttattttataaggctttatgggaaacagtgtgttcaattacctcagttaaaactcattccagggagcagactattaaaatactacttgaaagtactgaga

SEQ ID NO: 127706 - DNA, 1004 bp, Homo sapiens
ggctcactttactcatttgtaaaatgtggatgataataataaattcctaccttacaacacagctttgtatttggtgagctaatgtatgggacatatagtaggcatttaatagctgatagtgaaatctgaacctggggttcattggaccttcttaagaaaattttggtagatagatatataaatataagtatcatgtttatgtaatatatgtattcctctcccccctttatatctgcatcccatgtcttgtttccagtaggatttaactggtatgtggttgataagttaacttttaaatgtatgtaatagccagagccttttaaagttatcttaaaatgttcactgtaaagcttcgttaatagctgctgtaaatctgtttgtcaagtgctttccactctcttccagtttctgctaatgctactactattgcttactacattatccaagttggaaaccttggtatgatctttcctgctttctcttttctttgtaattctgctgtctagcaggctatttctatgcaaaactaatactgcataaaatattgtcaatgccaatgtaaggtagacagcttagcaagtacatggacttgaaacaccagagtatgctaagcagcactctatagctgtaatgtattaccctttgtcaacagatttctgagacatcaatgaaactcctaatcatgtccgtttatacgatataataccaattttacagtttttttctgcttaattctcattcttattttcgaatggtagtagtatcaatggcagacttctgtaaaactaggactgacatacttagatgatgagatcttgttattccataagcggtaggataccagatgtggtaaacaaataacctctagcagcctgaatggaaggatgtggtaggttggattattgttcagcaaatattcattccctaacctaccccactcccaatagccccccacccaacctatgagagcagtctgtttcgtcatccaattgctattggacttg

SEQ ID NO: 127707 - DNA, 1857 bp, Homo sapiens
ataaattgaggatgaactgataaaaaaaaaatacatctgagtgactatggatgggtttgtgtgggagtgtgtgaggatgggagaaacttccatgattcattaagatatattatggtcatagtaaaggctcattttaaaattttttgatttctttttaaattttgcgtgttatccaaacatgttagaggatttcattttaaagaaagtactgaaaatatttgcccaaattaatatttgtgttctactttttttctcttatagtttctcaaatttactatatttgtgttactagagtttttagatttttattctgattatggcttatgattatccaccagatgtttaagtattttaccttttgctattatttatgagagaaaaaaatggactgtaagctccctgtggtacaattttctgttcagaagaaatggaaaagtttggtggcattcattttctagctcatggtcttttcccattttcgattatctggtgatcacttactatttgctctaaacttcagactaatgctggacaatgaagaagaatgcctgtgacctcatggagctcacatctggatgggaaaacagtgctattggtttcaccactaaaattttccgtaatatttctttgttaccattttaagatcgataggatattttattatctaatcttttttccacttcacatcttttatttccccgtttttctgtgatgtttccatactgattgtaaatgactccacaagtgtgtgcatgaattcccttaagctcctctgcttcccatcatccaggcctgctgattggtatgagttcagtattgtcaagtgttccccatctgctttttgtcagtcgctatttttgcaaagtcttccttctctctaattatacaaatatgtctttttcatttttcttgtcaaagacaaattaaaaagaattagttcagtttcttagctagtttagtcttcattaattccaaaccccactccatttttagcaccatttttcttttcctagtctttgtcccgctttttggtaattttaaaagctcctcttctcttgtctgacttatttaagtagcatgaattaatttgctacctctgactcttttctataagttttagctaactctaacaagatactttttcactcttctccatatttagttcagatctgtctttgtctgtagatctttgaagagtcatttgtgaaactacattaggtgtttcttgttcattatcattttccccaagaggaattttaatcctatgtgtgttaattatttaattatcctaatgatgtctcatatggtacccctggcctcttgcacactgatggaattaatcccttatcccagggctcctcagagttcctgattctttaatgtttgtacatttatatttaaatagttcttatattagtttttaagtaactttcccctggtttttccttgccatcttgattttgtctcttatttctctaatgccctatgttctttcgatttaaatattatgacattagtttcttcctttctgttgcctccaatgggggttgttattatctaatatactctggtttcaagctttaatagccatgagaatcgtctggaatgcttgttaaaagtccagatttctgagtcttagcccagaaattctaattcatttggtttgtgaagagcctagatatgaagagccaaacatcccaagttttaatgaggtggtctactgaggcagtccactatgactaccacctgctaactgccatcctttatcttaaacgcagcagccagatttttcatctcagaacatttataaaatgcctgctctctgtaaggcactgtgttgggcactcagaatatcac

SEQ ID NO: 127708 - DNA, 1322 bp, Homo sapiens
atttttgtatttttagtagagacggggtttcatcatgttggccaggatggtctggatctcttgacttcatgatctgcctgtctcagcctcccaaagtgctggggctacaggtgtgagccaccgcacccagcccatatttcatcagttctaatgtatcatcacttatcagacccctcccaacttcagagatgttaaaatgtgaaataatatgtatcatatatccatgaagtatagtgtacgtatttatgtgtgagtgtgtttgtatttgtgaggataatgataccacacaaagctaccttctgactactgacacatggttacttgggaccaaaaaagctgtatcactggtctgacactcctgaaagactcaggatttattaagaaacataaagcctgtaacacaaaagaagcaaagatgtaggaggagattatcagtctctcagcccagatgacccttcccatgttttccctggacctgcctcactgttgaattgtgtaatgtgtagagattcctaacaatgaagccatcagggagactataactcattgggtaactcttccatctatcactcagctctgacatctccaagaaaccaaactcagatgagcacattgcttattgtgagttatagcttctttattttttactttttaattcaatatattcatttaaaggcattaaaaaaataaatttagtgattacattgaataatcacttactggcaaccctctcccacccccacagggacacacagtttaaccatttctgagtcaaggccttgcataggtaacattaactactgtttacactcttcaggaagttgtcatagttcttgaacactacaatggctttcttatttctcttcatgttttcactggatctgagtcttcctgggagggacagtgacttattcagggattcagaggaaagtaaggtactggaatcaattctgcatttttgtaaaagctctcattctgttatttttcccacctttatctccacccccacccccccattacctattcaattctgtcttccttccaagtacttttagccttagaattaacttctcatgctacagttggtcatcagtgttcatgatgtgactggaaatgtcagagacatttgaaccagagcaactccatcttgggtaagggctgggtaaaataaggctcagacttactgggctgcatttccaggtggttttaagtcacaggatgtgatcagaggtcagcacaagatacaggtcataaagaccttgttgataaaataggttgcagtaaagaagctgggcaaacccactaaaaccaagatggcaatg

SEQ ID NO: 127709 - DNA, 1035 bp, Homo sapiens
ctggaaggaaaagataccaggataagattttttttaaagaggggacaagggaaagagaagaattgtaaggaaggttaaaatgctgcaacttcagaagagaaagccataataaaggaactaggatactaacaattgatattccataaaataaaatcagagatgcaaaaaacaaattgagaaatactcccaaatatagatgggaaaaacagcaataataaagattgaaaagctggaggagagatgatagacataaaaatttcagaacagggattcaatccaagtattacagaaataatgtttgtaaaaagagatgtacacacacacacacacacacacacacaaatgtattttcttgctttacagaaaaaaacaccatgagtaagacaaaagagtttaccgcattttccagggaaaacaatgaaataacacttatctagatacagatagaataaggaacttacaaaaagaacaaaaatcacgatagctatatacttcctgtaacactaaatgtgagaagactaaggagcaatgttgatagatttttaaagaaaaaacagtgtattaaaagaaattatccttgcatttaagaaagctcagaaaaaaacttgagacagttcagaacataggtgttcttgagaggtgtgttagtttcccagggctacagtaacaaatgaccacatactgggtggcttaaaacaatagaaatgtattctcttgcagttctagaagctgcagatcttaaatcaaggtgttggcagagtcaccctccctctggggtctctaggggaggagtcttccttgccttttcctagcttctggtggtagccagcaatccttggcgttctacggcatgtacaagttttactctaatctctgcctccatcattacatggcattccttgtgtgtcttctctgtaaccaaattcccatattctttttatttatttatttatttttgagacagagtctcactgtcacccaggctggagtgcactggtgtgatctcagctcactgcaaactccacctcccagatt

SEQ ID NO: 127710 - DNA, 1068 bp, Homo sapiens
cagcttctagaactgcaagagaatacatttctattgttttaagccacccagtatgtggtcatttgttactgtagccctgggaaactaacacacctctcaagaacacctatgttctgaactgtctcaagtttttttctgagctttcttaaatgcaaggataatttcttttaatacactgttttttctttaaaaatctatcaacattgctccttagtcttctcacatttagtgttacaggaagtatatagctatcgtgatttttgttctttttgtaagttccttattctatctgtatctagataagtgttatttcattgttttccctggaaaatgcggtaaactcttttgtcttactcatggtgtttttttctgtaaagcaagaaaatacatttgtgtgtgtgtgtgtgtgtgtgtgtgtacatctctttttacaaacattatttctgtaatacttggattgaatccctgttctgaaatttttatgtctatcatctctcctccagcttttcaatctttattattgctgtttttcccatctatatttgggagtatttctcaatttgttttttgcatctctgattttattttatggaatatcaattgttagtatcctagttcctttattatggctttctcttctgaagttgcagcattttaaccttccttacaattcttctctttcccttgtcccctctttaaaaaaaatcttatcctggtatcttttccttccagcctgttttctctttaaagatttcttttactgttgcaagaagctatgtgttcttgtgtgctactgaggatgccaggatttactgaaaattttttgtttctagtttttgggttattattattttttttttgagacagagtcttgccctgttgcccaggctggagcacagtgcagctcactgcagtctcaaactcttcggctcaagcaatcctcctgcctcaggctccttgagtagttgggactacaggggtgtgtcaccacacccatttaatttttattttttgtagagatggggttttgctttcttgcccagtctgatcttgaactcctgtcctcaa

SEQ ID NO: 127711 - DNA, 1050 bp, Homo sapiens
atattttaattgtagtaaaaaacataaaatttaccatcttaaccatttttaattgtacggttcagtagtgttaactatattcacattagtgttaccttttattgcctttacctttgaaagctttttgtcctactcagaagagctgaggctttgataattagcctgatgcactgtgaattgctaagagtccaacttttttcatggaaggaaccgaagacaaaatgagagaataaaagcagagaggagggaagaggaatacagcttagattagaaatggtccctacagcagcattattagtaaatatctcattttctggattccaagaccctaagaagtataagattaggaaaaaaaagtaaaactaccttaaatgtacacatctatcataagataactgttgatttttggatatgtgaaaaaatgtgagcaaatgtgtaccttagaatctgagaaataccaggaagtctcccacatggtgatgagaagcagcaaatgttgtgtctgaggaggaagttggtgaccagagtagaacagtgccacagcacaggcatcaagaagggtcacaagccatctacccccaatagcctctgccatcctcatgctccagtcaacctttagctctctgtgcatctcgtatgtccagaatagctaatgctcatccattctagatagcagttttattttttctataaatgttatttttaactaagttgtttgattctctactattatggattgttgagagcccctgacagcctgacaaatgtaccctgtggaacatgtgcttagcagtgatgacagaatagccaacagaatgttacatatgtaaactactcagctttgtgttcactctgggcaaatgaacaacatatggacatttgaaatatatgtgtgttcaaaattctgtcatgtgaggttagttgtggaattcgatagtccattttgtatttgttccatgtgaaaagggccttataatggcatcaccagttgttcattaatctcctttcccttatgtaaagtctccttttgtcctccctctgccagtctgt

SEQ ID NO: 127712 - DNA, 3291 bp, Homo sapiens
aaggaaatcttttccttaattcatttctgaaaggacatctttttcatactaaaagaaccttttgtttagtattatattttaaataatttctccaacactgctttcatttattttatttattttattttattgagacaaagtcttactgtgttgcccaggttggggtgcaatggtgtgatcttggctcactgcagccattgcctcctggcgaagcgattcttgtgcctcagcctcccaagtagctgggattacagttgtgcgccaccatgcctggctggtttttgtatttttaatagagatggggtttcgccatgttgtccatgcaggtctcatactcctggcctcaagtgatctgccctccttggcttcccaaagtgctgggattataggcgtgagccaccacgcctgaccactgccttcatttcttctgaggagtagctttgtttcttgttaggccaaagtttatgaaacaaaatttcttccttgctaataatagaacttatttctaagatggcaatatgtgattacagtagtcctcccttatccgtgtgggatatgtgccaggacccccagtggaggcctgaaactaaagatagtacagaaccactctatatactatgattaagttataggccagacacagtggcacctgtctgtaatcccagcactttgggatgccgaggcaggtggatcacttgagctctggagttcaagacaagcctgagcaacgtggtgaaaacctatctctacaaaaaatataaaaattagccatgtatcgtggtcacagctacttgggaggctgaggcgggaggattgcttgagctggggaggttgaggctgcagtgagtcaagattttgccattgcactccagctgggcaacagagtgagaccctgtctccaaaaaatatatataaaataaataaaaagtttaagttataaattagagtgagaaattaacaacaataactaataatagaacaatgatagcaatatactgtagtgaaagttatgtgagttatactctttcttaagatatttgaggaaggggtgaagtgggccagtacaagatttcatcacattactcagagcagcatgcaattaaaaacttattaattatttctgtaatttttcatttaatttttttgaactgtggttgactatgggtgactaaaaccgtggaaagcaaaaccatgggcccaggggttaggggaggtggggatgggactgctgtattatttagtagtattattttcttatcaaattttatctgacaaagtttaggaataccaccatctagattttaatcgtagattttcagttaaaatgtcatggttgatatatgagacaaaataagtttattttctagatttgttacttgtagaacctgtttattatagagagttctaggcttctttgaaagctgttctagagttgataaatctgaaaattcaagtggtaggatgaaccaatatcatggataaagctgagctaatggttgtccaatgaataagtgctgactagagctttaaaactgcatatataatatgcataattggcagtccatagatttatgggttttaagttactgctattttgacttaaagattgaacgatctatctgtagtgctagtgatgtttcaaacatcaaaagtaacagaacttcttgcaacataagcagtgcaactcttgccatgtctattgtatcccaaatcatacacctttattatttattaactgagaattattgcaataggtttaccctctgagaaaataaattataaggaataaattatgtgagctgtttgtctccttccaccttggaataagccagaatgtctttggttgatatgcttcattctgtaatcaatatacgtgtattctgcttttattcatggaggctattttgtaaagataagtacatttttatcagttgaaggtaaatgcaaaggaggtgaaagcacctctattccagccattatcattatccattatcattaatgatcctaatttcttcttgcaagttactgtgactgaatcctagaatcactgtatttatagggatcaccagattctagagaggtcaccatgtggctggaaaatatttgggttttagttttatgtgcccagaagaaagaatggctgcaccaaggtcaacaaaatgggcaataattatatctccactgtgtgaaagtgccacagtatcaggaatcgtaaactttgttgcctttatggagcacactaccataattcacattcatgcgatcatatcattgaattggcttaggagggagaaaacttgagatggaactcccctggtattttggtaaataacagtaagccacattctgtactatctaatcaatgtctgatatgagaaaacttaggaaacatcatgaattgaactctgcaaactcccctgaatggtgtggataatcatcttgaacttgaaggcaggtgtaccttcccaagttctctgagctcatttttgggctgcagctcctgccagtatggaatcaggtatcacagagcccaggatgaaggacatgataggtggtttggagaattgagtcactccacagatcacctaggtgacgaagatacttgtggtgtgtagcacacagaaagcactcataaatgctgtttaagctaataaaggaaattacaggaataggccatagaatttgaagaacacagataacacttcaggataattttatttgcaggattatttgtataagccagcagagaaactaaatgtagttcaatggaatggaagaccactgaagaacactgagagctccttcagagcataaactatcttaatcatcttttcgtgggcaatacctaacatagtgccctgcattcaataaatgctcgtcgaatgaacagaaactttagtgaaacgttaatatttgtgttgggccttgaaaggtggttgaatttgatttagtgaagggaaatgacatggcttttcagaatagtaggactcaatgaataaaggcacagatgttggaatgagcttacttaattttgtgagacacaggagaggtcagtctgatgagaggcccgtggtgtatgttgtggtggtaatggttgataagaggttgttattgattgaacacacacaaaaagactcagtgcaagcttctttggggaaatacaaagggatgagacatttttgtactgagaaattctgtctcacagactagtctcataactcctgatcaatagccttactataggctgttgatcttgaaagggcaccagcaagaagcaagtgcagtatatag

SEQ ID NO: 127713 - DNA, 1068 bp, Homo sapiens
gggttgacagaaggggtgtttttcttaataaatgtatacctaaagaaaagttatttttactggctagatatcacactacaaatattttctgactttgagttctgtagttattttgtctagaccactacgcagctattcatctcattcattattgcacttattggttgttttacctagctcctctgaagctggagaatctgagattaagtattagagctggaataaggacctgactctgggggttgggattgtcatttatcctattgcaggatgcaagccctcgcaaattttgtgaagtgcactccaaagacatggttttgctttcaactgtgatgacactataattgatcaagtatattctttcaaagaatcataaattcttattggagtttgaggagatgtcatattcatttgtcaacatgtcactccagggacacaggtgcagcaaatttatggaggaagcaccttgtgtttctcctgagtcacataaatatgaagcagaattgattgaaaacgtgtggttttagattactcctcaggtggagagcaattaagatctctctgtaaaggcatttcactctgcttctcaggttttcttgtagcataggcagagatcaggtctgaggggacaccagagaaatttttgaagacctgatggtgtcttctcagaaaagaatactaagacatttctctggcagagagaatattgcacatttttagtcaagtgcatgattaactttgacatttggaaatggaacttcacgtaaaaataagcatggtacttctgcatgtttaattaagatgtttagttcttgtcaaggctgatagccctccctcccacccccacacccccgccctgtgaagggcaatatattctcaacttctgaaatttcagaaacctgtacttaacctttaattgtcactccatttacatggaaatctgattaacaacttttaaagttcatgagctcctggtaaatgcaattaagacctttttggagtttgttattaagagctggcatttaaagaagactaggccctggctactgttgctgtcttctctgtagc

SEQ ID NO: 127714 - DNA, 1055 bp, Homo sapiens
tggactccttaaagaacagaaccactgtatttgtctctgcattctggtgccttgtactctcagtgcttccaaacccccttatctcctggtctttacaatgttccccttaaattccaatgagaaggtatgtaacacagttcctggcacttagtaattacaaagtaaatgctggttgaatctgaatttgcaattgttatctctaaaaattctattttgaatgaactataggcaaatatttttttataagtgtgacaatatttacatattacagataaacaatataaaatcatctttagtaactgaactgctaattgaaaatgctgggtcttagccacttaattgagtaaactgtctccagagagtaatttgggtcttttccaagatgcattaactctttcaggtcgttagggtggcacttatctcattggagcagaaatgtaataaatggtattcctataatgtaagtaaattaatgtacctcaaaaagcctgaagtttcaccatgggtgttgtagttgtactccaaggagctcatctgtgaatgtgaaacagcaataagtagctgctgtttggagcatcttactttcaatttaggtaacttaagacattgtgcctagatgttgacagagatacaaagaaaagacctggctgacaggcggcagagaaggcaaataactgctaaatgaaatccttgagagatacaaactgctgtatgggttttaattagagtgagatatcatagttgacagtcgagatagatggtaatctcccagaagacaggcatcatggcttttttacacaatatgcttattcatgtttattctcagtatatagacatgtataagtataaatattaatatgaacaaatatatttgtaaatatgagttgaataaattgtaaacatattttacaattttcatatgtgtgctttttttccttgtgagaatatgaaatattaatgtctggcattgatctaaagtgactatagtaagtaggtggaaaccagaaaaaacacacggcatcttttagagatatatgctactcacaggttccctg

SEQ ID NO: 127715 - DNA, 1071 bp, Homo sapiens
ttgcctgaaagggatctaccacatcaaatacctcagagatctgagtgtttaattgagtagctgggataaatggagaagctaaagacagaagatgtgttaattctaagcctatgactctcatatttatttaaaaaaaacctctgcatgtataaccacaaacagttataggcaaaaggttaaaggagattaaatggtaaatgaggaattaattcagaatgatgttaccaatgttagcaagttataaatctcaaaatttttgtcctgctttaataccgtgagattgctaagtaacatcttaggaactactaatcaaatatagcagaagagatgcctaaccaacctagtttatatgttctttaaaacactctgtatctttattttgaccacagagccattcaacgtaataggtcctcagaaaaaaacagtgaatgatgatatcactggaatatgtagacttccaagtgctttccaactgttttgttgttgttgttgtttcttgcctttagtttttacagattataccttttaagttgacacacccatcaattttgactattatttttggggctcttgatgaacaacaaatagaaattcatggtacttaaaaatagtaaagagattagtatctaagatatgaaggaattgagagccaacaagaatgtgggatcctgcacattttctgtagacagaatgtatttgatattgtaagtaatgctctttgttccagaatttcaatcttgggtgattttcttcacgcaaatgttaatcagaatagcttgtttacttttatgaaaattaaaatttgaacccataggtgtgtgcttagaatatatacaatttggaaggtgcagtacattatccaccatgatgtggaatcatcaataaattatatagttatattttaatactaggcatctgatgtttgtgtcaagactgtgtagtagaagatttagcccaattcaaataaatttcaggtatcctagaaataaaggcttttttgttctttgagatactaaaaaattctggccgggtgtgctggctcacacctgtaattctagcacattgggaggc

SEQ ID NO: 127716 - DNA, 2093 bp, Homo sapiens
acctaaatttaaaatagtattttccagctggtgatgaatggtattagacaagagaggcaaacaatgaagcaaacaaacacaaattgcaaacatttagcctgtggttaaaaattacacccatcctttttcttttaaattttatttgtattgtagatttttgtactgaggattaatttacagagttcattctactttgaagactttttaatttgcatataacaacatattcattaaagcttctttatgctttttttaaaaagttcagcaatttgttgtatttttttgatttgctggtctgttgcatggccctatggtggaagtaaagaaatgtaatgctttaaggaacatataaattgggggtagtaagatgtctttattattaaataaggactaataatatcaggcagtttttgatgaatacttattgaatgatgtagaaaatgggtgttttaggagttcaggaaagggtatagccaactagagtggcctggcaagggctccttgaagaaaaaacactggaattattcttggaagtatttgttggtatttatttaggagagaaggtaatccagattaggccttctagaaatgagaatgcccacatatattcagggaagagttaagtaattttgattgcagtgttgggtttacgtttgagagaataagatacgcttggaaatatgtactaaagtcagaatgttgtagatgatgaaaggagtagccttctgatgatagcagcagtgttttaggactgtcagtctgttgatattacgtgagaaggactggaagggaaagagatgagaggcagaaaattaaatgaaaactacatgaattgaactaagttggtggctgtcaaaatggacaggagtgggcaaactaatagggagttgaggaacagtcattaatgatcttgaggactaattcccttatggacacaaaggatgtggaaatgtatcaaaagatggttctgaagttttaaacctggaaagtagtgaaaataagaaactaccaacaaacaaaaaggagacagaaggaattaatgtttttatgggaagatgatttaggtttcagaggagttggttttcttagtgaaatatgtgaatatatatcaagcatgcagtcacagatgtgggactggagctcaggagagaaatgaggaataaatcacattgtgataaagggaacagtagatgtaaaggctactttttaaagtttgggactcaaagacagaaggaaaataagattacagataaagcataaggaccaatgcaagatttttgttgagaaagtaggaaaagtgtgtgtttgcagattgaaaggagaagtgggtggataggaatagactaacaatgctgagaggtaacaattaaggggactttactgatgataaggggactttactgatgatgagaaaaagaaaaatgatcttaaaatacctgtgttttgaggtcagtattttattatacaaggccccagtcattggattctagaacagcaagtgcctcaaaagagttacttggattagtgtattttcatgctttggtagaaacatcactctgtcatgttgatgttaaccatctgaaatatgagtgaaacaatgcatttatatacatctttctgtgttatattaatttgaaattcttttctggtttaccagtctttttttgatcacaaattgctgaaaatcttattagcagcagtgccaaatatacagtataatttagtccctgagttgagttgttactagagacccaactcaatattctccctgatcattgggtagtttgggtgatgtattaacagagctagtacttatcattatattatttcatccacataccgaataatactctagtggcttcataaataaataaaaaatatttaccagtctgttgacatgttttgtattttccaagtgcaatccttattggacagaaaattaaataaagtacatttactgccacctatagacctgtgcttatttgggtgctctggtgtcaggtgcatatatatttactattgttgtattctcttgcagtattgacccctttattaatgaccttttttgtctttttgtacagtttttgacttaa

SEQ ID NO: 127717 - DNA, 1187 bp, Homo sapiens
ctttgtctagtcctctacctgtggaagttaggcatgagttctgctctgaggagccagtgtgtctgtgttggtagctggcagtcactggtgacttctgagctggatggtaacgtaattagaatgacttcataggatgctttcgttgctgcatgtataaggatcctggctaaaggctgatgggggtctgaaagcaaaaggaagttgggacagatcacagttgtaccagttgaaatgcagaataagcaaaagatccaaatacggttgtaaaggagccttagccaggaatatcgctcataaatcaaggtctgcggcagctggccctggccctgtcatggtatagccaaagtgtcttcatcacggaacatcggggagcaccacacagaccagagtagaataatgtggaatacagagctggtcagcacttaattggtttacacctgcttgtctgtttcccctgtgtttctctgcaggttcgaatcgtcctcccatgccatcagtatgagcgcctatctgcgagaacagagaagggagctctatagtcggagtggagaactgcaaggtgagtgattgagcttctctggaaaaattaattttctggaggagtatttcctttattacacatgagtttgtgtcctgcattcacacgatcctttcaaggtaacaaacacttagtgacttaataatttgtttcttctgtaatttcccagcatctgctgccaagcaggtaaaactattactgtggccataggacttgtagacctgctactgttcaagtgggaattcaaagcaaaaagagatgaggccaggctcgtcttgcttaaacagaagacctgagtccagtcacaatctaggagaatgttggtcttctgcgactgccactgttacttctaattgttgtttttgacaccttctagaatatgacaggagtacctgagatttgggaaagggaaaatgcaaccactgtcattatttaaagggaaaaagatgcctctaaatagtatgttataatcaatataactgtgatgaacaggctatttgatacccatgtatagttaccaaagagttgtaagctgaagaagaaaatatttagaaaataaattaaatataaataaatatattagactgataacatttccttctgtgacaaaaagatgctgatcatgtaaatgtaatgagttaagaaaggt

SEQ ID NO: 127718 - DNA, 6983 bp, Homo sapiens
tcagcactttgggagactgaggcaggcagatcacttgagtccaggagttcaagaccagcctgggcgacatggcgaagccctgtctctataaaaaaatacaaaaattagttggacatggtggcacgtgcgtattcccagctactcaggaggctgaggtgagattgcttgagcctgagaggcagaggttgcagtgagctgagatcatgccactgcacttcagcctgtgtgacaaagtgagaccatgtctcaaaaaaagaaaaaaaaaaaaacaacaaaaccacattggtgagggcctgctaagtgtaagacatcttaggtgttggaagtagtggaagttgggtacaaagaaatataaagcttaaagatctagttatgaaagtaaagtatacatatgtgtgtgtgcatatatacatacacacacagagatacacacacacacacacgtcaataacaatatcaggaagtaaatactaacaactgagtgggtggtatggataaattgctagagaaattacaagaaaggagtgattacataaattgttttagaactctgggcttttctccatgagggatgggaacgaatacttttactgtcttgatgcgttgggctcacgtagcattttgcagtgactggcctgtgtaattaaatatttagtctttaagactcataattctgtaccaaaacactatgaagtaaccactcaacctttcttgatttaaagactattgccttgtcattcctaacttcacctttgttattaatagaataacctgtaagtttttccaaagatgctgctgtactctctcatatttatatcacagtaatagttctacagcccataaatgtggtcaccagaagtaaaagcctagaagtatgtttagggtattaggaagaggagattagcctaccaacattttatttaatatgaaagggttgtcatgcattctggaagacatgcaatgtgcatgtcgagagtcttgatgtagaggagtacagactgtcattagacctggaacaagtgaaaggacagaaaggagtgaaggaggagggtgactcatgctctagcaggctttctctgcctcccaggagaagaggctaggctgccaagagtgaaaggaaatgatgataacagaacatacattattgcaggaggtaggattgtgctcgaactgcccttagcaggctatctaaggctagtgtatcttccacactcacggtatcctaattttaatttctcttcagatttgccttaaggaatagtttaaatttgcctccatattttctctacacctgtcttctaatacacataaatttatttgatggtgacaaagcatctcctttcttctttttaggttgagtcctaattattttctttcttaaaaattaataaacactatctgttagagcagttataaggtcccagctaaattgagtggaaagaacagagttcctgtgtgcccttgtccccacacatgcccaccttcctccagtgtcgacatccgtcagcacagtgcagccttccatttgacccttctagtgaacaggcagagcatgtccctatggttacatagggaccgaggacctctcatcgctcactcacactcaagcataaatagtcaacaagggcacaggactagtggcagattctttatgcttgtatgagtgagaatggagagcactctgcagcagccgtgggaaggcttttcagtcctgccccagtggtccacgctctcttgagagacagtatagggtggcagtgcagagtaggtggctctgggcccaagtcacctccatttagatacctagctccccagcacttgctttgtaacctccagcaagttccatggtctctgtgcctctttttccttttctctaaatgggaataaaagtaacactccctactccatgaggtggttatgaaaattaggtgagttaagctaggaagtgtttcaaaaagtgtctgacatatagtgaatgctatgcctttcttcttctcctctatttctagtactgtggtgtgacttcagagtattcacacacattctgtttgtcctttctgtcatctttatatggctaagccctcctgagctttccaagttaaatttaggtatcgctcatttggatgggcttccctgttggtccctcctctctcagcctgtcacaaatacacacacattctggggttgtggcccctgctgtgtgttactgccacatctttaatgatgttcttctgagtactttccatactgcattgtggaacaatgctctcttgtttgagtttgccacgaaactataagctgcaagagcaaaatactattttatttcctgtgcttctcacagcacctggtacaataaatgtttgataaatactggttgacttagtgacagaatgaatgaggacagttaggatctaaaataggatagagagcaccatggagaggcaggaagggcctgaaaggaaccactttcagctttatagttttccattagtctttaagttgaaggcaaagtagagggtatacatatatggttttgtcctctgcagttataagctttattaaatagaaatattgcccttgagctctctggcccaggacaaaactactgtatgtaattgaaaaacattttaaaatctaagtgacagaggaattttactctgtgaggatggttaatggagaaatcactacaatctaactaggaattttcccatccttcaaaaagttaattgaaatatgggctttcaagcacaagtcgattgaacttaccagttttcagcaaggaatatttctggttacaacagaagaaaagtaatagttagcaaccacattatgttcctaataatcattaaaaatactttaggtgagctgacatattacacacttggtgagagaataaatcagtggaccagtttttgtaaaagtctgatggtgtttcattcaggaggaaaagtttctctgatgaatgcttttaacatttcaacaggaaaaaagagaagaaaatcatacctgtcttccattaaaaacggctgtcctttttcagttattccattaatgactggtccaaggaccacaatgagatctgcatttcagcttgtccctgaaaaggcataattgaatagttcagtcaaaccgtaagagactaagggaagatttttgtttcttctgttaacaccatatagcggcaggctttgcttcccagtaatttcggttcatacgtcaacttttccttccgttgcagggtagcggcgaagaaatccaccagaaagacaatcaaagtaacattaaaaagctcaaattttacaaaagttaagttcctgccaacattttcaatttatcatacaattagaaatgtgactcagtctaacaacacccaagaggataaaaggattaaaaaaatgagatttctttggtgttatcaatgcatctcaataggctctaactgttatggtacagatggttcattatatagtctgctgttggcagttgggctgcggagatgtgggtgctgcttcaaaatgtgtgagataccaggtggagatctaacttgtgggtgtgtcagtgttaatcataggcttcctgtggttttagtctctgccgcttcattgtacttagcagtgctgggagtgaagaaagatacaagttttaatgaacattttatttgaatatagcttctcaggtttaatgtataattcttcaggggaatagataattgatgaacacattatctggtgagggttaaaaaaaaacaaaaacaaaaaacaatctaaagactaccactcatgaccaaaataagctcacaggtttatcaatgacattctgcctcagatttctcataggaaaaaattagaactgttttcagtcctgactactttaggggaatgttgtgactattaacttaaatattaaattattagtattagaaatttctaaattagaaacattagattagcaatgttgatttaaatgataaagtgatgttttaaaaaatcattttgggccagacacagtggcttatgcctgtaatcccagcactttgggaggcctgaggtgcacagatcacttgaggtcaggagtttgagaccagcctggccaatatggtgaaaccccctctctactaaaaatacaaaaattagcctggcgtggtggcggacacctgtaatcccagctacttgggaggctgaggcaggagaatcgcttgaacctggaaggtggaggttgcagtgagccgagatcgcgccactgtactccaacctgggagacacagcgagactccgtctcaaaaaataaataaataaataaataaataaataaataaataattaaataaatgagtcagtaataaataaataaaaatttaaaaagtatcatcatggagttaagggtgctgcatctacttcgttacttcccattttctcttcaactccagtccactgagttagctctcctccaagtcaccagtgacctctgcttggtagacttaatattagctttttctgacattcatttcacttgatctttccgctgtttttcttttcttatcctcatgttctttctgagtcttgtcaaaagcctgttggagtatctcatgatttggtcctgggatttcttctgtgctgactttgtagactctccccagatgatctcagccaagaccaagcttcactcagtgcccgagcacagctgacctccatgtctgtgtctcctgcccttttctcattgttgtctaaccttttctagcatcccgtctccctacaatataattctttatcacaatatttaaaaaaattttctcattgtacttttcttaatatgtacatgtcttttttaactttgttaacttccttcacttcccttgacccagagtgcaagccttattcacgggtacatttcagtacctaggataatgcttggcttgaattaggcgctttaagacatatatgatgaacacatatgattctatctttaatatctccttatttgtaggtacaagcctacttatttgagaaaccctagtggttgtttaaataaacagactgggagtcctgtgatttgtcttttctcatttttaaggataataaaactcatgaatgagtaagagtatattaattgccattgattcaaatagaaatgtatactcaatttccattatgttttcttttctatctcggggctacttaatacttttgtttttattcaatgatattacctttagagtgccatttttatttccattagtttaatgagtggcctttctatagccctgacattaaaatgttctgtaaatctccaaccacttgagacctcacttctttaagatgatttgcattacatagtaaatatggacatactggcataggtaaaaaagctcttatactggcctaacctgaattttctgagtttttctctctaatgggttgtcggtgactgggattgtgaatacttgtatgtaattaatctcttcgggggtgtcttgccttaagaaaagacagtatttgagatagattcactctgagttgattatccatttctactaaaaggatttataataggagtctcttatatagcaagctgttctataatggagcatttaaggcaatatttcacttttgcacacattttcagggtcactttgattgaagtgaggtgcattattttgtatagcaatattatgcttatgacatatatttgttctgcagccttaaatataagaagcactttcaaaactttataccctgaagtttgattagaaaattctttgttgccttctagaatttgcttaatgacttcattaataactatgcaacaatatgcagggaacatgaaaaaaagtacatttttcttctgaaaattgcatataattattacaaaataacttttaatctttcatagtcatcttttctgttttagcctctaaaatagtgtttaaaaattgattccccttttcttcatggatttatattcttgcttttttttaaaagaatgaccttaacttacttatatgtaagatttgtcttataataaagttataatagaatttttacaaatgctcatttctttgtctatccctaagacattgtaactaataaatatactttcctcaagtcatgaacagattgcattatttcaaatcatttaggaaataaaaatattcttatgccaagattgttatcaagtgtactactttttagccttaattgatgtagacatttatttaaaaatattctttagttatggatttactttatataagttggatttgttttctgaataaatctgatccatgcagtattttgtctagccagtagacaaaccatgcatagctgaaccatatggaagagcctggaatttatggtaaaatggatcttgagaatacaaaataaccatcacaaagccgattactcagtgaagcctaagaacctcgctcttgagatatgatacttggtcatcacacagaaccagttgatgacatctaaccttatttctaaaaatattctattcattcatacagatgtgagaaaagaaggaatgctggtaaatgaaacgtaatgtatttgagttttaaaagttgaacaaatgcatttctctacatttatattatatggttttttaaaaaagccaaatttatggctgcgcatggtggctcactcctgtaatcccctctctttgggaggccaaggtgggtggatcacctgaggtcagtagttcgtgaccagcctgaccaatatggtgaaactctgtctctactaaaaatacaaaaatcagctgggtgtggtggtatgtacctgtagtcctagctagtcaggaggctgagacaggagaattgcttgaacctaggaggtggaggttgcagtgagtcaagatcgtaccactgtgctccagcctgggcgacagagtgagactccatctcaaaaaacaaacaaacaaacaaaaaaaacgaaatttgtgtaaaaagtttttgttttcagaacaaaaacttctgaaat

SEQ ID NO: 127719 - DNA, 5277 bp, Homo sapiens
atgtgatatctggaaaataaaacagtagattttagtgctagaaagtgctttagaactcatagtctagtgctttttaaattcatttttagttatagaactcttcttctatttaatcttatttcacagttcaaggtagacaacaggtaaaagtggagatagtttaacaaagtgggggtgaggattcaacctcacttcatctttttctttttccttcctctgtgtgggcacccagggtactatttaaaacactaaagactcagaggcagacatatggaaatattatatgagggagaaatgactttacaaagtttaggaagaggacagaccagtcaataaagaatggtgagacaattgatcatgcatataggaaaaaaacaaagaaattggatttgtacctcatatcatttagggaaataaatttccaataggttgataactcaaatgtgaaaggcaaacctattcagaatgttcatagcaacattgttttagtagcaaaaaccgagaaacagctcaaatgcccatagaaagaaggatggatatgtaagttgttgtagagtcacaaagtagaatactatgtagcaatgaaaatgaatgaactatgctatacattgagttggttgaatctcaaaggtagtcatataagaaaatattagataatatattagaaattagattatatatagaaatgtaaacatttataatgtaatatatataaaatctctatataaagtctaatataaatctaatatcttacacatgtaaacttaatatgtaatatatatgaatctaatatataatatctaatatatttaatatatataaaatctaatgtcatttgtatgaaggtcagaagcaggcagaactgaatagcctatttcataggaatatatcctgtgtgataaaaaaatgaagaaggtaagggcataaatataaaagtcaaggaaaacatcacctctggagaggatggaggagggttgtaaccaaagagaggatctcgtggggattcaaagatcctagtaatgttctctttcttaagctgttacagaaatactgttgttttattcttttaaaaactgtacaaatgtcatatgcactcatacatttcataaaatgtacagatataaacaattttttaagaagcctcttaaagctttagagacaaaaccatgtatgtagtttaatgttcctgtttagaaatcgagaacaaatgtggagttttctggacagcagcacttttgttgcaactcctggtatgtgccaaagctgtgaactacccctgaacgagtactgtaccttaagtcgtccatgagaaggcatctttgtggttagaagagtttcctcccaacttacctgctccctccatcatcctccatctgggatgtcagacacctaacattaattggagtcagcagcgattatacttttgtttcctgtgttaagggactttctgtttatttgttaatcctgtataggtttattgtatgtttacttgtgctggatacttcactaggccctcaggataaaataatgaacaggactgcctttgaaggccaaaagaaaagaaagggaccataaatgtgtcacttatatggtcacctgcctcccagcatttgttctccctttcctccaaattcatagagtccctgatatttcgctagtcacagggccacccaaaataggaacatttctaacttgccttgcagccaacatggacgtgtaatttaattctggctaataggatgtgattgaaagtaatgtgtgtaactttgggtcattctcttattgggaagaaagaggctgtctttctctcccagcccagcctgtgtgtgaaggtgtggatatgaatggaatgtggtaagtcctcctagaccatgcaggtgaggcagcactgaaggaaagctacaacaacaagacagagggggcctgggtttctgatactgtgtagtgccatacctcagtaacttcctggaccagagtcaccgcatcatcccggacttctgcatgagagatgagtaaactctgacttgttaattcactagtgttttgattcatgttacatgcagccctacttatatcccagttaattcagcaggaacacaagtgatcacagctctgtgatacacactatcacggagttgtgtgtatgtatatagacaactgggatgcatatacaagttctgggaaaggcagggaggcatctataagtatttaaagcttaaactcggttataacagatgaagagaagttttccaggtaaagaaattgaggcaagcatttcaggcatcaggcacagtatgggtaaatgtatgaaagtatgagagtataggctcttctctcatcagagtttcacaacatgaatcggatatttttctactaattaaggaactcagtttatatatacagatttttactgattataatttgttactttcaggagtcagatgaaagtacatcaaagctattatgaatggctttggccattgttcatcctagtaagagattaagaattgataagaaccaatggtgtactggtgatatgggaaaataaaggtcattattatacctgagcaaagaataaatgtaatcacatacaggattttccgagtattgttcaagtgttgtagctatgcagctttattattaaaaattctataggaaaaaataactttgttttaaatgcacttattatagcatattatattagactctgcatggtagctgaggctggaaatattggtagggcccacggcacaacctatttctaaagtaccttgcgttaaaaatagaatgttcagcttgaactgcaagtgatcatgatggcagcctggttctatatggagattgcagagctctgtgtgctcacatctgatttccagcttgtaattttggtgtggatgaaaatatgcattaagttacttttggcttctccacaattttaaactggaaaagcccatattacagtaatatatgatagtatgtatgaatgcgacatgaatattgtaatagtcataatataggatgttcattcctagaattgtgatgacatctactgaattgcagccagtaatttgcatattcatgcccacttagctcaaataagtccctgtttgtttgcacattaatgtctgatttcagcaccagctaactcatttacatatcctgttcagttggttagtgatgttcatatgtggaatattggtgcagctctgtttgggctttgagtagcttggggtttagtagaaggatcacctgttactcatcctagcttttctaggcaaggcactttacttttctgagctctaggttattcatctgtgtaatgaagttaatgctggttagttcttagggctgtcatatcagttgacacactggaggttatggtgtacagtcaacatttctaggccaactatattctggggcctgttcctggaacattttctgcgtgcagaggggttctagatgctgtagaagataagacatgcaaacagtcacagtttcagtgaatattagaagtactttggggagtacagaagagaaaacacttaacattttcaagggaagtcataggaggtattacaaaggtggaattcttacgccgaactggtaagatgagttgaccacactgaacaaaggaagggaactcgcggcaagtagggagaagatgtggatgaacacacagatgtttgagaatctcatggaactggaaatattttattgtggttaagcataaagtgtatggggaagattgaacatagacatggaagactggtaggcagatctcaaaagacctggtatgccatagcaagaaggttcggtttttgtcctgcgggtgataaggagtcctccaaaggtttaaagtaggagagtcgcataatgaaatgtgcattttagaaaatgttttctgatgactgtgtggagaatgaattgagtggaatgagagtgtagacaaagaggcaagttttgttatttcaggtgagagctcatagaagaattcttaggtgaggtgggaagtgacccagaacctattttggaggtacaatcagttggacatggtgactcattctgtgtggtgtttcagcaagaagagatgtattttggtgtcttgggtaggtaatgatgtcatttgttaagacaggaaatataaaaagaggagtagtttttatggagtgttagataggggtaaagatagcatttcattatgtatgcttttatggttctcttttggttgtgtttagttctgtctaatctaatctagcccaatataattttactacatagtctaatcttttatctttccctcaagtgtaaggctttcagcagtttgtgattactcataaccattcctcttctcaagttcagagtaatggagttacggttttcttccatcccttttcctctttttattttttaattgcaaatactactttcttttttttctaggctttcgttgatgtattagttttagtgcccactttagtctcttaagaatatgaattctttaatttttattccttgatgtaccctgtatttttattattaaaatcaaactattagcgatgtctcttgataacttgctctgactttgtgcaagtcacttaaccagttttctcagttgtaaaaggaagaaggtaagtgatttttttttttggaatctcatttatctccaaagctctaggttcttggattatcagtcactggcccactatatgttcctcacagcagagtctggggactagttagaggttcggagtggtgggtctctggaattgggcttactacctaggtgactttgggcacagtaactccttctatgtgtcacattcattttcttaaactgtgaatataatatacctaacctcatagggccatagtgatgacgaaatgagttaacacatgtaaaatgtttaaaactgtgccttgggcctggcacggtgactcatgcctgtaatcccagcactttgggaggccgaggtgggtggatcacctgaggtcagcagtttgagaccaacctggccaacatggtgaagtcctgtctctactaaaaatactgaactctactaaaaaattagctggacatggtggcacacgcctctagtcccagctactcaggaggctgaggcaggagaattacgtgaacccaggaggcagaggttgcagtgagccaagattgcaccattgcactccggcctgggcgacaaagcgatactctgtctcaaagcaaaacaaaacaaaaaactgtgcctggcacatattaagtacagataaatgttaacaact

SEQ ID NO: 127720 - DNA, 3417 bp, Homo sapiens
tggccatttttcttcaaaaccatttggtctgcagtggcacgaactctaaattttactacacaaataatttaggacggttggaatatggctagtaaagaggttaaaagggaaaggacagcccttctatttatgaattaatggcagctgaaaatttggcattgttttatgtacattattgttttgccttcctcttgcctccagtttgacatcactttcttgctgcttgtgaaaacaaaaataaaaatgcagttgtaatcctttaacggattgggtaatacgttggtgagggagagcttctttcttcaagtctatctacagattggaaagctgacctcttcagaagtacccttatagacacactcagaaataatgctttactagctctgtgagcgtccctagcacagtcaagttgacatataaaggtaaccatcacagaaacaaagtttgaaaaaaaaaggttacagctgatctgaaagggaaatttttgacttggcttagaaagcaagcaataaattgtttatggatatcattccccacagcatgtctgctgaaagaggactgataaaagcaaggcaattgatgggatgaatcattcgctcatttatgattatctaccatttctagattataggaatgttattgaggaccattaactccatatccacttaaatatgtcatgaatcattttttaaaatttctcaagacaagaactttttccataagaattctttaacatgtaaattgagtggttgactatcatttctaaattatggtattcaccctaacacaatagatgtagttgccctaaaatagatacagaatttggtctaacttattctaaccaattgaaatcctttgtcatccccaaattataatcagtatgatcttctttttactgtcacttccaggacattttttaggcaagtataatgcccaagaggaataattagctctttttaagtaacgtctacttttctatctgttttagatggtttctgtttagttattagccatatttgttgcattttacactttgaaatttgtagttcctataatacttttagaagtaataataatatacattatattaaaaaaattgggcgtggcatggtggctcacgcctgtaatcccagcacagtgggaggccgagctgggcagatcacgtgagatcaggagttcgagaccaacctggccaacatggtgaatataaaattagttgagtatagtggcacatatctgtaatcccagctactagggaggctgaggcaggagaatcgcttgaggctgggaaacggagattgcagtgagctgagatcacgccattgcactccagcctgggtgacaagagcgaaactgtctccaataaaaaaaaaaaaattgtgcgtaacactggagttttagatgcctgtacactgaatcttttctgttctttctccccttttttaaccttagtttatttattaatattattattacactttaattagatttcacttattattgaggtgaatgtacctgcagtgaagtgtgtaatgtgcactcatcttaaatgtacagctaaattcttgcacatatgtattcccatataactaccacccagaagatttcctatgcttcttaacactccctgagggtcaacactattctgatttctaactctatctcttagttttacctattctttaaataaatagaatcatactctgttttgtgtttctggcttctgtaactcaacaaaatgtctggcacattcattcttgtggatttgcatatcagtttttattattgcatagtattttattctatgactataggacaattcattcattcaccttttaatggactttcatcgtttccactttggggctactatagataattctcctatgaacagttgtattacaaatgcactaatttctcgtgggaatatacctaggaatggaattgttggttcataacataggcatgtgtttggctttaggagatacaaggattttaccattatagaaattgataagaaattgtatgacaatatcagttgctttacattctcactaatgtatttttatgggctcaaatttttaccattctcttgagtgtgtagtataccttctttttttttaaagaaaaagagtctaagctttccttacttctgctactcttcccctgcccccatactggcaggaatttctggatatgattatttgctatacagactatctgccaatttactgatttacagtacagcattttttgttgttgttgttggttttttttgagatgcggtcttgctctgtcccccaggctggagtgcagtgcaccggtgtgatcataactcactgcagccttgatctcctggacatcaggtgatcttcctgccttagcctcccaagtagctaggaacacaggtgtgcaccaccgcatgcaccatcacacctggccaattttagcttttttattgagacaaggtctcacttttttgctgaggctggtctcaagctcctggcctcaaacagtcctcctgcctcagcttcccaaagcactggggttataggcttgagccactgcacccagccaatatagtttttcatagttcagtgatcttgtattccttctagaagaagtcctgatcatgttcatacagtttctacccagaattctttagcggcttttcttactagaaatcacctaccatatttcttcgcaccttcgaggtggaagataaaggtatctcctctctttcaactttttgtaattttttggccagtggttttctattttgaatgatctttttattgcatgtttcttactgatattcccactggtagtaggcagaattctagaatgaccccaatgaccagacccatgcccatgtatttataatttttcccctttgggtggtatccatgattctgacagactgtcactctcggggttagttttttatatggcaacactgaatggattttgcaagtgtgattaaaatccctaataatttaaatttgagtcaatcaaaagggagattaccctggttgggcctcacatgacatttgaacccttaaaagagacaaaaagcagcagaaggtgctcttctgttagcctcaaagtagtaattcttgtgaatagattaggccatgttgtaaggacctggggtcatctctgtctaacagccaacagaaaaataggacctccatcctacaaccaaaaggaacagaattctcccaacaatcagaatgagctaggagcaggtccctatgccttagataagattgtgaccttgcctgacaccttgatttcagcatagtaaaaccctaaacataggactcagctaatccatgtctggacttctgacccacagaaattgtgagatcatcaatttttgtttttctgagctgttaaatttgtgaaattgtccct

SEQ ID NO: 127721 - DNA, 6145 bp, Homo sapiens
agtctcgggtatttcttgatagcggtgtgagaacagactaatatgccttattatttcatttctattatagctaaggaaaaaaaaaacatggctcatggaggttaagttacttgattatagtcacaaaaccaataaaggacaaagatgttacataatagttttattatatagggtttgcaaaataacttgcatttgaaatggcttgtgtattttccactttattgagataatttctatataatccacatttatttaaaatgaacagtttgatgagttttggaggatatatacacctgtgaaaataatgtcactattaagatacagaacattttcattacctagaagtttctttgtatccttttcagtctgtttctccctcaatttcaagcccttggtcactggtaaaatgctttatgtcataatagatgagcttacaacttctataatttgatataactggaatcatacaatagacaattttgtgatcagcttctttcactccacataatgatgttgacattcatccgcagtgttgcattcttcagtagttgttcctttcactgctgagtaggactctgttgtatggagatactgcttattgcttatccctgcagttgttgatatacatttgggttgtttccagtttttacttattgtgaataatgctgccctgaacatttgtgtgcaggtctctgtgtgggacagtattccctgaggaacacatacgagtgggattcttaggttatatggttagtgtatgtttaacttttaaagaaattcccagttttgtaaaataaatgtattattttatattcccagcaacaatgtgtgtcagcacttggtattgtcagttcttttaattttagacattactctgggtgtgtagtggtatctcattatggtggtttatatttaatataacatcttattgatgtaggaggccacacaaatgtggattcaggccttggaagttagaatcaacctcaaatcctttttctcttgtgagaattcatctagacctcttattatatgtcatgtcttttagaataacttgtgtctacctccatgaagtttttaaatacagagaaaatacatgtaactattttacaagtcaactggaaagccatacatgtatgtatatgttcgtgtgtgtatggcatatatgtatatataattattcattaaaaataatgcttactaaaactactcatactcattattgtatatatctatatttccagcatcttctgaaagtttgtaagttctgaataaatcctgctttgaagctaaaaattctaaattgttgctttattagtaatcacagggctaatgcaaagctctgataattaagactttatgtttttctttgagtgccaccatggcagcaaatggtatctgaaactgacagactgtagattaaaactttcagaatgtaaggcctagtctagggaaaatgaagttatgtataggtgacttgttccatttgaattaatcaaagggctgctggtgtagaccagctgtgttctctgatgacaaaaacgaatcttgacattttagataatgaaattcagttcagcacctcttagagatatgtgtgataatatatgtcagtcagaaacagagagaaggggagaagctcaaaccttgtcttattaaaatagacattgtgacaagtggacattgctgaatctctggtttctaggggaaaaaatgtcaagggaaacctctttaaaaaaatgatgggaatggctgttttatggaagctgggtgaaaagatttgacttctgatgcatgacctctttgacagttgcctttgttcatgattcctagtttcctggtttattttattggggtacagggtgaggtctggaagacctggaaaggaaactcacttttttggtttgacagtattaatgcaatcatctagttcataccttgtaagcccacttattatttcctctgcgtgtgttttttctggtttagcggattagctgcactgtctcttcaaaggctatccaatcaaggaggggttattaaaaccagggcgatttatgactgagaattaattagagaagcattttcatgcacaacatccaattttttgattagcaatggagcagggccgcaattaacactcgaggaagcttaaatttccagctttttgattctcaggaaatgagattatcaaaccagggtcagacacttgacagcaaagtgggagtgggggagtgtgaaattatatgtaaaaaaaaagaaaaaagagtcgtttgattttgattctgagattgctattaagacaatgggaaattcagaggagggaaagaacaaaaaatctgaaatggaagaacctgaaaggactgattctttggtggcctatttgctatgcacaatatctgttgtaaatgtttgctggaagtatgttttagaagcacagcaatattgttgtgttccttcattgttacttattattcagtttttctctcataaatttttcttggatattcagtggctgaacaaatatttaaaatgtttatatatgttggagagaggccaaaatttttcttgttagaaaagagagcttcttttctaaatgctaatttgcttttttgtgtgtggggggagtctgcttcttttcattggtgtttttaattttttcaagtcactcaagacacagtttaggtagtgagttatgtcaagccatagatgaccacttattgctaagtggccttgtcaagcttaggtgcctgagataagaagtaaggcaaccgcaggtttgctgtaaaacaaagtgtattctgtcatcagtgtaattggtgctccccaaggaatgcaacataatgaaaattcatttgttctggaaaatatttttcatcttgtctcctcttaatttggacatctaattttcatggagaaatagcagagcagcaaatcttttaattcattctgccaagttaaaactcatatgcatctcttctttattcagtagattctaagatttttaagagaccttgtcagtatttttgaatcatccaaccctctcttcattgccctgttttcatatttgcatgtatgatgaattgcctatctataaatagtgtaagactagtacaatctaaatattaaaatagtaatatgtactatttatagattgcttgcctattggtcttagggaaattgttggcatccagttctaagaggaaacacaagtgatcaatgtgtctttggcccagggtgggagagggactgagaattggttgatagtcttgtgtgactctggtttctctcatattctcctagcattggtttctctatttaaataagggtggggctttttgttacaatctggggagttattttaaaaaacatcttcataagcagattccagaatacaccaaaaatgaatggaagagaccatacgtcatttatataatcagagattgttgctatggcatttttctctctaaagcccctctggtttaggaacatgatccattgatctagcctatcattcttgcaatcctactatggattctcagctttatttgtcagtcttgcttaatcctccttcctttgttgatgaagagtatctatcactggctggatgaaaattggctgcagtttaatcttggggaaaaaggaagaaaactgccagtcagaggctgaagagttgatcttgtcagatttatagtcatcagttatcagtgctgatcttcatgttcttagatgttgatgattacatgcttttcggcatccaataaacatttgcggaaataatttatagttatatttatggatatttcctttgttgggaaatgttcctgcatttccaggtccatagcaaagggagcctaagcgtatgaattagggattcttaacctatgtgtgttatgtgttgggtggtttgggggagggtacgtgggtagccttcagggaatctgtgacacccagcagtgtcttcagattagaggggtggggagcaggaagaagttaccaagttttcattaggtttacaaaatgctattgttacatgtgtgtgtgtatacatagacacacgtatgtatatgtgtgtatatatatatatgtatacatacacacacgtatacacacacacacactcacaaatacgtgtacaaatacagttcccgacttggagagccttattatcaacagaggaaaacaatgtaacaactttagtaaaagcatatgaaatgatatccttttgtaataaatgtgaatgaaatacatctaacctatatttaaatgcttagtaacatttaatattaattatattaacatcacaggtaggcagaaaagttgaatttataaaaattgagaaaattaatcaagagaggcatagtaattaagtgtgaatcattttaaagaaagcaaggattatttagtggagtagaaaaacagaaaagcaaagctattctaggttggtttgtttgttttttctcctttaatgtgaagatttttaaaagtacagtttgatatagctcaattgatcgtttaattaaggaacttgatttgctttaagaggctcgcaattgataataatcatattatcatgttgaattcccagtggtgaggtgagggtgtcagctgttctactggcgcatttttgctttgcttgatttgctgtatgctcagtttatatcgtggtagatgacagatgtgcaagaaggctatttaaaaatcattgctggtgatgggtggaaaagaatgcctttagtttttagtatgatataattaatctttaatagtgatcgactaatgtatgtttatatgattatatctgaatagatatttattaaatatatattattgatatttctgccggggtaactgtgttattattgagtctctgggactcttttccacttcccatctgaatacttgctttaataagaatatcctactctagcagaagtagtgtaggtacaaagaaccccgttttcttaggttagtggtcaatctatgaaattagatttttgtgagcatgaaagtagagtgtagcccagtgaaatgaaatatggaaacctcagggttcaaagcaatgggttggcagagtcaggtcggagattgaaatgttgtgagtcatctatgagatagatggaaacactggagttgttgagcttttaaaacagtaatagatggaaagaaaaactctagactctgcataaggaaaaggctactagtttgttgaagaagagtagcttgtgagactcgaggagtgtcttgaataagttaggggaagggcaggcaaatggacacttaaggtttatagtgtgaatatcttctatctgctttttgaaaaacacatttaaatgagttcttaatgattcccaggaaccacagtccgattttggcttttgtttcctgtgccctcctgtcagttttgataactgtacctttgtctctgagcccatttttttcaaaattatggtttcattttaattgtttaatagtctgctcttgtctgtaatttccagagtttgaattgtatgatttttgcagcctctatgaaaatggtcagtgaaaaagaatttttggttaactatgacatcctgtatttaatggaaatattttgttttaatgacatgaaaccatagccatgaaaatttttctaatgtaacatcaagaacttctctttgtatattatatgaaccttctgtgaggtccagctaattgcaagacgtcctaagttagatatctcgtgcccattctgattcttctaagaatttactactattttagatcacattaaggttttcagatttttctctaattgcttgataatgtaacacaagcttaatagtgtaataacaaaagcttgatgttctgtagttagattcttttaaataatgtaaaaaaaagttataaatgatttgtagcttggatgactttttacatttctctctgggagtttcagttgctatgattttgttgttgtgttcagcttaattgccattagctactgctgaagtctcctccttactcaccgtgcaggcagtgtccatcagcagcatttagtacaggatgaatgaacgattcctttttgttatgttcaatggaatatgtaaatactttcaaatggccttcttcaactagagttttttaaaaatgagagatacgctggaaaaat

SEQ ID NO: 127722 - DNA, 1023 bp, Homo sapiens
gtaatcccagcactttgggaggccgaggcaggtggaccacctaaggtcaggagttcaaaaccagctgtgccagcatggtgaaaccttgtgtctactaaaaatacaaaattaactgggcatggtagtgcatgcctgtaatccagctactcaggaggccaaggcaggagaatcacttgaacctggaaggcagaggttgcagtgaaccaagatcgcgccattgcactctcagcctgggcaacaagagcaaaactccgtctcaaaaaaaagaaaagaaaagaaaagaaaaatcagtaacaaatacacagattttttttttatccatgactacaaaggtacctaactgaataatacatcatgatatttcttatatcattgtccttgagaacttaagtcttttcaatgaaagaaatgaaatatgaagtatttcccgagacagtgttctctaactttggggtgcatcaaatgcctggaggtcttgtgaacacagcttgcaggaccccattacttgaatttctgactcagtaggtctgagatggggtctgaaaatttgcatttctaacaagtccttttatgatgctgatggagggaccacactttgagaaccactactctaaaccttgtgataaaaatgatgaaaggtgatgctaatcaggatagccttgttgcctgtgaccaactacttctgtttcctctttaacactgtagcacttaggaattatcttatttcccctggagaagatcaaacctaatagaattatgcatgcgctgtaagagatcatcaaccttacaccttttcccttggacctagagcaatttgaaaagagacatttccatcaaaggacataaaacctgtagctacagtcacaagttaacaattatcagggtgtttgtacctgtctcctccatttgggttttatgcatgaattataaaactagagatgggaaagtaggaagaggatgaaggagtagcttccaaactgttactccaatagagatttcatactaattttgaattgaaaatga

SEQ ID NO: 127723 - DNA, 1031 bp, Homo sapiens
tctggatcatatggtcattcggggtttattcttttgggaaactgccaaactagctgctcattttttttttttttacagaatttataccacttatttacagtcgaaaacatttagttaagatatttttactttaggccattgtcttcaaggtgagttgtttattcttccctctttgatgtgtgaacttgtccatttgtgatgtagattagtcatcacatcacaaatagtaaatgtaaatataccatttatacacatccacctaaatctattctttctaaaatgcatatatctatttatctttctgatgaaccaagggacataagtatgccataaccataatgagattgatactaatttggacaatgagagtaaatgagtccttcacagagcaaaaggaattctatacatttatttaaaagacaaatatttgatttgtaaaaataatattaagacagttggaagacatgtttgaaactgcatgggagggagtgtgattaatagaaagtgtagggttgggaaggaggattagttatggcagttccacaatgagtctggaagtttaataaaggaagtgtgcagggaataacagaaaaatcaaggaaaaggtagtacctgctactatcaattgtctgttgagatgggaaaatgaagcctacaaatctattaatcatttgaagatattaacaaagataatatataatttttgttctctgagttccttcccccgctccatgtgtattagctcattttcatgccgctgataaaggcatacctgtgactgggcaatttacaaaacaaagaggtttaatggagtcatagttccacatggctggggaggcctcacaatcatggctgaaggtgaaaggcacatctcacatggccacagatgagagaagagagcttgtgcagggaaactaccctttataaaaccatcagatcttgcgagacttattcactatcataagaatagcatggggaagacccgcctccatgattcaattaccccccactggattcctcccacaatacgt

SEQ ID NO: 127724 - DNA, 1398 bp, Homo sapiens
tgctgacaaatgcatttgttaatcgatgaagcagatttgagaaggggatagaaaaatgttcagttaagttactgtgcaaatgcagcatacattaactttcttggtggaaaatattttaaaagatgaaatatatattccaataaaatatttggtggctattgaagtcacattacaaaatgcagctaccacacattgttagtttatatgaatcaattacaggggagatctttctggtgccatttttaatttttcctccttccagttgctgaagccctaccttcattcctcttgtcttaattttcccgctcccttctctttacctccttttttctctattctcccttcctttcttttcctttctctatcgccttctccacaacagctcagtaaaagagtgaagtttttgagtttcatttatgcctttccctgttttgctataaaaatcaaccaaggatgcttttagatagcaccagtatgatgagggaaataagctttcattgcaggatgattactgttggtgatgatgtataaaataaagggagggatgttatgtggaatgttgacccttcagggcttgtaaatgcacattacgtggtctggatggtaaactaagtgaatttaatattagctactggaaatgacagtgtttataaattttcaaaatgacgtttgtatctgtcaggctttagcttttattgtatcgaatacacttactttattttaatatttttctagagctgctttatgctatgggaaacactagttggaaattgaaaaccctagacattagatgatttttatttaacattatcttttgtattagttgtaattataattttctgtttgtaagtcactctcccaaagcacaggagaaaaaaacaaatttttcttccatgattttctcactgagaataattcgtcttatctacttaaaaatacgttcttttaaacaataaaagtggctctatctaaggctgttactttataaaattggaaagtatttatttgttaacacttatttatttctgtagtctttgaaatttgtattctcccccaatgtattttagcaaaatgggagaaatgaaggataacctagaattacattcccagagcaaaatatactgtatttattatttgtgattcatttcagttccgtgttttttttttgttcgtttgtttgcttgttttttgagacggggtctcactctgtcagcaggctggagtgcagtggtgcagtcttggctcactgcaacctctgcctcctgggctcaagcaattctcctgcctcagcctcccgagtagctgggactacaggcacgtgccaccacgcccggctaattttttgtatttttagtagagacgtgatttcaccatgttagccaggatggtctcgatctg

SEQ ID NO: 127725 - DNA, 1018 bp, Homo sapiens
gtaagtgtaacatatagctttcttgaattgtctaccatactgtaagagctatggttcttggagtgcttcatagtgtcccttctggggtacgttaggatggaggacgcaggattttggatggaggaaaatgtgactcctgatattgtgtttgctgaattattaatatcactgagctgcctttttcttagaatagccactgctggtaggctaatatttctaaggtcaaactgattgctagaaattattcctgttgagatcagctaggccatttcaacctttacttaggttttattgtaattttcaagtgagaataataagctagtgttgcttcctaacttttctgtgtgtgtatttcagaacagaacaattgcatatgtttcttggcagattctttttcatgatgtggtttatgctggagttggtgagactgcttcagagcatttcctcttccccatcttatgcctttctgaaatagagtttttaatactttttaagtcatggaccccttttgacctgtcaggataatgctgtttactgtgttaatgaatgcaaagagtacaaaaggaaacccactatattgaaatacaggtacaataaataagaagatctagtgtcaagtctaataatactataatttcaaagtagttatgagtataggtgtaattttgagatacctgcaacacctgtaatatagtatgaaagtatttgttatttctgttggtgacagaattgcaggtatgttaatactgttgtagttgtctgtaatcatagttgaaggaaatgctaaatttcagtagaggttagtgaaataaaagatacgtgttttccccctctaaggtcatgccctttttgaattctttccatggattccagattaagaagtatttttctaatgggattcctggttttctgattactatttctcctgagccaatattccagagagagagactgcgatttgcctttctttcctaaagggctgagttccccaaacattagtgacaaggcctatagtgct

SEQ ID NO: 127726 - DNA, 1379 bp, Homo sapiens
caggtggtatctatgtgacatgatagaacacctcattgtattaaaaacaagaggaagcagtttcacagttgaaagaagctgtataataaacctaaatggaactctgagccttgatctcaggaacattcaaagtcctctagattcgagagaaatttccttatagtcttaggaaatatgggggtcaatgagatgttaatatttttaattgtgaaagttctgattttacaaataaacttaagtgcgacatcagtgattgtgatttttgaatttggaattagtgattccttgataggagctatagagatctacagctatatatattttttctggtggctgatcattgtattctcttcagattgttgtcactgtcagttggttttcgggaagaggctttcaaattatctcctatggccttttatatgttgattcattcaaatactgagtgaccatataatattttaagtcaaccaggacatgtgaaagtgctcagagtgagagaatatatgagtactccgtgtatcaccagcttaattttctataaacctaaaactgctctaaaattttaagtcaattaaaaaaaaagtactcagagccaacacatttgtctgaacaaaaggagaagaggtgagaaaatgtacgtaagtttggagaagaaagatcctgaatgtgcaagggtttttttcttcttcttaaatctctgttcatttatacatcccaacatcaacagatgtatgatttagcatttgccctgcacctctggctctagggaccctggagttttgtatatggataccctgctgcagtgaactctgtcattgttctcaacagctgggaatggaatatagctcattaagacaggagatgttatccaagcctcccctggcatcctgaagagtagtgaatatgttttgcttcctgagatctaaagtatccctttcgttaccacctagtgttctcttccttttattgaaaaactctattggccccattgccactttgaatgatgtgtacagtttatgccagctgttccttttcttaatcctttctccttcttctttgcctttttattatgtttatggtgtgtgctgtgccttgtatttaaaaaataaaaccctagtgtaattagtacatatcacttggttatgtaattaaaagaatattaaggacagattttcacaataaacccctatcattcagacatccctgctcccttttgtataaaaagcaactttgctggagagagggttgcaagtttaagtttctcatacttatcaggcgagggaacttatatttgagtttttattttatatcagatgcttagtcctattactccatttgattgtagcaataaatctgtgagacataaagatataagaatt

SEQ ID NO: 127727 - DNA, 2596 bp, Homo sapiens
ttatctttataagacatggtatctttattttattgactataaatgtactagtgaaatgtttcctaagttaactcttgaaacacagattctaacactggtattgtacagaacccaaccatccatgttggagagtgtctgtgctgctttaattagttctgatgtaataaaccgtttcatgtttagcattttagatttataatatggtctagttggcttctgactacagatcattgagtgaatttatatccaattttaaaattttgacaagtaggtgaaaactggaggaacgacaaaggaacattttagtaaaaccaagaaagacttgtctttagtcatggactgtggcactaccacttatttgagacccaggcgagacttgcaagcagatttaccacagtcagggtccaaagttaggaagaaaaaaagacatgagaaaagttcttcttatgtgaaaagtatagtagtccttaggtacataaatcctccttggatttgtgattgagaattcagttgtactgcttctttgcagtaaaccttacttttaataatgtgatagcttttttattttcaaaaaatcttccttttgaattgtttttagaaattagttttggggactagaggcctggtagacctacaagcacagattgaatatcccgtatccaaaatgctttggaccagaagcgtttgggattttggactttttcaagttctggaatatttgcacatacatattgaggtatcttgggagtggaacccaagtctaaacacgaaattcatttgttttttatatacatagcctgaagaaattttatacaatattttaaataattttatacatgaaacgggtttatgttaagtacttgtgtagaattctctacttgtagtgtcgtaacgatgctcaaaaagttttggattttggagcactttagattttgaatttttagataaggaatgctcagtctgtacccaatacttactatttctaatgttggggaagccagtaattccaaaaatattctaaactttttctttcttcattaccttgaacttaactcttatattgtcattcatcaatatatgacccatcatttagtaatattttagaaacgtaaaaggagggatgggctcaaaaagacaagatttatgataaatttcttcagtgaaactcctcttaggaaatgagtattagttccactctcccactgtaaacaggagcagagtaaccacactgatcaagagttggtgcttcgttttgtaggtaatttattttcctgggtgccaagtggtttttatatatggagctatggtcataacttaatggcaaaaaatgaagcataatgctaaaagaaaacatagttctaggagaaagcttgcttttaatacctgtttcttctagaagtgaataggactttggtgtgggcagtttaaaagttggccacatcaggttttaagcttggaagccatgtttgattttgaatcttagcccaagaaaaataaataaattatttattccaatataaagatgtttggaggtgtcagtaattgacttatttagcagcaataaagcaattcagataattttagaaaatttacttttgaggaggaattctaataaaggataatttaaacaattacgtgtgagaaataactatttactgaacaggaaatagggttgctataggtggtttgagtttaaaactagagatttgctttgaatgtagttttttctttgagatttcagggtgaaaattgcatggctggagcatgacccagaaacagccctgccattgattgccactgggaatacagtaattgaagatttgcctgtgttgattgactttcagtatctgattacagaagctctgagcaatgtatcttggtcttttatctcctttgttgcctcctttcagaaatgcttctaaaatgtgtctggtttatctatagatttttggattcttagaaggccacttaaccatttctgtttagtatttaccagttcaatcaatatgaatagtaacaaagaaaacctgaattaaaatgtactaggattctgagactgttatgtctggtatataatatacttctctaatttattctttgtagaacctcatctctataaacgcttgtgttgaaatgctttttggtcttaagtgatggaatgacagcctgtgccaggacattgtagcttgtggatgcctactcttttcaagtgactcatcggtacaggttaatattttgagtaaatctttcggaattaaattcagtactgtcaacaatgagaatctggctagtttatgtagagcttaacagaggcagaatatattaatggactttagtgtttttaaaaaagggacattggtattgtacgctattctatacctagctctaggggtagcatgtgcagtatggattatttatggtccactccttgccacaggtcttctgtgttacctttaaaaagctagggtagtgctcggctgactgtgccatctctgtatggattttctgtttatttgttttataattttgttttatagaaactatagtatgatgtcagaaacattggtggctggattaggtacagtatgttggaaaa

SEQ ID NO: 127728 - DNA, 1011 bp, Homo sapiens
cctatctgaatgaccacagctgtgtgaatcctaacttcagtcaagataagcagtaatactggaaacactgtagaaagcaaggatggcatcacagtgtctaccagcattctgtgggaggattagaggatttgcatgcagaccaagagcagcctgagtaatcaggactctggtactgttttatggaaagcaatttaatgcatatttttaaagcaatatcaactcttttatatgattaaaaatgatttctaccttatacgttttaattttcttttatagatttcagccctggaatcatacatatctatcctccacacatgtcattttcttcctctcaaggctagtggtacacgtttaaatatttccagcatacattttgttgctgttagaaactatgaataagcatcatcattttcttccaagatttctgtcactgtcaacatcatctctttcttttctgatggctcacattaatgcaggcagtgctaacacatttgtttcttttgtcttttatgacagtctgagttttaaaactttgcttctattctgagtttagtagtttttgttcagaaatgaaactttgaggcagcagcatcaggtaatgggaagagtgtaggcttttgagacaaagacctgaatttggattcttgctgctccacttactagctttattgagttactcaaatactcctagtcacactgtcctgttcataaaataggggttggttgtgctattgtgaggatttgatagggcaacctaagagaaatgcctgccatggtcccttactcagaataaatgttcaacaaattacaattctcctttatttgcagtactgtttctcatgctttttaattagatattttactccctctgtttgcccctccctcctcctctttttcttcttctctctctgtttacagccccgaagtcctagtaattcttgagatcacgtacatccactttgaagtttactttgaccatgctctgatcatacaaatagtatgtttccagcc

SEQ ID NO: 127729 - DNA, 2757 bp, Homo sapiens
aaccaaactgtattgaagatggggttgtaaagagttttacatgttgatcacaataatacatatttttggttcattttgttttcttttataaataaatgtttcctttctttagtaggaacaactacaagagctttccctgttttttttggtatactttcttgtgactgacaggtatctgaggccataagagtatttttattttaaagatgaggcaattgagttcagaggttggataacttgcccaagaccctataacaggcaagcagcagatcccagaatcaaacccaggccgtttgaattcaaattcacttcctttttcactatggtacaagaattggaaaataagagcattcttttgcatattagagactgaattatcaaaattctttattgctgttctttcattatcggtcatccttcatgggagagccctcatctctatacagtatgattcagctgggatagaattgtttccctttatttgctgttaaatggtttcctttccatccgtagcttgacaaacatctcctttctggttcttaaaatattttactcttagaccttttcccctttcttctctgattgaatgcataatattctttaacagttgtatatatgctctcaaggaattttaaatctcttcagggacacataatacatgtatgaaaaaggatttgtaggaaaggagtggcagctcatgcctgtaatctcagtactatgggaggctgaggctggagcatcacttgaggctgggaatttgagaccagcctgggcaacaaagtaagacctttgtttctacaaaaaataaaaataaaaaaataaaaaactcaatcaggtgaggtagcatgtgtctgtacccctagatagccgggaggctgagggaggagaattatttgaccccaggagttagaggctgcagtgagctgtgatcctgccactgcactgcagcttgggctacagagcaagaccctgtgtcttgaaagaaaaagaaagaaagaaagaaagagagagagagagagagagagagagggagggagggagggagggaaggaaggaaggagggaaggaaggaaggattacacttagctctgtgaaatagcttgggttttttttttcttagtcttctttattggtacatttttaatataaactgctgctgatctgtcattctctattctggaaatgtttacttcattgtctgtctttatcttttacccaggtgtcttgtacctgtggtatgcttaagcctctgctctacctcattacttctagaaagaacaattttatacctagacacacacatacatgtcttatattacagagagtgagacagagggcagtgacagagtgtcctgccctccctgggaatggacagagcagcattctttctgtcctacttaagcaatgtgatgcttcgatttggtatgagacttttttttttcttgtattgtcttctttttattgttttattattttattgtctgacaaaaatggccgtctctcctgtatctctttttacccttaaccttttctgctgggttgtatttttttcctattgcataactgcaatgtctgaaccttaaattcaactcaaattattaactctgaaatgaacttcctttggcaagactgattgttaacagagttctagatctcagttgcattctcttccatgttgatttaagtaaagacaggctgtcttagtacctgttaatcaagaataggaaagtctgtggggtgggggggtatatatattctctctaaaagctaactataaaatcaatgtagtagcttgcatgatttaataacttggaggttttttttcctttttttgtgtgacttagcagtttttaagtataggaaaggaaattataatatggttttataaaaatgaaacctgtttgaagatcccatcattgatggggcctgaattttttagttggtctttgcgaaggagatcattgctctgtgaagtttatgaatccctagacctgagaatttctaccattatcttactaaggaaatgtctatatgctctcccagaagattctaaggaggcatgccctaggggcacatgtgctgtagaggtaatgagttcactggaggaaatctcacaatcccttcttgcttgatgattttttgataattctgtaattcaggtgtgaaaaaaaaatcaccaccagcaacctctaaaacctgggaggagcagttcgctatttgctggtagtagttttgaggactttagaaggaaggcactagataaacataaggcattttttgttattactattgccattacttgttatcatttatgtagcacctgcttcactaatgcaattgcttataggagctgcaattttactcctgatggctactttctgtcattatgtaatctgtggtaaaccacataccatctaaatgttgccactggatttcttttttcttcaaactccagccctggaatactgttgctgtcctatttgtcaacgaaccactaatagaaatttcttaggaacatactgtactagatgcctaggaaaagaaaatatattaaaaaccagtgtaactccaactgattaccccatcatagttcttattacttcagaaaactattaaaagaacactaataagttttccatgcatgggttcatttttataaccaattgctaaattgctaagttgcctttttattcactttcaaatttacaaacaatttccaagtctgtgctttcatttactaatgcaaagctctttgca

SEQ ID NO: 127730 - DNA, 2658 bp, Homo sapiens
ccctttctggaattgggcaggggaaggttttatgacctatagtgaaacaagattggtcagataagttacttttggccagtttttacacagaaatgtggagagaaagttagggtaatatttttaggttttatgactggccttggggtaaaggttctggcttctgtgaccagccttgggcaagagggattctagtttctgtgggtagccttgggggagaataggactgaggaggggagaagatcagagaaaaagcagcttctgaggccacttctgaacccttcattttgggggtattgtcttctgagccctaatacatgtcacttggagagggcccacttaaaggtgttcagaaaatgatttgaaatggtttgaaactgatctaatgaatggcatttaattctatgtttgattgtcagtaccattttagtttttcttctatgtattcagaaaaattttattttttttttgaattgttggatgcagaataaaaacttacaggttataaatgttaataatattaagtgtgtttagactagaaatatgctaattgactgcctgaagacgaccatagctatcaaaagaatgttttgcttattttcagttatcccacaaacataacagcttgaatatattgagaaacttgagctttttagatttgtccttgaactcttgattggctttgcaagttgttttctggatggtgtggtaaaggatttaataccctttggtattgattttaaaaggtaatgagaattttttttttgatataatcctcacaaaatatactttgtgtataagttgagtgtcctgacataatctcaatagcctaaggttttcccctaaggcaaatttttaggtttctgttcaatatttatttaagctaattcaagcatcgatgatataatttaattaattctgtttattccacccaagctcttatcagttgatattccctagtgttgagtctcagaggagtatttttatattttcatctctatattttatatttatactgtgggcattttttcccctcattttacctggtctcttaattccatttctcctgagttgctgcccccttgaacagcctcatccatccttcatacaacaagctttcatatatttaataactattattaggttatccttatgctgtcatttcttcagccacaataatcccagttcctttaagctttatttttatcctgcttttatctagcctttaatattttagtggcttcttctagatcttctttagaaaagagtggtgtgagattataaaacgaacctgctgctagaagtgtgcttgtcacttctcctctatagccgtcaaattctttgagatcctcaaactgaagcatccatgggaacatttattatttgttcaaatatggccataaaaatcgactttgcaatcatattgagtcatcttgacagtgctgtgagtgacagaaactaatcttatctgctggctagcattttaaaaatgataaatggaccctcagtctttagtttgcctgtaaatgaaattaggtttatcttatttctcccagaaatagcattacttagaaaattttgaattatttctttctgaacaaagttaaatggcccaggctaggggctaaattttgattattattacatacatatattttttgccttttatcagcaaataatggtgcattgggaaaattcaagtattaagaaatcagcatatattttctaaacagaacaaagattcctcaccatctatacttgcagcctgagaaatatatgttcaaagtaaattttactgaatatttgttctttgaatttttttttcagatctaaaataaagttccaaatcttgataatcacagcacgtttaggactaatgtcttcattgttttatctgtcttccttttagttgcctaatcatttaaagatcaaattaaattgaaatctaatataattcctgctggtaaagtgacttttatagtaacttccaccatttatttgttttcttagtaggaaactgatttaccttacttctacatgtgtttttggtatctttattctgaaattgtcttttctttgtcaatcaggatctaggacttcagaacccatttgtatcaactcctataagaaactaaattaggtcacctaacagtgtcaaatgcctttttcttctgcgttttcactgacattttagaactccaatactgtcatactgtcatttttttctttcctctattcttaatctctaggaccatgttagtaagtttgttagatattttgtcaaatgtgatttttaaccaaatcgagggaattaaagcaataacctttttatgttctgtttctaaagcaagaggacattgctgtgcagggttgattttttgaaaaaccttgttgtcttccacttgtaggtttccttccctttttttttttttttcccctggtcactgtttttcagggctctttgtatcttgtacatgaaataatatgaaaagaagatttgaatgaatgggaggataactcttcactttttgtctcgattattatgtttttaaatttcatttcactttgggcctttaaaagcatatgtgtgtgtacgtatgtatgtgtgtatgtatttatgtgtttagtatttggaaatttgtgagggatgaaaaggttact

SEQ ID NO: 127731 - DNA, 2179 bp, Homo sapiens
aaatcctacctctgggaatcatactagctcctccatttttagatgttgaacaagttataaatttcactgaccctccatttcttcttttctaaagatgtgcatgtaatacctattttaatgatttgttcaggggattaaataagtgtaaaatgcctagaaccgcagaaaacttagtatttttgagatatcaagaaaactggataccttatagctgatcaataaatactaggttctttcccttttcccattaaatgccatatcttgatttaaattatctttttcttatttcttcctacactcatagtcataaaatcagttagattttacattcaaattttaaaaaattttcctttctgtatttattacagattctccagttcacattctctttatcattcacttgaaccattttcaatattaaagagtcttagaagcaatctagtttgactactgtcccaatagttgaattctgtctgcatcctttcttcaagttactttgcagtctatatctattgcttaaatgtgctggtgctagtttgaccctatataaccacaaagaatgtcagatctcagtttcatgtggcacccttccaatacatgaggatggttggcatgttctcactgagcctccctttttccaaatgaaaatccctgattaccaatttatattttggggtttccagtgccttgacattcgggttactatttcctgctgcttcagttggtttaacttgctcttggattggaatggattctagtctagatatgatttaaccaatccagaggagagtgagatgattacttctcttctagatacttctgttaatgtagcctgatatcactctagataatgttttatagccagtcactctgttgattcatagtaacttttaagaattctttcttatgggtactgtttttaaactatatctattttattttttaagatcagatttattgatatatagtttacatacagcaaaatttcaccctttttataatagctggaaaactttttttttttttttttttccgagatggagtcttgctctgtcacccaggctggagtgcagtggcacgatcttggtcactgcagcctctgcctcctgggttcaagtgattctcctgcctcagccccccgagtagctgggattacaggcatgtgccaccatacccagctaatttttgtattttttgtttgagatgaggtttaccatgttggccaggctggtctcaaacttctcacctcaagcgatctgcctgcctcagcctcccagtgtgctgggattgcaggagtgagccactttacccggccttagctggaaaacttgaagagttttgacaaatgtatacagtcatataactatcaccacaattgagatataaattgtttccttccttttcaaaagttccctagtatccctttgcagccggtccatttccccacccccagcctctggcaacctgattcctgtccatataattttgtattttgtagataccattctattcttatatggttggcttctctgctctggtataaaactttatttatttaaaatttctacatcttagtttggatacatagctctagactgtcatgatatttttaatcccaattctgtttttattttcttccctatctcataacatgcataaatttgatatgcattttagctgatcctccatgttattggggataaaaggccaaagataagagccaacgaggaaaaacccacaaaaattccttatttgacactagacaacattatcgaaggtgacatttattcattaatcattctcttttgatattgtgctttaatccactaaactttattattgttcagttcatacttatataggcatatgttggaggtattccaggttcagttccagaccaccagaataaagtgaaaatcactatatagcaagccacatgaattttttagtttctcagtgcatataaaagttatgtttacactatagtgtagtttgtaaagtgtgtgatagcattacgtctgaaaaacaaaatatatatcttaatttattgatcagctttattgataaaaaatactgatgatcatctgagccttcagcaaattgtcatctttttgctggtggcgggtcttgccttgatgtttgtggctgctaactgatcgggatggtggttgttgaatgt

SEQ ID NO: 127732 - DNA, 1228 bp, Homo sapiens
ctgagatgcagttgcaagaatactgtccagagttccctaacttcacaaatgagggcatgttcctagcttccacattagaacctgtaatagcctttttgatttaacattgctggactaccacccccatttattcagcaaaacactaatttaagtgctgctgcaaaggtattttatagatatgattaaaatccataatcagttgacttcatgtatgggagattatactagatactctaggtgggcccaattcagtcagcaaaaagttcttacacgaagagttgtggctttccctgaaaaagaaatttcatttgtggacagcatcttcagctgatttccgagacttaggccccaccttcctgacagcctgtcctaatgatttcgtacttgcctacatagctcccacactattctaagccagtaccctgccgtgtatttcttaatctggatctccattggttctcctcctctagttgaaccctgactgatatattacccaatcagaatgatggctcctgataattttataagaaatagtgtgatgctaagcatgattcctagttaatcattctattcctatgcaacatatcaaaaaagacccttgttgcatgctgaattcttggactaaacgtactttttagttgcacagctgccacaaaccttactattgtatacttgctgattttgtcatttgattttttttttaatttctaggtttttctaaggatagattcatcatgttatttttcttgtctagagtacagagaaataatattttgattattttagttgtttcaaaattgctctcttttttggaaggagaaacgtaactgccgtgcattttactgtagtcagtagttaaatgtataacatgttagctcaaagattaaaatgtgaatattctagagcacgagtacagagagttgatacaaagggggatgtcagttgctctgaagttaaattccaggattctgtcacatgctgatatagtgccaaagcatatggatctccatatggtgctgcttttggggtttataccacctgtaatctagctgattttcattcacttaaatttgtccaagaggtaagcaaactaaataaggaaatgaaaataatatgcctgtgttaaaatgccgaagtttgggatgagttactgttattacagtgattaccaagaaaaaaaaagattgattagaggagtgcattagtaatatagcagtagtgtttctat

SEQ ID NO: 127733 - DNA, 1723 bp, Homo sapiens
ttaataaaggaaggaggaggacttacctttgtaaggtctgatccatttgcttttggtataattgaaggatcattgactgggttaacatgcactgagctccagtactatccttgccatttactagtgggtatgtgacactgggcaacttacaatatctcaggcactgattgattctttattgataaggtaggggtagtattatatatcccagtttataggatgattatgagaatcaaataagataatggatatgaagtgttttataaagtgtgatatacatataaagggtattactaatcacagtgtgtctgtaatttacgtcttattttattctgactgccccaactaattcaggccttttgccatctcacacttggattgttcctatcttctgctaaatcaattccgtctcttgcttttataggatgtgttgagtagccctgaaataatgttctaaatatgttactttccttttcaaggctttttgctgtaccacctgtctactcttgtagccattatcttctctttatactccttcctccgatttcattccctgaactccttgctattcctgagctctttatgcttgccacctacgtgcctgtgcatgtgctgttatttctacctaaaatcctttctcccttctaacctcataatgtttctactcaacaaaatctgatttgtctctcaagactcatctcagatatgactttgtcccttaattttttttcctcttttgccaggcctgatgtttcttttatggaaatggaatagataatggtaggaatggggatggcagccggggagagaaagtattaccgaatttgattttctgttgttcccaacaaagtgagaggtgatcctaggttttattttgctgttggagaatttaaaattgtggtaagtttttatcgctcacgtaacatgtcaccagtttctcccgcctccacccatgtctattctttggtgcttacatttgtactttaccgatcaggggattttatgtagatctattcttattttatgtaatatagataataaatttttaatacatcatataatataaattccataggaaatagctgtttaggggaatgaagaggtgagctatctagaaagcaaagaaccagtttttacattgaaaaacctcacagtttatctgttatgtagactcctttatattagcttttcttaagtcgtgctttatctcaggtggatctttaggaaaatagtaactttacagcccaggcctattcctgagactattaaaatctttgtagactgtactactatagattgatgaaatgttttattttatttctcagtaatttaatactattccctagaaatcattcttaatattatttgagtatcaaaaataatgtaaatgtcaacagaacagccatctatgtttaaattctaagttcctaagctctttacactaaaaatagaattgttgttatacattttctcaatttaaaaataaattgaggtctgaaagagttgtttattgctctgctcgccaaccttaatctagtgctggggcagtatctgtacctatctgcctgatctgtgtttcaaaatgctactaaattgatgccttttctttgacaaaatcaccatgaatcagaatggcaatcacagggcccccttgagttttaggttttgtggccattgtcatttcctcctcattatttgaaacctgtcctttcctaggcctgct

SEQ ID NO: 127734 - DNA, 1030 bp, Homo sapiens
tatatgtaaggtagttctgcttttgtgagaagattggccagatacattaggttgtttctgatagaaataggatgtgtgcatcacttagaaaattataaccacttgacgtgatttttcataaacttcattttacctgttagttgttgcctttagttaagttgttgcagtgcagcttggtacctacaccctttaacttgtcaccagctatgttcttcgtggattgtttgttgtaactttaatgaaatctagtcttgctgaatcactaaacctgttctctcctagaaggctctttattgggacctgacagatcacctctccagagccttcagacgtcctagctctctaattcttctccataatgagttttgtgctgcatgataaaatattcatgttcaaataggttctaaactaattatctgtggccagcagtcgccactgcagtcatttgctgttagcttggctcaagttaatggcttgtatttcagtacaaatagtcccttctggctgtttcctgtcctgattcttatcctaaatggaatttccatacatatctagagttaagtcttcttcttttgaaaggagattttttgccctaccttttttcatctcattttattaagattagcttattttagtgttcagttccttattgtttcttatccatcttcaaatcctacatccctgccaaattcatgactcccacactgtccaaaaagaaatagtaaagcaccaactttaatcaaatataccatgtcagattttggaagaaaccaaaatggggtaccgcggtaaggatgggatctagtttcagtgtgtatgataaacatttctgcttagttgctagagacctacacagggaatgttacgataggaattaaccactttgggaagaattatggggctggacatgagggagataaggcactaatggaatatttttctgtgggtgttgttgaaaatgatggatgacttgctgaaggagtgggagagttcaatatcagaggactaagggcttgatcttcggggaatc

SEQ ID NO: 127735 - DNA, 3399 bp, Homo sapiens
tctttatagcttcttggtttttaaattttctttggttaagctttctctacactaatactgaaaacacacatttttctagacttcattgtttaatttttctgtattacatctaggcctttaatctatatagaatttatttctttgtaagatattgatttaatttttcctgatgtaaaaaagggtctcagtatcttttgttggtcagttctgtccattcccagtgatttgaaatgcactgtgtttcccaattccaaatgcgtaattagaatttcttgatttcagttgtaaaggactcagcttaatgagcataaacaaagttgggtaatttttaaggagagtaggcttttcctcaggaccacagagcaggtggctgtgccttgggaacaactatttacaggaactcaaataccatcaggtttcattctctttcttttttcctttgtcttcatttctcatttctttttcatatatcggcttcattgttctttctcactgtacactttttctgagtggttcctgagtgtttcatctactcagaaatcacttttttggttaccagttgaaaaatctcagatttgtgtcagttgaccttcactgtgttctggaaatgaagtcattaaaaacatagccagccctgaccataaccatgtggatgaaaggctaattcttctttagaaaaattagatagcttaggtacatatatctcattctggactctctagaagttatatctgtttatccatgcctatttcagttcagtgctgtgtcaattacgtcaattactgtagttttatgtttggcttagaaaactgtaggacaagtactttctcattttttttaactttcaaaatattactggctggtatttattcttcacaatgaaatgtagaatcagcatgtcacgttccagtatacatcccatgttttttgatgggaatatattgaatttatagctttctaagtggaaatttgccttcttattttgagattttattttattttatttatttatttttttagacagagtctccgtctgtggcccaggctagagtgcagtggcgcaaccttggctcactgcaacctccacctcctggattcaattgattctcatgcttcagccacttgagtagctgggattacaggtgtgtgccaccatgcccagctaatttttatatttttagtagagatggggtttcatcatgttggctaggctggttggaattcctggcctcaagagattctcccgccttggcctcccaaagtgatgggattataggcgtgagccactgtgctgggccaagattttttttccggaatcatggtgtgcctttccatttaaaaaaatctttcttttatggtaaagtgggctggtgtggctgtatttctgtcaaatgaattcccattactaatctctgcttaattaaataaaacttcattgaataataataatttagaaagcaaagatgagtaaaagaagaaaaagttttcttataatcttgtcatttaaggataactgtatatacatttaggcatatcatggtgctatatcttccacagagattaaatgtttaggatacaatgaattggcatttgtatcaggaatgcattcccatttaagtgaaaagaaacctgctaagagtatgattttattattcataatcaaagaggtttaaagatactagatcagtgactcagtaaagtcaaagatgattctgtacagttcttttggccttgctctggtagtcacaagatgactgctactaggacagtcattatgtacctggttgaggcaagagggtgacagatgtttgacgtcagtttgttcccttgttgtcagtaaaacgaaagctgttttagggtacctctgtttctgcctggtcacatgaactcttctccatgcaggtaaggttgacaagcaagcacatggctttttaatctctgttgtgggaagtgggattggattggcctttaggtagccagtcaacaccatctgcctttgcaaataaggccagaattactcttgatcttaaattttacaagccaagtttttagacagtggataagttcttccacgtcttctcaaaccagtgtttttctaagccccttaatttattcatttctttccctcagtgatttccaggaagccattacccctatttgcctggcacttatacagtgcggaaaaggtcctgaaaacccgaaaaatcatttatagtgtgttttccttcatttttaaatgctatttcttgattgcctaagactgaattgccttgggcattcctcactgagctggaatgctgactctacagcaggttcttgaataacattgctttgctataacgttgatgagaaaaagaaattgattcctggagggccccactgtctgtgtgaagttaacacattctccccatgtctatgaattttctccagatactccagtttcctcccacatcccaaagctgtgcatgttctttgaattgtcatgtctaaattatcccagtctgagtgagtgtgggtgcgtgcgcgtgccccaagatggaatggtgtcctgttcagggctagtgcccgctttgcgccctgaactgccgaaataggctcctgccacccgccacccagagctggattaagcaggtaaatatcttacttggtgtcatttatctcaaatgtatgcatagctcacatttatttcagtatttaatattagtgtttttgtcttcatttagaggtttggtgatgtttttgcaaccagaaatatgccataacaactcagctcttgtttatgtcagttagccagtggggaaattggttttgtggtacatcattttgcttaaagttgaagtttctaagaacctatagaggacattaagtgaagaacttgttgcatttctgcttatttatttgcttttactgtgaagaaatagctgaacttctgtgaagggtgcagttgcttttagtccactgtgtgctgctctaggctatccaagcccaggggttggtttctgctcctatgatatgaaggcagtatgagaattctcacagggccctagcctgacctctggattagggttctcatggtgttgctctggttcctggtttctgcaatgctaggttccccggcttgcctgaccttgccgccttttgcttccggttagtgtggttctctcaatcccattcatctgatacttccagacttgtcatttttattaggtctcattgcttcagcagttatgccattctcctgacaaatagagttctttcttacctaggaaaaatattagctttactttaactagagctgttttcacaagtgtgtgaagacctggaaatttgcaattagtttcagataagcacagctgaaatattcttgttttgtactaaggcaacaaattgaaagaaaga

SEQ ID NO: 127736 - DNA, 1032 bp, Homo sapiens
aggctgagtgttatattttaaactgttagatttcatttgttttatttgtactagtgggttgtcacactctggcattagtggtcattttttaatggccatttctaatggcatatgaaattgaaagagactgaagtgttggaaagaaggaaagttaggtttttttttaattattaaagtatcccaaataaaaatggaattttaaagaatgtctcaagaaatgtatgcgttaaagaagtcaatcaaaattgggcaaatgagcttctgctcatgaacatctgtaaagcattgactttaattgccctgcagctgctgttggctgtgcggtttctagttttactcgtttctcctccatcttacatgtcactttatttcctctttccaatgttgcctgggtcacatgcatttgcttgtgtcgaaaaagtaagatgatttagttatttttaagatcccaaagacaaggatgcttatctgttaaagccttttcctccaagcacctgttaagagttgaatttaatctacaccagctgtagcctagttatgtgtagctcgagtaggaggtgtctgatacattgtcttctcttttcattgaaatggattggtaaaactaggcggcataagttagtggggaaaatttagatacatcttagattagatgaagacctttcaaaatagggctttaaaacatacaattcaaatatacgtgcttatacttttacgtgaattacaaattgggtaaagatagaaatttgtttctacagaactgccaggaattatattacacattgagaccactgatttttgacactggccactttgtccatttgaattttgctgctgagttactcttttgggcataattctgcagagtggaagtctttaaagataaaggaagggctgagaatgttttattcttgttgacatatgagtatgattcaaattgagttttatggaaagatcactcacttcatagaaatttttttattttacctactcagtagcaggttgtattagtccgttctcacattgttgtaa

SEQ ID NO: 127737 - DNA, 1061 bp, Homo sapiens
ttttatccttaatgtctaaaacagtacctttcatagaatagatactcaataaatatttgtggaaaaaacaaaaagtgactaccactggtaaatgctttcaataaactgtttttagatgattttatggttatgtgtagacaaagttgttgtatcagaagattatgttcccatggatataacaatagactaaaggttcagaatatctcaaacaatgaacctggacacataaacagaatcatacagaatgtcaagaaaaatggaaatgttttagatgtctgatgtaagaacagtcacttggtttttcttctccttttttaaccttttgatatactatgctggcttaagaaaaccagctttattattcttaaaagtaaatttaaataggcaatacattcccatgcttcagaatttaaaagtataaaagtatacatgttaaacatctccttaaaactcctctccaatagataccctgttacctttcccacaggttaatttatatcattagtttcttatatatcattctagaaattttttggcatatataagcaaatatatatatatattcttttttttcctgttttacacagatggtaacattatgaacactgttctgaacatcatttttttttcattttgtatatcatggagttttatttcttctttctttgttatggcaagagtattacgttgtattgttacaccataatttatataaccagtcctgtgttgatatgcattcatgttgtttctagtcctttgttatcacaagcaatgccacagtataaccatccttgcatgcatgtgctaatatgtctgtaagataaatttctggcagtggcgtttgcaggccaaaccgttatattccagggtttgtgcatttgtagttttgatggatactgccttagttcattttttgctgctataacagaatatcatagactggataatttataaagaacaaaagcatatttggctcatgcttctagagactggaaagtcccagagcatggcactggcatctggtgagggtcattccgtagcagaaaggcaaaaggcagaaa

SEQ ID NO: 127738 - DNA, 1035 bp, Homo sapiens
tgcatagacaggaatgattcatcctttctttgtatgggaaagaacaggactcagaataaggaaatatttataccacactcatttttgaaatcaggaatatcttaaaacagtttagttttatgaaactgaaggatttatttagaagaacagatacagtctgaattagaatgttgatgtaccgtgtgaatagatcaactgatatgattcacgtttgttaagactggcagctttctactgatattttttagcaaagtaaaaataagtaagcaaataaatagggctaagaaaactaatttgagagagtcagttttcaagatgttggagagggtagtaatatgagaacacaaacttcccaactgtgtgattttggaactccctttgagaaaaaaaagaataattaataaagatttttttttaaaaggccagattaataattaagcaagaaaagcctcagataacttgaaaggtgagagaataaattgccaggtgataacaataaagaaatttaatcatgtccacgaatgtataatactttgtacagccaataaaagcaagtaagaattttcagtcctgtagaggactttaatgcaagggacaacaaatacgttagatatgcccaaaggacatgactagtaagagaagcgcttcagttttgaaagtaagataaaatgtgtaagttgacataatctttaggaaagtgaatacagttcccatgttaggtacaagcaggcagttattttcaactagaaagatatgaaagtcttttaaaaaccaagtgtagatatgtaactttattattaaacatgcattcattcagtgttactgagagagtaaagaattaggaagataatattgaggaaagatgtgtggattatatttcaaatgtatatacgtaggtatgtgtgtgtaagacacacacacataatggtggagtgttgggttttgtttccagagaaccaaaagaagtataaaatatttaactatccttcaaattttgacagtcttttgcctttcattcatgaagatgaatattat

SEQ ID NO: 127739 - DNA, 1056 bp, Homo sapiens
tcttcctgtgtgtacaggaaagatttctagcatttgaaaggttacagcagaataaaggaagtacaagcaaaaaaatacataaaaataattccttccagcataacaaaaatcgctttcatgaaatgataaactttagtgtagatacattattgaattgaagagccgttggcattccagggaagcttttggggtccttaaatgtcattccactgaaacagcatgattgtgattgctgattaatagtccaagaatagtgatatctgaatatggtctatagtgatttaaaaaggcttatgaccagcttctcatttgaaacttctagacagttttcaatttaataatcttagtttcccactatgaaaatgaggattgcttggggaaaagagtctgttatttttgaatttttgagttagacgtcttccattcaccagaaagcactatccagattctaagattatgtttcaggatataaccatatggcaaagcacttactatatataggtaatttgaaactataccagttctaaaacaaacaaataaaaggatgtggtcatgtatagcagtggtaatacatgaatagttagatcttgtgtatagttaatatgtttctgtggagttgtctgattaatacaaacaaaaaaatactaatctgtgatatataggatacttaccactttatgtatattgttagagatggaagcaaccgcatttttacagaatggcaaaacttagttctggagaggtgaattgactagctattgacagagataaataggcaccagatcttttgggcaccagtgcagataaaccatgatgctacttagaagaatagaggaagaaccagtttcagcgccagatagtatgcttaggatagcccttcactcacctcattgccttctctgataagtcatcatctctggtcctctacttaggcccatttagttgaggtatcaccagaggcagcttctgtaatggggagtcaggtacctggaaagctgtggtaatacgccccaaagtatacagtcctgtggaacttggtgcatttacagtcacgtc

SEQ ID NO: 127740 - DNA, 1405 bp, Homo sapiens
atgaccattgcttctcagaaatgtaaattttctcactcttgtgaatatcatacttacacctcatgctggctactctcctcttcttctcttcatgatctttctcattataactttgtccgttgcacccagatacatccgaaaagttgtcacctgcagagatgctatttggtgaagatttgaaacctcttaacggttaagagtgtcctttatcttcagcgttgatgacaaacctgttacaaacaaatttttggatgggatattgtaatacaaatgaaactgtttgtgaaacagatgacctgattgtttcatatgcgtttatattatctgtattggtgatgtgctccacaggatcagataattatgataatacacacgtgttgaaaagagatgcattcaattcacagctatggaagttttaaattgatttttttttccccaaaagaagtcagaatgtattcattttttctcgtcatttccttcttagcttagagttaccccttgtggcttcctaatttcattgctaccacattgtccgagtcttcatcacctgaaacctgagttactgtacacttaatgcttgtctctcctgtttctggttcattctatatactgtatacttcagcacacatttatttaccatggtggtgatagtggtgataagattttagttctagactagaaggcataatccatcaaaaagtgcacaagagaggtattggtttgtaatttttagaacactaactttaaaatagtcccccacccagttaaaaaataattgtggacctataacgtatacaatactgctttagatggtgaaaacatttaatatatttattgaattgaaatagtttgttgatttaaaaattctgctatgatggtaggatagggtaatgggacaattctagagaggagcacatctggtatgtggcatgttcattgtccgaagagaaccagttctggtaatgagtagagcatttcttgaaattaacattgtaataagcacagcaaagcaaagagggtttaaatcatagtggtgcctctctcctccctggcttccctgatgcccagtggtatacaattcagaaatatctgatgagtggttataacatttctctgattttcccctttcttttcttcatctccaggttcatcttaaatgaacctctccttggtcccataaggccagtctgtttttgcattcctcagttctgatttcttttggcaggaggactacatgtggttgacagattatatctgaaaagggctttggtaattgctcgttctcttcagtgactgtgttgctgacagatgggcacagtgaatattgaaagtgttctggacctccgcttactccttcagctcatgagtgctgagcactgccagcacttttcttattatctattag

SEQ ID NO: 127741 - DNA, 1121 bp, Homo sapiens
tatattactacacttaaaaaattatttaacccatttatagagggcatctgtcggttgcatttgatttatttaaaacgttttcttacatggccaatttagtaacagcaagcaaaaccaaaatgagcaaaggagaggatcccaataatcccagatctataaagcggatttctcaagggggtagagataaccacctagctattgctaaatgtgatctcactcagttgaaaaagaaacaatcagaagtgagcaatgggagccgtgaaaccatctcaatgaagacttgttgccaacatggagatagaggatattggtctacagggtactattggagaggtaactgtgaggcttttacacccagacagcccttctgtgcatggcaagttttactgaactcctcgagatttagggccaattaattcatctgttttaagatgaattcatcgggtaatgtgttttaagattaaattaacttgtttgttcttgctttccagatctcttattcactgcatgtgtgtatgtgggtaggtgagtgagagtgagaaagataatatgcccggggttggatgtctgttttcatttattattaagtagaagaagatgctcacatacttgtaggtacagaagcttcaacatagcagtctttcacagtgtgagttatgatagacgcaatctaagagtgaattataaaagtgatagggccggaacagacttttattaaattttgggtaatattgtagattagaaaagtaaaatgtgttacctctacttatctttaaacattcactctatttaatgtattcatcagacctcaggaagcttgcaagtatattctgaagttacaaatttgtattttctttgtaagtaatatttagtaatattttcctttataaaaaacttttaaagtctaaaaatgccactgtgtgtcaatgtcctgtatcacctctctctcaattttcgttctctttcttctaataactatttctaaggaaactatttttacaaattattccaatgattactatcaaattagaagatctcttaaatagcatctaatgtgatttatagcagagataactaaggtccccaaaagttaagttacatgtttaagattacacaacaag

SEQ ID NO: 127742 - DNA, 1366 bp, Homo sapiens
tagttttgtttgacatatgcactttttctgactttcaaaaaaaaagttaaaatcagaaaagaaaccaaaatggatccatctggcttatttggaaggacattattgtgtaatgaaataccaacgcagtcacattatataagtcagtgttcattatcacagacaaatcagcatggtaaagatgatagattttcagaatagcatagggattcttttaataaccccctaataaatagatgcaaatagttttccaattgaacatacctttgaattattacccatattattgtcttaatttgttgaaattgttgtatttttgtaatgtgattgcaacattgcttttcaggaagaggagattatgattctgtatccccttttggtcctatttatcccttttaaatcagtttcacctctcatcttagacttatcgggatttttatgaatgtacctgactatccttggtacataaaaagaagactcttttcactttacttaatgctacaaaattttgagtgtagttcccagatggctaattatttatttggtgactaaaaatatagcttcttgttctccagtcacatatgtgattttgggatcttaagataaatttttatatctcatatgagtgatcgtagaatttccagccattatatttcttatcactatggctagcttgaatataataacatgattttaaaatatatataaccctgacatggtgatgtacttttgaaagctccttgtattagcaggttatttgtacagctgtatcaaaaagacttgcctcacttcagaggattatcgattaatttgcataaatgtatttatgcttgagagttaaagtaatgcactattagttttataaaacagttggcatagctgtcaaagttcttaatgttctttgcagtgttacagctagaatttcccagggcattgaaagaaaaagcaaagaaacaaatctttaatagtgttacattctgcttgttctcctgggcttgtattgaagcacaggtgttaaggtggtgttgaaattagtctggaatcatgaaaaaataaaatacaactctttgaggtagctagggcaaaatgactttgcagtgccacgactgctctgcccctatctgagaaaatgcttcttgtgctcggtagctcttgttaacttgaaaaactctagaattacataaataatgaatggatgcaaaaattcattggtttttgtaatgtagatgaaggtaagatgtcctgtcagaactgaaatttgcatagtagaaaaatttagttatcctatcttgttctttaaagcaataaatgactatgaatattcatggtcaattaaaatattaatggtatactgatactttagttttag

SEQ ID NO: 127743 - DNA, 1736 bp, Homo sapiens
ttcagcctcctgagtagctgggactacaggcacgcgccaccacgcccagctaattttttgtatttttagttgagatggggtttcaccatgttggccaggatggccaggatggtcttgatctcttgaccttgtgatctgcccgccttggcctcccaaagtgctgagattacaggtgtgagccactgcgcccggcccacaatattactttctatgaactggactccattgattcatataagtgaaataatacagtgtttgccttttcgtgactggcttatttcacttagcgtaatgttctcaaagtttatccatgtgacactatgtgtcagaattcccttactttttaaggctgcataatattccaaagtatgtatacatcgcattttgtttattcattcttctattgatggacatataccttaaatgtgtgacttacatggcgtgtacattatttgggttgctttcagcttttggcttttgtgaataatgctgctccacgaacatgggtatacaaatatttttttgagaccctgcttttaattcttttggatatctactcagaagtggaattgttggatcatatggtaatttttatttttatttttttgagggatctccctactgttttccatacgactacagcatttgactttttcacagtagtgcccataggttccaatttctctacaacctcgccaacgctcctacatttctgtttaatatattgatttttaagttacaaaagttgcgtattgtagagattcaaacgattcagagaggtgtaaagtaaacttgaaaatccttctttattttccctttgactcttaaaacattgattaacactgattgaatcagatccaagatgaggtttcaaattcctctaaaaatcttcctaagaaagctttttaatacctcccgcacatatgtgtagataactgtcctttcttttgagcttctcttttaaggtactgcatcttagtgtagtgacttccatttagtgaatgctactgaatgtggattcgtgtcagacactgtactatccatatgtttttcaaccttatagcaccagcagtgcctaagtcattgtgcctggcaagtcataggtgttcaatataggtatgatacatgaatacacatgtccagtctgggaggaacttttcaggaagtaactaacataggcctctttccttccgagtgctgtataagcagtctcatgctggtgttgctttgagcatgcattttccgtgttgtataatatattgctttagggtacacactgggcctgtgaagactgggcctatgtttcctgctgcttttgatacaggatcagaaaatgtttggaccccccaactgttctctgatttattaacactggctcagaattatggaagtttgaagttggctggaagctatgagatgattcactgagaaccttatttgacagctgaagagactgacatagtcaaagacttctactgttgttaggaacagcacttgttttaaacctttattttaggtcgcgggtacatgtacaggtttgctagataggtaaattgcttgccacgggtgtacagataatttcatcattcagatgataagcatagtacccacaggtactttttcatcctcaccctctgtattagtttgttttcacagtgctataaagaatgacctgaggccgggcgcggtggctcacgcctgtaatcccagcactttgggaggccgaggcgggcgga

SEQ ID NO: 127744 - DNA, 1038 bp, Homo sapiens
ttgtttatctagatatactcattctgtcagctgtgccctcacctctgttatgggctctttgtattccttatcccattttttttgtttgttttttgaggcagagtctcactccgtcacccaggctggagtgtaatggtgcgatctcggctcactgcaacctctgcctcccgggttcaagtgattctcctgcctcagcctcctgaatagctgggattacaagtgcacgccaccatgcctggctaattttttttgtatttttagtagagacaggatttcatcatattggccaggctggtctcaaactcctgacctcgagtggtccacctgcctcggcctccagaagtgctgggattacagcagtgagccaccatgcctggccctgatcccatttttattgcagtagaagtgtagtgacaaggaattggtaaggtatcaaaatagaacaggaaataatggaagaggcaagaccttcacatctaggaagagactggtggaattctatgaaagttaaatatttaatacttgttttgtccagtttttattagtccagacacttgcaaaatgaaaacgagaagaataaagactacctgcctctaccaggcattattaattgccctttggagattttgaatgaggatgttagtgtctttgagtttcataatgaaaactggaactatggggagaaattgcttgatctcagaactaactgaagctccagtgctcagagtcaaactaaactagacgggccttggacaggtggggagttagcagccaattttattcacatcatttgtcttttataaaaggtgtttgcatgtcagattgagcaaaaatcatggaaaatgcccaagttttaacatcattgtttgaacctatcagcaaaatcagatggcttgaatatgtaattaacagttaaatttgtcctccagatttgttttagcttctagcataccaggcaggaaattggaattagaaagaagaactcaggatgtgaaactctcatttctggttcagtttttttccaaagaagttatccag

SEQ ID NO: 127745 - DNA, 1490 bp, Homo sapiens
agaaaatgttccatggatttttgagaatttgtgtgatttctggctgtttctttatgtttcataatgtgctgcctcattttggagaaaagacaaaaataggctaactttgttttacaactagggaaaatgtgcatagaattgttcatatttgcaaaatgaattaatagaactacttaaaattagattttcctgctttaaactcccgttctttatcctctgtttccataactcagctatgtatttttgtttgtttataatcgtttgtttgttgtgtttggagcttggtaaaagaatgaaatgtttttgtagagaaattcactcttccccccaataatgtggctcccccataagtgcaacaagatgtctctcaaatagggtgagctttagttacatcataggtggtgggttccagcttcatttccctgccaatatcatggtttttcccttttccaagtacaaacttcatcttcagcttggttccaggatgggcactagtgtgcccagcatcatagctctcatagctataaaatccactcaagacgttcagagccagcaaaggctcatctctttctcactctcctttataaagcaagtgagcctttacgggaagaccctacgtctcattagcctgaattgtagaccttgcttgtatctatttatggccaaggacttcgggtcggcctcccatgaagcatccagctatccagaagaatacaatcagggttctttttagaggaagcaatcagggaggatatgaatctaggttgacagccaaatttttagtttgtcgtcttcagtatatgtggaatatcccctcagccagccagattgtccagatcaagtttggtgaatagtgcagagataattcatgtcactggagcagcccccctcctcacctttattggtgtggattagattctgctgcaagtagcaaagacctaaacaacggcctctacaagatggacctttccctttcttacttacaagtcaggtgtagttcagggctgatatgacagccttcttgcatagaatccttggaggctgggcgtggtgtctcacgcctgtaatcccagcactttgggaggccgaggcgggtggatcacctaagattaggagatccagaccagcctgaaccaacatggagaaaccccgtctctactaaaaatacaaaataagccaggcatggtggcacatgcctttaatcccagctgctcggcaggctgaggcaggagaatcgcttgaacccaggaggcggagattgcggtgagctgagatcgcaccattgcactccagcctgggcaagaagagcgaaactctgtttcaaaaaaaaaaaaaaaaaaaaacccaaaaaaaaaaccccgaatccttggaaagttaggcttcttctagatcattcttcggctatacagtggtccaaaatggtggccgttgcagctactgaatggagaaaggaacacagtatttaggttagtgcaaaactaattgcggtt

SEQ ID NO: 127746 - DNA, 1084 bp, Homo sapiens
agttcttgtactggcaatggctttgattaagcagtgtagtagggtcatatcctagaataacagcatttccaaatccctgactgtttttgaaagaattgtgattaaagttctggctcttttcccatgattactaatgtctgctgagggttgagtttcccaggttgttattggcgattgagttgtgtggcagcccgttgtgctttcttgtcagtatcagtggcattctctagggggaagtgatttcacattgaaatgcgagaactaaaagctgtaacaaaattaacacggggtctagggtttctgatgtgactacaaaactagaatgggaatgtttcctaaagcctaattcatctgtgattgaatttcagactaaacaaagctgccatgatgagaaggtagagaaacccttctaaaagagattatggatgaacagattgaggaacatgatatggcagggcaaagtctagacaatcatatatttcagcttcagctgggcctttcttcttgacaggtgtgttctgtgccttggcatgagcagctcacttgggaaagcccgtgctgttaggaatgatctctttgcatgccaatgggaaatggaaaatgaactccattcttatataatatgtaggaaaaaataagtgttgtgtgtgttgggtggcaggcatggctccctaggttttaagatgtattgtggaattatgtttgtctgaaaacaattatttaatgtctactactaccccagttaatgatatgctcttttccacattgaaaaaatatgcaggattttagaaatcaagaatatattaggtgtttttttgttttttagttgctaccaaatttaaattttacataattttactctttcatctgctggtcttttaccttggaaattctagaacttaggtgttgattctctacctctgtaggttatgaagtgcttgaggtagagcactgtattttagactctttgttttctctctaggtgccatactcaaaatagttttgtaatgcctgtctggattgatttagagctgcttctttgtgctctacaaaaaataatttttaaactcaaatgcatcttcat

SEQ ID NO: 127747 - DNA, 1027 bp, Homo sapiens
ttagagaaatgaaaaagcatctgtaaagttgcactgagtatgcctgactctccggcctccccttctactttccccacctcctccacttcttctgtctcttccactcctgagacagcaagaccaacccctcctcttctccctcctcctcctcccccctcatctactcaaaatgaagaaaacgagggtgatttatttttataacgattgacttttagtgaatagtaaaattgtctcttccttatgatttccttatctgtagctttattataacaatacagtataacacacatacaaaatatgtgtttatttttctgtttatgttatcagtaaggctgctggtcaacagtaggctattaacagttaagtttttaggaagtgaaaagttacataaagatttttgactggaatgggagaagcaaccctatcctgctttgttcaaggattagctatatttgaatttaatctgtctgcagtctttttgttttaatttctgcgttctctattggtggagtggtgcttggcgattgagataaaaagtgtttatgctgaagttgtgctccatggaccattagtttttaggcttaagttgctttgtctagtattatcagagccttttcgttggtaacctctacctgtctctgttctctcctcagctaaatcgacaagtacattttaataaaagctttatctgtatttcagacttttgaaaaacaacatttaaaaagcagaatcaccaatctttaaagaaatacaaagaaaaagtgtttttccaggaagagattgtagcagtaattttatgtgatgtgtttagaaactgttgataagtagcttctttgttctgtgattgagtcactgtttttgatcagtcaaacgtagtatgtattgaataccaatattaggagttctgtattatgtgttaccattgccagtctgtttacctatcttattaatattggcctattttgtagaggaacagtgtcctgttttctctaccaaacaatggtaacttatgtttgtccctggattt

SEQ ID NO: 127748 - DNA, 2034 bp, Homo sapiens
aaagtactgctaaagccagttttcaccctaagggtatttaccaaacccaagtgaactagcatggcacaggagaacaggaacaaagcccaggacctgtgcaacctggggagtctgacagaagcatccccatcatctacataaagcatatggatcatctaaaaatatcatctctttcccataataccccacctcctataagagactaaaaggaagttggtcaccttgacacaggctgaggggagaaaaaaatccctaaagaattcttaactagatatcttgtcaaaatatacatcctctgggtagtgtgaggaaagtttaaagtgagaattgagttcaaaatgagttccaggttggtagtgcccttaagtggactagcagaactgttgctaatgtttgggataggacctactttcaaaccgggccttaaagaattgctgtagataaagatctaaggaatatgagagtataaaacatgcaaacatacacacacatgatacacaggataaagttaatcaggattcagtagaggtgaaaggagaagaaccagatcagcaaagacttccaataatgtaattatcagacacatgatacaggcttattttttaatatgattttaattaataaactttcaccttaatgactcctgccttttatacctttttcttgctttattgcagtgtttatttttaatggctgcataatattctagttatatatatatatttatgtgtgtgtacatctgtatttatgtttatttaatctagtttctgttttgcattttgagagcttttttttttaaagttcaatataccattctgtgaggaacatctttgttgccaaatcttaatctcacccatgctattattttttaatgaggttgggagtaaattcctagaactgaaattttgagatcaaatagtattcaaaatgttaattaacactttgtgcatgtgctttataacaatcaagactgagcaaatggaaaatgaaaattttgggtttacatgtaagtgtgctagacaaatgtggagcaaataagattggaaaaattcactactttttgctttggtgggtggtcgacattgaatttactgaattcagtgaaggacggaggtcagtacttcaaacatagaacacttaaccttttttctattggttggtgtcattattttgattgtagatatgtaggagtgctgtatgtccttttgttatcaatatagtactccatcagagcaaaaatttaaagtgtattctaccttggagatctgggaaatagtctgagtctggatagactataaaatgatgattatttttgtcaattatttattgaacatagtaaatgtacaacaagtaatattatatatcataatatgtaacattctctgtgaaaacaggaaaaatgcctctagcaattgtaattttgagtattgatctcgtcatggctcatattttgctggcttggaagactgattttgattttgttagaatattacaaaaattgcttcctagagtgtttggaaagttgactgttgccagttaagcctaaacagcaactataggtttgctggtaaagttatttaaagccacctgtgcctcagtaatccagatgcttctaatgagtcatgaaataatgctgtttctgtttagatgccagctctgattatctttatcagtaagctaaatggcaccatgttttgcaacctgtattttgactctgattttgtatttacagagcactcgatctctccggcttctcttagtcattttgagttatgcttgttatgccaatccgttcaaaataatttctttccaaatttgggagtacttagatttaagcacacctctgtgcgtgaagacaatgacagcatttaaacaacactatttcttctatatgaactagtactaatcatttccagtggcctaagctcttttgtggaccctttcacagacaaaacaagattgataggctcaacatgttttcagtttgaggtttattcacatcagaaatctactgcccaactggcaagccgtcat

SEQ ID NO: 127749 - DNA, 1038 bp, Homo sapiens
gttttatctatctcaggagttggaaactgcttactggagaaatctactctgcacacgtatttttaaatacatttttattgacacacagacatgcttatttgtttatgtattgcccatagctgcttttgtgctacaagtgcagacttttaattgcaacaggactcatatggcccacaaagcctgaaatacttattttctggccctttacaggaaaaaattgcaaacccataatctgtccctctcatttacaccaatgtctgagatatcctttgagaattggcaggtctctgaaatatgatttataaaaaatgaaagacatatacatcaaacatatgtttttatatattgaatgataacatgatatgactagagtgaaatctattctaatgctcagttcattgtgataacatgattataggaaagtaagaatccatggtgcctccattaaagaaaaaatataaatcctaaatacttttaaaaaggtactttatgagagtggaaaaaaggggcaattgttgagtagataaaacgtttcagtttatgataaaaaagttctagagatctgttacataaccatgtgcgcatagttaacactactgtatggtacatttaaaaaaggttgatggtaaatgtaatgttatgtatttttttaccacaatttttaaaatgcaccttttgggatccagatatctaatatatcaattgtgtgttttctctgtaaagaaccagagtatatatttgtggcattttcgcataatagagcagaaactcctggatttactaaatgttaggtacttcagaatatcaccttacctttctcacatcacttctataatatttgaggcatttagaataacagttaaacaaatgctgttgaattgaccagatataatattatgtatattttctccaagcataaacagtttattactacaattatcctaccttctcattaaccgagacttactaaattgataccattagaactaattacattctaatctcttatatagctaaccagtgttctaaatcgtagtg

SEQ ID NO: 127750 - DNA, 2106 bp, Homo sapiens
caaggcttggtaatactcccagtggttttactcacttacttggtttctaccttcattcagaattttaacttactagtgattaaaaccggaaaaagtttgttccctgatgtagtttatcattcattctttctctgtgtatctcttaatggaaatccccaaaatattatgtggtctgaaaggtaagttcattctttgataaacggatgactatgatggagtttaaattagcccttggcccaaattgcaaccttgtcaaaaactcctgattggcttgtggaacttgaaatgactaagatcttttagtggatttttactttttttatttgagttttcacacttcagcatttcctgagtgttggatttattatttcttctaaagttcagaagtttagtttttgtaatgaaacgaaccagtgttcattatcacgcttgtgtattttattagtactattataattcaaaatttttcttttatattcaacaaatatttattgaatacttatgatgcatattttcctatctccaagttagatgtggtctcttgttcagatgtagttactcttatttttatgagactatgtaaataaaattgtgtagatatgttttctattctttagaatggtcattgcttttattctatgctagtttaagtgagtatgagttagcattctgttatttgaaagatagtgtagcctaatgggagaggcagtgcagaagaatgaaagctggaaaaatgtacaggattgcaaatttcaaatgaaaaacatgacaaataatcttggttcaggactaggctccttcactttagttttactcaatgcttgttactagactctgattatgccatgtcctggggaaagaaaaaaataagaccatatccttacctgcaagctcctctcttggtagctgcatgggttgcaaaaatgaagaagcctgaaaacaccacatattggcgaggacatggatcagtgggatgtcctataccttgtgggaggatataaattggttcagcctctctcaaaactggtttgacatgattgagaaatcacatttcctgttactcagcagttccctctcctaatgctcttgaatgtgtttctacttgttatcaactgactcatattatttttctgtcccaatttgccaaactctttttctaattgattacaataattattctatatttataacttagctcatattaaaaaataagtttggctgggcacggtggctcacatctgtaatcccaacaccttgggaagccgaggtgggtggatcacctgaggtcaggagtttgagaccagcctggccgacatggtgaaaccctgtctctactaaaaatacaaaaattaaccaggcatggtggcatgtgcctgtaatcccagctatttgggaggctgaggcaggagaatcacttgaacccggaggcggaggttgcagtgagctgagatcgcgccactgcactcaagcctgggcaacaagagcgaaactccatctcaaaaataaaataagttctagaggaacttatcacaagttgacttttatcaaaagtcaggacctatttaaacattgtatcatttttttttcttacgtggtctcttggcaaactcagatttgttttcagtggagggagaatccctttcaagtgcgtaggtccttcactttcctttgctactttttccctatgtctggtgtcactggtactctgtcttcctgaaactttgcatgactgttctatgcacttcatttattaaaatcattcagttcataattttcattcagctagcagtgcgttctttgcagcctagcgggtttctatattgacaattccaaccacccttctaagaataccacagagcagtttcccgttatgctggtttatatattctcagcagtcgtttttactctcctttcataaaattattataccgggtcctcaattctggtaatcttgctaacttatttttatactgttctcatagctactgcagttccatcactaggaaatctcacaggatgttagcgtcaaatatactgacttctaatttgttcattccccattaactccgcttatccctttacttgtttatttaatgctttccttat

SEQ ID NO: 127751 - DNA, 1016 bp, Homo sapiens
gctctatgggatcagggccctgccattgtgacctcatttgaccttaattacctcctttagagaatatatattaaaattcactgtcagaacagactattaattaaagtggtatttaatcgtccttttagcattggagccctatttcaactggaaaggagttttgtgcattgtatgagagagagagaaactagaccactaaaagtgaagtgttggggctgggtagaaatgaacacattctaagttttgatgtctgccaaatcactgtgagcctttgtttcccttatctgtaaaggaaggaaaaacattcattaagtgtttgatgacagtgtcttggtaggtaaagagtaaagcaagcaagataatactatacctcatttctttcagaaatttactctttaagagacaacgcttaaccagaaagagaaaacagcaaggaaaagcattaaataaatgagttggttggtttggatgttgctttctacctgttaagttttgtgattctgtgactgggcagtgcttttataatatttagggaatctgaaggcctggcattttgaaatttaaaagtttatgcaaaaagtgagttttatagtatgttggagaattgctgcttatttgcttcaactggcttttaaaaggcatttggctctttagggtaatgaacacttggcatgcatgaagtaatatgtttcttacaggagaaccaaagaacagttgtttgcagtcttgtagtgacatggcagaggcaggaggctggggacatggggatgatgatgccattcaaattgcaaagtgttactgatgctggttctgttgaacactgctggaatattgaatatctgggctatgagcatttttcactagtaattattcacacctcattaagatcagacatcagttaatgtctttctaggtagagcaaaaagtgaaatatttattggtcagtgagtaaagtcctggcatctaggtcagttaagaagatgaacctctcttggcaacttgggcttttggtgata

SEQ ID NO: 127752 - DNA, 1370 bp, Homo sapiens
gtatggttggctgtgtaacattcttaagactagtaacagtcagaacaagtagttgtagtcatatcatctaatgtatagagaataatttctaaaaattactcttagatgtatatgttacatgtagaaatcgccatattgcagcagtacagggtactgtttcatggcctgtttgtgaaatagctttgaaatgcctatgattaagagatgcttaaagttaggaggacaggaagtaactaaatccaaacctggaggagtgaaaggctccaaaggtgattatgctattaactagtaatttctgtttccaaaagtgacatttcaaagtaaaagacaattgtgattaacatttttattttatactttttgttttaataattatagtacttataatatcacatattgccaatatttccagatcaaaggcatatataatttgctgttataattaagcacattttccctaatatttttatctttgaaaaatgcagtgacattgttctacccatgtcagtttgatgtgtacattgatacttatttagcagaatattattctcagtgttcacaggtatgtgatatttttatacagatgcatgtttgttcttaatgagctaaagcctatgtagacattttgaaagatgttagtgattagacagcctagcaaataatgttgtagatcacatattattcatgcatgggaggaaatatagacaccttgttgcatttttatgaaacacagccatttttccccctatgctcagaattatgaaaaaatattgctagttttcagtctgcctgacctgtaaggtctgtgaagtgctgagtggttggtatacatagatttcaaaccctgtatttgagtaacttcttttgaattaatattataaatgttaaatgctataaaccttcaaaccacctaacttttggagattaaaaaatttcattctaaactttttttacttttatattttcaaaatgtatgacatatggctaaacaccgattgcaactaactgggcggttttatactactgaataaaatggagagccagtcaagatatcaacccatgtatctatgcacatttcagcagtttctaaagaggtgaggcatcccaatctagttagcacaaaagaataggcggtttctcatgagaaacagtagggaaaacgggaaatgttagtgaaaaacagaggagaaacagaagattttttatctatttacatatataaagagatcactttatatagaaatcacttaaagagatagttattttgttatttgttgcttcataagtatggattataactagttggttgtatgtttagagagattctactctacacaatgagaattttcaaatgaataaggcagcagaaa

SEQ ID NO: 127753 - DNA, 1371 bp, Homo sapiens
ttatcattggcagagtcaaggagtatagttgacttctgtgtcgcttcagcattgactttcttctttggaacacaaagagactcatggaggggttgttagacgaatgccacccctccctaccatatagttgcttctgtcctctttctttttttcttctctgcttttgtttttgtatttttctttttccttttcatgtccagtaactggtacgtacgagtataacttaactcttccagtgactgttaaaggaaaaagaaaactagctttcttctgttgtaaaagctaatgtgggaccaacgctgtatttccaaataaacctaaaatcagcatgactttgctgctgtgattttgacctagatttaagctgatattttagatgcaggttttcgtctctttatcaattatttttttttattatcgattaaccttattagcagcttatatataaaagacagtagaaaagactattcagaacaaaatgcttgcataatttgtatgctgctttttatgtattctgaacatgtgttcgtcttttggactgcagtacccaaaatgtgcttattcagcatttgacgaaatatgtttatgtccagccacagggccatttacatctgattttgaaatctgaattgataatgtaatttggtgttaaaaataacataggcatacctagggggaaaatacagtctctccctttaataacgtatattcctttgagtgttggctatgcattgtttccttgtatgatttggaaaattattttatcattccccttgctcctcagaaaacagaaagacacacacaccccctctttccgatttgttctgtttctgttttgcattctttgttactgggtctgctatataataccaaagactcttctttggtcataagtgtcatttgaacatttgatcattaatattgcctactgtgtttttaaaaaatgtgtcatactgcctgtgaagtatttttcatttcatggtcatgaaatcttttttattttccttttgtagttaaacaaaaataggccccaaaataagcaatgctattttctcaggactttattatttattaaccgagaaaggaaacttctttgattcagcaagataagtgagaagagccagctagaaaggagaagaaggtggaagcatcataaaggaagttttagtttttaattaccttaatttcattttttggtaagagtagtggttatgaacctgggaagtgctgggtctgactttcttgttgcacttgaaataattgctggaatgtttgatgtttttatgttgtttttattagttgtgaaagaatagtaattttgacaattgctatttttaaactcgatgagcattcttcaaagtccatttctgt

SEQ ID NO: 127754 - DNA, 1046 bp, Homo sapiens
ccaaggaggttctcagggcagtaagagatcttgcggtggagcagtgtccagcagagcagtgagccagcatagctggaagccacattctcttcatgatgaatgtagactgtttcctacagctttggtagtaaaagctagcggagcaaaaattagttgacatgtttcctagactttgggttttctgatcagtcagtgaaaagataattggcaattaacatgagttgctacttttattaaagaaaagggatttttcttagaattaagatccatcctttttaaggaaagataattggcaacttaaaatcgacattctctctctctctctttttttttttaagagagaggatcttgctgtgttgcccaggctggagtgcagtggctgttcagaggtgcagtaatagcacactgcagaatgcctgggctcaagcgatcctcccaccttagcctccatacctggcgtaagtcaatgttcttaagccaacattaatatgtaggctagtttttggagacagtaaattcagtcaaggagggaggagagaagcttgacatgagggattagccaagaaccagatgcagaattatcacaggaagccatgagcaggtatggacccaattgagagaccctaacatagttgtagtgagttgggaatttacttttattgattgtaaatcacatccttctggtccctaacaggcagtcactaaaaatgttttgagtaaatgagcaaatgaattgaaggtaaaagtgatgggggcagttttaaatgtataaggcaaattggatggatattgaatattctttcagtatgtctacagtacctttcattgtaattcttgaatattaaaagatactttttaaatctctacactgtcctgagcacacatatatatatagatacacacacatacatatacgtacatacaaacacacacactcattgccttcactttagctagttgattattagaatatattctgtacagtcacatttgttccagccactttgtttttgaagttttagtacatctgcagcctctcctggtgg

SEQ ID NO: 127755 - DNA, 1044 bp, Homo sapiens
taatttgagaataagagaaaatctatgataaaggagtccctcattccactaatgctaaatttcttccagtttccttttttacacgtagaagattatctgttgtagaggcacagctcttttcatgccatttctttttcagaggcagtttcacctctgatcttcatcctatttccctccatcccctttgggatccagatcaaaaaatcttgaagttctacttagaagatccttgtccctcttaccccacacgtctagtgttgctagtttctaccagtcctgctttataaatatgtctcaaatttatccattccctgcttttgatacttgttgccattgctttagtcgctcagtttcctaactggtttctgctactccaaacctaaacttctttaatccatcttctacactacttccggagtgatcatgtcactcccctccttctttgtgatttcttatcctcagcccttgaagtggaattccttgttgtagaatagaaggcctgactttctgactttatgcacactgatctcaggcccccttgtacacttcaaagccacgaatccttcctttttccaggtctgtcatgctattttcaaaatttttttctttctaccaaaaatgcatctaccaacactgacctttgacctccttcattatctgaaagacattttatccttcaagaatcagcgcatgtatccccttttcttccaactttttcctgtgcctgctcttactcacccttacataatgtaagtggattgctgtctgcttttaaaaaattattgtgattttgccatatttttattatagcacctggcacattgtctggagatgactcaaaagagaacacaggtgttatttgatgtattagtcagggttctctagaacctcacacaatcacaaggtcccacaataggctgagggacccacaatagcctgcaggctggggagcaagaagagccagtccaagttccaaaactgaagagcttagagtccaacgtttgagggcaggaagtatctagcatgggagaagatgtaggctgg

SEQ ID NO: 127756 - DNA, 1048 bp, Homo sapiens
gcacacactagattctcagtaaatatttggtgatttttatttggtaatgtgatttttttatggaaattaaggtcatatagttctctgtcagaaccaggatatcaagaacagggttgttaggaattcacacagttcatcgttcaggttttgtgctcctgtgtacctttggaccattgccccctaaaatagattttcatccaatgtttcttcttggagttgcttttgatatccaaatagacaaattacaaatatgcacttccaaatgtattttgtggtaaagttatgtaaagaggactagtttttatttaggtaattgtaaagatgaggctgaagcagataaagaaggtcttttgttttgcaatctttattgctttatgttagctggcaggctgcctgtgtttgattaaaaatgatagtctgtaaactccttaagttagaccattaatttcccatgacagcacacgaagcttctcctctcctcctctccccaaacagcatacatatcagaggagcctcctatgtgagacatttgtttaacgttgcctgtcagaaaaggtgctacaacaagtcagtcaggtttggagtttgcaaacatacttccaccttactgaacatcacaaaggctgtcaaaaatttcatgtccttatattttttcttctttccagaagaaaaaccattacagatgtaaatgttagagaaattttgtcatacactttggagcttctccaagaagtatttttcatagcttggaaaagaggaaggaggcctctgctgacacatttgcaatctttccagtagtttgtgtgaactttatagtttactaccctacaagaggctagatattttttcttctaaatactacttatatctcattttctttttttttcttgctttctctgaaaatgaaagtgtaagctttttcaaatggccttgatatttctaaaatttctgtttatttttccttttactttcttctcagtcttctagatgctttccaccaaacccacttctgggaattatccacatgtgtacttacttgggagtttga

SEQ ID NO: 127757 - DNA, 1031 bp, Homo sapiens
ttctgatattattttatttgatggatgttgaataactactaagagagaaaccagttgctcttcaaaatataattagcaacaccaggcctggagaagtttacatttggttgtgacaaagttagtagtatgccctctgcaaagaagagaaggggaagatggatgcatttctaatgcaatcaggaaacccctctataatttaaatatattagcatatcctaagaaacccaggtatttgaatgttcctaagacagctcgaagcctttcctaaacaagcatgattaaattacttggagcacattgaaacagcacacatggcccttaatggatcagcattatcaatatgcattttcacggccaactccaggaaagccatcactaaagccataaggagtcaaattaccgatgcagtcctaatgattttgcttgcattgctcacatccagtttgccactaaatgtttgacggcacgcaaacactgaatttcgcaaacattagtgtcatttcctacttgtccctagaaatagtaatgagcatacatcttgaatcctcttattttggatcatatacaagaaagtaaaagttttcaaatattctgaagtctgggcatgttaggataatatgacatggaactaattatgtaagggtacattctgggtcatttgaaatttgcgtatgtattgcaaaggtcacaatcaactcaaataaataataataagagctaaaatgattgagccctagtgatgagctcagctatgttatcaacactttgcatgtagtatctaatttagtattcctagcaactctgtgtggtaggaaatagtatcacccccgttttatagctaaggaacctgaggcatggagagatgaagtagcttgacaaagaccaggctattgtaaatgggtggctaggatcaaacctagacagaaggaccctagagccccaactcttacctccaactctatgcctcaggtgtgtgcctccatttaaaacccttaccagaggaggctcaaaggctcgaggactcttccata

SEQ ID NO: 127758 - DNA, 1315 bp, Homo sapiens
tagatacatttatatatttatttggaaaaggtcgaataaaggatttgcaatttgattcagaaacgtcattaatttttaaaatttatttacttgcttatccttttctgaaaagactgtgaaacagttgcctgaatatttcgtttgaggggcagttaaaaacagaagttgtggaaaaacaatgtcggcaacaatttatgaaaggaaagcattggacatatttaatttttcttacccatttctcttgaaatacctgtgctttcccatttagtgcctttaatatcacaaagagagatgaaagggattaattttgtcgatggtggattgcactgaagcttgagtagacttttttggtagttttacaagcctcagtataccactcatacagggaaaagtcaccttggcttttaaatttagttgagcattttcttgagctattattttaaaataatagtgccccctcctcttttaaaaattactggcattgcaaacccttttttataatttcttcccaatgtttgcaaaatcccccttaggatacttatggttctatggaattcctcttctccagatattgacagaatcattaaacatgcctgaagcttcattattacttttccagcaccactttctttgctctttatcattgcatttagttatgtttcatctagttttcaatacacatgatagggttcatagcccagccaaatggaatgaatttgatagctaagcatttcacaggctggctctgtaacatattctgccagaccctactgtgtgtgaagcattactactttttcttttttttttttttttttaaccagtaaagattatttataactttgatttctttcatgctcatttgtgttcctgaagaagggatggaatggtgtaccccatcagagtgtttctcttggctttcctgtatgtaaacctcactaatactttcagtcaccaccttctgtgtcattccttttaagcaaaaggagaagaagtggaattgggttcaaggccatgctttgcttttcacaagagagtgctctcagaagcgctggtgtagttccaacaccttatttctactgctgcctgatagtggcttgaagtggttatttagagggagagggtggcttggtaggaatgtacttcattcagtatttttgttgatgctgtcattggaatgaacctcagtgaatgattttaagagcatagttcttagaagttatgatgataaatgactgaatgagaacctatttaatattatgtcactactttggggaaaaataattttagctgagtatttcaggagtaagagaaagtt

SEQ ID NO: 127759 - DNA, 1969 bp, Homo sapiens
ggttatatgtttgcatctgtaatagaacagttgtatgtaatgtttttctacatattacatggtgggcctgggggtgtcttcagagaggaagaagatcattattaatattaatatgttatattagtaagtagatgctatattttcagattctctattactttgaattggtttgtaatccaaaaccataacttagctttcactggctttttcgccctaaagaccaattgccatgataaaatgctctcaacatatctacctataacagttgagaatactcactgtactaagatgcccctttacttgtaaaactgtgtatcaagagtaatttgttaaagtgtacaggacctctctttactatttttgcactattttgtgtttgcacacaaatgcagcagtacatttatctctcagaaatttcaattctctctggcaggttgatagggtaaataccctctctaatctttttttctctgggtcttcagctctgcaaatatcccctcattccttgtaaactgtccaaagctcagcaaatacctttccctatatagctgagtattctttcccatgttgctccattttcctcccttttgacagataagaaaaggtaagcctgactttatgaacctttttctgagttgtcactctctaaacaactttcctatttctgaactgcccagcagaatttggagtgagcaaattagagatattgagaatggtgtactctctgtccacagctaccttttatgagtacgagaacaggaaaagggcaagagagtgcccagggcagcagagaattcagggctagagaaattctgtttctgttggccaaggtgaataggacacaagaaagtctaactacaattaagaaacctagtcgggaaaggtagggatagtcatggaagaagtgagtttcctctagaaatttttccccctttgggactcataaaatagggtttctaatagatggagttttgcctgaataagaaatcgagcagtgcactgggtggtctctgtcattacagcaccggttctatgcatgtgtgaataagggcttatccaaatcaatcctgcatgaaagaatataccttagtaggaatttaaaggaggaccttaaattcattagtattccgagaactgtgagtgaaactgtttagccctgaaagcagcaatacagctgaggttcaggttttagagtcaaactaatctaagttccattcttgttttagtcactgaacttccctaagcctcagttccttcatctgtaaaatgggaatgatattattaagttttatgggattattaggagaagatgagccgttatacctaaattaattagaattgtacttgaaacacaagtgttgttaaatgatattggtacaggtggtggttgtagaaaccgaaaaatggatggttaaatggattaacacttttagaggatctgaggggccttagcatttgggagtgttggttatggatagagcaaactgaagggtatggttgtattatctgctccttccctcttatctcagtactgggcgcagcagttctctttctttcttttccctattgctcaggcgtcattcataataaaatatagtcacacatcacttaaccatggggatgtgttctgagaaatgcgccattaggtgatttcatcattatgcaaacactagatgttataacctactacacgcctaggctgtatggtatagcccattgctcctaggctacaaacctcaacagcaggttactgttctgaacattataggcagttgcaacacaatggtaagtacttgtgtgtttaaacatctaaatatagaaaaggcagagcaaaaataccatacaaaatgtaaaaaataatgcagctgtataggtcctttaccctatgaatgttgcttgcaggactaaagttgctctgggtgagtcagtgagtggtacgtgaatgtgaaggtctaggatattactgaac

SEQ ID NO: 127760 - DNA, 2580 bp, Homo sapiens
atagaatatactgctttcttttcagcctgtgaaaataaattaatgagtttgaatattggaagaaatagaaaatgaatttgatcttataaagcatccacagtatgtatgtatgtatgtatatctgtgtgtgtgtgtatatatataactggaacagtgagaatcactatttttgaattctgaaaatattaagaaggtaataaccccctcaaatacagaaaaagcgctagtaaaatggtgagtgatcctattaaggtaataatgcaaatgagacaacagccaactactaatgaaatgacccatcacagacacatatgtgttaaattaattgtgaagacttcagtgaatccttacagaacaaaaacacaagtgcctacctattttaaattgtttccatcttaagcagaaaatatttccagaaatagtagaattgcagttatttgtactaaatgaatcaggtctgacttactacgtatgatttgtgccagtacactaacataaatttgaatgttgtgaaatgatatagtatagctttgtagtgatttgtgtgaagttgtatatacttgtctgaactttacttttgatggtttaggaattaagttatgattttgggacttgaaatgagagtaattcagaagagcatttcaaataacaaatggcacttaggggaacaaaagctcatttatctaatttaacatatgctgtgaagatgtggagacagccaaggagaatatcagaagtggcacatattatctcttgtctttttgttcttagtctggaaaggtaaaatggcatttcctctaggaattgaggcatgactaagaaaaacaagttttgctaaatgcatggtgacagttgctggtcccttcgggtttcatattaaattaatgatgtgaatgaagttcagcaaatgagaagcatggacatcagtttctttccattcctagttaatattcaacccaggaagggatggtcattcacagctactattaagaaagctttagagttttgttactgagcatagagaaataaaattttaaatatcaaaattttacttccgagcattttttttagcatggatgttaaacaccatcaacagttctgtattagttctatcccaactcccttgatagatacaattaaattttactgatgttggtattttactaaagagggtcattatacttttagtataaactgtaattctaagcagaaatgatcttcagtttcccaaggacagcattttgtaagtggtgtgcgtgctttttgagtttcttctcatctaaccagagttgtactgttatgttagaaatcagtgtggatcctaccttggttgagtttgggctcagcattgggagataattgagttggttacgaaggctgtgtggagaaacttggaactgggagatacaggttctctgtgcatcttgtaatggtatgcatggtttttgctctttgacactttatactcaacgcttgaaataaatcttatagaattggctctgccatgaacctactgtgggtccttggactttgtcaaggcttagtttgcttgcttatttgttcattggtttattcattgattcattcagcaatcaattactgaacacccattgtgtggttggctctgtactagccaataggaataaaatagacatgagtcattccaaccctcatggtgctcacaggttagtgcgggatataggcaatcttacagaaagcagttaggtaccaaaaggatgggagagtatagtagagtaatctaactctacctttagggcagggaaatcctcctaaaataggagatgtctaaactgagaccctagaggatgactaatattcagttagggatatggagaagaccttttctgtcagaaagtacagcatgtgccaaggcggtaagaaaagagagagagcgagagagatcccaatacatccgtgaggactgtttgagtctaagatctaccagattatgccagtatgaacttgtttctccattagctcttgcactttctcacctatggtttgaaaatgcaaccaggtgattataggccacacgacccttctgccagtatgttttagggcctttaaggatcccagcaggttaaaatctacttatctacttacatctgccctgtgcccaaataaggaggtccacatctgttactgtgtctgtccctgccgaatatcctctgtatggccaggctgctatggggctcatgttgcccatgccccaaaagtacatgattgcacctagcctgtgggctgctgtctcttcacagcctgtgctaactgaaatcatgagattggctatgtctttggggtaacgctgcagtttacagtcacctcttctacagatttattatgatagtgaagtaagttgtaagcacaacggaaaattccgacaggaaaggatgtgtggggtggatgtgtgatcaactgaagaggtttcctaggaaggtagaaatcaaatgagatcttgagtaaaggtaacagaaaggaatactgttgcaataaggagtaaagatgtggtgtttaataatcctgtttaatctcaatgcatagtttatggagagactagtg

SEQ ID NO: 127761 - DNA, 2536 bp, Homo sapiens
tgctgtgtaccaactacttttcatgtcttatcttaattctcataacagtcatttgatattttaaaaaaccccagaaatctgagaaagagataaagtggtttgctcaaggttatagaacagactaccatgtgttgtatttcagattttaattcatgtttgtctgattttaagttttgttcgcttgccagggtaccccacaaaaatgccaggcagggcattttcatgatgcacttgagatacctgaaatgacagggtagcatcacacctgagaggggtaaaggatgggaacctaccttccatggccgctgcttggcagtctcttgctgcatgctagcagagccactgtatatgtgccgaggctctgagaattaactgcttaaagaactgccttctggagggagaagagcacaagatcacaattaaccatatacacatcttactgtgcgaggtcattgagcaatacaggagggattttatacattttagcaactatcttcaaaacctgagctatagttgtattctgcccccttcctctgggcaaaagtgtaaaagtttgctgctacaaagaatacagaaaactcagaaagaaatgctaacatacacatttagctggccctatggatatatcatattaactgcttatcgttaggggctgtatatttgtaaaataaaagaattttgggagttccatctctcggctttggagcccccctccttttgtctctgtatggaggagcttcgtccttctgcctttttctttacctgttaaattctccactccttaaaactaaaaaaaaaaaaaaaacaaaaaaaaaaaaaacaagaattttgatcacagtcagactctgtattttaaaatacattgtaactagtgagctgggtgtccagcaggagtttgatatggcaccatgctttataggactatattggtagtcctgtaaagcatatatagtcctataaagtatggtatcacatcaaactccttagtacttagagagtagtaagaaattaaacgtgaaattaagaaaggctggagctaggaatttgtatttgggagccataataatagccagcatttttaatatgcttaatatgtgccaatctctgtgttgagccttttatgtggatgagctcattaaatcttcacaaaaactccacgaaggtagtattaaaacccacattttacagatgaggaggctggcgcagaaaaggtttttgtaatttttctcggttcacacaactgcaattgttagggcgagattcaaaggcaaacatttgtgatgtttaaatctgaacttttcattcctgtggtagtctgcatagaggtgattttggaaccttaaatatagttgaaaacagggctccatttaatcttagaacatacccgtattaagggtgagagaagtgttgaggtagcacatgatgagatagcaaaggacacagaaagaaagccagtttcgggaaaccatgcaagggtattatttagagaagaagagagttattaaaaactacaaagaactcaaggagaatgggagggaaattatcagatatagagattatgtgtctttagggactttgacaagaacagttttgagtagagcatttagtcatatctcaatatgccattcattttgaagctttggattagtttattccatgattatcctcacctatcacgtatggctagtttaagagcgttatttaatctagagtaacagttctgaatgttttttaacaacaacaacaacaacaaaatagcgcatgtgacacttcctttacttctttgtcccattcctcctcttttctaaaataaacaaatatgtgtataaaacaagaaaaaaaaagtgtgggatagtatctgctttactgagaacagcagaagtagctatttttctctattttgcctaggaagtattttgctaagaagcagtagatagaagatggcagtaggtaacggtaaatgtgttagtggactctcttgaaagtggaatttcctatactttttactaaggtactcaaaacatctcacagacctgcttcgtttttataagtatgtattgtgcaagtgatatggctgttaattttctttgttttcccttttgcagtggagaaagtgaaacagaaaggagtggtgtgggacaaatgcaacccccagttttccttttctgtgcagtgtctcctagtctgcatttttcctgctgatcagaacaaagtgtcaccaccattgtgaccagctattctgacttgttgctaaatccatctatagtatttgatgtggctcactggtatatcctctttgaaagactcccttcacttagctgccaggatacgcgctcttctaatttttctcctgcctcattgtctcctcccaactctgtcccctccatctccctgacctcttactagcctgtagtacccaggggttagtcattggccaccttttcttctttcatgtacactcacttccctggtaatctgatccattcctaaggcttttaataccgtctcaagctgatcacttccaaatttatatctc

SEQ ID NO: 127762 - DNA, 6645 bp, Homo sapiens
taggccatcctgttgaaaactgtgatatcttcttccagcatgccctactttttaatttttttctgttgcccttattaccatgcacatattttatctgttatctggaaatagaatataagttccaaatgggcagggatttttgtctgttttgttcactgtagttttcgtaccacttagaatggttcctgacatacagtaggccctcaattaatgtttgttgaatgaatgaatgaagtttcagagcctaaaatagagtggttgagtcagggtatgtcagtgtatgttggtctgcgagtacgatttttctactgatctccaaactacagtctcaagacaacagttttccacctctgaacagaggtgcctctgaatacccagatctttatgtctgtgaacaagcactgcctattagagccaaacaagagaaacacatattaccatctccaattctttagaatccttttggcccagaatgacttcaaaatgctaacccataaaggcaaacaaatccagagacctttgtagtttcccttagcctctgctgcattagctgaagataaatctatgcagaattcacttaagggaacagacaactacattaagctgtgtaatgatgaacattaatggcctgtgacaaaatgggtctctgtaggctgagcaaccatgcaaggtggggatttttccctgtttttggtaaggtaatgaagaaggaaaaaaaaagtctcatccaaagatgcaaagaaacaatctgctggcccaggtcattttcatggtatctttttgtttctcctttctttgttttgtaagtacatgcattttggctgaaaaagatacaggcaccattttacagtggtgggggaatctctactttgttaaagaaaaatgcaatgctctttatttccaacctggtatagttcattcattccttttcctgtggtattcacatgtcttgcaaattgttatgttgaattttttagttccttgttatttttacttgtagacacttacaccatggtcacaggaatctatactgatttcttccactttccatgcatttgtttccattattaatttaagtgagaagcatgtgtgtcattccccttcccatttgacttttacatggttaactggtgatctcaagttgatcagttaacttttcctattgtgcatgattgttgtggggatcaaatgtgtacaaatacgcttcataaattgctgtaaacatttaagttaatggtgcttatgtggatattagaccagttgatttgtagacttgaatcattctaagacttctgaaagtaatccttctggcaaattctataaattaaggtaattgggatatatatacatatatacataaaatttggggtttctacaagttgaccatgaactattgaatgatctgaagtggcctaggatttttttataatctattcagaatgtcactgtgacacacatactatattttcagtatttgcttctcagatattcagaacactttttaccctacagcagaattatttgacaacacatttccttcctgccctctgaatctccctggatgatctacaaaaatatagcatctccatttgtgacaatataaaaccctggtatgactcttttctataaattcagttttattgccttcttccaaagtaatttctgttaatccagccagaaccttcatttttgttttgtcattttcaagctagattctgaagtaacagaactgactacaattttagcctaagaacaaaagagtttcaaggcctatttcaagaccctggttttgctacctcatctactaaatttatacattctaggaatccatttactttttaaaacatttcttttcttattttcagtaccaatttgtttccttcagctttcccacatgcatgacttttatagcatggcataaagtagagtgctctgccatattgatttaatggtatgtttcaataaatttcccctgttacagttcttgctccataccaggcatccaagagggaaatagacggatgtgctggttaactaattttaaaagcgaaaaaattccattttctccatcctttaatgtcatagctgtcctgccaatgacctgatactgagatatattaggttcctctgacatatgttacaggaagtagtgacctgaccttttaaaaattttattaacatttataaatttgttttagtgtattatgttggaagcagtgatttttctccagaatggattggggtgactggtgtacagattgatagccatgtcatatattaaggtggtggacattttgtagagtccaccatctctatactcacaatatattgtagagtatagagatgctgtctttttttcccctccctcttctctcctgcctttaagggttatgctaatggggatggaaacattcaaaatcttactttaatgcagtttataagcaactagaaccattactgtcagctttttggtagctggttggctttgactattgcttgataaaacattgagacatggacattcatccatttattcactcaacctttgctcagtgcttaatgtattccagacactatgccagtcactaggcatgtaagagtgattgccacaatacctgcttccaagtaatttatagactgatggattaggacccagtagtatacaatcaagatcctaatcaaagattttttccttcttcaactctgttcaaagcccagataagtatcatctctctgtctctttttttaaatttttgtttatttagagggtgcaagtacagattcttacatgcatatattgcatagtggtgaagtctggacttttccagatgggtgtcttctttttccctcctttccctgtttctctttccttttcttccattctctcttagcacttcctaggaaataatttatatatatattttgtaggcacaaatacttgtcatacattaagggaaatctttattgatgtaaagcattggaacttagctatatccagttttattgccttagcaattctcttctttcctccataccctaagtaatcgaggagagtgtggctttagacaaaggacacctctcctgtgacagaaaacacaggagccaggagagttggcatgctggctttctaacctgcttgctgcaagagcagttgtgagcaatgatgatgactgacactcacatccatcatttgccttcttccaaatgcttctgaaactgaaatgaagcttcccaacacctcagtgagtatagatggctgttttattttatagtaagtatttgtttattttctagacagggaaattgagggactgagaatgtaagtggatagataaataagttatggacactgctgggaagcattagctaatgtttattgagcccgtgtggagtgtaatactttcctaagccctgtgcagtgtattttgtttctagttttccactttgtacttgagggaagtattccatggatcttcttgttttgaatttactcttttgtcttcatagaaggttattgttttgttgttgcacatttcacaattacatttgcattttcttcaaacattttgttttttatctttgctatgcaagacttaataacaggaattttcgctgtatttccaggctcactcactcagttttggaactttaaattgttccaacagtcactcagttgttggaactccaacaactagtgcatttggtaagaactcttacataaatagcctttacaatcaaatagacaaaaaatagactgtgcaaccaaaaactttttgctgttttcccacaaaattatctgaatttgtttgacttgagatttttctttgtaattttctcatctgctgcctatcctaagatttaggatgtttttaccttaatagccatatcatgttttaggccttagtgggcctctctccttcatgctctacagacaaatataaagtgactcagtgttaaaatctgatacactacagaagcactgtatggtttatattcggaatggttttttatgtcaaaggaagtgcaatgaatataggcaaggaattaaagccattaaatgtatgaatggaaaataattttatagaaggtcttatttttctcataaatgtgttccagaaatgtaagtccaataaaaatgtatacatacagaatattcagtggtcatctttcggtcgtgttcacagtcatttgcctaatcgcctgttttctgaagcttttctataagcagggcaccccattataatggtaacaatatagtttttttcttgtaaatagattatagttcatacatctgattcacttgttagtcaattgtttggaattcagaatgcattttctcatagacatcatcttatattatcttgattggtgcaaccctttgcaacacaggtttatccataatgtatttctagtatcatactgtggctttctgaaatttaactgaagtgttaagcatgtgtcctgggaatggatttagagtttgacttgagattctaggagcacatttcttcctactgaatgctgtttgtgggatcagaagctcatgtgatgttaggacatggtcaacagaggggatgttaaagcttatttagtccaccttcctttgttttgagaatgagaacatcacctccaacattcccgagttatggttccaaggacctgggccagaggtgcctttctggagagagccaggtggtgaggggcagcctccaggggtcactggtataagaggcaggatgtggcctgggtcagatgacagctttggggtgaggcatgggaaggggaggaggtgatgggggtctgaggataggagtgaatatgtgggtcccttttgttatgcacaatagaattgttctcccaattttttttttttttttttgcctgtcacttcatactctattctatttacttccctttctagttagtaaggcatgttgggtgaactccccttttttggcaaaaaggcatttacctttctcttccccattaccactaccagcacaccaatacagattttccccctcgctcagggaggccatgactggagggaggggtaaggagccaaatcgagctgtctctggtggatgcagcctttacagtggtgagaggaggagccgcgggatgtaaggaaaaggagctcctatggcctggctggagtgtgcagtggatgaggctgcctcaatgcagggcgagatccacacatcacatggtgggggaagccattgctgaggtggggagggtaaacaatgctagctttttggccaggccagggcacctgtgtgggtgtggggaggacggttgaagagtgctcagtgcttttctttggaatcagaatttctgatttagtgacaaatcatggaaagtttagaatggaaactttttaattttagaaaccaattaaataatattcaaacacagcagtgaataaagaactatgttcgctaaatgcctgtgtttaacatgtgagaagatatgtcccttgaccctgaatcttctaaatatgtacagttttaaaagatagaaatttatagtgaaatgcatttgcgtatatttggggtaagagatggtgttcagaaagagagggaagctagatgggctgaaacatgaaataaattccttcagagtcccttccactcatgtaaagctccttgaagggcgtcaggagacaacattcctgtttctgaggaacacttacaaggactctaaggaatgttgtttcccttattatatttttatatcaaaacattttatttccacagttattttctttacctaatctggcattgtagctgtgatttggcgggggatggggtgttaggaagttcattttcttttcaaaattgaagtttttaatgaacttggtagatttcctgaaggttagttccttcaacttttggtattacaaagtcatgattagttttaatggtgaacattaagattgcaaataactgctgtggcgagggtgtttctttgtgaatttgaagtgtctcgtttaaagattggtgcctacattgctaaggtgcataccaccctcagtagctatattaacttatctcaggttgcagagtctttggggttgtgcttgggttaaaattctagccatgcagctttgtgacagggaaagttctttaatcatttgaacttgtttcctcacttgtacgatggagcaaatacctagctcaccgtgttgttcaagtgtcaactcaaatgatattatgtgaaagattctggcatttcctagctgcctagccagtgtatggtttgtttcaatttgattccatgtgtgactgcatgctcttggcctattgctaacgagcaggcagagaaacagcagcagtacagtctggctagagggcgtctgttgagcctccaaacattgaaggctactttgcctctttgtcaggggcatgagcctccagaaactctttcctagatgcgctaattgtgtttcttcttcctcactgtgtaacatgttatactgggaatctctcctgaatgtttgtttgtgtctctatctctatattttctatgacagtatttgcctgactgaggtaatcccaactggagggctgaggtgacagatttggagaacattcttacaacatgctgttcaagcatttaccaccatgatgtaataagtgtttg

SEQ ID NO: 127763 - DNA, 1081 bp, Homo sapiens
gagttcaagaccagcctggccaacatggcgaaaccccatctctactaaaaaatacaaaaattagctgggcgtgtgttggtgggtgcctgtaatcccagttactcaggagactgaggcaggagaatcacttgaacgggggagtcagaggttgcagtgagccaagttcacgccactgcactccagcctgggcgatagagcaagactccatcttaaataaataaataagtaaataaataggatggatttggctgccgtatgaagaatgtgctgtaggggagtaatagtagtggcagagagcagaaagccattgtaataattaatggtaagagatggtaacagtggaggggagaagtggtcacattctggatgaagtgtgaagatttgccagtgggtttaatgtgcaggtaagaaaaagaggagtcaagcatatcgcaaaggtttttcacttaagtaacagcacaatggaaatgtaatttcagaagaccataggaagactacaggaagaagctagctggagagtaagatcgtgagtttggtttgggacatgctaaatttgacatctctattagatagtcaagtgtatgtgttgagcagctagttgaagtacatgacactaaaattcgtaaatgggaattagactagcactgtccaaaagaactttctaccatgatggaaatgttttatatcttcactgttcaatataatagccactagtcatgtgtggatattgagcacttaaaatgtacctagtacaggccaggcgtggtggctcacgcctgtaatcccagcactttgggaggccaagacaggcggatcatgaggtcaggagattgagaccatcctggctaacatggtgaaaccccgtctctactaaaaatacaaaaaattagccgggcgtggtggcgggcacctgtagtcccagctactcgggaggctgaggcaggagaatggcgtgaacccgggaggtgaagcttgcagtgagccgagatcgcaccactgcactccagcctgggcgacagagtgagactccgtttaaaaaaaaaaaaaaaaaaagtacctagaacaactgagatatggattg

SEQ ID NO: 127764 - DNA, 3307 bp, Homo sapiens
atctgttcatcaccttcattatagagcaagtcacgtaaggatttatctctttgaaacccagtcttatcccaggccctagcaaatagttattgctttataatcacttttaaaatgaacaatgctgaacaaattaatgggttactcgattagcctttaaaattttttttcaggaaatatgctctcttctttgaggtccaagcactgccatcttatagctgctacctgttggaaatcccagattctgttaatgactgacctcttactcatcagccacccaccatcacccctccccagttcttccagggcttattttagaggagctggattggagatagcctcagtatttcttatttcagcagttgaggttaaagagccaaacatctgcttagctctggactttctctttctcccttactttgctcttctttggttccttaaaggagtacttaaagggagttagtttctagatggggaagctagcatctgtatgtatacttggactgtggtaactggtaggaagttattgtgtatggttaaaaagtagattttaccccaaatctctggtagctagatctgattatttttccattatttttctcatcttttaattcttctggacttcaagtgttgagagttaaccttgcatctcctgtctttctcttttccccttgaatgaagttccattcattgttccggtgtatgccctgattcagagtctttcttggtctcaccacacacacccttgctttgtcttgaagtactctaacatgtctgcatttggaatttctcctgcatgtcccaacctctggttgtattctttgcacctggctctgccttaccttccattctgtatttgatatactgtttcctgtgctctctgagctattacgttagcatagaggtaaatctgaaaaacaagaagacaacacacatgcttcttttccttgccatttttaagatgttgattataggtcttgtgggaattctgttaagtatgtttttcaataattactatggcattctgttactactcatttttcttgttccttatatctgtgttgtaccagctcataatactaaacaaatattgtaattgacaaagaacatgcatcctcattcctattgttaaagccactcacagtcctgtaggaagtgttggtacagcactgtatgaggaagagcagatgctagggttgtatggtgccctattcttaagacctactgtgactttctatagtggagttcaaggaaggcaaggaatttgtgtcactctcaaactctccagattttaaacctgccaaggaaaaaatgcagagctggagcttgccttgaatgattaaaagtcacatgaggaatggggaaagaaaatcccaaaggattgatggctagaaagtagtttatagtcaaaagctataccaaaagcaattgctcgaaaccctagaaaccacaaatggaaatgagagtggattatatatagtacaaaagacaaatacacacacattccccacccagtgggctttactataaaacaagccaattaagacaaaatgcacagtaattaggaacatcttaggtggggtcagggttgctggatttttttatacattcatacacttaatttattttaaattttatcacgataattacattgttttaaggtttgaatttttgcaattcaggtatataaaaatgatagattaccaaatgagtttggtgtgtttaacctcatgattcacttatatgccaataatgtgccttgcctagaatgtttgctttctaatgtttctgtgttactccagctgcctccctttattgctgtcatattacaatgaatgttttctgcatatttatgaagagcctattagcagcatagacttgatttaaagaacttctccagtttatgaatacagttcatctcttgtgaatgaatttagcactttaatgctatttatttactccacaccataaaatgtactataataaataataggtcccttgggcctatggtaaaactcactgatcatcctctcagcaggaagatgaacacaacttgagtggagaagtaaccatcaaagttcaccatgctcactgggatgtcatttatatacctgaatctaataaagacagaattacagtgcttaacattgtgctcactactagcatctgaattcagtgagactcagggagggaaaagactcagtcacattagcaacatcttagaaggtgatacaaagtctaaattggcaattcaaataagaaagtgttctttaaaagcatataatgcttaatttcttatgctaaatacacagtaagttagtgttttccattttcttcacccatggaaaacccttagttttggagggttgtgtttttggtgggggatggtagggggcaggggattgcttcaaaatctcttctctgtcaattccatttggagttttcaaggcgaccccagctgtcagctatccataaatgcaatatctacaagccaggacgtctgtgtggcatttggtcagtagggccattctgttttatggttgaagtccagaaagagtcaatatatgagtgttcaaaactctttctagatgaatgtatgcctgattatattctaagattatttgggttatttttgtgttatctttgtttttatttgatatgatttgcttttgtagatatttgttcctttaaataaatggtcacaaatttgaatgcttaaaatttgaaaccaggcagtgtattatagaaacagtataggccatagttctgtatcagggaagagttgactttattctggaagatttttaggtctgatttactagttgtctacttctatgtggacaaatcattctgctttgtagattatttgatttagagcagactacatatctgatggctctgccaagatgaattagcccctcactacatctccagataacggcgtaggagtgaggaactgtataccgtatccctctaaagagaggcttcaaaaagcacaatcttgatttgggtggttgggaattgttcctttgttggacagctttaattattaaattgagatgaaatatgccagcttatgatttttaatactaatttattcaacctcaaaattcccagtgcaccatttggttctcttctcaggcaaattgttagtttctgccttgtgtattatttatgcttgtactatgaataaaggatgtctcatctctatgtggcaatgtcgtctgcttcatgagctgacagttttgaagaggaacatgagacagtcagatctgttagtgcaactcagtcaagcaggtggtcgcaaaat

SEQ ID NO: 127765 - DNA, 1743 bp, Homo sapiens
aaagaacagaagattcttgttaacatctttgttaccgttaagatgtattgttgtttctaggaacaaatgacaaatcccatgtctttgtcattccataagccttctaccaaatccatgggtcaaagtgccgtatgcaggtgatttactgtgcttgatttgttccatgatttcatctttagacacttccatctttgtcaaggccatgctaatctcaccacagagaatgtatactagaatttctcaaatgtcaaatatattgtgtacacttaaaaaaaagattgtcatctaagtttatcaatcataaaaataaaattccatagtttcagtttgcaattacaagcttgtgtcttaaagtttgttttgctccgatttttaatttggctttttctttctttatacatttcagcttccttctttctctaggttaatttcgcaaatatttcttaaatgttggctatgtgcaaagaattgttttaagcaccttaatagctacaaagataagtaagagcttatctctactttctcctaccccaaggccacccaaacctgctaatcaatcttaaatccttctctttctgctaaatatcattagaaggcatcactttgagggctttttttgtattagttgtaactgagggatttttaaaatattttaattggttattattggtagatatatttgagagaccttacatcacatagtgaattaggatgtttattgaatgtcctataatgtgttcaacagtgtactgttgttaaaaagcatcattataattgtactctaaaacttgcaatttttaatgtcttcattgcctcctgcatttgttgaaatcaataataaccttttaaaaagtatgaactttatgatatgtaaattatatcgcagtaaagctgctatataaaaaagaataacctaaagtatctaaattatattattgggtgttaaaacacaaatagccttctcttgttagatttaatcccacatgtaacaaatttgctgggccattttgcagcaccatagattgactgctttattccacatactacagttctaaaacatgaggaaatcttagttaactaattgaaacactcatttggataagaacttgagcatggttcaataattctcaatttcccactttgcttgtaaaacacaatgtaagtatggaattaccctcttcacagcttattgcactatgtgttcagtcacagagaaataatttaaagcagttcacttccaactgtttccctcatgctgacccctttcttaaagtaacgaatttctcaaggttatgtttattttgaaattataaatttagtcacatacctggttggtttcattctccttttgttgttttcccctttggaatttccacactgtgtcaccaagcaagctcttgattgctcccaccctctttttttttttttcttctttgttgagacaggttcttgctgtgttgcccaggctggagtacagtggtatgaacacaactccctgtatcctcaacctcctgggctcaagtgatcctcctgcctcaggctcccaggtggctgggaccacaggcgcatgcctccacacctgggtagtgttttttgttttgtttctttttgtagagctggggtcttgccatgttgcctaggctggtctcaaactcctgggctcaagcattctccccgccttgacctcccaaagtgctggaattacaggcatgagccaccacacctggccagcttccactgtct

SEQ ID NO: 127766 - DNA, 1061 bp, Homo sapiens
ctggccctggggagtggttttagctacacttgaattccaccttttcctcataaagtggtatggacatcatattaactataacactattataatcagttgacattgccagtcattatttgagacaggtgtttgttcttctagaatttgcattttctcactgcagaacactgtagaatgttaaagctaaaagattgctcataaatggccatatgtgagaacatgcagtacattaacttgctcatttgtttatgatttaattatgagagtaagtggaaaagaaggtttagagtggctaacaaatgatactgtctcaatattaaatagtgggggctttgttgttgtttttataaattgggtgaaagtccttcatgcttttaattttttttatttaagtaatttatatgttttctcccttccaaggaatgaattttattcttcatcataatccctgcaaattagaggctaaaaatctttgttttacatctggagaacaaatggatgttcctgcttcattctcagacaagcaagtgattgatagctttgatatcagattctgaaatgaaataaattttgtctcaatttgagagaaaatagtgataatacaggtcctttctgccaaccaactcaggcatatgggccttttatttttttgatcttttttcattcactacaattctaaattgaaaaatctcacattttcttctaaagttgatttaacaatatagttaacacttaaaaatatctaaaataaagaatataacacattctactgaaataggcagccagcagtttatacatatttggtctaatacattcctcaccttacataaatctccagaaaagctataggaaggaaacacattcccctgacacgacaggacgtaaaatggatataaaccaattactttttgcagttcccagagtctcaggaatactgacccttctgacttcattttcaagcaagaactctccacccccatcttgtaaggaaaaataattgagctgaatttctagcaagaagcgaatcaagattttcaaagaataatttcgctaggacctat

SEQ ID NO: 127767 - DNA, 1034 bp, Homo sapiens
cacagaagtcttttgatgaacttttcccactttaaatacatcaaacgaagcaaagagagtagagaaagccattagaaaatcattataataaataccaacattgatctacttcttccctctcctttggaacctcccctttccttgtttttaaaccttttagttgagctttatatagcaaagtaatcaaactctcacaggccattataaaagaaatttaaatgatttttacgaaaaccattttccttgtttaagatttcagggaacctggtcagtactgtgagggctcagtttttggttgtgactttcaagttgaacctttttgatggtaaatagcctcctgcttatgcctgtgtgttttgacttaaaaaaatcaatctctgagaaaatgggcttccatcttcctttcagccccgtctcctttgatgattgatgttaattcagtaagctgctgacccaagaaaaaaagaattgtttgtgctgttgttttgaataaataaacttacaaagaatcaatggctgtaacttagagaaattaggtagtagagagcataaagtctctgtcgtgtttctcatgtaaataaagcaaagtaaagggcatttcagcaccagatatctttttgaatgatgaaaacttgcttcaagggcaattttttttttaaataaatgttctctctgtatctatagtgagaaaggtctgtagttgtgacaaaaataggacaccttctacttattcacataataattcgaataagtagcgaagcaaagcaaattccttagtcactgggcccagcttacattcaatgttgttagtatgtggacttcagtcttcctaccatagtttagagaaaactttttgaaggactttgtaacaccatgattcaattacctcctcctgggtcccccctacaacatgtgggaattctgggagatacaattcaagttcagatttgggtgggcacacagccaaaccatatcatggagcaaaatgattagcttgcatattgtatgaatttggcctttacttctcggtgttt

SEQ ID NO: 127768 - DNA, 1395 bp, Homo sapiens
catgattctgaggcctccccagccatgtggaactgcaaatccaattaaacctctttttgttcccagttttgggtatatctttatcagcagcatcaaaacaaactaatacaccccatgtctggaattctcataccaggtttataccattaagtttgttggagtaacactcagataagcgtggatggcattgtggaggaagggcaaaccctgagcactttcttaagccacctttctcatgcacacattattattcccctgcctgctagtcatctaccacatgtaaagtagtggcaaacatcagacgcttttaccaccacatagagtttgaggctctcagtcaaaatgactcaaatgccgcacctgctcggtcccagagcacattgttattttctcaagtaccgatacgtgcttttgaaggaaaggaggtagtgcagacatggcaaagggatgtatggatttaccctcttgtgctgaacaccatgaaatgcttttctttaaacaagttggttttctgatcttacagagatgttgtcattctgtgaaagggggaaaactgtgaaggctcatttaaaagtcctcccttctcaccttgattttctgagcactatgactcttttgaatgtcatctctcctcctggtcttttacccctctctttctttgtgggacctgacttctccttccccttgtgtttatattgcatagctcattctagctgacacattttgttagtgttatcagagagattagaaggagtaaagtcactgagagtgttgtttctccttcttccaggtcaacaggcttactttcaaagatagcactccttgtttgctctgcttgggccataattgagcagtatcaagtttgcagtttattctacgtctgacttgttaatttaactcacagtgtactgattttatatgcagcgttggttcatatcttggggctcagaatctaacatatatattaaactgtcaagacactggcagtaggagaatgaatgcttcataatttgatcatctgagccattttaactaatatctgtatcttttgaatcaaatgaaaatatactgtgataattattctttcactgaatgttaattaagtgttgttttaaggttagaattatgaaaataatttctagtaaagcccccgtttaaaagctctacccctaaaaataaaacaagaaaagcaaggaaaaagaaaaaattcctaccccacatagcacattgtctcttttttccaatttcggggcactcatgtgagattgtaggcattcttcaaccacgaagcaactttaccaactctgttaaaattgccacttttaacatggggaaaaacaagataatatttattaacatcaaaatataacaagctggtaaatatctttactatag

SEQ ID NO: 127769 - DNA, 1051 bp, Homo sapiens
gtatacaggcatgtgtgaaatttactttttttaggattagagaacatctatatttgccttcaagctcccttaaaatagtttagggaaccatttagcatcactttccatgccattgaactcagagttaaaatcgtgattgagatacttataatgcaaatagaaatgtcccgaggtcattgtgtaattttataggggtcttcaccaaagcaaggaagaaggcagtaagttttatagcgtgataggtggcctttatgtgaagtgggttgaaatgttgctctctgtgtaggcacacagtgcatggaataggcatttcattatgttcatatctacctgtatttttcctttgatcaatgcatatgtttgattaaacagaatgaaaatctacaaaagtgaaaatacgtattgaaaaaagtaatagcggtaaagcagtatcttgcagctttttactttgagtcccagtggattagcgattttactttactctagaaatgacagtatagtgatgattatttttcttttgggactgataagaaaagaaatggtgcccaattatattagtcattagtattctttgttataagtattatgggaagcttgtggagctagaagaacgtggcctgaatatatttttaaacaagtaaattatctttcagtattggcaaaaaatgtagtttgtctgccttagaaaaataaaacgttcatacataatttagcttgtctgtcattttaaacaattcagaaggcatagccctgtcgtctaggcctattttttttttgtcaagagatgcttcattggttcctgtgtgaaagtgttgacatttatattacactctgaatacttaagaaaccagaggattccagttcttttggaattaaccaatggtatctcatctactagtcaggcattcacaacattgtgtgcacatgctgaatttgtgctaatggcttcttgccataggtacattttgtgaatgtgactatttatatagcttctttcatatatggcccagtcctcattcccttgtagccaccctccttccccaaatgtgtt

SEQ ID NO: 127770 - DNA, 1054 bp, Homo sapiens
atctcaacagatttgtttatattcgccccttttccatgtggtgggaggaaaaactttttcactactttctttaattcaatgcttggggactgctgaattagaataacagaagacagattaacaggataaaagttacacagtttttattaatatttacatacatgggagttcacagaagagaaaatcaaaaaagtagtctcagggtcttgtatcattcaaacataggacagggcggattgggcttcaaggggtcataaattgtggggaagtgactaggaatatgggggaaactaatggaagataggattattttagtaagggttgctaattcagtctcatccaggtgccgactcctcatcttgtgataacttgtgataagagttgctctcctttctgtggtccggaagtacggagcaccctcacaagggaaatttctgccctgcttttaagcagataagggagggcagagaactcttctgcatctgttcattctcacttgccttcagctcaaaataatccttgtgtttgagcagcatattttagggtagtatatcctcatctccttcatccacaaaagatttaaggtggtttttacagatgcaattaagtaagctaaacttaatgatatatgagaaatatgaaactaatgaaatgatggctcaaaaagtcagaagcagccattgatgttagtggttggagatggactgtgaatatgtcttgagctttccagcagtcagcacagagatgcacatagatatacctcatttgattccttgggtctatcatataaaataaaccatttgctcagaagaattatctgttcctgggaatgggatagcttctagagattctcttgaagataatactttgtaatgtaatgcgtatatttttaacaatgaagtaaatgcagtacaacagagtaaataaaatattaataatacatatttactgagtatattctgtatgccagaaacacattaggtatgctggatatgtaatagtgaaccagacagacatgacctgtgtcttcaaggagcttataaatataatgggg

SEQ ID NO: 127771 - DNA, 1049 bp, Homo sapiens
gttcaaggctgaagagataatgcttaccagggagtctcacagagtaacccctggatgaacatctcttaagattgttagaaatgctggctgggtgtggtggctcatgcctgtaatcccagcactttgggaggccaaggtgggcggatcatgaggtcaagagattgagaccatcctggccaacatggtgaaaccctgtctctactacaaatacaaaaattagctgggcgttgtgtgtgcccgtagtcccagctacttgggaggctgaggcaggagaattgcttgaacccgggaggcagagattacagtgagccgagatcacgctgatgtactccagcctggcaacagagtgagattccttctcaaaaaaaaaaaaaaaaaaaaattgttataaatgctaagtctcagacctatggaagcagaaacactgaatgttgggccctgaaatctgcatttttaaagcctttacaggtcatccttaggtatgctcaaacttgagaaccgctataaatgctcagaagatgagagaatgtgacttatttcaagaattacaatattatttccattcctctcccttgcaacctaaaagaaacagagttgtttatcatactgaaattgtctacctttggtctaacagtatgtgtaaagaaaagcaattgaagatatattctcatttcatttatttttattttttaaattgttacataatgtgcatattttgggcgttcttctgaaattttgatacgtgcttacaatgtgtaatgatcaagtcaaggtaattgggatatctgtcactgtaaacatttttctttatgttgggaacattcagattcttctagctattttgaaatatgcagtaaattactaactgtagtcaccctattgcaccatcatactctagatcttattccttttaactgcatttttgtacctattaatcaacctttcatcatcttcccttcccactaccttttctttgtgcaatggcgcaatctcagctcaccgcaacctctgcctcctgggttcaagcgattctcctgcctcagcctccc

SEQ ID NO: 127772 - DNA, 1056 bp, Homo sapiens
accttaccacatatgtgtgagaacacacaacatgtctttctgtgcctgggtttttttatttaacataacgacttgcagttctatctatgttgttgcaaatgacagcttcccattctttttaatggctgagtgatatttcaatgtgtgcatgtattgtagtttctttatccatttatctgttgacagactcttaggttgattccatatcgtggttattacgaatagtgttgcgataaatatgaacatataggtatctttgatatattgattttttttattatatgtctagcattttttttaataagaaagtagactttgtggatagcaggtttccacatttcactttcacttttcacctctttctcaatagttgaatcccttcccaactagcctcttactcttaagagacttcatattatttaataatgttataattaactaatgacatattatttaagtattggggtaaaaccaaaccatcatcaccttaaataagtctgtattgataattgttgcagtgatatagagatagcaccttttctagtccattatcattgatgttcattgagttgtctcagcaatttacaaatttgaaatggaattccagaggcatctgaattatgcttatcctaacaattatgttgtatgaatcaaatgctattacagtaaaagccaaggggaccatccaaattcatttgttatactgaaacacaactgtatgtggggattgcttgaaataatgttttattatatgaagattaacatataaatatggttcaaatgtttttcatgttttagaggttatttgtactgcttcttaggtcattaaaaaataaaacattttactgatcaaggggcatttaaagcatgacagtgttaaagtatgccccggctggcaaagcggacttcctgtggctaactgaggtgctcattaaacagatcaggtggccgtggctgggtgagggagcagtcatgtactctgtgttttgcagagatgctgttaaagtgtcacaggacctccctttctacgatcatgccaaaccagtttctgttgtc

SEQ ID NO: 127773 - DNA, 1382 bp, Homo sapiens
gtttttttaagtgtatgtcttatcaacctaaaataagcaacagaaagaccaactcgccaaagagtttattcaggaatagcaggggagcaatccagaatatgcctgctatgatggatcataggcgcttccagagaggcaagggaaggtaagagtctgtaaaggcaaaatgagggaggttacagtagttgtttagcatcagttcgttagtggaacaggcagttgctgggctggtctccttgtagaactaatctgtatgtagggttgcggtggcctttatgtaatgttgtggttttggcagtctcttatgataattcctgttgtcaagcaaacatgcatgagggcctgtctttcatcgcatcctggctccattttgttggggtttgaataagtgactctcttttgacatggacaactttcacagtcttctcaagtacatgtgagctccttcatgtaaggaccatctgtgggaggtcccatagagtctgaaacattgaacattcactaaatgtttgattttgatttaatgaataaaatttattgtttgcaatagaaaatgtaacagaacaactaatttcacattatataattgtgacatatgttatgattcttattttcagaaaaaccgaggtctgaggtagctaaatagctttctgaagtcatacagattgtcccttagatttagtctgacattatgttcatgtgttattcaatcctatatgcttttcaaaaaaacctgcatttgcccagctacaatccacatgacactattgcttccaagaaatgtaactggaatcatggccagtggaggggaaatggattttggaaaaaactattaagtaaaagttaatagtattttttacttttgactccaggacttttctcaactataatgtgctaaagtgcatagtaccaaagagattgatttaacacgcaatattttacagttatatgttaacagaagccctcttcaaaattacttattttctcttgagggactatttttttttaaggatgtaatttggaggagctacactaatctattctgtaagatgttgattcaagttctttatatcaaagtcatctcaactttgtatgttaacaaaagaaattgaaaatatattggttgtgggctcttttcctatattcgactctgatatgctctataagttttgacaaattccaaaattgcaggaaattgtttccatttattcattagcaagggggctatctgaggagacacatggtcaaatactcagcttttggatttgtgaatttcagcttgtagtcattgttttgctaagaggtcttagttaagatgtatatgtcagatcatactataataaataatagacaatccaaattcatttactttactggattta

SEQ ID NO: 127774 - DNA, 1058 bp, Homo sapiens
acaaacatattagtatttgtacttatatttacatttatacacacatacatggaaactcacaagtcatcattagacatggcttttggttgactaagagccctctctgataggagaaatatagtgcaagccacaaatgtaattttatttccaacagaaataatatgagccacatttaaaaagtgtaaagaaatagatgaaatacattttaataatacattttattgcacccagtacatccaaaatactatctcttcaatctgtaatcaatataaacatttttaacgagatattttacattctttttttcatatcaggtcttagaaacccagtgtgtgttttatacttagagcacacctccatttggactagccacatttgaagtgcttaatatccctgcatggcttatgagtggagcaaggggaaaaggtggagagggaagagtacctgtctctcttcttctttgcttaagggcactaatcccatcatgagatcccacccttatgaccccatctgaatctaagcacctcccaaaggccccacatcctaatactgtcacactggggattagggcttcagcctgtgaatttggggaaacacagacattcagaccatagcatttataacctcaagctttcactgtctctatcccagtaaaccagagctcttgtaagacatgtgtgtgtacacattaagtggccttttttttttttgcctgttcttctttaagaaaaccaatataaaattgaagctaagacactaatttaggacataattaattgttgaggtgctttgaaggatctgtattgaagcatttactggtaaaagtatagaatttaacatagatccatgattagccaagaaaatgacagaaaatgtggtggtgcatgtctataatcccagctactctggaggctgaggcacaagatcactggaacccaggaggtggaggttgcagtgagccgagatcatgccactgcactccagcctgggtgacagagtgaggctttttattgacatatcaaaagaaaataaaagatgatagaaaagccattgttggt

SEQ ID NO: 127775 - DNA, 1043 bp, Homo sapiens
cgtaggagatgacatcaaggaggaagaaaagataaaaaggaagcaagacagttccatgcacagaccagtcagctacagtgaagcatcctgcaaactggcaaactgattatcagcagtggctgtcaccaggctctgccccagcaggtgagagttgctacctgccaatttgtttagacaccttgtttgttattagattaaggttttgaatacatctgatccaagagaatggggcataatcatatttaatgtggatttggccagacctcagactacatagctggaagattatgtctattcattgcctaagtgagtttagcattgttttaaaacattctctgatggactcatcactatcataatctgttttctttttttttttttttttttttcaaagtggtatgtggtttcagtgtcgtcgtgaagactctgtggctttttagccaaatcatcttaatgccaatctcttactacttgtgaaaccttggataaatgacttaatctcttgtctcagtttcctcctctataaaatggggatagcaatagaacctacttgatagcatttttgtgagtaaagcactttgaagagtgcttggcacatggtaaatgctgtaggcattagctagactgctattactgtgattattgttattgctgtagttattattacacatatgttattacaccaaacttaaattggtcaccattatcctcttagcatcaaatgacagatgaacaagagcatttacttttagattcctggcactttgcctatgagtgttgtcatttttatcagccataaaataacttatgagtttaataaaatatcgtatgccatagtagccaggcatttagagaatacttgggaggaagtgcagcagaagcagcaatggtgatagtctgggcttctatcacagggtgggacagaccttggagatatgctgtctcctctgtacttgatctttcatgtgccatccggagtcttccctcttgctcaaaggcctgggtcagtgcatccttagtggctcagtttgaatggggatttc

SEQ ID NO: 127776 - DNA, 2838 bp, Homo sapiens
caggagatcgagaccatcctggctaaaacagtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagtgagactctgtctcagaaaaaaaaaaaaaaaaagttggtagttgcagatacaaaatgctactgcatgagatctgtccagtagcctcaactatttttaatatgcagtcagagagacagaaatgtatttcagggcagctgctaccaatttctttttttttgttttgttttgttttgacatgatactttttgccagatactgttcttttctatagagtaatcctaaatcagaaaaccatgtcatgatatcaggcttaattttaacagccagaaaaaaaaaatcgccaccaagatataaaacattttacaaaatgaatgagggaagagattttgagcacagtattggtaaagtagagttcaaggggtgagagatgtgatacaccacaccgtccccacggaaaaacagcaatacaaaatgaactgtatcattttttactgacttgttctgttggtgattgaggcatttcagtgcacaaccaggaaaataataggttactttcacaatggtagaagtttaacaaatgctcaattattcaccctacatcatcgctgtcattggtgagagttttactgtatgatattgatgcctggcttctttcttattgctgtattcttttcagattcaatctgtctgcaatgggccactaaacatttcaatttgctacctgtggagctggattgcaatgctcagactgaaatgagaaaaatggatttagtgaaactcaaaatagagagagtttcatggatttttgtggaaggatgcacaaactgaaacccactgataaaaatacacacgatcacttttgagtgtctcataaaagtacatggtattaagcaattcatggatgtttttagggaaaatagactcagtgagatggagactgacaagactcccaacacttaggggaactcagactctgtcaatctggggtgtagttgtgtatactcagtgccattatcatagtccttgaatacagtatttgtaaagccgtacttgtttaggtgcacttaagagagctgagctagcaaagaacaggataaagtccaaattattttctggccaaccctagcatttagttttttcctagcaggaatcatttaggagatttcctggttgggagagagggttcatttcatatgggtgcctcttattattgtcatttcctgactgttgcccatagttcttgactgactgtagtactcactgtcttaccatgccttcctgtttatttatttatttatgcccattttggatttatttttctctttgactatcaagatgctctaaaagtttccccacattgcctaaatttgagctccatgaaataaagtggatttgacaaacatcaagaacattcagaagtacttgatagaaaatgcaagtattaagaattagaggcttaaaaaagactgaagtaccacagtaaggtgttacttcaagcccactaggatggctgtaacataagaatgcaaaataacaagtcttgccaggacattaaaaaattggagccctctggccggacgcagtggctcacgcctgtaatcccagcactctgggaggccgaggtgggcaaatcacctgatgttgggagttcaagagtagcctgaccaacatggagaaactccatctctactaaaaatacgaaattagctgggcatggtggtacatgcctgtaatcccagctactcaggaggctgaggcaggagaatcacttgaacccaggaggcagaggttgcggtgagctgagattgcaccattgcactccagcctgggcaacaagaatgaaactctgtctcaaaaaaaaaaaaaaaaaaaaaaaaaaaaaaaaaatggagcgctcctacactgctggtaggaatacaaaagggttccaccatgatgcatgatggcaggtttggccgtgcctcaaaaaattaaacatagaattagcatataatttcactattcactcctagatatatataccaaaaataaaaatttaaaaagggactcaaacaagtacatatacacacacattaataaagctctattcacaatagctgaaagatagaaatagcccaaatagccgtcagcaaatatatggataaacaaattaatggtatatccatatagtggagtattattcagtgataaaaaggaatgaactaccaatacatgctacaacacggatacacctccaaaccattatactaagtgaaaaaggccaggccccaaaggccatatattatatggttcaatctatatgaatatccagaatggataattttatagaaacagaatgcagattgatggttgccaggggctagggaaaggggacaattgggaggaagtgcttactggataagggctcttactttggagtgacggaaatgttttggaaatagagagaggtggtgatagcaaaatatttattgtactaggtgcccctgaactgttcattttaatatggctaattttgtattatatgaaattcaccttaataagttattcctgaggaaaaaaaatagctaagaattcttatctgggaagacaaagtaaagggttaataaagacaagtcctcatatgcagtaggttttataagaataaccaactcatctcctcttctacagagttgcctaagtaagaaaagataatttatagt

SEQ ID NO: 127777 - DNA, 1941 bp, Homo sapiens
gaacctactctgtgggtttgagtttccctggtattccgccttaccacagggcaagaatgaggaagcattcttattggtggggaatacagaggctacttaggaccaagcagttcaatttagggccccagctgcctagagaagttgtctgagaatgtcagctgctttcctagtacttagatgcctttagactgatgtgaattggcagttttctctttttagagaagccaccagtgctgaggagaactgatttgggaggaaagtgttcacctacccaagccagcccattgtccaggcaacactgggtcagctctggggtcactatcagataatcctgcttcttgcactaccgaggttaagaatttgcaccctagaagacttcaattcaaatccctgcttccccactcactggctatgtaacctgaggcccttaatgtctctaggccttagtattgtaaaatatgaagttgggatagtaatagttcatttttcctgggattgtagtgaggattaaataaaatagccatgtaacacatggtgaatgtttagtaaacattagctgaaaaggaaggatcctctgagaaagcgagtggtgagaacatttttatgggcatagccatgctcagggatagtgggtggacccactttcccagtcttgttagggaaagggctcattctagggagaatagactggatttgtggagggcccttaatgtaagaccaaagagtcctcttccagtccatttggagccattcgtgattttcacgtcgaaccatgtgagatggtttggctgtgtccccacccaaatctcatcttgaattgtaactcccacaattcctatgttttgtgggagggacctagtaggaggtaattgaatcatgggggcaggtctttctcatgctgttctctcagtagtgaataagtgtcacaagatccaatggttttaaaaagagcagtttccctgcacaaactttctctctttgccttctgccatccacgtaagatgtgacttgctcctccttgccttccaccatggttgtgagacctccccagccatgagaaactgtaagtccattaagcctcttttgtaaattgcccagtcttggttatgtctttattagcagcatgaaaacgaactaatacactatgacacatagaagaatttttaggaaaaatagtgtggtggtaggcattccacatagattggaaagtaaacaaattaaaagcaggaagaccttttaggctagaagtaatttattttccaggaagccatggatttgagttttttgaacttcgacttccatctagtctgccatcagccttcattcctttcattaagcccttagttgcagtgtgcctcagacctttgtctgtctgctgctcttcatcattgtgtgcatggtttgaggcttagcattgcaaaaaagagttaagaagtaatcaagattattttaataaggcatagtgacaaaaacaacataaatggcatttctctgaagtgagttttggtgatttctcattaaattgaattggcagaaactcagaaacaatactttctcatttcaagaaatagtaattgtttttaatgtagcgagccagagttctataaaagattgcagtgtcttgttcaacattctgttttctaaccccgtctagcataatgcttgtaagaaactaacttctcaggaaaggatggatggatggatggatggatggatgaattgaaggtatgcaaaggagttcagattcattggaccttatcccactgattgtgattgattatatatgattgtctaatatgttctcaccatcgccacgtttggctgtggacctcttggggcaaggtctgtgtctgtttttctcactgtattaccagttcctatctcgttaactagaatagtctttcattaagtgggtaagtgaatctacccctgaaataatgc

SEQ ID NO: 127778 - DNA, 1078 bp, Homo sapiens
ctttatgatttcttgctaaataggctttgccctgtatcccatttgggacttggacgcctgaaaactgttctttcattgcaatgaaatgttggaaatctattgataatgcactttgattttgagagtgttaagacataaaaccagagaaaactggtatctctggccacacatactcagctactttacctgagttcattacattcttgttacctttgcatttatctagagtacagtctctttaaatggagaaaatagttaatgtctttctcctttagaaatcaagattctacagaatgagaaatgctaaggaagcaatatttttttttccacagggaaagggaaactggctattgttaaaccctgcctttggcaattgcatgtctctatcagtagccaatttggaaatattgaaaccctgtctttggtgtaatacaactggtgtagtaagcagaggtgataactgttacgtacttcaccttgaattttaggcattttaaaggtcattggggaagggaaaataatccattaatttttactagagtgttcatgtaagtgtcttctgctgtgaaaatcaatgtaaaatttcactgccattcaaaatgcaaagtggtgtataatatcactactccaaactgccctaaattgttgcatttttaaacaagcaggttttgagttatgcccttacctcgtaaattcagcttcacagattggattattgccatgtggatgtagtagcaggaaaaataaatttgtgtcagtctgaattctacttgtgcatttattaaactactcttaaccttttcttaggtcagtgatcatcatacagatttgcttttatatgccttagagaaaaattcctctatgagtattatttatgagttaagtgttacttatccatttacattagtaatcttaaattatttacctgctttggaattcatatgttacaaatttgccagatgaaagctgccagatgagtgaatatatttgtgctacatgtctgttgctcattaaagtagctggtttgggattcacagcaaaaataaaaagtgttacaaggggtagaaaagaggggaga

SEQ ID NO: 127779 - DNA, 1084 bp, Homo sapiens
ccaactgagaatattatcttgatctactaaataaatagattttatttccataatgacttatttagaattaaaagcgaagccctgagttatatatatattaaaaaaacttacatgcatttgctagtcaggccagtttaacttatgtgagagccaaaaatcttacataattattaacagtttaatgatgatagattattgattataattaaacctaggctgtcagactaatcaatggtaagtttagtcttaggccttgagttgctaggtcagatctggttttcccaggctgatatttcaaaagtcttacagtcttcttttgttgagaatccttcacttttccagttactccaaaggagacctcagtcagaccaaagtttgatggaggtcaagttaaaatttaaaccatatctggaagcaaggtcagtgcagcaaaggcacattctaaagcattacttcatataccttaattcttccggaaactcgtttgctgggtgttttcattcataagttcatttactcagcactcattcaacaaatattttttatttttttcaacagatatttattgagcatctactgtgtacattatattgttctaggctctggagttatattagtgacaaaacagaaaaaaattttgttcttttggaacttgcagggaaatacagatattaataatatcatatctattattttattaatgaatcataagatacagataatagatcatttggtgacaagcaccatgaaggtaaagtggactgaagggctcattaagaaagggatctctgaaggtgatatttgagcagaggccaaaagaaatatgggaacggttcatgcagttatttggagacagatgttctagcaagagggaacagcaagtacaaagtacctgaaagaagcatgtgcttggcatttggaggaactgtgaggggactggtaggattagaacacaatgagtgagaagtgaagggagatgaggtcagagaagtggtgtggaattggggatgaagggtgatcacatcataagccatagcaaagatgtttacattgaattaaaaagctattggaaggtttagcgaag

SEQ ID NO: 127780 - DNA, 1034 bp, Homo sapiens
gtgtcaagtaagacttcatcagtacttatcaaatgctgcctggtacgtaataggcacacgtatgtgtgctgagtcaatgaataactgggtacgtgctattctatactgacttctgttgagttctaatgtacaacacccccttaccccattcagaggcctttaatggctccccattgccaactccttgaccaggaatttgtattttaatatatgactgagttgaactgcaacacctcttcataggcctccaataggctctgcaattttgcatttctttatttactcattctatgcaaattccttcatgtgtgaaatgccattctgtccttctttgcctcttgaaatcttatccctctactaggagccctttcaaatgccctctcctaaatgagtacttccccttccctccacttctcttctaacctgtccttaaacccttgtcatggctctactgacatgcatcccactttccatttggttccagttgttcattttgttttgcacatgatattctaggatccctgtgagcaggtgcatgacaccatagtggaatgattgtgaacatggagaatggtataaacagacctgttttcaaatactagttttttatttacgaacctgtgactttcctaagtaacctaaactcctgaaggctccatttcttcacttgtaaatgaagacaaataaggcgtcatggaattagttgagatagttccattaaatttattcaaatattgcacttattgcctgtcagattcaagctaaattttttcaatttaaataatttatttttaatagattgtcaatctgtttttgttattgatctaagcactatacagtgattatatactttaagtaagtgaatgtcaagctagtgttaacagatagctattgccagcataagaatattccctgcctacccaaaaatatcggaaagaaataagaccagccacttataagagaaggtgccaatgcaatggctaatctttatgagaaagaagaaactttacagcacattttgagtaacttagtgc

SEQ ID NO: 127781 - DNA, 1050 bp, Homo sapiens
ttacagttgaatttctttcttttttatttttcattttacactccttgttaaaattcttttaaatcattgccgacttggcagtttattgccttgataacagcaaatgagtatctgattcttcctttaccccaaattgccacttttcttgttgatcagcagcatcactgagtgaaaaccagcaacagccgaagtcaatatttataactttatcattagaccttaaaatcttatgttagaaatttatggtagtgcatcaggtggagagagaaagttccatgggaagctaaacctctgcttaaaggctttgtgaaacttgactagtaagaagcatagttgctgtttcatgaaagtaactatttgctagggagccatcttgaaaggattatttctgtgacactatgtactggggaaatttttattgagactttgtattgatgttgtcacataatgtttactgtagacagttttttatttcagaactgtagataacattgagagttatagactgtctcaagcttttctgaccatatcgaatgaatcaaagagtgtctttccttgttagatttaagttggattttctgtccttcccttggaaaatggttgtatttgctggtaatttgtcttcatatttagtgtaaacttcccttacttcattgccatctagctatttgtaatttacagtatgtgccactataacatgatgtaaaattcatctattctgtaaacttcttttgggctcttaccccatttcattattagttggccaatagcattaacaagaaggacttctatgtacaagtcattatactgagaccttgaaggttttctagcccagacactccaacacatgatcttttctctagcatcccttcatcttgaattttgtccaccctaacatactgttagtaatacagaactctccaccttttgaggaaacccattccatctctcaatgaaattagctattagaaagccttcctttaatgcaaaacgcagtctcctcccaggaggattatttctgtgacagtatatactgggggaaatttccat

SEQ ID NO: 127782 - DNA, 1751 bp, Homo sapiens
tgtcagctcagttcactgcatattagggagcaatgaaaaggcctcattgtgcctcctgtgattgaaatgatattatctggcatgactggaagggagtgcttacttacagaataacttctttggtcttttcaaagatggtaagacttctcaagctttcttgttattttatttttagttagttatagatttttcttttagagtatttttcaaacttccttattttgatggtaactttttaaaaagtattgaaatagtcataatcagcttttatatttctccttttctaaatgcttccatgtattcaaaagatagattctctcctcactacagaaggctaagaaaacttccttttctaggtctacagtagtccagtctcttggtcaaaggtatacgatacattaaatctttatctggaaacctctcagaggaagataaagtaatcgacctttagaaattaaatgttatagcattcggataaataatcattggctattgttattacttttcttggatttaggtgaaggaaataaaagatgcaggcttttgaccaaattagagcatggctttaatttcctgttattccagcattgctactctttctaataaccacaaatcaaggatgacaaacaaacaaaaccgcacactagatcccaaaggcagctaaaacagcttcttagtgaccttctttctgacctacattgtacaaatgagatgattggaaacaggataataattgattgcaacaatatgacaatcttgttaaatgggcttaaaattacattctctacctggacagggaccttataggggagatcttagaggtaacaggatcctcatgtatggagcgttaggattaattgtttatgatggcactttactgaaatgttctaaattttcattatttctttctaacagattagtaagatggtattaatggtcctgccctatctgctgagcacagttcttaaaaaaacagctttctgatataacgaaagtcaacttggtgagctaccagctgttttagatttggcagatttcacattcgctttgggatgcctgtttggatatgtttataaagtcattaatcttctgtctctcctctcttcctgccttccttcctctattacttgctgaattctggacatacagcaaagtgtaagatgaatctctgtcctcatggagcttacaatccaaagcatattgaaagaagagttcaaaaataccaacattgaatatcaaactatttgaaattatgtgctatattggttttatttttcaattttgtatggattaacttgcaataacagataaacacaagtatggtgcactttggtaattttttggtgaatgctgtggaagacaggcctttagtaaggttaaatattctactttcctctattagatctcatttgacttcacaagattcacttgataatagttacaaagtaaatccagttcttcaaatggaagataggatttaggtattttttactttagattttacttaaaactatagattacatttaaataagcagcatatttcacagagattttcaaaaatattagatttcaccctaatttatgttttgcacaatatttcaatgaaaatttgatgtggttgttaatgttttattccttttgatcattgcaataaaataataaaatgtaacatcagatttactgttttaaccatttaagtgtatgattcagtgacattaaatacattcacattgttaaacaaccatgaacac

SEQ ID NO: 127783 - DNA, 1268 bp, Homo sapiens
tgtcattacacttgacacgtctaggtgtcactctttaattttcattctccctgaactttaatttttacaagtctatggtaactttctcttcagtgtttgtaactaccacatttctatagaaatcttagggtgatctattgagattcttcacccttcatttctaattcctcatgatactatgcaagtgacaaaaaggtggcttgtgacagagaaatatgatatttaaataaaatccttagaatcaaaaaagtgcctaagttaacaactttttaaaagggctattttaccaactccataattgacattctgtcactgctcagactttatttcattcctgctcaactcaatatatggatttttatacaaaccatttaccaaccactagacaatagcgcctctggcagatcaaatttgtacaggtaagttgtttgttatccacaggagagcttcattgtatccttgggacagcttccgttagcagcccagagtgagagttggtgacactcaaaaactcaaattattgatgagaacatcccaagtactaggaagaatttaaaattaaaccttttaagcctgtgcagtcattatcacattaagcagggagatggtgatgggtcataaattggttttccattttacttaaacaggacctggcagaatgtaaatggaacctttgaagttcacttatctcatgataattcttcactttttttttttttcgagatggttatgaggttgaaactttagatctctaattgtttctgttagattccatttattggaaaaattatatttcgaggatttttcccccggtttctgtatgccttccagaaacccagggacttcttgaaattctagttttcctgtacaggttgaatctccctgattttgaattagaaaattcaaaatctgaaatgctccaagtttgacactttttgagcactgacatgacattcaaaggaaatgctcatttggagtattttggatcttggatttctggattagatatgctgaactggtaagaatatgtgatacaaatattttaaaacctgaaaaaaatccaaaatccaaaacacttctgatcccaagcgttttggataagagatactcaacctgtatcggtttcatgcaactttttgaaatattagagatttaacaagtcatgactcacttcattgtctgtatatcgtaaatgttaaaggccaggcacggtggctcacgcctgtaatcccagcactttgggaggctgaggcgggtggatcataggg

SEQ ID NO: 127784 - DNA, 1342 bp, Homo sapiens
cccgagtagctgggattgtaggtgcaccccatcatgccaggctagtttttgtgtttttagtagagacaggatttcaccacgtgggtcagactggtctcggacccctgacctcaagtgatcctcctgcttcggcctcccaaagtgctgggattacaggcgtgagccaccagtgccgagccctgcttgattattaaatccaaattgtcctcctgctatcttaaaagaaatgaaatttctcagtagtagcaaacaatgtcaatctatttgagaccattaatgactcatttataatgtcaacagtcacatgaaggctagaaaaattaaatgtgtagcctcattacctttgtggttagcatttcttggaaatagcatggtgcttacttagtgcaacattgtaaaagacaagaagaattcctttggagaagagctttatagttgagaatgtggataatggaataacaaaatgataacttcttactctttgagctgcattctacgagacattctttgtgattagctatcagactctgcatgtatgaagaagctcagttgttccagtcattgtgacctgtttttcatagataattttgacatgtatttttggagttttgaaaacatcatttttagggaatatgatttaaaatatttttaaagtagtaattattagaaattatctaaactattagcttcttctaatttgaagataatgttacatctccaaggatactgcagaaaggagcttgggtaccatgtgaaccagcatgcctgtaagtttcctatcaactccaagttgtgttggtacttccgttctgttcaaatggttatcagcacctgaaatgaatatgctctagattagtcttcctttttatatatagaatacacttataaaatagatggattactttaacagtttgtagctgtgaagagagcgaaaccaacctgcacaatggagactgaaacataacttgagacccaaagtgtactcttagctataaaatgtaatataaatgtaaattatttgttgtggttcaagaccttatactcttacttctggtgccttttatgaattcccaccatggtataggactatactttttctaatagaacaacaaaagacattttatgaaaggatggcattgaagtttatcgtgacatctacctaccttacagaagcacatgtagaggggtttgtgtgtgtgtgtgtgtgtgtgtgtgtgtgtgtgtgtgtgtataaaaagagatttgtttcaggaacttgacctcgtttaattgtgggatctggctaaacagtctctgtaagatttttgtcttctcaactcatgctggagcttgaagttcacaa

SEQ ID NO: 127785 - DNA, 1054 bp, Homo sapiens
ggggctgagagtcctatagcatggctcattgtttttaagggtaaaggattctaatgtagcaaaattaagagtaaagaaatgaagatattagaggaaatttctttgaaaatttcatcatcaatttatggcatccagttttgtaatatttcatattataatgtagtttgattcgatgagttaactttagcaagcagaaagatactacaagcatgataatagtaatacttgctaccctcatagaactatatgaaataaaattctactgagtgtaaaaaaataatgttagaacttgacaggaagacttgatatgcattagcttgtgcactggaagcaacaagtaagcatatgaccctttgaaaactgtaggaccataaaattcccaatttttcacacattttatatatgagtctgcatgaatgttagcatgtacattaatactaagacctgtcccttaaacttcaggttcttgatcttttattacctgctgggatggcagaattgcttcataaatgtagtccatcttcatttacatagtgacactgctcaggagagtctctgttaaaaaaattatctggaaacactccaacactgttgggcagtttcatagtttgctggttgtctttcattagatgtaatctaaccttctttcccacgatgacaatataaaatgcttcagaaacacacatctcagcaaattgcttttcctcatgacaattatttgtccttctaattaacactattcagaatgagatattttctgagaaacaaagtcccctttctcactcccccttataataataattgcatctacttgtatacagagagtttacatatgtcatttaatgtgatcctctaggaatgatggccccattagatagtaggcataggttctcatgggaatgatgaccctgttcgatgagtaggcagatattaacatcctcacattagaattcaggaaaggaagacactgagatttggaggtataatagctagagtggtttctgtctgttacagtgagaccctatttgccacttttagtcagtttcctgttact

SEQ ID NO: 127786 - DNA, 1944 bp, Homo sapiens
aaagaggaacaaagaaaaagattgtttttgcttttcccaactgccctctggtggcaaaggcacaacagacagcaaagacgtttaacaaagattcttgctgtgtaggtgctgctggtggttcttaagaggctcttaaaccaaagtctgtactgtacatgtgtgcttctgaaaaagaagaacagaatattgggtctcataattatattttacttcccagcggcatctgttcttatcatagtagcaccaggctctactagctcagtcaatacttgtatattaacaagagacaatcgatagaaaaattaaaaggaaaagtcaaggtaattaggctaaagctgctgcttatgggttttcaataattactttagcttcctcttgttttcccatctccagaaaaatagggcctgattgaaggccctgattgaagggcctgggtcgtgtttgactgaggacatgtcaaaattatacaaagccaagcaggaaataaaattaagctgtatttgttttagagcagtaaaaggggctttgcatgatggcatgggaagaatagatgttgatttaaatgtaccccttagcagctgtgccattgttggtacctgtttcatgtcatcagtttctgtactactggcagtagcccactcaaaagcactatgacatgtcatgtattaaattaaagctccagaggaagatagcgaatggatttctccccaaaacatcaggatatgtttggaaactagatgccatcctttatgaaaccatgaaattagtcaaaacccccccatggttgccattgtgggccatacttgggccattgttctttatggacataattgctagagatcactgtccatttagtgaggcttaatcaacaagccacacacattgtgtgaaggagtctaatctttggttttgagctacttgggtgttttcgtgccctgatgctgtgaaatcttctaaatacatcagagccaccctgcttctcactgctgcttagtaggttggtgtgtctgcctcctaggggaaggagaaaaccagaggatttcctagttttggagagagaactctgaggaggaaggataggctactgagagagagatttcattttttatgttcatttacagtcttcatttgcactatttctgtcagctcaaagtactttataaactttacaaccaaattatgtaccaacatcatttcattcattgctgatatatagctgttaaacatctgccaggtacacatttcctggaggcaaaaaaaaaaaatgtggaagagaattagatcttgttaaatgttcagagaaaatgtagatatggggcatattatatgaagatatttattgagcacctatgtacaaggcattatagaagacatcttaggtacaggaaatatagcaaactcttaactctgcccctcatcaccgctgcccccttgaacctcccctccttccctcctaagtttgttaatcaaaagtgagtaatagagccaggatttgaatccaggagagtctgatttaaaagcacaaacctttcattacgatttttacttgatgtttaaaagaaagcctctctaggggaagaagaaatgtacgaagctggtattaactcagtgaacccaaaatctaactgatgatagagttgttggtttgggagagtgagatagaagagtattgaattaaatgtacatgcccaaaggcattgaaaagttaagatgaggaagcacagatagtactagagctttgatgagaactgttgttaattatttttaatgccacaaatggctttatattattccaccactggttaagcttgcatgtgtgaatccctgctgtctgtaaaacctccagcaagtaaaacctttgctgattggtgacttggctctgtcatttttataagactgtaccgaggctcgcagaaaatgcttgattctatacaccctttagct

SEQ ID NO: 127787 - DNA, 1028 bp, Homo sapiens
atttttgaaagttcactttttctcccctttcttgatcctttttatttaatcattcccaggaaaggttctttctactgctctgccttttttcttttatttttgttgcttccattgtcactccatattttttgtctttaccgttttgattttcaccctatagaaagtttgtgtgccaaataccaaataagaatgatgggatattatgcaagcactaaggcagtagagtgtagttatgtaataagagcttacactcgagtacagctgcctggtttgaatctcaactgttcttttaattaattatataatctttagtaagttctttaaacttactgtctaattttatctataaaatgagaattatagaagtatctatcttctagcattgttatcaatattaaatgactaacatataggaagtattttgtacacagtgttctataaataaatgttaacctatttaataacaaaaacttattaaattatgtctgtaaggtatgtgtaatgatacagaaaatgttcatgagagaactttaagaaacaggatataaagtgacgtgatcacagctattaaaacaagcatttaaacatttttgaaaagactggaataaaataggacaaaatattaattatggtttattttagaactattgcctcctgttactctttttttttttttttttttcctgtttgggttacttatcacaatccacagttatagtattggtctatttagttggttttgatggtctctccttctagcatgtatgttttaaatgagaaaggactcaagtcaatctttttctaccattatatattgtgtctaatgccaagtgtctggcacaagacttctcttcaataagtacgtgttaagtgaatatgtttacctcttacttttctgtgtttttcagtcatattaacagaaaatccctgttacaacattttttaaaaaggctatttttaaaacattagctcagctttgttaaaggcttaaaataggtaaccttaaaagtattaccctatagttcatg

SEQ ID NO: 127788 - DNA, 2314 bp, Homo sapiens
tcgttactttgctagttaaatgttaccttaaagccttattgtaggtgaggaaatatccctttttttaattccaaaaattgtagcatgattaatgaactcacagattcctttagtggtttactctgtgttaattatcccagtgccagagtttctacctagtatgctttgactcactgggccacagtgcatttctgcctaaggctgggttacatgtaacttacctgcagatatgccagtgagaggaatacgtgtttctttgccagagactttgctttccagtaaaacttggccttggcattcgttgttgaggttcataaggttttctgttagctctgtaattcagtgctcatttttaaagatgaaacttcagtgaaataggattgtaacgatacacacaggttcatacagagaaaattcaaacagaatgcagaaaccttctcatctgttactaaaaaatttcaaagccagagatgcagcccatctttctcgtgattcctcattcaactgccagactgacagcaggaaattctaccatgatccttatgagtcagggcagcgttttctcttttctaaagagggtctcactgaaggactttagagaaagcaaaaacaggagatgagagaaagagagaaggaaataacttgaggaaagtcagaggttcagactggtgtttattgactgggtaatactagtagtacaactacacctggggaatgttaggaattaggtccagacaaaaggtatgttgtttgaagcagcacttagaaaaacatccacttctctgaatctttggttgaagtgacgtaattagatgtgcataatgaatcttccagtagcattttgttactctgaaggtctgagacttttctgagcccttaactccaagttggtagtatcttcagttttctgaaataccatgctattattgctctatattaagatctgttgtttaatataatattggaaagtattgcagcgaacacacctaaaagtaattactattgaaagtaatgtagtccagaataaagacaactgtacgctgagtagaaggaataaatggtacaggttgaatttttcttatggcagtggtagtactgttggggatggtggtcactatcactgttattttatttttcttacagggaataaacttggcatgtttaacttgtggttagaacgccaagaagactaatattatagtatatagtaacatttatttaaaatcacactagaaatagtcatagaaattgatatgctgtatcaaatgaaataatttgtgaattgattttgaaatgcgtgtacattgaagtgtatgttggtaaaatgatgatggtgatgtacctttctgaccttggtgtattcatttacccttgtcaaaaaataaaggtgatttgagctgttttgctcctcagaggatccaactgaccatataacctgacttcctagccactctgttgctccccgctccttcatccccacgccaacataactgctcctattctgagacagtgttttaaatctgtattattcagcaagaaaaacacaacagtcagggagaatatcaattattttcttgcctatccgtaccatcacataattgcaacatctacatcctgatcgaagatttggtctttcagattcagaatgtctcattagctttttgctccctgtctcatactgaaaaaggagaatctaaacagtcacaaagactagcagaccagtagattttctcttcccgggggcatatacctaaatctttgtgctagaccagccctatttgcagatctaagagctgctggtgtattatgaccagagacactgcaaagcctgtattgcccccagatttttgttttcactgatcaattattgacctgtcatctttctacctggcctaagatttctaccatgatagttaatactttggcttagacaatgaacctgaggattttttttcaagaatgatacagttttgaagaaagaccttagatcttagaactctacagtgacccttcttcactaacacactgtatcagtaatctaggagagtatgagctaggcaggtttcaacatggggaaagtgaagcctatcaatcaatgagccccagggatgagaggaaccacatgaaggcccagattgcctaggcattgcagagttgcactggggtccccaaaattactcccaggtttggagattcactagaaggacttatggaaccttagcatgtaattttatttatggctatgatttattacagtgaggtagtaaggttactcaactggataacaaggggaaaaagcacaggtgttgaggtc

SEQ ID NO: 127789 - DNA, 1030 bp, Homo sapiens
aagggacttgtcacctggtcacgtcagcaactctctcactagcataaaccaaaatttcagacttccagaaggaaatcaggtatttggcataaaccatgttatttgcacagtctagcataggaaactacccttatcagtcagggaaaggtaagctcacttccaaaaccctagttcccaaatgctactccaaggccaaccttgcagacaggcccttcttaagatagcagcctcagactgcacaaagataagtacttggcttcaaggatttcagtggataggcaacatgtaaaaataggctcaggagcctggacagttgctgcctgttttcatacatgagagataaatacttttgtgcttgcattcgtacatataactcactattagtaatctaagggaacttcattacttggaaattaaattcaggagatttaggtgccctgctcttttgtttgagaatcactgccctctgtgataggcttttcactggagcctgaagggatgatggaaaggagagatattcccccagatggcctactttacaattttatccatatctctgggtcctgatggatggtggcccatatttaaaagctttccgcataatcagaatgaagaactctaaaaatgtgacttaattgttttgagtctttttttttgagccagagtctcactctgtctctcattgtggagtgcagcagcatgatctcggctcattgcaacctctacctcccaggttcaagtgattctcatatctcagcctccggagtagctgagactacaggggcgcaccaccacactcagataattttttgtatttttaatagagatggggtttcgccatgttggccaggctggtcttcaactcctgacctcaggtgatccacccactttggcctcctaaagtgctgggattacaggcatgagccaccaggcctggcctgttttgagcttgttcaatctatgtcataagtaaacctaatcttgttaaacttcaaaggaataatattgtgtctaaaatttcaattcaagc

SEQ ID NO: 127790 - DNA, 1050 bp, Homo sapiens
ttttggagaagataaagtttcctgaaatacaagaatcacaccacttggacagacgttgtttgtatttcacgcccacacaagtgtgttagtgtggagaaggaccattttggaagaaagtactttttcctctgaactggtttcctgaatccttttgagtttcatgttttatggaagaccatcaaaatatttggaaggccagcttatttcatggtcacaaaggcagctttaattgcttgcataaagttggagcttgtctttctccttttccaacaaagtgacatttattagcaattctctggtagttatttgtaattgcactagtattcaccattcccaaatgttacaattaaatcatttgagagtctagtcacatttctaagcagatgtaccaaattacagctcaagacttctgcttgaaatctacaaatccaattagtaaaattttggggctgggaagggttagccagggaaagacctgagaaaacacatagcccaaaatagtttgaaatttccttgctgctttgcctccacccaaagttgatttgtcagcatgtaagggggtgttacatcttttcagaaactgcttggttttcttttcattcaagtttaattggttttcatggactgaattgaagcaggaaggcataagttaggtagatgatgtaagtgagcaaatctccatgtatagcagcatcttgatttgggtgtttgttctttgttgttcttttatttctgtcaaaaccacagcttcatatatagctctttttgtcacatgagtttttacgttgtcttaaaactgtgaaacagttacatctagttttcctttttatcttgattcaagagcccttgaaactatccttttacatactattttttttcacttggaacggctactctattatattctctgaattttctaatttattttcttcaagaccagcattagccaggtgttgtgacccatacttataatttcagaactttgggaggccaaggtgggagaatcgctagaggccaggagtttgagaccagcctgcacaacatagtgag

SEQ ID NO: 127791 - DNA, 1050 bp, Homo sapiens
gctttggcaacagacctagggctagactatgttgcctggaagataaagaagcattcactgctcttcccatcccactgtattgcctggctagtgtttgatcagcttttcaatgtgcggtcaagttgttgattgagctagtaacttataagtgaattatctttatgattgtgttcatttctaaccatgtccctgtgcagtttacgaacaatactaatcataagcaaatactttcacctgggcccaatgatttttacctgtactgaccaagtgaacaacttaggctggcttatgccagtgaagtggtgcttctccctcctgacatgagacttcactgaagtgacttgccaagaagaaatgagaagatggcacgtggagagtcatgtggatgctcttctctgcctcaagctcagctctcacgtgcttgatctgttctgtctgtgtcctttaatataaatgtttaaatgtttaaatgtcattgggtacttggttataggaggaggcagagctctgagtggaatccatgatggtcctgagaccagagatatgtatttttttcttttcatgtatgtatgtcttatatccccaattgagaattctatcactgtgagtgatacagcttcagaatcctgaaggctaagctattaggtttgaacaatatgaaattgctggtttgcaactatattatatctacaaaagggcaagttcatatagcttaacctaaaaagtaaaaatcaaatgacatcaggtatgtgcaaaaatgtcataaatggctggtgaatatataagaagttcaacattactaagagccaaaaattgaaaattaaaataagaaaccttttttttacttcatcaaatagtaaaccaacaattagtcctatactttcctggtttgagcattgattaatacaaccagtaagtatgcaaatatttaaactcagtgtttttcactgatagatatttatatcaaggtgctagattgatatgcatataaatatttttgcacaaatatgttcacaatttgtttataacagcagaaaatggaaaacaaac

SEQ ID NO: 127792 - DNA, 1020 bp, Homo sapiens
gaggtgcttaagattgatcaagcttttgctcatctggagaatgatgatgtctgttatacatatgtacagatctttgttctctttgacatctggaaggtggtgggaaggagcaaattcaaaatacaaagactggttttaagccccagttgtgccacttattagttaggtgatcccaaacaagttacttaacctctgcaatctcaattaccacatcattaaatacagatatgaatcgctaggtaactacagttgtgaccatcagctaagttaaaatgtgagaaaatttctacaaccaatgaagtcctacatagaggtagataggacctctagtcctctatagaggtaggctgttgctgctatctttatgttatactgtttatgaaaataagttttcttttctgtaaagtaagcatacctttattccttagggagggtttacactttcattgaactggatattgcatctaatgaggattgctgtttttttctccttgatttcaggatttaacatttaaatgaaagtgatccctgcctgcctttggattgaatttatcactggtttagaataacatgtatgacacaaaatttaaaaagctgaatagctgattctttttgaatgcagagtagatcatattttcaaatggcttgttctcatttaaaaaacccaaggcgaatagaatacctataaggatggtaggcttgggaattgaaagctctatgtgtgtctccagatgtgccctgttaacatggacaaatcgtttatttcttgatcactaaaaccatcatagtttttgtatgtttaggataaaaataaaaagggagtgtggtattttaagatctttgtgtagcatagcattgtgatgttaaagtttatacttgggctcattttagaaatgacctaattaagtcttccttttttctgcattaatcgccttcctttgtattatgatctttcctataaggaagctagcagactgacccatcatttttctttcctcagtgttaaataagaatacatat

SEQ ID NO: 127793 - DNA, 1036 bp, Homo sapiens
ccataaaacgaaagtgaggatgatatctggtaaagttcagatggagctaaagaatcaaaatcaactgaacttttaccaggagtccttagtgaagtaattgattgcattctccaacgcccctccttcaataagatttctgttatttgttttcttttacttgaatatggcttttaggaggcttgtatttagagtttctgtgcttatgaaaaaagagatagctttataattactatgtaagaactatgaagtgggaaagaatacattggcaagacatattacaattactttgtcatgcatctggttatgttggcatatttgtttaattaaattccctgctaattataactgtatgtgcttgtgttaattattatttacctaacactggtaacagtgtaattctttaaaggaaagcaactcgctttctatttaaattaaacttcaatttaatatgcttcctaaaataataatagtgacatttcattagaatggtagttgaaaaatctttatctacctcagtggaatttggactggctaaaatttaacagagttgttttaatatcagattgtaattagggatcttaaagttagagtaaaatggttaacatggccaaaccaccagctgatgctgcacatggttcatctgctgaaggaaacattttcatcctttaaggaaaaccttgcctgcccttccaaacttcctgatcacctactatagaagagagagggaggaaattatacttgacaatgattctcaaagacctaattagaagtgggtctaatatattctctgaagcatttgtttaaaagtcaaattgcccaggtcacttggttatgatcactcacccagatacttagtatatgtgtaagctttttcagggttgcaaacctattcgagttaaaattgaactcccagtggagttgagtctttcccatttcattcacttcatcctctctgtttcaaaattcttctacctctacagatatcttcttcctctcaccctttgtcagacgctagatatttttaaatttcccttac

SEQ ID NO: 127794 - DNA, 2258 bp, Homo sapiens
attcactcacattaatgagtgcccactacatggtaggaactgtgctaggactagacacaaagacaaggcatagtccttcccgtgaaggagttcatagtctggtagacaacctctttgaactcttagattcagcaattctagattcggttaaagtagttttagggcaatatgcatggcataaatggaatgtgtaagtacctaggggatagaaagttgtgcttatccatgaactcatctgagaaggctttctttggtgatgatttgaacagtttgagccttgattgtcaggagcggaaatgaatcctcgtgtaaacaaaaacctctgcaagactatcaaggactaagacagaagactaagaaaccctggtaggaaacaacaaacatattgcttatcacatttatcctcttaaatgggaaagacggaactaggaagctggaaatgaggtagaaggaaagagaaaggaccagttgtttgatgatttgaaataaacattttttattatgaggaatatagatttttttaattaagaaaaagtgcaattcagaaagaatgctattgtccatcttgaagtctttattgtctcccccacaactcttccccagtgtcaactgcgaatgggcaatcaggctgctgtccaggagagagaggccctagggtatgtaaaatactgcagagaaatctactgtgtctacaacagcaactggttctctaggaacctaaaaatagtcaaaacttcttttcaagttcaaactgtcaccaagattagttaatgaaccttaattggcaaaatgaaaatgctgcgttattttttgagaaggattcttagttatcatatgaaatttgtatctggttcatagtaaagtgttatttattagccacactttaatgaattccctaaaatttgttgctgaatttaggagagatgttcagttcaattcaacactctttgagattgactatcatgtatcaggcactgtattaagtgcaagagtaaaaaggcatggcccttcttctcagagagcccatggtctagtgaaggagtcagatgagtaagtagataattatgaaatattgtggtaagtgctatggaagaaatctaaagaacaggttatagaaaagaggatgtcacatcagaggccacgacacttaaactgagtctttcagaatgaatgagaaattaggcagatgaagacagagggaaggatgtcctatgtgccgttaacgtgcaaatcacatacgcttggatgtctgatacttgggccggttaacttctctgaacatgactttccatatcttcattgagtgtttatcacaaaacattgtgagaattgcacgtgcaaatgcaggtaaagaggctactcaatcctggtgcatagtcatttacaaataagttggtttccaccatggcacacgtatgcctgtgtaacaaacccacacattctgtacttgtatccggaacttaaagtaaaataaaaaataaaaatacatagattgttttttttttaagtgttgaaagctgggctttcattgccaaagaaggcaaatgttggtgtttcatagcagctgaatttgccaaccacctacccagtggttaggctactaaagtggaaagtttcattcccaattaatgcaccatttttctcagagactttgaacagacatgtttttgatccatcaaatctttctgtcctggggttgtgtttggtttttattccaattctaaggtctgtctgaacacgctgtgccttgagccatgtagcacacagaaggacaaatgatttcttcttattattctttttattaacaattgaagggaatagttaacatttaagaaaaaaaaagactgacttgagagaaacttttggttattttctagtgagggaaaaaaagctctaaatgcagtatgtcaatcttgtttcctagataacaaagcaaatctaaaacagttttgaacttttttccttattccctttatcatgaatgtttaatatccaaaggagccaatttttgttgagaattagcttccaggtttggaggctattagcaatcaccacagggagcctcacactccagttctatttcccatcctttttcctgaatcagaatcattttctgtgtagttatagcaagtgcctcggttttgctagcctcatctgctgtttttaaatgtcagcctctgccaagctgaaacatcatgaaagtaatcaaattatgtattaggaaagagtagatcattgcttcaataaacttgccaaaa

SEQ ID NO: 127795 - DNA, 1066 bp, Homo sapiens
atcgttaaaaaagacatgacagttgttgctgtaaaccataatttgatgtcttatgataacacttaactagcttattggtggttttgtttgtaaacattgaaagtaagctttagccaatgcacacttaatcagatttgtattcagcaagtgtgcttttgctaatagtaagccagacattgtatcaggcatcagggtaaacatacatatacatatgtatatgtcccgaccttgaggaggtcatatctagctggggaaacttacaaattgtacataatccattatccacaattccaaattccaaaatgctctgagaaatgaaatttttaaaatatgtagactcatttagcctaattcctgaattcatatgaggccacattatatatagcctttgtttgtacctcttaatataatttttcatacatgtgtttgattatgaggtgctaccctaagctctcctggcattgttgcataatacatagtaaatgccctgaaaacctttctaaaatctgaactttttgaattctgaaatatatctggtcctaagagtttagcagaagggattgtggccatacatgaatggacatgttgtagcccagcaaaaggaatgatttacttcccatgattgagttaaagattcacagaagaggctgcaggcagtgaaactggaatttaccaaagttgttttggcagcctaggcagaactgaagttacagccaaagatatagacttatagagaatctggggagggtatacatggaagacaggactggaaaggcaagttggcaccagattatggaaggcctcccatgtcacaggagaatgcattctttttctatcaactgacaggctcttttctgatttccttcagcctcatttgctgttgtaccttgctttgttgcagtgtgtcatggatccatttggagaagctgatgagtcatcttgtgaaagaaaaaatgaattgaaggacattgcttactttctgtgttgattcaggcctcatttcatcttaaccccctagttagaggacatcagtaatgattcagtctctgcaactcattcctaaata

SEQ ID NO: 127796 - DNA, 1021 bp, Homo sapiens
cctcacatgggctgcatcagagatttttaaataaattgttacagtgttaattaggatttcatggtcaggctccattcctttaatagatacgatatgatttggccttctctgtatcttcaaataagcagtcctcaaacatccttatgatctctcctgctgccttagaagatttgagataatggagggatgatgaagcaatcatacaaaatctattgattcaccttggtgagtatcatttatacatcagtgagtaccttggttgcaaaattacctttggagtttaaatgtcattgcaaagttgtattggaaaggtaattttgttttggtaggccacagggttttgctttctgatactgtaaaatttatatctacttgccattttcatcatataagtgagaggtttaaatgctatgtatttaatgcccctgtctataaaaatgaggatttttttttaatggctttctcaatactactaactcttatttttgccgcagtgttgagaagtacggatttatgatactataaaatgcaaagaatagggtggaaagaaggaacacttcaaatatcacagaagctctgttccttgaaacttttcttacttcaagtaggcctttggatcattttggacatttcaattattgagttcttgatatttaggtcagaggacttatccttgagaggtgggacttgctgggtcagtgaggacttggagaaattttctgtagctagctagaggtttgtaaaatgcaccaatcagtgctctgtaaaaatgctccaatcggtgctctgtggctatctaggggtttgtaaaatgcaccaatcagtgctctgtaaaaacgcaccaatcagcgctctgtagctagctagagatttgtaaaatagaccaatcagcagcctgtaaaatggaccaatcagcacactgtaaaatggaccaatcagctctctgtaaaatggaccaatcagcaggacatgggcggggacaaataagggaataaacctggccaccccagccagcagcagc

SEQ ID NO: 127797 - DNA, 1040 bp, Homo sapiens
gtttcctttcttgggacaacttatgcatgtaatatattatattcctcatacccccatccttctgctcttaaagaataggaatcattagtttaaaaacgtctgttttaactatctttccattttcaatgataatattactaattatgttaataattctaatcaattaaaaatgccgcttaattttttaaaagagctttatcatttgattaacatataggcttctctttgctcatatttttttttctttatcatcatctcttactaggcaatggcgaagtagaaatgcttgtaatagtgcataacagttattgaactcttgtgattaagacttcaagagttcattaagaggacagaaaaatgcacctttgatatcttaatctgatcactctaattgagaaaatacaccttaataattattcagtaggtatattgacctgatcattcatttgccttctaatttggacccttggtcttggcccttctatctccatttagctaggtgatatatggagcaccctggacatcagtattcaggggatagagcacaggcctttcttcctctctggggtccgttcttcttgtgtgtggcgttgctggtgagctccatcagggagctgacagtccaggctagtcataatgatgctttcagatttctaaagagtctgtaattaaatgacatcactgagtcttaaatgcatctgctgtgaaagtcagaaggctaaattatcccattaaagagagaaaagtgttacttggtattacagaatcccaagtttattatgctgaggagttgcttcgggaaggctattgaaagccagttgagcatggaacatagtgggaagattgggaggctggaaggccatgtggttcagaacaggctgttcaagaatcacagctgcactcaggctaaagtttaaaaaaagaagccattaaaaaatttcttttgctttcccaaatgcaattaactgcttggctgctggtttttattcctaacagctgtgctgtttcgggccctccagaagatatctgcagctacatga

SEQ ID NO: 127798 - DNA, 1039 bp, Homo sapiens
agattactgcctcatagcaaaaggcgtctggagaaaggaacttctatttatcagcccaagtgcccctgccattggaataatacctgacaattatgttcttcgggtctgtttgcctacatgggtaatttctagaattaaagcactattaatttttcagttgccagttgtgatgcccccttttaaatattaaaaaaaaaatcggtatttgatcaaatctgagtattttcaatactcattttctttgacacttccatagaattcagaaatgtttttaattgattttttcttcccatgtgtgtctcatttactgtactgtatcataacttaggagttttatcttttgatgactttgtaatatagggatagagtgaaaagacaaggaggaagtgaggtgacttggacaaaaactaccacatattccctcctttttcactaagcacatacttactttctctaaattgcctggcttctttcatcatcagcccccaagaatgccattatttccagtcaccaaactgaggccagaggaagagatggaagacagaaatgggcacatgttttgtttttgtttttgttttttttgagacggagtctcgttcttttgcccaggctggagtgcagtggtgctatctcagctcactgcaagctctgtctcccgggttcatgccattctcctgcctcagcctcccaagtagctgggactacaggtgcccgccaccatgcccggctaattttttgtatttttaatagagatggggtttcaccataaccaggatggtcttgatctcctgacctcatgatccacctgccttggcctcccaaagtgctgggatcacaggcgtgagccactgtgtctggccagaaatggacacatgttttatttccttggtttcactttagaaactttgaaaaatattcttacttcatacttcaacttctttccagtataccaactatatcaataaagggttctatttggtaaataaaataaaccaatacaaaaaagcagaacttttaagcaaaagaggtacatttttgg

SEQ ID NO: 127799 - DNA, 1860 bp, Homo sapiens
cctgttgaccacataattagatgaaatatatattctcatgtaacaaacctgacgccagtagtgttaggcagctcctaagggagtcagaagctgcttccagcctcgtaaataatgagcacataactaacagaacctgatcttcccagcagaaataagtcagcctccttcacagtatgcaatatggtcaatgaatcagtggttgctgagtgaactgcacttcccccagctggaggagaaacaagcttttttaggagcgatagagcatgcaataggatgtagatgggaaaggaatctgatgaattgattttcactggaaaagtctcagagattcttcacctgagattgcttaatagtcctaaagctttaagctgctaatgagtctctgtccaacccactgggggcacttacatgttgctaagcactgagtaggctgaaacaaatcatggaaaatcatgcttccatttcctggagctgtgggggtgatgaccataacacctcaagttgcatcaaagtgatagaacttagacaactggctggaaatatgtggaagtaatttgctgctatcacaagttcacatgttaacattatttcacccaatttgtattttgtgggtgaccacatgcatttcatttgaaataattaggcaaattcgtcatataattcatttcctgttactagagctaggttgtccttctatttaagatttacaactagccagtacctgaaggcaacatgtgactgaaatattcttaagttccatgaaacaaacctttccagattgagatttgcaggtagagtttcatgctgcacgcagctgggggctctctggaacctgcttgtcaaataaacagagaacattcattctcaggcatgtggtcccaatagctttcacaagcattaaactcacttagaaaataactagtaatcaaaaaaaggcatttaaactcaactctctgaagcatggaaggagatgtacattacatcgattgaattgtcattacaaatatctactttagttgtagacgtaattaggttttagtgaaagaagacatttatgtagattggggggatgtggaaggttttaatcactggaataccatttttattacagctggatattagggactgatattgaacaatggatccactcttttccactgagaatggtggaatcttcacattttagaactaacaggaagcgggcaactgatctcattcagcagctgcctgtttaggctacccaacccctagaagtctgagaaattggtgatagggtttacgagttatttttagtgtatttatgaatatgaatgcatgcatgatatggccacaaaactatgaatcaatttatttatacttaggttggagttatatcaactcaaagtgtagcatgtattgtatgctccatagaaataggggctggatctgcctaatttagttctgtgtccatagcgctcatgaataggacttcacacatgataggaactttaatatttgttggttggatggttgaacaaatgagtggaagaagaactattcagaagttcttttggcagttatagaaacttggattaattttcttaaagaagaaatccattactgtttaataagcatagtttggttagtaaaaatatttcaaaacaaaatgtccatgagagcaaattagtaatataagttcttggtgtgaaaacgactttgcacacttgtaaactaggttcccgaaaacttaagtgtcttgctccaagttgagcagggggcggtgatggcaaaaccaggattagaatccagagctattggcccatggtcttcccaccacaaactatgttattgaaaatagatcaggttcctttagatgtttaa

SEQ ID NO: 127800 - DNA, 1092 bp, Homo sapiens
atgcttctcgtgttctttatccctagttggagaaataactctttgaagatactttttcatgtacattcgggagacatcagtaatttaggtgatattttcatctttacggtctagatgagtcatagagtaagtgtctctctcctggtttaagtggtgaattccttcagaaagccactggccgactagccccttggtgactgtcccagtaacatggaggctacctggcctccttagtgagcccaggagaagaaccttattcttctatttggagttcttactttattttcagcatttgcgaaatctcaaaattaagttacctgttttcctgattttgaactttagttactaggctattccatcttttctcttagcacctaagaggcactaccctcagttcaatttattcaggtttcaatttcttcagcccagatgttccttctgtcattacgttagttcccttggaagctatccaggctgctgaaaatagcttgagtgtgtcacaacccactggcacttaccactttctcttcagtagcagaactcttgccctattgagtgagcatctcccaatcaaatcacaatggatagttgtcttttttttttttaattatactttaagttttagggtacatgtgcacaaagtgcaggtttgttacatatgtatgcatgtgccatattggtgtgctgcacccattaactcttcattaaacattaggtatatctcctaatgctatccctcccccttccccccaccccacaacaggccccggtgtgtgatgttccccttcctgtgtccacacaatggatagttttcaaagcaactacccattatgcatgtgttcttaaatggtacgttgaagagactatacaaagaactttttttaaaaaatcaagtattacgcagccagctcatatataaccattgttgaatagaactattaccctcaataaataagaaatgatgacacttggaaaagagagaacaatagttaatgggtctgcttttccctctaaccacaaccatgaaaatataatcctcattaaagggctataaagttgtctgctttcaaggttcagcacactaatgtctcc

SEQ ID NO: 127801 - DNA, 1021 bp, Homo sapiens
tgtattcttattacaaatcattataatgcaatagaataaaacacagtttgcataaagatggggcccatttataaaactgtcaccacagccactctattaatagagccattttaaagatttattgtgagcatatgttactttttacagggggccagattgagagctgcaggatttgaacgtggaagagtgtgctactgatgataattcaaaaaaaaattaaagcgattctgcccaagtagtatcattagactggtactcttcccttttcaggtgtgattatcaaagatcaatcttaatgaggcattaaggacaggtgacaaggtctagagcagtgctacataactacttttttaaattcacagattctagttttatttcctgggaccgctagaggtcagggaacacaatgcatgggctaaatataagggtttggaagcagaactgggttatgagctttattgtcctttggaaaacggtggctgcatgtgtctggtggggaagaagtagtaaagacatcatctctattcattcactgttgattcagtgagagtcacagccctcctccataggattcctgaagtctctagtccctggagtttatgcaaagagctagacagttccacaagcttacatttattcagcaagttcctaaatagcacttgcaatgtgctaggcactttcctaggttctaggtatacagctatgaagccgtctaagaccctgccctcgtggggcctgctttccagtaaggcaaatgaaaagtaaacaaagtcaatgcttgtggtatcagattataagtgctgtaaagaaaaaaagaggcagtgaagggagatggagaatgatcttaagaaggtgatgtatgtgctggcaccctactgaagtcagcaagtgagttgtgtaactgtctggaggaagagcagcccaggcagagggaccaggactttcagaggcccaagcaaattatgagtatttttgccagtcctaccaccaagaaaccagctgctttcagattcctttgcct

SEQ ID NO: 127802 - DNA, 1140 bp, Homo sapiens
cttgttagtaatattacctgccacataatgagtgctaccatatttcagacactgtttatagacacgaggtgaatttaagatactactgcaatacatacatcactgccaaccttataataaccctgcaaggcagatattatttcctcattttacagattaggagcctgagtggtcagaaaagtgccacagttaaatatctgggaaagctgaaattccaacccaggcctgtctgacctcagaccctgtggcctctcctgtatattatgttgctcaaaagatcataccattgagttcttaatatgagtggcacactgtgttaggaaccatgagaaagacaaaaaaaaataaaataaaataaaagcacaatccctctactcagagacatgaaaatatagttggggagagataattttatgagaaataacagaggacagtaaaagatgaggtataaacacatcattgtgttccttggactatgaaagctaaggaacagagagagattaatgtagactacagacaataaggctgaagctgcgattttgagagacaggtaaaattcaggtgatctctgtcatagagttccagtcatatattgatgttagaatctactcctgtacctagggtgaaaatcagatatcatcatgattacctatgaaaattgcttagcaagttagagatgaactactgtctctcaacatggtaaatataacccagctacattttcctccaattttatacccctttggttaaactccaaaagaggtatcccccctgtgaataattatgtcacataaaaagtacacattttaagtactagatcacacagtcacactcagaatgactagagtctgataccatgaaagacatccaggagctgagtctgactgaggggcctggattggtgcctccctgtcctgcatactgtgggacacattctcatcgagtggaatggcaggccaaataccttgatgtgtttgcattgcccctgtccctctcagcccatacaccgctgatttcatgtatattaaatatgggtattctaaaacctcactgaagtggagtatgttctaaataagcagaaaaacataagcaaaaggacaaggacagaaataattttggattctcatgaaatcatcaaat

SEQ ID NO: 127803 - DNA, 1023 bp, Homo sapiens
attttctttcctccctctctacatttatacttacagtcaaacatatcacttccccagatgagagtctcagcttagcactctaaaatgctggtggcattaagttaggtaatgaatgtgaaagtgactaaaaaattctgaaaacaaatttgaaatgttattatccagttgtcattcctttggattctcttaaagtcacatttaaagtaggtagatttatatattacttgtacttttgaaaataaatatatccttcaatcattctaatagtttttaactattctgattccttctgtgtttttatgatatcgtcttcttctagagaattagttgaccaaaaataaagggagtcgttctatttcttaagacctaaaataatcattttggttcatttatgatgctctgaatgaaaaattcacaactttaggaataaaagttttccagttttgttttaataacattcctttttttgtcctcataaagtagtattaagtaatatcacattattaagtaatatttctgcactgaattttcagtcctctgatgataggattttctttcttttgtttcaaaagttgaagcaatcttaggaacaatagtcaaaaagaattcatttagggaaacatttcacaaagatcccctggtcattgctttcaaagtttagatgacccaagtaacagacagtgttgacgtctagtcataacttcagtgtgggtaggcaggcatcttctgttctccaataacgatactataaagtgtcaagcatacataaattctcaaatctgagcatgagatacaaaatttttaagataatctcatgcttttgttccattccaatgttttaacttacataaattatcttagggaatacagtggctcaagcttgtggttgaagttgatcaagcccttcttttgatgagtaaatgaataaagggatacccatgtctgctcagaaccatctttggtccgaccttatgaatagcacagatacgtcctctataatcgtggcctaaagaaataagaaaa

SEQ ID NO: 127804 - DNA, 1107 bp, Homo sapiens
ctgggggtgccttagacctggaacactaacatagtgcctacctttcagcataaggagtaataaatagtgaaggggtaaacaagtagataaatgtatgaacttaagatttaatataaagagaatgtctatacatctagaagcttcttgcatgagtagcaaggctgaagaaaaagtgaaagatgatttttaagcttgagcttaggtaactggaatgatgatgacacaaaaatagagaacacaggaggagagaattgaaatgataatgggagtgcagcagcgaagagctccatgttggacatagtttgagttatcaggaggacatcatttgaaagtatctatcaagtgattggaaatgcaggtcaggagcaagaagtcagggctggagataatatttgttgtatttttagagaaataattcagtctttgatatattcaaatgcttatatttagtaatattatggtcctctccatccacacaatgtcccagtacctcagcacacactttagggttttcagcatggacttaagtctattgattgtcatccccttgcctgcccacctctggagttctaaccttacgggtgaacctttgagaggctttgatattaaagtatgttggatagcgtgatgaagtctggcatggtctctggagacaaactgtccaaggtcaaattttggccccatcccttgctagctgtatgaccttgggaaagtaactttgcctttctgtgccttcgtgtctgcttccaaatggcaattataaaagtacctaacttcatagtgttataaggaatatgtgaagcaaagcatggtgattacttaaaacaatgctggcctatacagttggccctcagaaaacactggtttgaactgtgcaggtccacttctatgctgattttcttaaataaatacggtcggccctcatatcgcagggctctgcatccacaaccaaatgcagatcgaaaatacagcattcacagcatgtgaaatcggaagatatggtgggccgacttttcatatacgcaggttctgcagggctgactgccggactggagtgtgcacagacccagatggtcttggaaccagtcccccagggatactgaaaga

SEQ ID NO: 127805 - DNA, 2169 bp, Homo sapiens
acatctgaccctttgaagattctggccaacgcagacaccatgaaggtgctgggagtgcagcggcctctcctacaggtaataatacactttgaacttactatttttatcagcaattttcattgacttggcaagtgtcataaatttaaaaaagaagaattaccatctgtttccatattcatcagggacaaaacaaaagaaaataaataggcactagggaaatttagatttaatgtagttggataatggaagttccttaagatctttaaggaaaattaaaaaaaaaaacggttagctttggatatgagagatggtgaatctcattaacatgcaggcagttcctcattattatgcctggaattggtccttgaaaggaactatttttccattggtgaatgcatccctgagtatgaaggattaacaggaaggaagctatgatgcccaacttcaattaccagcaggaaaccctctataccttttaggggcagacttacctttcaatgacttggctacctcacagggaatttgaaccagtaaactgacctttaaaagtcaaatcactgaattcacatgatgatcttgttagtactgaaaattttactttatataaaaaaatggtttcttagcatcagaaaaaataaaataatctgtcagtagattttttgattaataggcttgaggcatatattttatatacattttagctggtgacttggaggtatatataaaactaaaacaaaattagtaggagtttaaattataggtatacattaactattattacgttggaattgaatccttattgtgtttcttcatttaagagtaggatgggcacagtctcacacttttacctaaattgtacaatatgagactattcaacatgtggaaggcttgagcttttcaaagagaagttgtatatatggaagggagttttacttgttccagttgcctgcccttacctgcctttacatatgtttcccttgatttttctttgtatgttagaatttacagaagtgctggacctttcttagagaagcgtcctagttatgagcattcttttttatgagcaagctcttttatgatattgataaaatagaataggaagatgttcatttggatggtctgggtctctgttagccatgtgcctggtgagggatctgtactgagtgttgggtgcagagaagggggaatgccaaaggaacgtgcttgctcttccttctgctggatatctcttccggctctttgcatggctggggtcttctcctctctgggtgtcacttaaaatgtcatgtccactggaaggcttttcctgactgtcctacctaattaggtcccctttcctggttattctccattctcccatttttccttaccaccagccccatccattgtcaatactgaggccaaaccctatggactgtgtctgtggactgtgtcatggaggcccccttgccaggtagcttctgatcaggttctgccgataggcagcacaagtagaagattggaaagtgggaggagaaagagggtgggtgatttcttctccccttcctcttcactttggatcatggccctggctgtgagtgcctccctccataacaggagatcctgccaggtgacacatcctccatagctccagctctcactggactctggcaatgtcatttcttctccttgcctcttgatttcagctttctgctgttacaacctctggatgcctcagtatcccttgttcctgctttcaaccctgcccatacctctgtaagttatttcttcattcatatttctttatttgaattatctaaatggaatactttttttttttttgtcaagatcccagatagatctccccagttaatcaggattttaacactttggttttttcttcctaacacttatcacaaccctaattattaattaattttgctaacttgtatattttctatcctttcccactagaaggtaagttccaaacacatattataatgtcaggcagcaggaaggtgctcaatgaataacttactggatgaatgcatgttgcatggatggatggatggatggatggatggatacagtgaataagtttcgagagtcataagtacccacagagtcagaataaggagatgagaaatagagagtaacaaaaatatgtttacttttatgtgttgtctgacc

SEQ ID NO: 127806 - DNA, 2873 bp, Homo sapiens
gaataagtcttgaggctaagaccattcaagctattaacctgcaaatttttttttctagagttaacacacctgcttcatttttttttttttttttttttttggtgattatgttgctctcctttttttcattaaaaaaatttattttatgaaaatgcaaattatttaaaccatatcactaagtttgtttaatattctcagagagagttatgcagtttaaaaagcaaacaaggagatggttatttttttttcctatctttggtattttcctgcattatagtgattgtaaattgttttctaataattccccatactcaagcttcattctttttttgtcttcctctacaagcacagggtgaattttattcttgaattttttctatgtttccttaatattttattcccagctaattgtaggtggctaatctgaaaaaagaataagaaataattctcaaaaattttagctgagaatccaaaacaaatgttaagaaggagcttggagaaatatgtgtgtgcgtgaaagatgcatgtgggttaaatattcaattacaggaagtataaaaatgtcctttaaaattcttccctttgctaaactgttgtttggtcacagagtagaagagaggacatgcctttccctgtggcaacacccagtgtcacacagcatcagcccagccggattctccagggagggtgggaggacagctgtctcagtgatgcttccagttgtttgataacggacagacacggtgcctaggagccctgtgaagagaaccccaggacactttgtccttgtccctctgaagtggcatctgggcagtacagacacttggattattagaggcatttccatgggtgccaacatgtgttctcagtgatttcactttctaggcacaggttccataggagggaaggaaggaagtcagtaggaaggaagagatgacaatcagcattttatacctaaaacactgtgcaagtgttagcccaagctgatacagcagagtaacactagtggtaataatagaagaagtaaaaacagtaatgatagcagttataatagtagatagtagtaatgatagcagctaacactttagtagcatttactgtgagtcagacactattctgggtgctttgtctgtattgattgcaagtgtttaaaatgtatggcaactctgagtggtattctttttatgaggaagaaactgagaaacaatgaaattaaataacttgcccacagtcacatagctgccaagtagtagaactgtaatgcaaacccaggcgatgcaaccctggagtcagtgctcccagccagttctacccaaagtggattctgaggattatgcttgtctgcaagctgtttgtcaccagtctgctatgagacgtagagaatttaggagtgagcatttagacaattttttttagcattttgacattgtctgttgaatccagtaataaaaaattgggcctcatgttttgtatatctttgtgggttttaacatttcttttttctagcaattcatttttatgttttataaaagtatcaatgtgcaactgattggggataaaaactgggctctccatagttagagaagaactgtctaaatcccttacttttcggtactgcctcacagagaggtaaagcacagaaccatcacttttaccccagtgcctaaagcatttttcaatagatagatagaaaagtgcagatatgtgttacagttgggtctctcctaaatccccagctcctagaatagtgtctgccatagaggaaacactcaatatttaataaatggatgaatgaatgagtgaatgaaaatgaatgaatgaatgatgacttccttagtaccaggacatggctgtgttttctgcgcatggtataaaactcatggtcttgggtttaagatagttaatggtgctaaaattaaaatgtcacagttcttatgcctctaatgctcccaggatgacagcaggattggatacatctcatggtcttaccatttgagatccctctgttgccatcactttttctgcagaatggcctccacctgttgcaaggaaagcatgttgattcaaactaaggaaatacctgaagagaaattattcatttctcctgagtcagattctgaacacggagttctggaaacagtccattgaagtggataccatctcatgctttatatatctcccagagtacaaattattcattccttaaacatgaggagacagacggaactgattcagttcatttccctggtttaccattgatttggagatgccatttaatttatttcttctttggtgtctccatctgaaaaaaagagcgaggggactaatgcttaaggtttttgaccccttacccatcaaattgctgaataggcaactatctatgtgaacaaatggtacaagcaaactttcttcctctatcaccaatggaatatgccatacccttgctacttagagagtgttctgtggccaagagcatcaacctctgatgagtctgcatttgtatagaatctccagatgatttgtatatacattagagtttgagcagcattgccttataccagtgcaaaagcaagtgtggcccatggaccgggagcatcagtgtggcctgggagcttatgagaaatgcagattcctgaacctcactccactctggaaatctctgttcacaccagccctctaagtgattttggtactcgctaaagtttaagaagcatactcttaacataacgtcgtcatgatacccagcgtgaagttaggaaacgggatctaatgttgtggggttttagctttgtggtgaacaacagtagtcattttttaaaaagtattcagctttgtttcatgcaggcccaggaattgtaaaaacaatatttgct

SEQ ID NO: 127807 - DNA, 1398 bp, Homo sapiens
gaagtctctgagattactttctatcatgagtaaaggagccccactgatggtcgtcttagttgtcacctagactgttctatgaaacagggcttatttggggtaagcattttgaggttttgattggctactgtccattttgatcttgtctcagcccactccttggtggataagcaggagagaaggtaatgccttatgacagatctgctgacaggaactgaaatacattaacactctgtcactcagatctttagagggctgcctttgcctgaaatatatttgactttacttgctaacaaaggcatcttcagatttatttcttttccttaaatgttagagaagaggaagagcgtcccattgaaagatactgggaagagaaaagcctggctcgacagcccaagcaaatgatagttagcattcttgggagcagcagaattgctgatcgtgcgagattactagtaggagccagatgagtgtagacagagaactgctgtacttaggaaatttttgaggttcttatcctaagcagtttttgccctatgtggatgttgcagctctggcttaggatgctccagtgagaaaatgaagagagagaaacaagactatctcagcttcaaagtttaatggccatttaagattaacatttcaagtaaagcagctgcttttcttcatgcttttcaaggatcctgccctactcaaaaacttgtgtgtacttaatcttagcatagacaatctcagatgggctggtgaaacctgatacatctcttataacaagagtgacatgacacagtgaaagaatttccaccattgaaattttaataaaatgaaatgattaatatttattcgacacctgctttgtgctattgctagacaaggtgatgtggggatacagaataaacttaaagcaagacttcttcttctcaggaatttagtagggatcaattaattaggaaaccggaattcctcacacctacaaatccaagaacagtaaaggacactttataattgagtactgaatgtgatggtttagaagattttcactataagagctgaggagagagacacagaaggctggaggattcaagagagaccttaggcaagaagtgggccctgagtcactgtaggatgtgtagaaacgaagaaggcagaggagaaaagtgacctgaacaacagtcacaatgtaagcaaagacacaaaaggtaaaactgaccatcgcgtgttcttgagacagtgagagtctaaatgagtgaaggaatgaaaggagaatgagaaataaggttaacgggggcacaaaactctaccagggaggtctcaaactgaacacaccagtttacttttgaagtgaaaatgatacagaatggtgaaagtttttagagaaggtgcatgttcaaatggatgcac

SEQ ID NO: 127808 - DNA, 1313 bp, Homo sapiens
catattatactatattttatatatatcttatatatactagatatataagatatatataaaagaaatacaacgtttgcccattatactaactgaagatacttgtgagttaggctcatcccaaactgtccagtatttgcttctcttagaaagtccaaaagcttttcatgtaacttggtgggctttctccctgacagaagcatttcacatatgcctactctctagcatgtcattcctgccacatatctcagccatgggcatctcactctcagctagtgcagcctatcttgatacctgctcagaacttggtataaacaaaactctatatacttcatgttgcatgcagtgagctaaaggaagctttgcttactttcacagattacaggtttattttataatcatgccatgaacacaagtcagagtaatctgattctttgctgcagtggcattagagcactgatagcacactctcctttttcagggagaatgttgtgtgtctggttgactggataaactcttcagtcttataggatttgaaagaacataaaaggcaggcatttatttactataataaaacaatagactttgcaatgaattctgtaataactgccttttaatcctcacagtcccccacacacacacacgagaactttataccccccaaaaaaaagttaaacgtcacacttactttattttatatctctgaagttggtcttcaatcaagcaaaaaaataagggataaagtgaaaggaaatttgagaaaagatcctgcaagaagcaagctgagactagaatttcataaaatccatttctagccctgtcagctgcctgcctcattaccttagactttcatataatcttttaagtctttagttcaatctttctactcagttatttttcttcagtttcttgtaaccttcaaaaatgctaacaatagaaatcacaggccaacctgaagttaatccagtaccttgtaaccacagccttttaccacccttaactgagctgtgtgtgggtggcttgcatcccacggttggtactctgggcttagagagtccttgcatgctatgtgggtggcgttcatcctgtagtgttcctacgggtttagggagtccctttccagtacccaatcagatatacattgttctttatatgctgggctgaaagattccatacttttgtttctaggaattcaggaccattcaactaagataatacggtataatgcagggaccaacaatctttttctttttgggctatgctgtctgtgttgcagctatgcggctctgcctttgtggtggggaagtagccataga

SEQ ID NO: 127809 - DNA, 1032 bp, Homo sapiens
tagctgattattggattataatggcttctctattcctaaggctatatatatatctaaatatatatatatctaaatatatctaaatatatctaaatatatctaaatatatataaatatatatataaatatatataaatatatatatataaatatatatatatataaatatatatataaatatatatattttttttatcagcaaagagaagtggacagttgtttttcatgtacggcttaccccagacaatcagtagagcacctctgctgctttatactctctcagtcctcctgaaccaaccttcctggaataatctactaatctaaaccagaaaacgaacttagttccacagcagatttcaactgtacctctatattacagcaggtaccctgtcagatttcttctatcgagaaatgaaaagatgtacacacgcccatgtctgtatgtcttccatttatcaggcagggagaattgattatctcaattctaaagatatcagcacatttggagatatgtggcttttattctaggaccctgggattcacattttagcctataaccttcaaatctccacattcatttttctccaccctaagtgcctgtgtagtgatgtaatagcactgttaaccataatagaatgatcaatgattttgaaaaacatagtgtgtacctttctctttgggaggagggtaaaagcaactactgataagaaagtaagccttagccagctccccacgatccatctgccagtcaaagcagttaatcttatataccccttcccactcaagaaagttagtgaacagttattacatggctgcaataattatctgtaagcgttatatctacagatgtagactgcatctgtctacagagaaggcgctgattttaagcctgctttggcacctagttttaagcctttggctttatcaaccatgtacgtaggttgtcacccatataaataggtcctatccctcaccatcctgagccttgattttcttacctgtcatttgagatagttacctcacagaattgcc

SEQ ID NO: 127810 - DNA, 1760 bp, Homo sapiens
atgcatttcaaattccaggcgcctgttctgtgacagccttccaccctggcaggtctctttgttgccatcttttgtagcatcctctgggtatttgactcttctcccctgcctcaaaactttgcagaaccccacccagtggcaccaatttgttcttcaaaaaccttattctacttgtctcgttgtttctcttttcggttgagttaaatctacaaccactgcttgtgcatcttcatttttccaagcagccattagaggcaaatggcaccacagctcctgctacatttcaagcttatgtcccagaggtggcaagacagaacatcaatcttcagtgccacctggctctctgataagcttttgtttcatgtgtggctatgttgtcaggagcttcacgccctctcttcccactacctcacccagagagcttttctgaatatgacaaccatctaaagacgaattatctccttgcaaagttaatttctgtttctcagcagggagccactggttcccgctgggcttgaaagtactgctgtttgttaatggatgagtgtctcttggatcctggtacccacactggaactgctgcagcgcctggctttccatttgctttaatttcctacttgcagctggtgttaggagacctaaatgggtttattcacggaatagtggtttacagtcattagcactgggaggaaatcatattgaagacaaggactagagagctgctttcatgccatccttgaacacttaggacagtttggttggttggttgattggttttggcttttttagagagcaaattcacaaaatccttctagagatagaacaaaaggcctaacataaaaggtttatttctgacttttaagagttagaaaaaaacagtatttttttaatgtcttcaatgtacagaatggtgaagataaaataagatgctggttgaaaattgctctgagcacttttaagtgtaatagtcgatgttgctattgtttggtatgcccaagctctttaaagtgcaggaaatttcgttacaaagatttgtgctgtcttctataaagcagagccagctgtagactagaaaactccaacccgtagaacatctggaatgtttgtttctattcattatgaaattgccacttttgtaggtcaaacaaggtcaaatgttggcaatttcctactattcaacctatgcagttttgtttttagatagaattctgaaggccaagagagcaccataggtatgtttcctgcctctgaaaaaaatccaaagcctgtaggccaatgcctgtttgtccttgagaggagcccaattctaagctgttaactgtgtgaatctgaaatgtgcctcagaattgctatgctaggagaacatctggtcacacagactggctaatgtcggacagctcgctctccctttctccgcctcgttttccacagcatttctacatattacactgtcaagctaacagagcatgagagaacatcaaactaaaagttctgagcaagaaagtacaagtgcaagcaattcctcatgcctaaaaagtgccactgacaatgaaaaactttactactggtgactccagagatggcagtgtgtgaaagtgaagaaaggactatggaaaagaaaaagaaatctttccccccttacagctgctttgtgactttgggcaaatattttcatatctactagtttttatttattttagagaaatgttgttgaattgaagagaatcaaatagctaaatatcccgtatagagccaacaca

SEQ ID NO: 127811 - DNA, 1466 bp, Homo sapiens
atagcctggtagagaacacagactcagcccttctctagacttgccttctcaaactctttcacacttgacctctttcgccattcttcaagttagagtgggtattcggtttttcataagctctgtcatttttgttttccctctttctgcatttatttcctagccatggtaaatttgggatgttgtgaagatcaagtctcagttcactctccatccacttacttgagaatagaggtactcggtagtcgtactcacattcgctgtgctccagggagctagttgtcaaattttctgaaattttgtgagctggttgttaaatacagccattattaaaaagcaaattctgtaatatgacaaaggtaataaataccaagactcatcacttcttaattattttttaacatttcaggattatctatgttcttcagggtatctgcatgcatctattgttgctgatagcagagttattataccttattactgtttgtgttgcttttcatctcttcccaactctgagttcagcaacatttttaagttcagtgacatctcggtggtagcttgaaaccagccacacaaccaaaaaaatcaccacaaaaaccaccaaacaccacaaaccaggacccctccatttccctggagagctgcttgtcaaaacatttaccagcacaccgctagtcatgctcttcttctgttcctgccagtcatgagtgattgtgagccacaccaattaccattcatcttaaagatggcaaaagtcttcctccaaggtggttacaccaaccttacacgttttccccccacagccttatgaacacccagcccagatttttactctggatccatggttactcctaggctgcctctccctccatctttctcatccccaatgattcagtcattaatttctctctttctccctctgtttccacttcccatcctcttctccttcctcctgcttcacattcttcctctaccagtggttaagagcaagggctctggagacagactgactggctttgaatctgggcttcatgatctactggttatgttaccttggggttgttactgaactttttgtgcctcagttttattatctgtaaagtggagataataacagtatccacctagcatagttatgaggaccaaatgagttaataattttaaaagcacctacaataatgggtggcttatagtaagcaatatgtacatatttacttaataaaataaacacttatatttgtcatccagcccttccttatgtgctaatgttcaaggccagaaggagaacagcaacagaacacatgagaataaaagaagaggcaaaatggcctggggttgtatcacagcaatggtgtgacagttctcgggaactaggaaaagagtcaatgaaaggaactggaggaaaggtggggatcaggaagggagacaaataagaagaaaattacatttcaaaataatctgcaaagatt

SEQ ID NO: 127812 - DNA, 1029 bp, Homo sapiens
cctatgctaaaataatttcagaaagataagtttgaagacaggttggattattggcctgtacctgtatgacaatcgtatgtccttctggtctatccttttgtcttaggtatcagttctgagtgaatttagagggcagggtttgaggaatgttgaaagagagaagagatctcgctggcctaaaactgcccacgaactgtctcttggctgctggcattggagtggcctgtgcttcccgaggctggtcacatagaatggtctactgatgatcaggagggtccagtcttcacttcctgtcctgacaccatcctatccacttgctgagttacttcacacctttttttcactgaagaatgtctccaatgacagtctttcttcctgtaccacacactaccttcacagcttcctgtaaacctagctttggcctcactagtcccaccattgaaactgtcatctgaggaaggtcacaataaccttcttccacaagcagtcttcattcatgtctaccatgatacacctggcatcatggactacctgaaaagattgaagttactgctttttgtttttactggaaacaacaaaaaatagtggttaagatacgggctctggattcagtctgcctgagtttcagtcataacagtataaactgttttgctgttgtattcgagagcatagcatagtagcagtgcctggcacatagtaggtgatcaataaatattggatggattcacagataggtaggtaggcatatctgtttgctataagctcatctatatttgtggcttttcatgtcttttaacttttatatggcttcttgctattaatatttttcctttagtaagttacatttaaaaaattaactcatattgcttaggctaaggaaaagaatgaagaggtgtgtgtgtgtgtgtgtgtgtgtgtgtgtgtgtgtagactgtagagcagggaatcatattgggccctttgagcaggaaaataatatttggaaatatacaactgggaaataaaatttcaggggacatcattacctcg

SEQ ID NO: 127813 - DNA, 1084 bp, Homo sapiens
tccagtgaggaaatgaaatagaaataataattcaaagagaaaaaggaaaagcaaaacatatccagctgttaaagaagagcttgttcatatgtattttaaatgtataatggagggtatcaaatccctatggcattgagattctattggatgcttttttaaaatttttaattgacaaataataattatataatgagctacaattggatgttctgatatatgaatacattatgaaatgattacattcaatctgattcacatatccattacctctcatacttctctttgtgtgtctttgtgctgcagacatttaaaatctactctcagcattttgaaatatatattacattattgttaattatagtgaccatgatgttcaatcagtctcaaaatggcattccttctaactgaaactttgtatggtttgagcaacatctccccacctcaccccacacccaccccaatcccccagcccccagcctccagcaaccgctgttctaccctctacttctataagttcaactcttttagagtccccatataagtgaaatcatgcaatatttgtctttctgtgcctggccattggatacatttaaaatagtgatttttaacagtgtcagtctttagggtatgccaaaatttatatctgttgcatctatttaaatgcaggctaaaaaaattaaatgtcaacttaaaaagggaaggagaatatagtttttcaaaattattttaaaggatacaccaataacaattgtaaaagccactattctaggttaattgcctgagattggaatttctgggccattagagtcttggattttcagttttacaaaaccagattccaaagtggtagtaccaacgtctcatctaccaaaagagaatggaataaaatattttaactattaaaacttaggcccgatgcagtggctcacgcctgtaatctcagcactttgagaggccgaggcaggcggatcacgaggtcaggagatcgagaccatcctggttaacacggtgaaaccccgtctctactaaaaatacaaaaaaaattagccgggcgtggtggcagcgcctgtagtcccagctactc

SEQ ID NO: 127814 - DNA, 1042 bp, Homo sapiens
gtcgaagaaataagtacatatttgtatttgaagaaaaggacttgggaagaatgaaaatttggtgatgtaagaaagaaaggggaaaatccctgaaattatgtttttggccagggaagtagcggtggaggaggggtgtgcaactggagtgattggtttaggcgggaacatggatagttttgcctgcgctgtctgtccgttctataggaattgtgttatttctctgtcattcatattttaccgctttgtccaaacagcaaactctatctctcttggactactactctggaacatggccattgctttggtttttgacatattctggtcatcaggagcattttgattccttcccgtaagaaactctactgctgtggcatctctgctagccacagtctctgaaatggtgtccacctgttggtgcccactgtcacatctcaggggattatctgggagggatctaccatagttgctgaatgatggacctgggttaaatttttctcaggattgggaaaagtattctttgaggctttgaaagggaataaatagaaaatcatctttctggttgttatacaacaatgcacactcaaaggcacaacacatgcccccacggtgctgttgctgctggttaatcagcgtattcaggtttctggagaaagtgttttcttattgtatgactctgaagatgcaaagtgtccttacttcctctcttcccatttattgccctcccccagattggcacctgctgaggactaattagggcagtcctaatttggacggccaaatcctgattacagtgaggggaaaaacaggaaatgttctagttttgctgccagcaaatgactgacttaaatagaaagccatatacaattcaaatgatccaaaatggtataacactggggaaggaggaagggagcaggaagacgttgcactctgattttctcccatgtgatcctcagcagatatccttcagagaaatcatcaaatctagaaactcacaatgccctctgctgagggttggcttgttttccaagcttcccatgaaaac

SEQ ID NO: 127815 - DNA, 1004 bp, Homo sapiens
taaattggacgacggcactttactttggaccagtcttgtccaaggttcatttgttgagcttggctcctagtttttgaagtatcttgaaagattcagtctgggaaagtacacatcatgccctggctgtcaccaaacaattgaatccaattagccccacctgcacctggttgtttacctaatgaaagactcagcaccccagctgtgtccagggaccatgcacactcgcacttcccaactgttccagagaggaagcggtacacatcagagccaggcgacaccagcagatgttttctgaatgaaattcactcagctgtatctcgagggtggacctttctcttggcagcctcatcacctgtaccaaaaggtacacctattttcctcttcctcttggaaacagatacaaatagttacacagttggctctgtctgtggctcattgagctgtgaattaatgagtacattatggttctggtagggatgattaaccttgcttctcctatggaataatttttggacatgtagctctccttttttgaggctatttggatatgtcctggaattctgtaacccacatgatctggtttaccagaaaatcaaaaacaaataaatgcaattagtcagggtggacttgccacttgagtaaaaaattttctttagggtaattgtttattgctgatcaatgccagtatttcaaattagaatatttggaattacttttgggattggtgttcattccaaatgtactaacatatttattgttgagggcagtatgttagtagccttttcattcatttggatgactattttttaataaaatgggatcgatgcatattagagataatgtaatcttgaattactgaattaatccagtcctttaaaaatatgtaagtaaataatgtgggtacctttaatgtcatccaacctaacctaatttttttatttcagctaatgctaaaatggaaaattctagcccttcaaaatgtacggtaccatctcacacctaca

SEQ ID NO: 127816 - DNA, 1004 bp, Homo sapiens
tgtaacacttccgtcacctttcaggtactagttatgttgtcacttaatagcattcttttacatggttatcccactttttattcaacattttcttaaaaggtcccccccaaaacataccatatgcttttatttatcctaagggatcaaatatggtaagaggagctaattagttttttcaactgtcacgattactcaacaactaagaaactaagaatgaaatctagaaatgttgtttcccagtaatgtgacctattaatgggtatcatggactccaacttagataatggattatgttcaaaggagagatgagtgtgatttcttttttcctgcagcaaaggtagatgaaaatgctaactgaataccaggcatcatgctacagtgtctcttttctattggctgtgtttaggggtattgtccagtcagaagaaaaacttgtcatcagtgcatcctgggcaaaagatgatgatatcagcagactcttgaaatctctaccaaactggatgaatatggctcaacccaaacagctgaggccaaaaagagaggaggaagaagatttcataaggtaaaaggtccattttctaagttgtcctaaacatagggaggaagcacatctgtttagctaatatttttttacatgaaatttaggcaaattctaaaaatcaagcagcaattacttgaacttagtaaaatatgttttcctcctgtctcacctcatttcccatgcaagtgtgccttgagctcaaaactttagaaggaaaaaaattaatgtgagtcaaatttggaacattgctaaattggattaaaatatctttttttttttttttgagacagagtctcactctgtctcccaggctggagtacagtggcgcaatctcggctcactgcaaactccacctcctgggttcacgccattctcctgcctcagcctcccaagtagctgggactaccggtgcccaccaccacgcccggctaattttttatttttagtagagacggggtttcac

SEQ ID NO: 127817 - DNA, 1027 bp, Homo sapiens
ttgaatatcctcttttgtaacatatttgttcaaatctattgcccattttaattagcttgtctgtctgtagcgatttttaagagttctttgcatatctggatgtaacatctttgagatagacagatagaccaacagatcttctcccactgtacaggccaccttttttactgtcttaatggtgtcttttactaaacagactttttaaagttttaataaatttaatttgttattatttatggacaagacattttgaatcctatttaagaaatctatgatttaccaaagtcacagagatgttttcttctaaaacctttattgtgctgaatatattttccccctgcatctgatataaatgataagcttttacatttttatttcctctacctgttctcttcccttcatttgcatcatgttgtcatgactatagtgtagagagtaacttgagggtttttttttctatcaagacaggtaaagaatgattgagagatcgattggttagagccctgagtagaaataattaaactgaccttaggataaaggtcaggccacaaggctccactctttcacagtattaccataatattttcccactgccagattttgaagatgcctgggtgaacatgtccccactcgttctccgtaagcatactcatctaactacagctgtcaaccttaatagttgcgctacaagcagtttctggaagaaaaattattttttcccaactttacagattattttaaatgactaaatatctttttcttcttgttcctcagcttatttttgtgtaactccttaattgtattttatgcttgacaatgggattttccatcagtcttataggtatcttcaatagcttaaattgaagggaatgctttctagcctcattccagaaaagagaatactgatccaaagaaatgaatttttacccttcatgcttctgatttaaaaaagctagaatcaaggtcctggctttctttattcttattttgctcactgagttgtatcactttctatcttaaatttgaa

SEQ ID NO: 127818 - DNA, 1047 bp, Homo sapiens
taaaatgtgatcagatacagcacaggtctgcagaccaatccctgaaaccttttgtaatgtttcgttcataattgcatcaggtctgctgaaagcgcagatttttttttttttcttttttgctttcctttcagtagctaacagaattctttaaagactaaatggagacaattttgagcatctttggcaaaatttccttaaatgaattcttgtcagatagacctttttaaagattgtaattgtgtggtaaaattaagttaaataggtttaacactcctggcaaaattaccttaaatgaattcttgtcagatagagctctttaaagattatcaataattatgtggtaaaaattaggcttaacaggtttaacattcttctttagtttcataggcttctatgtgagcctgttggccaactgatttggaaggcaagtcctcagatgggatccagtacccaaaacattcatgttttgagttctgatttctgctcctggctgtgtcagatcatctttgagcaattgctgagtgcctgttacctctgagtttctgttacttcaccttctgaagacaatgttaatttgctgcctgtttcactcaaaaatacatagtgtcttcattaaataatgtgttatcataataagcagaagatgaagggtacataaaaattcaggcctagaaagtggaaataatactgtccagttgccaggcagcagccattctggctgcgaggtcttctgcaggggacaagtgactgtgtcttccgcaagcctggagccaccagtccagaccagcttcaggccagtgcgcccattgcctcccaccttggcacaagtaactaatacccaatgtcctccagttttatgtgctgggattcctggcgtgcccatttgaaagttctctcatatgtggtgagacgttccgtttttctcttcactaaaacgtgaagttgttttttggagaacatatggacagtatagaaaagcacaaagcatgatacatttctgcagttgacattttggcatatagatatccaaccttttttctgctcata

SEQ ID NO: 127819 - DNA, 1054 bp, Homo sapiens
aattatatttaaagcattacttcaggagtatgtataacacagttaaaatagagacaaagaaaacatgatatgaagaaggcataaaggaaaaggcagatttattctttatttgttgagacagtctcactctgttgcccaggctggagtgcagtggcacaatctcagctcacagcaacctctgcctcctgggttaaagcgattctcatgcttcagcctcccgagtagctgggattacaagtgtgcaccaccacacctggtctcaaactcctgggctcaagcgatccacctgcctcggcctcccaaagtgctgggattacaggcgtgagcaagcacgtccagaccaaaagacagatttagatgtgtgaatggagagatagaaacaggatagaaaaagcaaaagaaacagcaggaaggataaggaagcaaaatcacctctgaatttaatattagggctattagacagttattagaaagaaaacacattatttggactgtacatgtcagagtgagctttttttaatcaccgtcatttgagaaggtattattacttgattaaccatgtttccagcctagagatggaaaggtgtggattaaattcacagagtaaattattcgcttatcctctaagagtctaaggaaccccttgagtgctcactacttgcatggcctcatgctgattctctgcctatcccaagggccaatgcagggtgggaagaagggactgaagcagtgggcttcagagggagatcatagaatctgcaccagaaatctccttaaaatattactgcatatttatacttttattcttacgtcttttattgaaaatactacttatttttgagacagtcttgctgtattacccaggctagtcttgaacttctggctttaggtggtcctcccatttcagcctcccaagtagctgggactacaagcatgcaccaccatgcccaactctaaaagactgctttttatctgatgatgaaattatacaagtttattctcagaaatctataagaatagaaaatgtgtctaccaattaaggatagtttgggca

SEQ ID NO: 127820 - DNA, 1083 bp, Homo sapiens
gtacataacctgtgtagcaagccactgagtgatttacacaggctaacctggcatcaactgttttcaaaaggagaaagatgcattctgagttatgcttaactttgtaattgcacgatttagctgttgtgttcatgtcactgaaagtacccagtaaagttgatgtctaattcatgcctataatcatctctgttattctgacaaagatctcatctaccacgcctgttaatcctttgcctcatgtgctcagttccattttataatataagttgtaccctctcagttccttgcagggtgattattccacccagtgagtgatttaagtaactgtcagcattttgaggatcagtgcaaaacccaagtgaactgtaatcactacttatggtgtctgctaaaacaaagcatcaagcaagcctggtttatcctactaacagcaagcctggctcacccccacttatgtgctctttgaattcccaggagagatgcccattgatgtttataatttgaacaaagcaggggattctctgataatggcttactttgattgccctatgtcaatgtgactctagaaagggaacaaggggacagctttttattatttttttttttttgaaaagtgaaccaaatgattactgcaacaaaagtgtttccaagtctggagactagagaacatgaggaaaatgctcagcaggatgggaagaactcaagaagatcttcagtttatttcttgttccacattctgttaactatttggtatggtaaaggccatgttttattaagcttaagaagctattgctgtgatagggtggaaaaagtttgcagaaaattattttctttctttttttcttttttttttttgagatggattcatgcagtggcgcgatctcggctcactgcagcctctgcttcccaggttcaagcgattctcctgcctcagcctccctagtaactaggattacaggtgcccaccaccacgcctggctaatttttagtatttttagtagaggcagggtttcactacattgcccaggctggtctcgaactcctgatctcgtgatccgcccgcctcggcctcccaaagtgctg

SEQ ID NO: 127821 - DNA, 1041 bp, Homo sapiens
ctcttcagaaattaaataattactattaatgactattttctctataaaatattgtaatgcatccaaaaatatttctgtagcctcttctaattttttgggcaaataaatctcatagttttggttgccagaattggtttgtgaattgcagtattagttatacaattatttatatacttatttcttacaggtaaattattgttaggtatcttagaaatcatctggtctaactcagtcattttgcatatgaggaaattaaggtctcagggtggttatatcacctgtctgtgccaaactgagatggagcaggtcttcagaatcccagtttaattttctttctactacgtcagttagagccactaattggaccgttcatgccgtattcctattaaaccattccagcagggttggcatattttgttttaatggaagcactttaatgcttacaagcaagttgtggtcatttctgatcattttcttgtgcctaaacagaatttctacacctaaatatatggaattattgtacaaacccctcttgaatttcatcttagttgcaataaaacatttctgtaatttgccactctctatttttgttttgcaagtattttctaagttagaaactccatctgtcttgttatcatgccgtgtaatatattctagatattgcattgccctatatattagccactagccttgtgtggctatttaaatttaaattaattaaagttaaaaatgtagttcctctgtcatactagccatgtctcaaatgctcagtggctgttatattggacagtataggtatagaacactttcgtcatcacagaaagttctgttggccagtgctgtagatcatcactgaggtcattgataaaggttaaaaataatgccagtccatattcttagcctttgaaagatacttgaaatgcctacctagttctatcaaaacatggtgaactactttaattgtccagcctcagatcacatgtaccctcctgatgaaggttgatgtttttggctctgcattatcaaaatttctcctattga

SEQ ID NO: 127822 - DNA, 1319 bp, Homo sapiens
catgcaataatgtcaatgtatccatggtgggggtcctgggattgatttatgataaaaattttgttgtataatatttttagatttagtgtaaagttgcaaagatattacagataatctccttatctctctcatccagttcccctattgttaatatattagtatgatacatatgttacaagtaatgaatcaatattgatacattattattaatgaaagtctatacttagttcagattttcttagtttttccctgatcttctttttctgttctaggatctcatccaggatatatcacatttataccacagttttcccatatcacagttatcacatatatcacatagtgatgtctccttaggctcatttagactgtgacagtttcctagactttccttgttttttgtgaccttgagagttataggaattctggttgggtatttgtagaatcttcttcaatctgggtttatctggtgtcttttcctgattagactgggcttgtgggttttcaaaaggaaaactacagaggggaggtaccattctcatgaaatcacatcaagggtacatatcatcagtgtaactgattactgatgatgtctgggattgactttgtgcctccaatttgtgtagtcctctctaggcagttccttccaaattttggattgactctccactttctgactacaaattgcttatctttctagtggctatttttttaacatgatagaagcatcttattataagcccaatgtttggatgagttgaatacttgctaagaaaaatggttgtctaccttaaacaattatgcagttgataatggattataatcttgtgggtctgaaagactctgtgggaggagctgttttttaataccttgagccacttgactaaggcctgtagctacttttgggttgctacatgtgctaaacatcccttaataaatgtatacaaccatattaatttcaaacaaaaccatgctgacattaaaagagtttaactaaatttcttcactaaaaataaagtcttattttaacccattttaattaaactgtaatgtgcattgttgactcaaaacccattcacaagtggaactcgcttcctgagataagtccttttagagtagaatacctcataataccgagctgcacatcagttataatcagttagagagctgtaaaaatactgatgtagagattttgatgtaattgttcctaggtatgacatgggcaacaggctacaccccagaccaatcaaatcagaggcagagaaacctatgttgtaaaggagtggttttcagcctcatcgcattagaaatgcctgtgc

SEQ ID NO: 127823 - DNA, 1033 bp, Homo sapiens
gccgaggtgtcggtccacccccatcccccaaccgcacagttgcgcaatattccagcatgttttttatgcattcccgatggtgacttaatattttctatgagatggaatgtgaatattctcatgctagagctcactatcatggactctttgtgccttaatagtaaatgaaaaataaaatgcaaatcctccagctgtttgtttttctgccttggcacaaatgaaaataaaaatttccctacccaagatctcttgggaatctgtcgtgtttcaggtttgcttttgtcagaccattaagccggagttttccttgtcataatttcatctgattctttttaattagaactctatgcgtggtaattcctctctcgcttcagtatttacaagtttcaaatatttgttgactgttatcagacagttcctcctcagcctaccttacatgtttagtttctctaatcacctttctatggttagactttccgtgcccttcatcgtttttcattcttagtagttgtcattttcctaagctgactttcatattgtggcttcatttctgtcattcttcttttattgacgataccttccaaactcattgccattggttgatttcatgatcatgctgttgactaagaaaattaatttaccattggtattgtattttgttcatgagcttcccaccccctgcctgactctaaatatattttggccttatctcattaacattacttgtacttctgttgagcctttctctcttttaaaaataatgtccaaatatatttccatgttgtgctcaatgtctcaactaatgttttgtaggaacaaaagcaccaactgataattgtatgatgatccagttttgttcattttcagtcttaaatgtactctgcttatatttacaaactcgttgaaacttatcataatgaagaaagaattgtgtggaaagccgctgtgcttagcgtgttcacctgattattcttagctgtcttctgaaatctacgttattactaggaatggagatgctgcttgttcttttatt

SEQ ID NO: 127824 - DNA, 1036 bp, Homo sapiens
aaactgttaatatgtgtgttcctaaatcatttccagtaaatcatggctctcactcaccagagctcccaaaatgtttctgaggtcatggaagtgtgtctgagaatgggcctgcactggagggcctacaggtgctcatctgagaagccagggttgaatttgaaaaaggcaccttttgttcttcaaaactacaaaaacaaggctcagctattgttgaaaaacatgccaaacccaaccacaattccctctgtcaatcagctggtcgttagtagagttcattgtcctgtgctgattagaaagcagtaccccacccccctccgtaaggaggtgattatcaactgtggagctacagaaggctagtgctgtgggcatttcaatgtaattatggagttctaagtacttgcccataaaaaattatgtggctgtttctttggaaatgccaacatttgtacccataagggaaatattttattaaaatatgataatatcatggatgcttaagtgtggtggctggaagctgccagctgaatgattttatcttcaagcaaaactataaaatggaaacaacaagatatgaaagaatctctgggaaagaggagagacagaaggagttagaaagcaagagaaggctctaaaatggcatgctgaaattgcaaagccagacagagaagatggtggaaatgcagaatcaccagagcctgagccgacacccagcacagcagagaggaggagcggctgctgcagcagagtgacttgaacaagacatctgagtggattgatttggttgccacacagaaccacgagttccaatgaggagcagtggaagattgtacctgaaggcgctgattgtgctattcaatctggcctcttatctagaaaaacccttagacacttgggtgctttaaaacctgggataagcccaggaaccagtgtgaaatcatgacttaatgaactcctcaccagagaaagagtgtgtctttccattcttcacccttgaaactaagtttagatctacaaaatgcagtgggtgagggagaca

SEQ ID NO: 127825 - DNA, 1409 bp, Homo sapiens
gatttaagaggtgaggaaaagactctatttcttaatggggaaaagctgcaaagaattgtgatcatacttattccaccacactggtaaattaggaagaaacaataccaaaaaagatatttataattaatcactttggcctgtacagagagcatgttttctatgcatttccttataaaaagtgtattttccacgtgataataccattgatttttttttttgtcaatgtgagaactatatagagaggctaaaatgtgcaactgaaatgatgcatcttttcagtgttcctcagtggcattctcaaaatgatcgttatattcatggcttaaaattaactaaattaagttttcaatgcaagtgttccctaaagtcaaagcttttcttcatttcttcattagagattaatttgtagcatgtctcattgaatggattgttcacagtgattgtttttcagttagacctcttagaaatagttttattttagaaaggcagaataattatagactgttaaatgtctaagtgaccctgaatagttctaggaaggtgtacagaatactgatacttccttaatgccatatatgctggaaattttagagtaaatatacattaattaaaatatctaccataactttcaagcacttacttttgaataactgtagtctttagtcttcagtaaaatcctgatgcaaagtacaacttagtctaaattaggattttcctgatagagtctaaggagtacaagccactctggtctttggaaagtcaagattcttaaatgttaatgtggcatttcctgtgttgaccatttggataatggattactccatcatttcttttgtatacccaccctttataaggattatttcttaatccttatatgtttcacatacatcatgaaacaacaaaaggcttcattatcaggagcttctattcgcttcagcagaaccatttgaaacatctaaacagttgagaaatgcatcccagtaatatactcagaaggcctaggaaacaagaatagtgaaaatagctattaactcaaattcattaggggttaattagccatgttgcaatctccttaattttctactttccacactgaattagtcatgtgtattacttaacccagccactattgccagatcagttagcactacgattccttttcctcagcaatgcttcatattatgacttagatcataaaccagagcaccaggtagaaatcacagccaatctgagtgtgctgcatggggcctcgtgatacttcctgttaatttagatgttgacagggccagtatcagtaatgaaattagttcagggcataactccttgaacatagcaggcacttagtaaatgttttatcaaattgaattaaattaacaaaatgcttccagtgagggcctgaaatcttctac

SEQ ID NO: 127826 - DNA, 1029 bp, Homo sapiens
gatagtaacaattactaatgtcttatagtactgggacgttcctctctagtcatccatttatctctgctaagaatttctcttaggattaaatagtatgattactatttccacatatttccacagtattttggtcattaacatacatatttaaagcaatatatttaattatatgcctattttatcccttgctaaatgtggattttatttactgaaactgttctctctgactttctactttgacttctctttctttttcttaaacaatctttcctatagtacctactctggcacaaaaaacactgttatattccagaagttcttttttaacccaaaagttagagaattggcatagctactgacattgaaagaggaaatgaagataaggctaaaaacaggaggacttgttaaaagtctgtttaggatatatttaccctcagatttttctctcttacttcatatacctgtgccactgcttctatcagaattgcagctgagcactggagttttagtttctgaaaatggtaaaatagagattccttggactgagggacataagtcatagctgagtgtgagggctgttattctgaaatcaggcaaagtttacattaatgactgctgacacttctgttctttttcctattggctggcatccaggaatataacttcagacaaaagactagaaagtcttttctgaaaaatctgataagcaccaggatggtgcaggtgtaggcgggagatagacactaacatcagtggttctccaataaaagagaccagccagatcacctacaaagacaactacaatgcatcagccttacctccagacacaaaactccagtcagccccacttaaatatgagcagacagccaagaagagtaatgtttgaggaaaccttataataggaaacagagaccaaaacaaacaggaaaagcaacttagaggaaacagggattatccagaaattaagaaaaacttaaaaaatgaaaattaatatccctagaagaaataagagaagatattgtattcatg

SEQ ID NO: 127827 - DNA, 1005 bp, Homo sapiens
actggcacaggcaggactggaacctaggccagtgtaactcttagaccagactctttcaacagcagtaatagttggcatttgtagaacaccaaccaggtaggaagcaggctgtggtctatgcactctaatgtggtacctcatctagtccttacagcagcctatgggggaaggtggtggccgccctcatttctcagaggaggaaattgaggccaagcttggtggaaacaggatttaaagctgtacagtcaaactccagtgcccacgcacttaatctcaacacctctttgctatctcctagcagtttatgaatgagaaaaccgagccaggatgtctgactctctcctgaggtcacacatcaaggtgctgccacagccagatctagaacccaggttaactcttgtctcatctagggccttgtcttcttgaagaacatacttactgtggaaatacaggtgaaaattccgcatcaaacagagataccaaataacagctctaaatagacagtgatgcatttgctctctccttcttgttagtgtagtttaatttcctgagaagctttacacatacccctgagcttttctgtcacagctaattgtgcaacttccaagtagttgtcctgcctatgtttgttacttgggctcattaacataccctttaccgtagatgacactctcattaggttaaattaattaaaagatgatcattggggctacatagcttcagcccgggcagagatgtgccaccttcgaccctctggttcccttcgacagcctctgtggagatgtacccccaagacatttaaaaggctgtgctcttattttctgtcactctttatatactatctaaatcttaccacacaaacaacatttagcatgcaagttaaacagatttaaatttaagcaaaattgagtgtcaccacatgtgcttatgccagatctgtataattcttttgaggtttttggaaacgtgaaccaagccatttacgcttcataggaacagattata

SEQ ID NO: 127828 - DNA, 1149 bp, Homo sapiens
atgaaggaaggagagaaaggagggaagcggggagggagagaagaaggaagaggaaaggaaagaacttattttatcccaagttagagtagaaaactgtgtggtgtctttcacctctgtacaaataggaagaggatttggaaatcattattataccaaaatttgatcttctaaaatgttttcaatgagaaaatctcatgggatcattcttcactgtctttttctatcttctagaaagtttgaattcacagtgttaacctttcctttcgtgccgagataaccatctttcccttttcaatttctcacttgcctgacagctgataccagtctaagctaatattgtaacaattttagataatattgcagatgcacaaggacatcctcatatgaatcaattaaagaagtcacagtgagttgccattgaaagtgtggcagctgcatccttgaaagcagatgctcttctgggtctgaatgagtccaattttaactaattttaagacctaaacagatttcagtctggttaatattaggatgtggaaccacttgagacatcctaatgtcctagtctgattacttctccatgacagtttgtatgttgactttccttgagagatgctgggtacttaatgccaggcatttttatgtcaatcgtaaagagagaccccaagtcatggctgcagcaaagtgcactgacaactcgtgaaattgaagtggcttctaacagcagcatgatttatagggaaagaacttggggtatagggattcaccagaattgctttaaactatatttctgttagattcctgaatccccagaaacaggctataatgaactacttccccatccctactctctctctagattatactcagaaaactaaggagaaagttagagttgtaaatggcaagttgctccttcttttttctgatttttctttaacaatctgttattatgttctttgtcatattgcattggtcagtttaattaaaaaggcattgattgagcttctgtaatgcctctagttattctgctggccttgaatgggggaaaatatatataatacataattctttcactgaagtaattaatgatctggaagggagacatagttaatggaatataccttctattctagaattgagaggggtagggga

SEQ ID NO: 127829 - DNA, 1795 bp, Homo sapiens
cagaatacaccacataaggctcggatagtgaatgtagatgcacttactctatcctggtcacgttaacaattttttttcagtttgcacagtgatgatacaaaatgaaaaagacagatttcatgccactctagtataataacgctagaatagaggtgtctgctaagtgctctgggggcgtgactgtggtagagaccatcgagcagctcttccaggtgtggcttgttcattgtgatggctggccctgaaacctaatatcctgctgtatataaggtgctcagtaaaaatgtgattaagaattagttggtttgaaaccaaacccagataaagtaagggctactttacaaaacaaaacctgttgtctttaaagaaaatgaattggtttgcagtttctgtttttacatagcagtccacttgtaagtccactgcattatcttaagaggtacagaggctgtgtggccaatatcattctcatcaactaatgtttgttttgttcccatcctgctgtaaaaaaagaattagaacgtaggcccggttgtccaggagctggtgtggtgaaaaagtggctggttagctcctgtctctggcacttttagccaagaaaccactgtaatagtacagatagaagaaaacaattcatggaaaaaagtaatgggatatgctagcaaaaagtccagaacaacttcagatgccaaaaattggtcttgttcccccaaatatctttatatccatagcccatatttttctttgacattgttaaaattcaaaccaaaaactgttttccaatccagcgcagtctgtgttgaaggatccatctaaggagtgtttgacattttacctgtgtcattgtaggtcacattttaaccaccaagcagcccctttccacagtttgaagcataaagcaaatgatacccccaagagatgaaagacatggtgagcccattaaaaactattgaggtttgttttttctatttgaactttagaagaagaaaattaagttgccatttgagtccaagatgccaagaatgtcacctttatcagctgatttttctcaccatcaggagggctctaagtaggttcaacagcaactgcctatcactgttgggatcctaagtgtgcactctctgaaaatcatccaccccactgtgtaatcagcagtgtttgcagaatacgttaatgtcaaagtcatagtaaggtcagcaacaacaggccagaatttaaatttaaaaaaatactttatttgaatttggcattcgctgatgactattttaatttcttttttttttttaatctctaatcacttgggaagaagataataccttaaagaaaggttatatgtcttctcccccagtagcttgaaggtctcataagctctcacctccagttcataagaatttcctaactagtcactctacttccagttgcttccattctctgctattaatccacttgtatactgtgccagagtgatcttgccaaagctcaggtctgattatattattcacttaaaatccccctaaggatccctatggcttctaggataaaggcttgattccctacatggccttcagagcctgtgctgacctggcctgtgcccatctccccaagctcgtggagtgcctgtaatgtgggatctgtgtgcagcagaaaagaactgctcaccagtcctcagaacatcctgcatttatagtctcatgctattttacatggtcttctcattgcctggagtcataatgtctgtcatttactttaaaaatactttagcatagatgctttaattttattttcaacaaagtgc

SEQ ID NO: 127830 - DNA, 1024 bp, Homo sapiens
aagacattacccttcacaatttggaaaaaatgtgatggcacccaaataatttttcatggtgaatttcacccagaggatccctgttaggactccacattatgttccctttgtccatgttttggtttgtttgtatgaaaacttgtatctgtgttctctcacagaattaaactagtattatttaaaacaactaagaaggtacattgtccaaaggattgtggcaaactgacaatacatggccaatgtttgctttatgaaagttatattccagcaaatttgggccccccaaaatccaatccttaaatgtatatggagttataaagagatgtgttctgttggggtatatctctcaaagactttagccaaaaagtgtaagtgattgaagggttagctggcagttaaccccatggcactatgagtttggtggcatctgtaatattctgcagctttcagctgcagtgcctacctgagaattcacttttctgttattacaccgagtttcctctgtgctcttgactgtggctcttcccagcccctgcatatcaacatttgttttattcctattacaaaatgcatttaatatatttattataatatattattatttcttattctctacaaacagcataccccttcattgcccagtcttgcagaccacgttatattgtggcagcaaaaacaaacaaacaaacaaacaaacaaaaactgtacctaaagttacagacttgagagaatgacaccaaaacttggcctacagagatttttcatataaataagttgtctagttttaaatgtagaatctgcagttgtgtttttctttgaataaaaacttttcttcatattcaaatagtaacacatacaagtttgtggtcttgaagcaatgttgtttgagtgtagctgaagcaagacctgaatgcatctcctccctcatttctactttcaccttaatcaagggaaaactcattttgaagacatggggagccatggacctaaagataagccccgcactctgatctaaacctcagag

SEQ ID NO: 127831 - DNA, 1965 bp, Homo sapiens
gatttgagagttaatttttttctctcttcatttgtcttaaccccatctaaaccttaattagaatatcaaacctttggtgctttaataaaagcttaagcaatttgaagatgatagatgataaatatgttatcttcatgctctattgccgtttatacctgagtggattattccgtaaactcccttattttccaaagcctttatggctaggaagtcctttgtttttaataatgcccaatgtttctgcctgagatttagtatttctgtggtcttttcacttgatttttttgattctttgagaagtgcaggaaaatttgaaacaatttatggagatgatgaaatattatattacttcaacaattgtaaagacaatatgctgtgatctttgttttgggtatgaaccatatatgttcatttttaacctttcttcctcaatctgttactccatttgttccattgctaccctgttcctctgcttttctgtccttctccttccctgtctctttctttctatttgtgggaaagtgagagagagagagaaagtgaatgagtgagtgtgtgtgttttcattaaattccctgttttaggctaaatttgatggaaagccttccttgctcagattagggaaaccaggtgtgactgaatgctgcatttatttggtcgctcttatggggaatgatctcattattgaattagtctagtcataataacattgacaaggagaagttaagaacatagaagcctgagggatacaaaaacccattactaatgctctaaggaatataattcctaaattcaatcatcctattttaaatgattttttttatttagctgaaataagtaaattaacacagtttttggcagacagtctggggcctgaaaaacctggcatctgaataatgcaatgctgactgggcaggattgaagttggcatcagcaggtcatgtgccgatgaagcatttcttcaggaactgagtcccaaccacgccttgcctttcacagtcggattggtgaattgtgtcccaggaagtaggtacaagtggcatgtgaccacttgggacatgtattgctactattattctttattctgacatggatttttgacaggaaataggctagcataaagatacagcactggatgaatctgttcttctgattctgctttagaagacatctccttactaagactaagctccaagaggccgagactcttttctcagtgcctctaccaaagtaagtgttaattgtatgtactgaatgaatgaaaagatatcaaatcaaggctaattttggtgtggatgaagaccttggatattgacaggtcagtttatgtttaattgcctgaaagtttaaagtagccggcatgggtcagttttcttataagcttgtaagaaaaagcgtatcttccttgcagttcgttctttgtaaaacagaaaccatattgtagccctactactcatagtctctttccctctcattttttcttgttttcatacagacacactttatagccttatttttcccccgcttcttgtttttggtagggacaggttttgtgaaaggggctccatcaattctaccatatttgaagctatgtaaaatacataaaacagcaataccaaaatagccagaaataatagactgcagcagtgtacctcagcattccttaagcaatgtttaatcaagcatggacagcatctgtatttccagcaaatctctataggaatgttatcttctaacacagtaattaatcactagttgccgtgtgtcagaaaacttatttaacaagaagttgcaaagtgcttgtagttttcttaccttctcagccttcctggccagtggaaaatataacacctttctgtaataaagaaatgaaggatctggagggattccattgatgttgattcttctactcatagtattgttatcttgtctctctcttttcatgcacaccttccctctaactaa

SEQ ID NO: 127832 - DNA, 1095 bp, Homo sapiens
tcattcttaaacctgcacaaggtaaggaaacaaaagctacgattcgggaagcggtagggcgaaaaattgtaacacccaagacagattcctcgcccggttattccttcatttcttcattccttcatcaaatatttattcagcgtatgttctctgtaggtcctggcctcatgaaacttgcattactgtggggcaagatgcaaagtaataaataagtaaaatatatataaagtatttcagatgataatatatgctgtagttaaaaaaaaaaaaaaagagtaggcatggggaggggaccagagggtgccagagtctaatggaggtaatccgaaattttagagtgttaatggaagtccttaatgagatggtaacatttgaggaaaaacctaaaggaagagtaggagcaagccatgcagctatctagggaaagagcgtaccaggaaagaacgtctaagggtgaagagccagagggaggcatacacttaacatctgaagaacagagcagaaaggccagcatggatgaagtgagtgagcaggggaagagtaagagatgaagtctgaggtttgatctaaggagctgagatctggaaagtcattgtaatgacactgagttttactttgcatgaggtaggaagctattagaaggtttggagcagaagagtgctacataatgtgaatcagtctggccgcgatgttgaaactaacatcacagttgttagttggggaggggaggttgtaggcaaaggcagaagcaggaagctctgttagaaaactgtggcaataatcttctaggtaaaaggtagtggtgattcaaagcaagatggtagcattggagaggatgagatatggtcagatgaggatatattttaaaagttgagctaacaggatttgctgaggaatcagaagtgaaccaaagactacaaagtttttgatctgaacaattcaaagcatgaagtttttatttactgtaatgaaagtgaaccagaccataggagaggctattgaagtgtgtggagggcggagagggggttcagatagagaggggataacaagaaatgtttgagatgcctgttaggcaccagaatagacataaaaagg

SEQ ID NO: 127833 - DNA, 1012 bp, Homo sapiens
aaaaatacgcacacaaatgttcatagcaagcattatgtataatagccaaaaagtataaacaggttgggcgcggtggctcacgcctgtaatcccagtactttgggaggccaaggcaggcagatcacgaggtcaggagatcgagaccatcctggctaacacgataaaaccctgtctctactaaaaatacaaaaaaattagccgggcatggtggcagatgcctgtagtcccaactactcgggagggtgaggcaggagaatgcttgaacctgggaggcagagcttgcagtcagccgagatcgtgccactgcactccagcctgggcgacagagcgagactccgtctcaaaaaaaaagtacaaacaaccagatatccatcaacgtatggatgaatagaacgtggtacattcatacaatggagtttatttggccacagaaagacatgatgtgctgaatcttgaaacattatgttaaatttaagaagctagtaacaaaaagctattttgtatgacactattcatatgaaatgtccaaaatagtcaaatttatagagatagattagtaggggtcgaaaggaaatggggaaatagatagaggagtctttggggggtgatgaaaatgcactaaactagattgtgctgatggttgtacagccctgtgactattctaaaagtccttgagttgtaccctctaagtctgaaaattatatggtatatgaattatatctcgatgaaggagtttaaaaaaaaaagaggttgagttttaagacttgaaaaattaaatcattcatcataggaaatgaggagccaaagttttatcctcccattagtggggaaacttttaaaaggaaatatttggctcattttttagtttccctaatccatcctgagaggtagaagataaaggaagaatttttggagaaggaggtgatacttcatattagtcttcataggaattatccagaatagggagaaagtcatttggaagagaaagggtagttccggggactggagaaga

SEQ ID NO: 127834 - DNA, 1080 bp, Homo sapiens
gcattaacactgcatctcattctccttcaggcagtctgtttcgcagagacactgattaaacatttggggtattggggacagagggagggagggagaggttggggatttttagtggctagagccttttattgacaacattaaaggcttcatgatatatttgaccagaaattaattacagcccagttccccatttctcccttaggtgacagtcttctgttgatgtgtgctgctgtgaaagtaataataggtttcaaatgtttgtgaaaaacataaagtaattacttgctgtggtaaatcagtcatttgaagcttcagcttttctctgttctatgtgtgtggcagtctgtttcttttgttaactttaattatacaacatatgagaatttgtatttttcagttttcagaagttttgcttttttcatttcttggtgcatagttctccagggatataggtattgaaatgataatgacacataaccagcatttgaacaagggaagcacatgtgtgtgaggaagctgattgctttagttaagtttcgtagctattggctatcagctatttgccagttttctaatgggtcttaaatatttactgtctgttgtacagaggggaagaattggctttcaggcattttaaggctccttccaccaatagcacttgtttacattatgggccctcaagccaaagagtctgtaatagctctttcccctttttcaaattaaaaaaaaaaatctgtttttttctattaaaagctgcagctccttgcctggggttcttgccttccagtaagatctgtaaagatctgcctggataataccaacctctatgttgactcacctggacaaagagagagaaatttccttttggcagctgttttaacagggagccttgcccagacagaatagtgaggcctgtatactggccagcatggcatattatcacacatcaatttccttctgtctgcactaaggctagctcactcctcaaaataggaattgttcacatgtattttcaactcaaataattcatgttaatcttgtttctctattttgtctaatctctcttgttcattcctgatc

SEQ ID NO: 127835 - DNA, 1045 bp, Homo sapiens
gctaagtaaatgcagaaagattattagttttattagcctttgatattgaaattgtcatgttctctcttagctatgaagacctgctctgcccacatcaacttggttattttttcgtaaggaaattaaagtagaaattataacacaattactatcaaaattctactaaactataagtcgaaacaaaatataagaaccgcaattatgtgagaataacatgtgggaaactgttcctgctgctgagatgcgtaaagtgaagtctttggaagaaggcatggagttactaggtagccgcagtgtggagggtggctggacttctctgtcgctagcaatgggcatggtgccattgccaatgcttggaagatgagtgtcttcacctaacttgttaagtgccaactagtcttctgcctccaatgaagatttctcctttgtgtgcacaggttcttctactgagccccaggagtttagggtcatcatgtgcccttaaagtgtggagtgataagagagaatctctatacctctgaccaatttggaggaaagcagagatttagtgttggggccacttacacgtaatcttctttttctcactttttcgctgagaggaatgtggtctaatctagacacctactggctgccttgaaagagcattctcagctatactggcagatctagcaaagagatgtgaaaggatcctcaggtggccccttcaggggtctttctgaggagtcaggaggaaccagccattgtgatgataagacacccacccaggtggttttctcttagtgtgataaaggaagctgaccctgtcgaggccaagatgttcacccagtgggttatccttcttatgcagagggatgacgtaccctcagtatccaaaacattctaatgtcttcattgtctgtttacattatgcctcctcctcactgtgggagttccaagaagttttgcgtctttccctataacttttataacttttgccaccaccctgactgatctcctacaacatacaacatgggtaaacctcaaaaacattgtgctaaatgaaaga

SEQ ID NO: 127836 - DNA, 1049 bp, Homo sapiens
ttttaaagtagccttttcttaggctcttacatatctttggaaccatccactattgggagcttctctccactgctttctaaaatgagaatagccatgtacaagcatatgatttaaactgtttcaatatctggaacgtttcctaaagaagtcacttgcttgaggttataacagattggcaaggggtcagtcattccattcatacatcaaatatttattgaataaatgtgagagctagtcattcctggagctacaaagataaaaatatgattcctatttttacacagtatagcacagtagacctcagtaatgggagcagaactttgtgataagaattaagagagggaaagcattaaggtaagaaaggaggttaaaacctcgtaagatgccctcctaggtatatacccaagagaaatgaaaagcatgtgtccacacagagacttacatacaaatgtttatagcagtaggtagtattcataatagccaaaaggtagaaacaactcatatgtccatcaatgatgagtggataaacaaaatgtggtatatccatgcagcagaatattatgtggccatagtggacttgaagtactgatacgtgctacatgctgccaagtctgtcctgcagactctggccaagcgacagatggaagaagttcactggcacaggtattttgcctaacaatgcggctagaggaccccacagcttagcaccgctgatgagagtgcagtgcagccacagcagcccccataaggtggagacacttgcatttatttcgtacagatttaatgacaaaggcttggagcaaatacactttgtgggtaataaaccttgttgacccgcaccccccctctgcccccccagctcacccccccgccccgagtagagagcagtcctgcacacgactgatcaaaggttggtttctggagagagtaaacaaatttatctagataagtctctttacagtcctttgttatcgaccctttgctgtcaggctcccaataagagaatttggctgccttcagccaaattttcttttgaagcttttgcaaaa

SEQ ID NO: 127837 - DNA, 1019 bp, Homo sapiens
taagaaataatgaagcattctttctcagctccaaggtagaatgatttcaacctagaattagacatccaaacagtgtatcggccaattttgagggtgcaataagggcatcttcagatttataaagacttggaaagttgacttttcatgctcttctttctagggaactttttgagaatgcatttaagcaaagcgagtaaataaaccacaaaaatcagaaaacgtcgtgtctaaaagagacttgatccagctcagaacagtgaaaaggtaaccatgaagcaggcttagagaggaaccagtccaaattgggataatgagatacagctgttctggagaaagttctctgggtgggaaaagactcaagaaaataggtagtatgatggagaggttgaaaaagaacctaagatgtgaaaaactcaagtagtacaagagaaaggaaaggcaattggaaatttttaggaaaaaaagcaactatacaggaaatgtgtggcctgcatgcaaagtgaacttctagaagcaccctctttgagaggcctcaaggctgtgatatagttaggctttgtgtccccacccaaatctcatcttgaattgtaatccccataatctgtacatgtcaagggagagaccaggtggaggtaattgaatcacgggggcagtttcccccatgtttttctcgtgatagtgagttctcatgaaatctgatggttttataaggagctcttcccccttcgatcagcacttctccttcctgcagctttgtgaacagggtgccttgcttacccttcactttctgccatgattgtaagtttcctgaggcctccccagacatgttgaactgtgagtcagtgaaacctgtttcctttataaattattcagccttggacagttccttatagcagtatgaaaacggactaatacaggttgtaagtgactgatagagaaggaaatataatccttagcatcactggccaagcactatttgtgtatatgtgatggcgtaaatgctttttattgtttttcgt

SEQ ID NO: 127838 - DNA, 1227 bp, Homo sapiens
gattctgatcccggggagttttttcaaaatgcctagaactgtgaataacaaggtgcaaacatagataacttatcttccactgtttacctttaaaaggtcaagacccagtgcaatctaggccccctatacctactatggaccactcagtagaacagacatcacatttcctgaggctagtctgagaagcatgggctaaggagtcgcagtatcgattgtataaggattagcatatctggcagatgggaactgtctgaactcattcaactgagaggcatctgcatcaggcggattggcattgctgaactttcacacggcaaattgaggattttaacatgcagcccaacttctcctgtggagatccagtgaacacataaaaaggtttcagtctttatgaattcctggatatattaggcattacagaataaaaatattttcccaagtgctgtattgatactctaggcacctatacttaacatttatgttcttcgggaaccactccatgtagtcagatattcagggattgttggactctcgtttcttttatatatcctttaattgccttagactgctgagcttcattatgtgggtcaattagtcttttttgagaaatcacttctaacacactaattttattctctattgcttccttctgattcctcatctctttcccagtctccaccctctaactcattctcatttttattttacttctcctgtttatttaccttatgttccttcgctatcctccacggccccatgccctcatcttcccagagagtgcttgaggcctagaccaagcagagcagccacaccacaggctgctcccagtctgtgtcacttaccattggcagtaactaggggctcttggagcatccctgagctatcagttggaaacaagctcttcctaggtcttgactaggtctaggtcaggatgctgagaatcaagatgaatggaagtttgcttacctagcagtctcaaagcactccaaatgcacatgtaaagagatacccatgtgtgtctacatggtaaatcccataacctgtgttcccacttctggagatcctgaggtttctgccttcattttccttgggggaacatggaaaggtccactcacctttactttgttcccctctcctgcttctgtgtatggtctgagttgacatcttgcttaatcagaaatagaaatgggtgaaagattgctatatgaggccataatgatcaataga

SEQ ID NO: 127839 - DNA, 1504 bp, Homo sapiens
tttacctccttaatttatgcatgaagccaaaagaaaaattacttcatattcttaataaaaatggcataaggtttagataattttttactatatgcagtaaaaatgcaaatgtgtgtggcttatttgcaaatgtagacattaataactgatatttaaacagtccagattagcaattttactgatatatttaagagatttttccaataatttgcacactcaaaatcaatttgaatacaacatgtaaattgaatttaattttttatataaaattgtggttatcagcttgaaccattaaatttactatttaatatatgctttccagatcacttggttagaatttcattgcaccttatctatataaatttaattaggcttgatatcatcagtatattatagaactaattaaagatttagataagtgctgagggggcttattgaaaactccataaagttccatttggaaaatgagatattcttccttcagttcattgtgagagaaggaaacagcaagaatgcttcttgcagtgtttctgaaaaattatttaactggatttaaagggcttattccattctttgaagagctttttaattactctctatctttgtgcagtccaacaacagttacaatctttatttaaaggctttaaaaatcctcatttccatcttctcccactgagccagctgtgttacattctgctgggcatatgtgcaggtaggtagtacagggtttgtgtaccctgattgcgatcatataatatgtagcagcatttgtggggaagtctatctagtcctcccaagcagaataaacattgagaaagctcagcgagcgcctgccacaaatgtcttaggaaaagggaaaagaaagaaaccctagcccaggaggatacctgggaaaaactgaggcttccactcaaaagatacagcgactttaagtaatcattttgcagaaatcacttttggattcccttgtatctgcatctctgctatagagtataaagcatattagtttaaaagactattatttcaactaagtgctttgtgtcttcattacaaagcacaataaagctttttaatacaataaagcctttattactttcaattgaatatgcctggaaataaagctttatcaaccacatttgccagtgtgctcaatgctcttgtcaaaagcactttttcttcattgcagattgagtgacacagagcatgctaggaaaaaaaaaaaaaggaaagtgaaaggacacatgacaaatatgggccatctacgactgggcacactgtcgattacgacagaggcctgaggaagccagggaaccggataaattgtcaagagcctgtgtggtgtaatagaaaggttacaggctttgggctcaggagatgcagatttaagtcagagccctgctgctgattagctgtgtgacctggacctcatcttttccacacctaaatcttgtttcctggaaaatggaaataatatcagtaatgctgccctggccaggcacggtgg

SEQ ID NO: 127840 - DNA, 2211 bp, Homo sapiens
gtggagaagagctcaaaggagcctgtgtagagtttgctcaaaagagtccttgtcaccaccttcctcccattttgttttctccaccaatatccaggtcatgagagcagcccttcctctgagccacagggaagtaatcaataaggccacatcccgctcactgacatccccactgaaacaggtgaagcacatgtggaaggtcatgagatttttgaaagcactagaaattaggagactaattctgaaggtagcaagtgtgagggaaatggaacctctgctgcgtcctgcctaccaccgtcttctgcaggatttgtaaaaaactaggttcaggtttccaggctatttttgctgctgtttgaacagtgtctactttttctactaggaatcagcatgtattttctttgacatctgtatctgctgagatcacaggccatcctggtcaccaccttgctgtctagaacagcgtcaactcaactgagcagtcatccattaccacgcataaagatctgaaggtccactctgtgaaagagcagacaatgcaaggcatctcctccttcgctttaatgtagcacacgttagcacaatgtgcacacttggagcagtcatctgcacctcagtttccagctcccccgatccaatgctgttaatatgttcttgccagacacttatattcacatagcactttacaatcgacatagggctttcacaaatatgatttcagtgagtctcttgatgagtcaacatttttgtctccccaagcattttctgatttgaactattttctcacagcctaactcagcagttttcctggaatgatgtgtgggaggtagggtatgatagtgtattgctatgtagtcaaactttaaccctgaaagtataaaagaattcaatactggtgttattgttaactagccaggtgaccttaggcaggtgttttgcctttggagcctcaggttgtgaggactaaatcaggtgtatgtgaaaggacctggtatatagtaagtgttaaatgctaattgttccatataattatggtcctccttaataataaacattaatagaatcattagtgaatctttggctgaattatatttctatcatacgtagagttgttcccaattctaacctatatttctcgtaagggttactcattactagttgttatcaatgtttcttgagaacagtatgtagggatggagaaagttcaaaggcatttagtacaaagatgctgggggtcagttaacttacaaaagcgtagagccctgagacatgactttaatacatttctggggcacttagtgaaaatgtgagctggtgaagatgttgccatatctgtcagcttacagaatcttctgtgcacttatcacaggagaacatggaactgcagcaaacatctcaattaatggatcaatcctcacaacagtattggctgcggacagatgtcttctgtatagttaagaagtcagggttccagtttataggatttgcatttttataacagctttatcaagatataatttacataccataaacattaacccttttaacgtatgcaattcattggttcttagtatagtcacagcgttgtacagccatcatcaccagctagttttggaacattttcatcaccccgaaaggaaaccccatatccattagcagtcactcctcatttcccccaaacgctacccctggcaaccatacatctactttctgtctctgtgggtttgcctcttctggatagatcatagaagtgaaattacacaatatttagtcttttgcggctagcttgtttcaattagcataatattttcaagatttataaaattagcacttgtcttaataacagggtatgagacagttaaaaatatactcaggtacacatcccaacacctggcctacagcctgctctctttttcatttcctttttctgtaggggtggggagaaggaagctaaagtgtttatatcgaagtatggcatacacacagtaaactgcacagatcttaagtacacagcttgattcctcttgacaaagagaatacacccttataaccatcactcctataaaaatacagaatgttaaaaccacctcagggccgggcacaatggctcatgcctataatcccaccacgttgggaggctgagacaggcggatcgcttgaggccaggagttcgagaccagcctggccaacatggtgaaaccccgtctctaataa

SEQ ID NO: 127841 - DNA, 1051 bp, Homo sapiens
ccaggtcacatttgacctgaaggagacatactagaggtgagagcctgatgtgttgttctttactgaggtgctgccatccttctctctttgaggttgattttgtttagctacaagcttggggatgtggagttgtgaggaaaccttctagaagattggcgtggtctggtactagaaaaaaaaaatagccaagttgcccaacagtctgaaggctttcttaccctcaggtccatcctccatgctgcagctggaaaggtctttctaaaacagttgtcatcatgtgtgacttctttctaaaatcgtctgtttccagattcctccctgtcattggttccagattccagggtgtatgtaaactgaaactgattgtcctcatctatacgaaaattagaaaaataatgactgtactttgtgagtttctcataaataatgactaaaagtttctgagtttcccacacaataaaacatgtaacctttttgttctgagattattttctttccacttaaggagtgttaaaataccttcttttatcaaatcttggtaataataaatggtaattgttttgtttgaataatctaggcaaaataaagcttaattcaccttcatccttccactcacccatgaaagtccaaaatcttagcatggcccacaggtctgttaggctctaggcccagcttgccttgcccacctttccccttccttgctcttccccacaccccatgcactccagtgaggaataaaccacttgtcgttttccccaaataccgtattcttcctactgtcccacccagttcacacattctgtttcctttgctcgtggaggactttatttccttcatatttgcctcattgttgacaacttctccttctctattaagccttccctggctgctctcagaaacctacagcccttcctgcctgtgatcttagagaatctcctccagacctttattatggccactgtcacattgctataagtacatacagtgcctggctactttcacaccagactctgcatcgccagagaacaaggactatgttttacttacctct

SEQ ID NO: 127842 - DNA, 1447 bp, Homo sapiens
ccatgagccagaaaatgtctcaatcaaatgtgcattcactgatcccatccaggcagccccagcaaagtgtcatcaaatggaaaatgtgttgccctggaagccacggctgctattttaatgctcgatgatgaagaccaagctttcaatttcctggggcctcaataagtgctgataaattatttatccctattgggtgacatgatttcatttcagtctgacagtgtttatcatggaagctcattctaatggtatagtttggggcatttttctattttctctttaggacacctggtagcaccctttccccacctccaggtgaaactgttgctgtgtcagtttagtcatctttgctcctgggtaccattctgaaagataaatgaatttccttctgtctttaaatatttatgattctttatgatctaatatatcagcatggttatggaggaattttttctctctaactatagaaaatacaccatcaattacctgtcaattttgttgaataactcagctttgcaattcaggggcactgttcatacgaagctcttgaggactcttttagtctctcagtccacttcagactgtcattccgggatttataaaggtcttcattgcacagaggatattgaaacattaaggacttaagtggcatgccctttatcactcatcacactgtggaagatccaagagtagaaatgcaggcatctttgttttgttgtttgctcccagcgtggaacaatggcctctgtagaaaaccagccagtatccctggaaacaattcatcagatttttcaaaagaaatccaatttcatctggcatgatgggctcagtgttgcttcttaagataaatgataaaaatatcaacatcctaatacaaagaaatccagttcttttggtttaatctcagtgaaaagcatcacaaaccttttattgcttctgtagccttctctgatgcgtttaggtccttggttgaaggagacagtggttctgtaactgttggtctaccaaacagactctgactgagtcgtggctggttcagaacctttaagaagcacatatctggggatggggcctcaggaatctgcacttttcataggcgccccaaggtaattcttaggtaccctaaagttcaagaactgcgagtctagaaatcgcagctttcaagttccttctagctttgaaagaatcgtgagccccagattcactctcatttcatttggtaaatctcgatgcacgcatgagctcttcttgggcaattttaaaaatgtatattcttaggaagttccattaatagacaactccctccatcacctgtgcatctacaggaaacagaattagatgacatagggcatcatttcccaaaataggggccaatatcagtgagagccaggggacatgcagagctgtaggataaatattaatatgatgcttcttcctgcagcatcaa

SEQ ID NO: 127843 - DNA, 1856 bp, Homo sapiens
ggagtacatccacgctctgaccctgctgcaccgcagccagactggggtgggggaactgaccacccagaacacgaggctgcagaggctcaaagagatcatctgcgagcaggctgccatcaagcaagccaccaaggacaagaagataactaccgtttagcagggcgtactgcggttggtgacgggggtcccctcagtcacactcacttttttccttggtatgttattgagtatattctgagcttagttttctctacagtgatactttagtggagaggaggtgtaaggattctttctctctggttttggcttttcatataaatgctaaaggaaggcgacagtacagagtgttttggttgaacaactactttaatgcagtcaaatctaacgggactagggtgggatagggaggaaggtggtatcaaattgttggactctgaaaaacaagtggatggattactaatatttgatttattactcaatatatatataattccagccttggaaagtaggaaagtaggctgctacctaacttttagtcccttccaaaaccatttagtagggttctattacataaacagtagggtttttcctctcctgaccttatccgtttacagttcaatgaaataagtgtatgtgcattgctgtctgtctctattgccaaaatcaaataaatggcttctcagctgctgtttacaacaaacttccctaaccaaaacagaacctctaatttagggctaggaatagaagtcttttgatcccagtccctgggacagttttgtatgctgtatcttgtacacaggttgtaggttggtttattgccattttgttttatttctgctgtataaaaaccaagagccagacaattagacaactatggaggaatgaaaggcaattcaaacatctgcttgattcccgccccgccacccctaatttctgagagaataatggttagagaacattgcatctcacttgaaacatcctttgggggtaaatgattcttaggtgctcacttggtctgagctcagctgaatgcagggaagatgggacagagtgacatttctcctctgtgcggcctccagctgagcctgtctctgaattgttccctcccccgcaatgtgggcacttaccatgttcctggcacactggacctcaccatgtcccccggtcaccagtcctcttgctgcccatggttcataggtcatagaaggcagcaatgcactgactgggccacatcttgaaaactcgtggaaagggaaaggggaggagatgggactttgaccacacacagtgatgcctcacaccctgaaggtgggggattttgtacctgtttgtacaactttggtcttgatgggaaaaatggagaattaaaaagtgttttgagaagcttaaatgtttcatgttatttttcttgtgttctttattcagcaaatattccccagaagcctaatatgtgctccatgctaccacacacaagggcaaatggatagatgaagaggacacccttattatctaagagtgtgggaactggactggagccaaaaatcccaacagctcaaactcagggctgggtcagaatcaggtcaggcagtggggctgccgggaaggggattcagtgggcagctggaggttccaggggattctggtgggaaagaatgtagtcaatctgtctggctccaagggcctgactgggaagaagttgaatctctgtaggagacaactgtggaaaaacatactgccctaaacgatatcatgagaaatagtctaccctagaagcaggagtggaagaaggggggatgagaggagattagggttgcctaagctgctgcttcatggccgtgacccccagcattgattct

SEQ ID NO: 127844 - DNA, 1040 bp, Homo sapiens
aaagggggtgggctagcttaaagcaagcttacaggggcatgaaagcagggatacagagggaggacaaagacaggattgcacatgactgttgccaagcaacccagatgtctgttatctaggtttgtctgagcacaggcttatcctgtaaccttcactatggtgcccaggcagctgtagttcaggcctactcaggctcctcatgaccttcattgtacttcttagataaaacagaatacttgaagtcactagttacagagaataggaatctataaactcattccataaaacaaaggaaaatttgtttttcttctccttatgttgagggagtgctgggagagtctccagagcacattagataatattatcaagacttttcctggatctggctgtgcctgttgctgcctctgggacaagtcagcctaatacaggaaaacttattttgctttctttttaatttgatttttctttaatttcctgcatcaaccatcacagtgagcaatcctggatccccccagtttatttatgtcttttgctttacccccctttttcatttatttgaactcctgtagtattagtgagctcagatacataggtcttaattcagtgtctctgagtactcacaggaaagcttctatgtaaatccaacacataaacagaaaaaaaactataatagttaactatatataatattatatctataatattatagagattataaatctgctgtctataataattaactgttattaaagcttaaaaccccctacaagttgccacacatccctgctccaaaatcctgatgtctaattatctcactggaccagcccctttttccttaggaactttctatttcagtaccatttattacccatcctcagcagtaagtgtttaccctctaacaacgtaggcccaatcaccaaaacatgaaaaagattggggaaaagaatatatttttctaccctcctccccaacagcttagagttccttgtatttctctgatgtcccagtggatgtaaatgttaatggttttgaatgagatt

SEQ ID NO: 127845 - DNA, 1050 bp, Homo sapiens
gtgaaatggtatgaggaaaacattccgcatgcatcaaaacctggaatctacagctataagttttattcctttttcacatattaaaagttggaatgtttactatattcaaagtaatcatgggctttagaggggctgtgggtttttgtttggtggtttttttgtgtgtgtttttgttttttgccattttccctcccaaaccaggcagaataaagaagtaggagatcaaaagactccactcaatatttttaaataattatcatttcttaaattttaggaaaattagagtagacatgaagactgaatactaatgttaatgggtgtgtgttaaattattttgtgtacctggctgcacgtgaacaacatttcattaaggaaaaatccaagctttgtcttctttttagaaacaaaactttttttcccttttacatctctaattctggaaaaggtttcagcagtgaataaatatgatcctccccctgaagtggttgcagctcaagaccacctgacccatgttgtcaacagcgtgatgcagccgcagaggatctttgacaggtacttattagaaatccaaaggccggaattcagggtgagcaagcaaaagacagcctcatcacttcccctaacccctattttgtgacccctttatttcctataaaggctgctttttccctttctctgagggaaggggccaagtctttatttgatagacaatattgtctccattatggtatattattaatatcatgtacttgagtgtgttgctttcttgctggtattttcccaagcatggtgatgagttgattcaccttcactagtttttctggccacttgtatggtggccagcgtgtgccacacaacagtgaaatctcaaaaaaaaaaaaaaaaaaaaaaccaggaccaatttttctgccttaggagagaaacacagaccttaaccttaacagaaaattgtggtaatttatatccattgtaaattttccctcagctgtgagtggaagctaaatacccttgccaaagactgttccatgaattcacattattagggagtcc

SEQ ID NO: 127846 - DNA, 1021 bp, Homo sapiens
agtaatagattaatgggtatagagtttctgtttggggtaatgacaaattttggaaataggtagtgatgatggttatacaacattgtaaatgtaattagtaccattgaattgtatacttacaatggttaaaacggcaaattttatgttaaggtatgctttttaaccaaaatataaaattaattttaaaagatggaaaaatataagaacaatgaaatcctgtgctaaagcttcttttgctccttaatctctcttggttttctgtaatcagatatataaggatgtgttccccacttttacaatttaacaattgacataacttggcaaatcataccaggccttttattaaagataaaggaaaactttacggactagtcaactgctcagttctcctctgtctgacttatcataaccatcatcatttctttctaccattagtcagattaatgatttgcaaatacaattttattttatgatctatatagcaagaactcagggtgatagttggtacagctttctaaaagctttgctggaagcattgactatcccagaagtaggttgtttagagacaaatggaaggaaagacatcccttaatactgagttgtgaatatagtttttaccttattttgtagaaactattttgtttacttgtgctttttaagccttcgggtattagaaataaatgttatccacattacaatagggaaaataagacaattctatatatatatacacacacacacatacacacatatatatatacacatacatatattatatatatatatgtatttatttatttattttgagatggagtctcactctgtcaccaggctggagtgcagtgctacaatattagctcattgcaacttctgactccctggttcaagcgattctcctgcctcagcctcccgagtagccgggattacaggcacgcaccaccacgcccagctaatttttgtatttttagtagagacgggatttctccatgttggccaggatggtctcgacctcctgacctcg

SEQ ID NO: 127847 - DNA, 1044 bp, Homo sapiens
ggggagctgctgaatttgtatctaagaggcatctgtctggaggggatatagaggatgaatttgaggagagcaatacaggaagcaggaggagtggcagggaagttattgctgtagtccaggaaagaaggttaggcctgaaataaggctgtgggggcaggaattgtcaaattaggtaaatatttagattgcatgtgggagagggtagattgtgcaagacaggaagaaaattaagatcattacccattttctgtgaggtgggtgtggggcactttagagttgtccgtgtctcatttaggtgaagaattttcgaaatttaaaattgcttttagaaatgtataattttcctcttcgggcgcctgtttctgaggctcctgaaggcatttggggttgcatttccattagggtacaaaagggaagcgataagccaaattttttttatcacttgtttgtgtttctgttattgctttggtagtatatgttcctaatgtctcagattcagtggaactggacaatattttgtttgtggtcagaggaaaggagtggaaaagagtatcaacaggagatttttagtgctattattgattctcttggtataagggaaacctctgatttttacacatagaataacaatgtttaaaaattgccattttccatctatatttacaaggttcctatcattcccatttgatatgttgctcagcaaggtgatctttataggaacaaaaaaacattgtggcttatagtgactacattagtaataccatctttagctcctttaaagaaaagtggcacctaatattcaaatcaatggagataatattgccacttggcatgaaagccttcctcaaatatttaaagagctaaatcagttatttccaaaacttcaaaagataattgaacaaagggcatgattgggaaattcacagaagaggaaataaaaatggccaatagatatgtcaaaaagtatttaacctcattataagttgaaacaggatagactttttttttttgtactgaattggcagatgaaaaacaacttaatgc

SEQ ID NO: 127848 - DNA, 1038 bp, Homo sapiens
ttttaccttgtatagtggtggtggcatattttactacaaacgattgtcagcaatctctcttcctaatgcctcgcagctggatcagtaataaaccacttctcaggctggtttctgcgccagaaattagtttacagaggatcagcctacttttggaagttttagaggtttgtggcagtacattctatagcaaatctctcaaaacctctttgccttgatagaaatacactgacttttgtcagctgcagtgaccagctctctttgtctttgatatgttgcttttaaataaacctcagctggaaagtaactcttcaaagcagtttacctcacccagcctacttttaatcatgttatgcagtagcccccaggtacagaacacaaaaagaaaaacaaatgagaaattttgcactaaatatagcatagttaaaattcatctctttaaaaatggcattactgttttatcaggacagggctggatgttcttaaacagccctgggcctgtcattacacgcaggaatggtctcactgcttctgaagccctttcactctcaagtcatttgggccttagagtgtgttgaactctaagatgttacgaaccacaagcctacaaaaaggtaaagaaccttctgggggactaaattatggtttaggtcaactctagcaaattgtatcatctcgttactggaggagacttctacacagaactctgtgattctggtgctagcagcaaaacacaattgcagacaatgcagtggtatctcaggctgagatgtccctcattaataaaggctccaagcacataggtgggtgtcagcaaagatccaatttctttgtccccgtcttacattcagcattcgagcaatgcattaattcattctcatgctgctaataaagagatacccaatcttgggtaatttataaaggaaagaggtttaactgacccactgttccgcatggctgaggaggcctaaggaaacttaaaatcatggcggaagggaagcaaacacatcctttttcacagggcagcaggaaggagaagta

SEQ ID NO: 127849 - DNA, 1054 bp, Homo sapiens
ttcactcaacagtgccagatacctatggagaggggaagtaaaacaccttaggtcaggaataataaaccaatgagttagctcagggccggtggacatgttcactggtggaccagttggcattgacctaaacggacagagaaatgcacatggaggagaactacgttgaaatcaagatcctatgtctgttgtattttctctttgcctggagtaaatagcattataagtcattccacccttattagataaccaaagcatattggtctcaatagctttctcctgaaaaatgtgattgaatcttacctgtagcagttcactcttaaggttgaaagaactgtcaatatagataaaatccattccttattattattgattggtgtgacatttgaaaatgtgtctaaacaatatttgtaagtaaaagaaccagtcataagcctcaaatgtgttcagtgtgtaccaagctggaatgggagactggcccctcttggctttaaagtagcatgttgtctttttctagcagcttcttcctagtagacattccagggatgggaggggccagggatcatgtcttactcatttctgtatcgccagcccctggcatagtgtctggcttatgttatgtgaataaatgaatgcttgccaagatctcttcttccctcaagtttctggaaaacctgagggttcgtgatacctgttcccactcctcatcagcgggttggcaagaaagcaaataaggggaaacatttttaacattccaagcaagagaaggaagaacgactattgggaggaggtacaccagagattgctcagtgtgcagcctgctacctcacttttggctctggattgcctggtggtagaagggaagagtattatgtagttagcaccttacatatttgatgctcaggaagaaagtgcaagaagatccctaatagaacattaaagattcttaaaagtttttgaagtaggctgcttggggtgaccagccccacccttacatctccatagttggtacagttagcttgtagcagctgaagctgatgcctggagatcactgtct

SEQ ID NO: 127850 - DNA, 1896 bp, Homo sapiens
cattttgcttttttttttttctatgcaaaagtcagatgcttctatccattgctttctgtgattagggcggccctgcagcatatctcacagcagacacagtgttcataacaaagaaaggttgtgccgggcacggtggctcacacctgtaatcccagccctttgggaggctgaggtgggtgtatcacttgaggtcaggagttcaagaccaatctggccaacatggtgaaaccccatctctactaaaaatacgaaaattagctgggtgtgatggcgcatgcctgtaatcccagctacttgggaggctgaggcaggagaatcacttgaacccgggagatgaaggttgcagtgagctgaggtcgtgctactgcactcccgcctgggtgacagagtgagactctatctcaaaaaaaaaaaaaaaaaagaaaggttgttatggactggacacccctgaagcccattgcctaggccacagtggtgacggcaggatggccctgctcagcaccgcaagagccatggctgtccctgttggcccagccgggcactcacagggcagaagggtgggtctcaagtgggaggataaggcttcaccaccaggagattcccctctgcccgatgactctgttaagagtcacgacccatcaagggaatgcatagatggagatatatagtgtgtgatgtgtaaatcaggtcaaacctcaacgacaattgaaagttgttattgtcctatgaggtatcttagcattctcgatgggtattgaggatggttggatgtgctttattgtgtgtggaaacatgcctctctttgctaatcatttcagaggtccagttttcctttcactggacaatcttgaataggaggaacgctgttgctgtaatatgcgtagcttctgtgtgctcttgtgtagtctgtgtgtgatcaaagggcacggaagtggctgcactttcacatcccttttctttacttagctggaaccttacataccagtacatgctcctctgtaagcagctgaactcaccggccacttctctgtttgcctatagacaaagactgtgtgtgtgtgtgtgtatgtatgtgtgtgtgtgtggtgcacacattgtgttcttaaactgagacgtggctctgcaggtctcctgggctcattccatggtgtggtatgtttattccactgtccagagctattctctgatggatttgagcaacagcagtggagataaatgtcctagagtcaccaggtcgcttggagaagtcatttaagctgcctcgggtttttgttacttaaaatgtggatattatttctccacctaaatcactgagtttacagagtaataatgtgttgctctggacattgacagctttctagagccagtaatgggctcttctgaaggatgctgaattagaagtgaacctattcataggatcaaaagccacttgctttgaaatatgtagagttcctcagaattgacggtgctagaaatatccaagtgttaaataaccttttaaaagcaacaaaagctacttttttcttaccacttaatagaagaacctgtccctagaggcgacttcattgctatggatctggagtctctgaactcttaataggatgcagcctcacatacataatgtcacccattttatgttgatgaaaacattacaagttttcttcattgggtatgtgttgatgttcacagacagtacttgggcccattaggttttcgcgtctggtcttagagcatgtgtattcatctcagcgtgaatacctcagccagtcttatgaataggaggctatgtatgggcagggaatagattagattagaacactcgcacaagatgaccacatatagaagcagaaagccccaaattccctgggaactgttttttctctagtagctgaatat

SEQ ID NO: 127851 - DNA, 1095 bp, Homo sapiens
ataagttttgaattgctaattttgtagctataaaatggtacagtcttatttactttggaattctgtaattactagtgtgattgaacatacttccaaacagtagttgctagccgcctttcctcttgtgttgagttgttaaggctgtctatatcattttatcattttcaacttttctgtgcttcacagtctttctttgtaaagtgaggtactattcaggcaaatggtaaaacacttccttaaaaattaaaactattatttgttttaagaaaccaatttaatgactttagtggctgctatagcctggagtcaaggcaagtaaagtgatgcgtgatccaattctatttgcaaggaagacaatgttgctgttcctattatgttcagtctgtattaccctgttcaaaagatgaaaaattcagctgtgaaaaagcaatatggctatatcctcttgtaacctctacagagttatatgaaattcccgtcatcggagtgaccctgcccatcatgtggttctacctcctcatgaacatcatcactcagtatcctttggactgtgccgtcacccttatgtcatcatcaggttcttttggcacaggaatggtcattcttttcttctaacagtgtgttgacttgaatatgattttcgctggatttattctgcggtaagctggagacagagaccaattcagggaactccttgtagagggcagaagagatgctagtggtgtagtaggtcagtaaggcacagggcagcaggaggaagtgctctgagtggaagtgtaggagtccattgattgatagtggcgggtgtggtggctcacgcctgtaatcccagcactttaggaggccgaggcgggcagatcacttgaggtcaggagtttgagaccagcctggccaacatggtgaaaccccctctctacaaaaatacaaaagtaagccaggcatgatgatgggtgcctataatcccagctactccataggctgaggcaggagaatcgcttgaacccaagaggtggaggttgcagtgagctgagatcatgccattgcactccagcctggacaacagagtgagactccatctcaaaaaacaaacaaaga

SEQ ID NO: 127852 - DNA, 1715 bp, Homo sapiens
cagtaattccacttatgagggtttatcctaaaatatatcaacatttgtttaaagatttgtatacaaggatgtacattgattttaataatgaaataattggaaataaccatcctcatacatttaagtgtgctacatccatatcatagtcattaaaagcattctatttaaaaaattttaatgactgatttgaagcaaaattccaggcaaaagctcatgaaaaaagcaagatataaaattccatatgcaatctgatcctgtcttagtgtaaaaaaatttacataaatgaatatataagaagatgtagaaagctgtaaaggactagatggtaataatgtatttttatttctttttacagttttgtacatgttctacaattagttcataatatttgcaggactttaaacaataatgttcttcaagaaaaacatctggaaatgaacaaatgcagacatcttgtcacctgatgtttgttttttaggtattggggcattgacttttgctcttctgatgtcagcaaggatggggatattccaagagactctctacaaacgatttgggaaacactccaaggaggctttgttttataatgtaagcaacttcctgaacctgggaacgtgaaaattcctaagttgtaaaatgttacttcaagtgaactattaatattctctgatgtagttgaaggtgtattattggtagatggctttgagacccacagactgaagcagttttgatgggatgctctggtgggttccaagtcacagttcactacatgagatgatcacgatcaatcaaagcaaattaaattgtgtctgcatatttagcaaatccttttgtgcagaaagactatatgtttaaatttctccattccctgttgttgaggaaaggatgctggctccattgtttgctttgtctgtgatggccctcagaccctataagggcaagaaccataatttgggggttaatatcctgccatacaaggtgaagtggtcaagaagcactgtatacatttaacttaagtctaacttgcttttctttgtattgctgtcaaacaacctgtacgacttttaatcattgtaaagctactctaattattctataatgtttttgcacttacatttatctgacctgtttctttccatagcacgcccttccacttccgggtttcgtcttcttggcttctgatatttatgaccatgcagttctattcaataagtctggtgagtttggggttagacagtagaattacctgacagtttctgaggcagagtctcagttttactcttgacttgacctcggcctttttcataatcctattcaaatcatgtgttcctttcgaaaatgtctccattccactttccagtcattgcagcagcaaaagcttttacaggggtttctcaattatttacaaatgaagtaaaagaatatcttcgagttttccattttgctttggaatttgtgtgtttgcatttgaatgtgaaatgtttgatgttttgagaatgcaaatgaatacttacagcacactgcagagactggagccctgcgaagttgggcagccgtccagctctctcaactgctgtttatccttctctgccatgaaaggcagagctgctcacagatccagcccaagctgccatggagcagagcaagaggggagctcaatgatgacaaggtttttctcctagttacagatgagacaggcagcagatgaataagca

SEQ ID NO: 127853 - DNA, 1049 bp, Homo sapiens
tcaacactgggtccatttttcgtttgacagcagtcttggtgattcctggtcaggagggatatataaacattccaggagacctgagcatatttctgtccctgggctttgctacctaagctgactgggatcctgattaaagacctttctggtgaagcaaagatcccaataagaacatatgaccaatttcctgcagtttactaggaaagctgtatcgtagttctgggaacaagtgtgtcgtcacagtaattctcactcatggcctgatacacgcaaggaagagttaaataagaaagcttgacattcttctctgtgagatcaatgctaagtatatgtgatccaaaggctatgaacattgagataaaggacagtgggtaattgaaatccatccacgctgttattctggccctctaattagaatgcattttagtgttctgtatctcagtttttgtgccttcaccccctcttttattattcactatacaggaagcatccaggatgtgggaacattgtgacatttgcacaatttttatttattgctgtggaaggcttcctctttgaagctgatttgggaaggaagccaccagctatcccaataaggtatggtacattagagtctcttttagcttttggattttttaagaaagtaaagaggtggtacctgtataaaaggaggatgagacattcttttataagatttatttcaaagataccagtagaataataagtcattttctgaatttaatatgttgtgaaaatccggggtacctacttcgaaaataaaatttctgccacaagatttaaaataaccatgatggagacaagagtgtgtatgtgtgtgtgttcttatttagtataggattagtcagaaggcctagtgtgaccacaaattttgtgctgtcttctgtgttggtgaagttatcaaacattctaaaaggggagtatccttgtttctttttaaaaacgaatggcttttggaaataaatagaggtagtagttacataactttgtgaatgtactaaatgccacggaattgttcactttaaaatggt

SEQ ID NO: 127854 - DNA, 1091 bp, Homo sapiens
attttgtcttttatttttatttgcagagcttactggatttttttgtttgttttttaggtctttgactttgaactgagcagccaggatatgaccaccttactcagctacaacaggaactggagggtctgtgccttgttgaggtgagtgagccccagtgtgaggagcagttcccaggagatattcagatgctgcacagcaagagagtgatccctgcaggcctcagcgccaatgtgctctcgtcacagctgttcttgctttgcacattaccttgctttctcagccacgtgacttgcatcagctgaactgcatggagccaagatgccaagagatccgctcttgatatcttcttccagccctggggcattgttggcctggcctgaagtaactacatattttggctttccattcaatttttaaatcctagcagttcatctgaaactaggtgatcccaggtgaccctggatcaaactctggaagaatttgcctgtgactttttgtcttaatgaccctaatgaaaggggtttggtcgggagcccctggggctgaggtttgagacagtcccggctctgacctggtaagccacatggctccaaaacaggccctccctctgagcagcaggcacctcagttcctccagccacacatcctctggttctgtttcctctgcatggtagtttggaaggagctgcctaggaaggttttctgtggggttttctcttttcctaccattacaataactaggtgacgcatgtaactcactttctgctttcaagaaggaacttctcattttgcagtggagactgagactctgtttctctctcactacccttattcttgtctgagctctgtgtttccacactctctcctttagtacttcctcttctaagcaaaatgtgaacattccctaagatggggtgggctaccagctttccctttccagcgtctgtcccatctccctccccggagtttgcactgctggtggcttcagccaccgccccaggcagatgtttgcccagtctgcgtcctggacaataactctggccctgcttcaggcatatgcgtgcctggcaagcctgctgctgccacactgtg

SEQ ID NO: 127855 - DNA, 1054 bp, Homo sapiens
gtgggatcaccaccatcctctcttctgaggccagggagctgtggcgagcaagccaagactgagactgacacctcaccagtggagccgtgtgcaggggcaggccttgggcctccagggccccgtgctgtgcacgcatacacctacacctttgctcaggcccttcagccacaccgagaggttacccggggagaatctcgctcttgagcttcactgcctggacctgccctgcactggagctctgtcagctaccagctgcataaccctgggcaagtcgcttaactgctcgatgcctcagcttccctatctataaaataatatccattttgagggttgttacgaagattaagtgatgcatcagagcacttcacatggtgcttaataccttagtaagtgatcgagaaatgttgctgtgctgataagtccagggactgcaaaggaccctctgggccatttagtccattcaccagctctgcaaggagttcgtgtgatgatgggcagagcctagacctgtgtcaggactctggcgaagcgctcagtgtggcagctggagcagctcaggctacttggcgccacctccctccctgcctgcccttgcagcattggtggcgggggtgtgggggagggggggggcacgcccaaaggagagcagctcaggggagtcctgatggcccaagagcctctgttctcactgagcaaagtggctctgccagggatgctctgtctttatccaagatctgtgccgagcgcagcacagccatgggcctggggctcttgggcaggccccagcttaggtgagcagctgattttgcccaattccactgcccaaagactgtggccatagtgcctgccacctgtcacatatgagacagggatgagagtgatccctgaagagggaagtggagctcattgtttaggagaggagacgtttttcttcttacgtgcaggtagatgttctaagtacacaagataaaatggcaaaacagtggccactgagggaaaggcatatcccaccagagatgcatcgtttgtttcgtatttcattttttaaggaatt

SEQ ID NO: 127856 - DNA, 1043 bp, Homo sapiens
ggagaggatgcagagccagaagtccctggcaccactttgcagatcaccatgtgggacttgggctagcagcatccctatgacctgggagcttgttagacatgcagaactggctgggtgtggtggctcatgcctgtaatcccagcactttgggagatccagacgagaggactgcttaagcccaggagttggagaccagactgggcaacatagcaagacccaatttctacaaataatcaataaattagctgtgcatggtggcatgcagctgtagtcccagccacttgggaggctgaggtggagattgagtgttgagcctgagaggtcaaggctgcagtgagcagtgattgtgccactgcactccagtctgggcaacagagtgagatcccgtgtaagagaaagaaagaaagagaaaaaatgcagagtctcaggcttcacccaggctacctaacgggcatctgcactttaacaagttccctaggtggttcctgtacacattgaaatctgcaacatgctgggactgcagagagcctgggctgggagtcgtgagctccacccggctgtttttatgacagctggcaaaacacgctaaggcacattgaggactcagtgaggcaggttcctgggcctctgttaggctaagtttgaagttgttccatcactgcctccctctgccttctttgccatttccatccatgatagcactaccctaactagtgatgagaagcagtctttggagttcctcttctctcctgtccctcatggctaatttccctgctcagacttctgcctctggctctctttccttctgtgcacactgacttttttccctctcctgtgccgagctggagggtaggaccctctgctgcagcactgggtcattctcaggataaagtcttggtctatctgggcgaacagatcacttccagctcgattcatacatactgactcttgcttgaatagcaagatttgccccaaatcagagctttaatcctatataaatggaacaaataatcacttccagatctccagggaatctgctcacc

SEQ ID NO: 127857 - DNA, 1014 bp, Homo sapiens
gttccccatcagagggatctaccatctgcccagaggcagtcacaggccaagggtgcaggcagggcttgatatgaagcctccctctcagcactgtggtctcagcgactgtgcccctgaggttctcagccagggggtattttggaaaacagtaggagcacttttctattatcacatgtgattttctttattcagtctagtaaaagttgaggtatacaatgttataaaaaaagaaaaggatgttgggtgtgagggtgttgagaatcactggatctatattatatgcaagttgctgaaaaaaaaaacaaaacactagttctgtgtacttggaaaatgcttacatctggtgggacaaatagaccccactgtgtagcagccaagtctggataaagcccttttaaagttatcacttgggtcctgataggcttgataagggacctatcagatgggtcagataaagggccatctattcccaaaggcctaagaatgcttgacatttaaaagctacacgcaattcctgctctcagagagcccacagctgaggaagagactgagacaggtaaacaaatttcaaatctgtggccacatttacttaaatgatctgagacacttatagagtactaggagagttgaaaaagtcaactgcttttaaaacttaagacatgtcattgaggtgctgagccctggcgatcttccacactgcatcgtggatcttaatcagctttgttatagatggcctgagccaggttagatgaggatgcaaatcaaaaagcagggacaatgagtataatgtggcccttccttttcccagtattactagctcattgctacactctttgcaggtgtggcccactttctttgagagaccccttgtgaggaaagcctttgagaagaccctcaaggacctgaagctgagctatctggacgtctatcttattcactggccacagggattcaaggtttgagtgactccctttctcagcctctagtttctgagctgttgcaggaattcaggga

SEQ ID NO: 127858 - DNA, 1024 bp, Homo sapiens
ggaattaaacaacaacaacaacaacaagggcgacatgcttgaccctctgggaatatttccagttcagccacccaagggtgaaccaggcttgcaaaatgctgaggcttcagagcccggggaaaggacccaagcttccaggtcctcctgcctgtctcccagatggagaggctctgatgatcagtcttgagaccctcattggagtggtgtccttctgtacacggtagccatggtgattattcacatcagcatctttctgcccctagggccaaacctgaggacccttccctgctggaggatcccaagattaaggagattgctgcaaagcacaaaaaaaccacagcccaggtaccatatttttatttttcttgttatccaaccactcatgcttccagtctcatgtttcatttctcgtgttgtcctcaactgactccttaaaggggaagaacacaggagctgaagccctctaaagtatttcctttgaagtctgttggaacctctaggaaacacaagagctgtcactgaagcaaagatagcttctgtctcacagcttcctgtcaagccctacagcccagtggcaaagcatggctttggagtctagggatatgggtgcagatgccaactctacctctgatcagccttatgacccccaagctactttcttcattcctaaaaaaggaagatcacagggttgtctctaaggtgaagggagagaaagaggtgggggtctggcacaagtctaatagctgtgaagggctcagtaattattagcgattgtacctgaagccacagtgagctgcagagatgttttattcttcctttccataaaaggaggggtccttgtagctgagtggaaacatgatgtcccctttctgcacaggttctgatccgtttccatatccagaggaatgtgacagtgatccccaagtctatgacaccagcacacattgttgagaacattcaggtaagtttccggctggtcgggcctggtattcctcagtggagtgggggacaggcagaccttctc

SEQ ID NO: 127859 - DNA, 1098 bp, Homo sapiens
caaaccagattattgtagaaaatttggagcataccgaagtataatgtggcagaaaaatgtcacttagaagcaactactgttagtgtttgggtagagcttttagtctttcttcctcttttgcctgctgtggttggttgagattaagaggcacattttaagtaatgattgatgcacctaaattcacctggccttcatctttgtgtgtctggggcctgaagaacagaggtcacaaacgtgtttgaaccgaatggtttcttgaaacatccttggaatgaaatctgatatgaaagatgtttatatgggtggcaggacaaaaagtattacttaataacaaaacccttctgctgaaacttagccacaaatatgaggaaaacatactttgtaaaatataaattaaatgttaaccacttcattaaagcatttggattgcagaatattagtacttggtaagcttctgagactgtatcttaccatcaccttcttccatcccacaatatttgattgcattcctccttctaccacctaatttaagcatttctcctctaattcctcccttcattttactttattcccagctttcgcttctgctcatatcatcggcaaggtaggattgctttgacgggcctgagatctgtgccattatttatgagttagtcaaagtctgctccattctacctctcactttttggtagagtgcttcaccataatctcatttaatctttctgatagccccctgagaacagtagtttcatgatcctcatctttatagatatggaacctgaggttcaaagaatttaaataagttaagatcacattgtcagtcagtagcagagctgggctcatatctaggttgtttttactttagacttttggaatttggtggacacagtttgtgttgataaaagctactaccctggggaagacaatgaccagagataggaaggaggggtccgtcatgagtgggtgttgtccacagtggtgatgccatgcaggctggaacatgcaacatgccctgagcaaatgcacatctcattacatatgtatatctcttcgccatgagtagggatctgcctggtatggttggttattcttgtaaca

SEQ ID NO: 127860 - DNA, 1043 bp, Homo sapiens
atgtaaccgtggaagagctggaggaaatgctacaccaaaatcttagtgggttttttttcttgatggaagtagtctgttttagagaagtcatgagagaagatgatctccacttagtaagaagtaactaacctgtagtcttttgaggcaccatttcagtagagtgggtaaggcacaagtttggtgtcaggaaactaaaaaaggaatggctagaagggaaggtaaatggacaagaggaaggggagggaggataagatacacagctgtgtaaaagatgtttccttagtaaactttttcttcaagccagatcacactttaaaaaggaagacaccctgggggataaatcaataacctatgtgttctttttttgacatgatgtaaattattgattaaaatcggtacttaagtgccagtaacttttgctatgggataaatgagaaaccaggtacaggttggtgagcttttatgaaaaacaaaacaaaacaaaaaaaataaagcttgaggttgaaaaggaatagtttttaatttgggatggggagtatttattcttagtaaggttcctctttataagttggggtgactattgcctggcttactttgtgccttgaggtttttctcaagagtactaataaggtgagccctccttcatgttcaccttgttcgtttgcgtttgatgaaatggctgcctgggtttggaaggacaagttggaactggagatacccctgtgaagtgaagccaagtgagccaagatcctcaaaccatgactctaatatctccagtggggggttgaaggcagaagaccagggttgcagttccagtttgccatttactggccatatgtttttgaacaagtcaatcagaatctccatttttttctgtggagattatggccatccatgaacatactaaacttatagtacaaaagtacaaagtacagaactataatggataattattcttggctcctgttttgacataaataccctgagattcttaagttaaagtttcctaacatcttagccctgccaactgattttactgtggc

SEQ ID NO: 127861 - DNA, 1052 bp, Homo sapiens
atcggtctcaacagggagcagatggctttgaatcatggtgaagaacaagtgaggctctggagaagaagctacaatgtaaccccgcctcccattgaggagtctcatccttactaccaagaaatctacaacgaccggaggtataaagtatgcgatgtgcccttggatcaactgccacggtcggaaagcttaaaggatgttctggagagactccttccctattggaatgaaaggattgctcccgaagtattacgtggcaaaaccattctgatatctgctcatggaaatagcagtagggcactcctaaaacacctggaaggtaccagctttatataccacttattagaggttgccaagtgtgatatctaggccttaatctagaaattaagctaatgaggccctatttacacaatagactcctctatccccctttgtcacttcagatttaagaattgtcttgttctataaatcagatctcttgtgtgttttctgttcctgttacccgaagcagcagttttcagactttagcaagcatcagagtcacctggagaggttggtgtatcacagattgtgggtcccaccctcagagtttcggaatcagtaggtctggggcgcaccctgagaatctgcatttcttagaagttttaggtgatgctgatactgctgattggggttccacactttgagaagcactagtctaaaggactgtatggcttgttgtagtgaaatgaaaggaagctaggaaaggaaggaattgttgaaatggccttgaaagtaaattagagtttttcaagtcaagtaaattatctagacttcagttttgctcacgttcttccaactttaaacaatgattgctgttcctagacgtaggtttcctgagcagttcttttgtttcaaacttcttttcagaacaggcttagtcattgactggaagaaagttagggggaaggaaactaaaaggatagttggtttatttatcttgactctaaaaatttggaaatcagcagcagccataattttaactactttatgtcatgttctacatgtatactaaa

SEQ ID NO: 127862 - DNA, 1033 bp, Homo sapiens
gggcacctgtagtcccaactactctggaggctgaggcaggagaatggcgtgaacccaggaggcggagcttgcagtgagctgagatcgcgccactgcactccagcctgggcgacagagcgagactccatctcaaaaagaaaataataataataaaataaaataaaacaaaattttagtcacttaagtctcattgactgattattaaccagtctaagtattttaaatatttgtaagtaattagtctgctgtgtgaatggcttgagtagtcattaaagtggaatgttgattttatttatttattggaaacatttctatttttgttgaactctccttcctttgtagttgaaatattacggcggcctttgtttatttggctctttaatttggtcccacacaaaagggaccaaacttgagagtgctgctattaaacaggggacctgttggatccggttagatctgaggccatggtcaaacaagtgaatcccatgtatacccaagccccttgctgaagacctggaactcgtttctaaagtcacagacaacaacccctaaacatggcccatcataatcgcagtgtgttagctggggatcagacaaacttattcattccctttaccagtcgtgggaacactggatggcatcagcagatgtccatttaggacccagcctttcacgagggcagagcattcatataaacattcttctctctcctcctcagtagtcgtggaaataaccatggataagtcacctgaccagggtttaaatcctggggatttggtagtttaaaaaggtccatttttactgccttaatagtcctgtgagtagagcaggtttttatttaaccactctggatctgtttccttttttttttttttttttttttaaattgagacagagtcttgctgtgtcacccaggctggagtgcaatggcacaatctcggttcactgcaacctccacctcccaggatcaagcaattctcctgcctcagcctcccaagtagctgggattacaggcgtccaccaccacgcctgg

SEQ ID NO: 127863 - DNA, 1388 bp, Homo sapiens
gctgtgaatctctaagccttttttcttgtaatttctggaaagttcctggcttccaggaattatagctggaatccctcagtacctgcatgtttcaggcacacagttaaatgggattaaagtgcagttatataattaaacagaacttcctcctgagttgtgttttaacacctggtctcttcctgtcctgatcaacaggtatctcagatgaagacatcatcaacattactcttcctactggagtccccattcttctggaattggatgaaaacctgcgtgctgttgggcctcatcagttcctgggtgaccaagaggcgatccaagcagccattaagaaagtagaagatcaaggaaaagtgaaacaagctaaaaaatagtctttctcaactgttggctaagaagaaatgcaaaagaagtggcataggagtgtgttatgggtgctgaactctctctctttttccccgattttccagagctaggctgtggagtagagtttgtataggtaactaggtaacttattgtggcccagataaggctttaggatgcctcagtgcttatgtcatagccttatgagttagctttcttgctagccccctagtcggtcaccaaactagtaactagtggggcttaatgaaggtcataagtttctgagatgggagagcaacaagtagagatgaagttaaaggtatttatcattcaagaaatcattattgagtcaccattgacaggcactattctaatcagtagttcactttaatatttaataagattttctgggataacagtaagggatattagataatataccgtatgtatttattactagtcttttcctctaggaaaagggatactttgataattaaggccagaggcccattagttgagaaagtcacagatatatttctccaagaaagccaacaaccaccaccacaatgacagaaatgacaacaaggccctttaacttgtcttctagtttagagacatccttcatttgacatttagtagaattcctctttggccacaagaataagcagcaaataaacaactatggctgttgaggttctcattttggtttgttttaattttttgaactttgggtacctgtaattagtttaaaaataaagttcctgataataaagtgactgaaaatggcatccccaaagtgtctccgtgtgtttggtgaattttaggtaggcttctaaactagtctttgactcatactttcctgtaacactcaaagaaagaattgcacttatttcaacacaacagatactcatgattttctatatgttgaagcatgaagcagggaaggtagaatacagtgcatgtaacttcattcacataagcagagggaatggtatattggggcttgtgacataaatttgttcatt

SEQ ID NO: 127864 - DNA, 1044 bp, Homo sapiens
gagaggggagcagcttcagggcagctggccgggccagggaggcagccacagagggaccttgtgcatgcctgcacagggcccaaagagggtggcccttttccgtcatttttatatatgctgatcacaaccacaaatccccagacacaaggaaaaatatttgaagcctacacatatttgcgctctgaatcatttgtctcttgtctttattttcctctctctcctctctatctatccttaaatttttatactttttctctcaacagtcctcctcactttatctgtctttgctctagttggtttcaagcgcccatacattgtgtcttgtctgcattttccatgttctatttttaaggtattttattttagcctttttgtcccttttttgtccctttcctaaagctcttcttggtgcccatttcccagctttggtcctgctcatggcttctctgtcttaggccaggggtagtctatagacaggatgactataccatttatcgtcaaactgggacacgttgaagagggaaagaaggggcagttaataatttccctaaaatgcagtcccgaagtgggactgtcccagtgtggagtggatgcttattctatccatggtgtggttttctgctttccacaaatctctcttcacctatcaaccactccctccatttatgtaccattttttttttttaaaccttttatgttctggtccttcttttttatttcaaccccaagaagctttatgtgttcttgtatttctgtcttcttttatctcctcctcattccttcactttactctactctgctctctatcttgtctcaccacttcaattcttcttctcccttgatttccttcttttgggtacagactggactgcagctcacagaggccatgcctgtctgccatgatacatgcaggacatagtccctgcatttctgaaacaaatcaaggcacagctgagcacatacacacacacttcaaaataagccaccaaatgttacaagctgctttgggtctcagatgagccctgagtggactgttcacccctt

SEQ ID NO: 127865 - DNA, 2018 bp, Homo sapiens
ccaggctggagtgcagtggcgcaatctgggctcactgcaacctccgcctcctgggttcaagcaattttcctgcctcagcctcccgagtaactgggactataggcacgcaccaccacaccggctaatttttgtatttttagtagagacggggtttcaccatattgtccaggatggtctcgatctcctgacctcaggtgatccacctgactcggcttcccaaagtgtttggattacaggcgtgagccaccatggctggccaaattgtttatttgtattgttctttaaataaaagtttattttagaatacttttaaatttacagaaaagtagcaagaatattacagagttctcatatgccccacacccagtttcccctattgttaacattaaggcacatttgtcacaaataataaaacaatattgatgcattattattaatgaaagtccaacctttatttggattgttttaggtttctttaagccccttaaaatagaaaaatgtttcatatggggaaaatgtaatgttcacattgtagctatatagttggaactctaatacatgagtgaaaatggtttaagctaactcttttcttgaacatatgcttactggactgacaatctcttgaggactttccacctgtaataccttaggcctcttctgttctctggtttgtttcccttgagaccgttagcagattgctcagcctgacccaccctggtgccagatgttggaaccctcttgctgctgccaatctgactagtcattccaaacagatggtaatatccagcatcacaccccctcccacaatttcacagttttaggcagaagccttagagtgaacacatttacctggctgttgaattgctgaaactctgttcttaaagttgcttcataccacagtgacttgtgagagctttgacattaatagaaggtccaaaagaagacctgagtgacgttcccccaaatcttgagatctaaagactttggccagtttaaaaacactacaatttatggaaaatacctgttagtaacaaatagagaaattataaaggagattgctttttagaaatcaccccaatgaccgtattccacatcccgagcttccaagctttctttgaaatacgagttaccagcagacactagtggaaagaatctttttaattcaatctctgcctttgagcaacttgctgactgacatctagaggcatctcagtcttctggggtggcaccttatggtggaaaggctggactagatgtggtctctcttagttttaaatctgcttggattggggctttataacgttccctcagaagtcttgttggtgtcctttctaccagatttctttttctactgtttcactttcattaacaaattgcttcacaggggacaaaattctagatgtagttcaaatactagttacaaatttgctgccttcaagatacctagttatttgattgatcacagttgtttttaaagttcattttaagtagagttatgatcaaacatgtgcaactgaatcaataaagttgaaaatatatcacgatgaggaaatgtaggtatcttctttggtatcttcatatcaaaaaattaattgagaggaacccttactaatgagtgaaactaatattcttgactcagagaacttcctcaaagcctcaaaataacaacaatttgaattggtcatctaagtataaataaagttgggaagagacacctttcatgaaaggaatggttgaactaactctcaaataggaagacatcaaagtcaaggaagaaagtaagagctcacggcttggggtggaaatggttactaagtttagccatctgctttggtctttcctgttccacatgtagctatatagtttacataaaagtatctctccagaggatcagaaagaacagatttatggaaccagatgtgagttagcatttctacaggtgtggctctgcagctgaaagaacatgttgtaccagggatgaagtttcttattatgtaatcaatataaattaccactag

SEQ ID NO: 127866 - DNA, 1047 bp, Homo sapiens
acaaatgctgaatcgaactgaattcaattaattgaagaaagggttgtttactgacactgtactaacacttctaatattatcctgcctcactagggagtcttcactgggggcaggggtctggagtacaatcagaatcaactggacagttttccaaactatacaggctaatggtagtggactgtgttaaaaagctattcaggatactccgaaattatccctgctcacatctcaccaatccttatgctagttgaggaccttcaaagaaccctccctgtccaaaatacatcattcagaatcttctgtttagctctcttcattttagtgaaagtctcctaaaactagtcctggatgtgttttcatcacacttgaagtttaattaactgataactcaggcacaatggaaatacttagatagatgctcttaaattacatttaaacaaaactatttacaagcgatctagtaaaaatctgtgtctttaatgggctatttttaatgtttcctaaacaaattattgtaggtgggccaattttccctctttacttgttacttagaagcccatttggacatgttctaccccgatctggttctctcaccccactggctacagaatagtgtgtttttgtttgaaagggtcaaaacattaagaatgtgacatccaaaatatgtgctatttttttttcctggagtcaaaacccctaaagtataaatcgtttttaaatgaagaaagcagtgccaaaaggaatgaaacatatttggtccttctccaaaacagagagatagcactgaaacaggaagtggatgatttaaatatccactcggcatcttggcaacatatttatgtttaagggacttaaggttaaaaggtttttgtctggcctgggaacactctatcttccctagggtttggaggtttggggaaaacttttaacaacttatcaaatatttgcaattagccattttttggagaacaaattgttactgagaatgtcataggaaatgttccctataagctgcatgctaccattactctcctgcttcttatgata

SEQ ID NO: 127867 - DNA, 1018 bp, Homo sapiens
atttattgaaggaaattgctagattcttggattttccacttattaattttcacatgctggaaaaggtgcgaatttgactagttccatttagtctgcaatttaaaagctaccccaaaatatttgaaagagcttatgacatcattcttagatcatgtgtacatgctcagaaaccaaacctattcctgaatagcccctttctcttcagccaatttaagcaatcagtagactgttttgtatatgcaacattaactcatttggaagatttatgcttatgctgttgctctgactgagctggtcagaggattttagaagtttccaggcgaatgggtaaaatgtagggagtaagcacactttgaagtgaactgtgccatcataggatcaatgtattcaaatagacactggagaagacatttccactgtttcccatactagttacatttcattgacaatcccatggcttcaataggtgagactctactgtgtcagaaggtagaacaatgagcttcagtcttcttgaacttctcttgtgaaacctgtttccttcctggctttattaaaaaattatgtcttctgtttttggaaaagtagctgtcagaggattagagacaattcattgaattggattacttgttgtcacaaatattataatagtattgtagagcacagaccaacggagagctgttcccatttgctaggatgttgttactgcttcggttttatttttatttaaattttttatctctgctattctcctttatggtcaaaattgtaaagagtgcatctttggaggaatgcaaggtaggcaagcttgctaagagcttctacaagactaccttaaaagaagacttatatttaacaaacagaatctcaacatatggacatacaccctcttgagctggttagaaaggacttttttctttatttgctctttttgaccactgacatttattttaatttttttcatttttaaacatttttattttgaaataaagtaaaagattaacaggaagttacaaaa

SEQ ID NO: 127868 - DNA, 1033 bp, Homo sapiens
gtgtgctttcttcttaggttttaatgctggtttacaaaaggaaaagtaaattgctttctggtaacaaattattgcagaagatcttctacttaaagcatagatgcatttttatttttcatttacttctctgtttttgaagggttcagtgtttattcggcggaggtttatgtcaattatttaatcagaagcaggccccagagtttgccagtgatattttggaatgtagggtctacttcaaagaaaggttccatgtctcttgacccagatgaagccaatttttcatagtgaagagcaaggtaattcgattttctttttcagagcaaaaattatttttagactgaatttgatgggtcatatttctctgctcagtaaatcttgcaattatcactccacactggaaaatgtaactcaatgacccaccattgcgccagagcttctgtgggcagccgagctccgagaggcagctggacatgatgtgaagttggtgtctatgacatactgcaagatggaaaccaagcagtcaaccagtggcagtagttcacatgccaacatttttgtttatttgtaatggaaaactttaggaggaaaacacaggagactgggtgccatgggtgtgaggtagagatttcaatcctgttcagtcacaggaaaatccaaattggccacgctaaaccagatccaaaatcccagactaatttcctctcctctttcctctgcgagtgtttctgatttcacacaaggcaagagcaactgagaacagggagcctgactagatgaagtaagaaccgtcgtgaggcccaggagcaagaaaaaaaggcctggagttgtagaacatgctagaacatgaatgacagtctctgcggaattaagaagcattctccactctattccatggcctcttgctgacctaactcctagtcttccttcacatctcaccttaggataccacttcctaaggaaagcttaacagactcaagtttgacttattacctttctctgtgccctgacaattcctgataccctctccagagca

SEQ ID NO: 127869 - DNA, 1024 bp, Homo sapiens
tgatttaaagctttgtctgctatccaataaatctgtttgctacagaatgccacaaaaattctgactttcactgaataattgactttttctttaattataagaaaaatttccttaatttcccactttagcctgtttggtagctaaattcctaacatattatcatattaatacatcttgtccctcttatctactcatttatacaaatatctgtatacatttccatatgcataataattccttaataacacagaaaacatatcccataaaaatcaagagattctcatacagacataaacctatacactaaactacaagcatactatagatgaatttgttcaagatacatagggaaaatctgaaatggaaacatacaattttaaaaaataaagaggaaacattgttcaaggacttgatgcacaaaagagctacaagaaataatttggggaaggtgggtggttaaaagtgaggacaagaaacagtggatactaagcaaagggctggatggatggtgaaattgcatggcattcttaagatgataagtagtccctgtatttggattgccttggtatggaccacttgcaaaaacattcaatatttcacttctaagatatggtaagccaaaatacatatatggaaagttcactaagtcattggcaaataatccagtgttgacttttaatttagaaataactggccaaattgatcccagccttcccaactacaattctccccctgcagagtacattgatttgtattatcttattgttttctctcactgtttgtctttctttttattattttattttcctactggtacaatgtatgacaagagatagtgaactttcctgattttatatattttgagctcataaattccctggagttgtcatctttccagactaaagtttcatctttttctattcacatgttctaaaaataatctttttaatgatgtgtaacatatagagaagtgcacaatttataattgtacagagtgatggactttcacagaatgaacgcaact

SEQ ID NO: 127870 - DNA, 1028 bp, Homo sapiens
aatacctcttcttgccacttttcttttctgtttgtcattcctgttttcctcctcctttgttcactttttcataactttggtctggggttcagaaagttacaaagagcaaaatcattcattagaatttcaagtgattctaccaatatttcaagtcttcaaaacctctctgtctccggaggtcttttttaaagaataaataatcttgggatcttacttatttgtctctaggagattcatgaatgagactgaatttaactcggctcaggagtcagaaattgatcactggctaccttatcagctttctaagagtaaagaaaaatcaggagaatgacaaatgggaaagagggcccatagtaactcaggagaagtaacacactgagttatcaatgatattgactctacctcctctctttcaggtccagacatcatctggtctccctgaacctgaaatcacaccatggatgattttgagcgtcgcagagaacttagaaggcaaaagagggaggagatgcgactcgaagcagaaaggtaaggatctagggtgaaaaatacttgtattcccttattaacaaccttggtttcaggcctcaaagaccatccttttgagaggccaaatgtggtcatatcgcacaccaaactgttcgcaaaagtagttatggaaaatttttctgctaagactctaaattaagcatttaaaaaaggaaaacaaacaagaatcaagaaaaagagagatttgagaggaatcaattgataactgcatattgataattgcatttaatcaatacctttcacattggaatgttttaaatgacaaaagtaatgtgtgaatgaaggtttaaaaagcttatataataagaaatgacaaaaaaatgtcaagtattgaatattggaaccacttaggacatgagagtcttcaatctaaaaaatataaaggcaaaaagccctggatgaatcttgtgaaaaattttcattcttattagaaaagtatccaactctagggatctgcatagtacaggttaataacgggc

SEQ ID NO: 127871 - DNA, 1005 bp, Homo sapiens
tctcctgcctcagcctctcgagtaggcacacgccaccacacccagctagtttttgtattaattagagaggaggtttcaccatgttggccaggctggtctcaaactcctggcctcaagtgctccaccggcctcagcctcccaaagtactgggattacaggcatgaggagctgtgatgtattttctgagaaaccagcagtgatgcttttatccatgagaaaatctccagcagacatacttggccgacaccgggcttggttccccaacaaatggctctctcactttccaagatgtgctcattacgttcacagcatctgctttctgcacccaacatgagttcctctcactgatcagaagaaaggcccctattgtagagttacgttatcagattcagaagcttacagacataaataaagggaatgaaaacacttgctgttgtcatcattcatacatttttatgggcttctgaaatggcttgatgattagacatttgaaagtaaatatttttactacactataaaaagaagcaattttttaaaatccatggggtctctaaagtcccctctcagaactgtatcactgagacttttttacatgatttaatagaaacagccaatgaatgattatacaacacacaacccctcacacacgcaaacccaacacttattcaaaatgcttagcatcaggaccttgacatttttaaataaaatcttttaaaatgaaattactgttattttatcatcagaacattattttccattaagaagttaaatacgatattcctttgaaactatctaaattatcaaagtagctagatttgctcaaaatttcccttcagttctctcagaaaactgatcactccaggggacaaaagaaagttagaatctgccatctagttttctacttttattttttattttttgtagagatgtggtctcgccatgttgcgcagtccagtctcaaactcctggactcaagcaatcctcccacctgggcctcccaaagtt

SEQ ID NO: 127872 - DNA, 2111 bp, Homo sapiens
ccagtgcttatcaaactttttaaaaaatcaaatttaatcttaaggggaacgctattgtataaaggagatgttctggttaaagaaaaggtttgggatctagagctcctcatcctcgctctactctgcagtcatagcccactgcacaattctacccctctcctcatccctcttctaccccacctccccaccctcttcatcaaaacttccttggaatcctaggtctccatggaatagttcagaaaccactgatctcattgaaagccttcatttcagatgaggaaactgaggcacaggaagggcttgcccagggtcacacagctgatcagcaatagagcgtgggatgctaggaaaagagcccagtctggctggctgtctctctctcaactcatggtcctgaggcttgtttccactccttcatgcctatgattctatcagtctcctttctctgtgtctctcttctctgtttactctgccatttcctggatttcaacagctattacctctcaccgggatggttgtcattgcctgccatctggtcctcggcctctgtctctctcccctttctgatccagccccctacagcccccacctatgaagataaagtccattctccttactacagcattcaaatttctccacaacatgccttcactatttcttcccattctgacttccgccagggagaatgttaaaaacattgtggggaaataaataaatgatgggcataattttaccagattctgcagaaatgacaaaagaaatgcacacagggatgtcgagatttgtaaaaactataggagtacctgatccggtgaaataagatcactcacagctccccaaactcagcatatacaagccaccactgtttcttgactcattctattccctacacagggaataccctcaccctcctgtttctgacctcctttctgttctgcaaggccctgatcaaatgctcccttcctctgtaaaccttcctcattcctcacttctctcactctaataacctttgcccatccttctattactagctttgtaccgtcaatcgaggaaaatgacgaggcaagtctcaatcattttaggaggtttacttgccaaagttaaggatgtgcctgggagataggtctatgcctttatctgaagatgattttgagggctccagatttaaaggggaaagggtggggatattgagaagtacacaattttcatctaagtgaatctgtgttttgtacataagatcacataaacaaagggggcagaggaaaaatgcggggaatctgcattttacgtatgataacagacaaaatggggtagggcgacactcagatatgcatttgtgtctggtgggccagggtgactgcacctataaagataagctgtccatttgcattgccatggtgaagttttaacagctctctaggaatgtccttgtggacaaaatatgggggaggcttgtgtagcttttcaccttgtagccatcttatttaggaactaaaaggggaaggctttgagtgacccagttcccggcttgacttttccgtttgtctaaatgcgttcggggtaccaaaatttaatttcctttcaataaagttattgttgaacatagctatcttccctcccaataaatggcaattcacttgagggcaggaatgattttgaatctttgaagcttcagcatccagaacagtgctgatgctccagaaatattctttaagtttcctattattgagtaaatcaaactcaattccccttagtttacctttttcatttgaaccgtttgaacacacaaagccttcactccttttgctttgctagacgtactaggttaaatgctaaaacaggtgctcaacaaaatgaattctaagttcctttgcatttccatcagataatttatctctgtttcatcacctgtagagcaagattggctgtgattttttaatgagacatgttaaaattcctgaatgccaagacctacacaagggccatgttattttcaggagcagtcgtgaatggttgttcagttatttagatttcaaggcatgtttaatttgttcctaccaagatcactgagagattctgtcacttgcggtttaatattttcactggtactt

SEQ ID NO: 127873 - DNA, 2008 bp, Homo sapiens
caattattctgcctcatcctcccgagaagctgggattacaggcgcccgccaccatgcctggctagcctgggggtttaagaaaagtttttttggatgggagtcagagggtctggattctggtctaactccttcagtaatcagtactgtgatctgcagcaagtcgcttcaacttgctgcgacacagctatgaagtggagatgctgatgcctgttctgtgtaattcacagggtgagcaagaacatccagtataataatgtgcattaaagtgtgcagaaaaatattaagtacagagcaaatccaagttattattaaacagtcttacttttacaattaaaatttaatatcagaggaacaacttggagggaccatttgttctttgtagatctgggaaaggattcttgaacaaggctataatatgatgcaacttcataaatggaaatctcagggtaactttttttgtgatattttaagtagatttgaattgaagaaactcagccaagttatcctggtccctcttcccttaaatacttttttttttggttttattttttatttttatttttttgagatggagcctcactctattgcccaggctggagtgcagtggcatggtctcggctcactgcaacctccacctcctgggttcaagcacttctccagcctcagcctcccgagtagctgggattgcaggcgtgatttttgtatttttgtagagatggagttttgccatgttggccaggctggtctcgaactcctgaactcaggtgatccgccaacctcagcctcccaaagtgccggcattataggcgtgagccactgcgcctggccatttttctggttttaaaatcaaggaagcaactaggtggttgttgggtttttaagtcatgaacctatttgtaaaggagcgtgctttgcctgatattatctactctaacccagtagatttataaacactaatttctactgttttaagaccactttttattaaaagcaactaacagtaaataaaaccaaccactaaaagagataattttatcaagaagggtttaaaacaataaacttttagatcaaatatagtactttcctcatttatctttcacttttccttttgtaactatcctagacctcatttcacacatctcacacagacattggttagaacaaatgcttctttctttttcttttttttttttttttgagatagagtttcactcttgttgaggctggagtgcaatggcacgatctcggctcactacaacctctgcctctcaggttcaagcgattctcctgcctcagcctcctgagtagctgggattacaggcgcccaccaccacacctggctaattttccatttttagtagagacggggtttcaccatgttggccacgctggtgttgaactcctgacctcaggtgatccgcccgcctggccctcacagagtgctgggatttcaggtatgagtcaccgcgcccagccagaatgcttcattcaaggcctgctgaattcctattcggagcctaacccaccctagagctgtgccttacaggctagctctgcctgctgcattagctccctgtgtctttccatgtctgtttattgatctttcttttttgtttttgtttttgtttttgttttgagacagggtcttgctctgtctcccaggctagagtgcagtggcactatctcagctcactgcagcctcaacctcctgggctcaagcaatcttcccacctcagcttcctgagtagctaggactacagatgcttgccaccactcctagttaatttaaaaatttttttttgtagagacgaggtctcactatgctgcccaggctgctctcaaactcctggactcaagagatcctcctgcctcgggatcccaaagtgtagagattacagacatgagtcaccacacccagtctgtttgctgatctgttttaaaggaatgtctacattcaccttttctaggagtcagttctccaaatcactctacctttcactttgtaagt

SEQ ID NO: 127874 - DNA, 1024 bp, Homo sapiens
attctccgtgaagtctgggtattaaaccagccccaaagaagaacagaaaaggggattatcctcttccactaggacacatgccttttctggcatgggaagataaagctctctgatgataaatttccaagtacattttaatgagaaatgacatggattaagaaagagatagagaaaataagagatgaaaggcattctatttgttggacatttttagccacagttctccttgtacacccctcaaaaaagaaagagaaaagtaatcaacagggaggaacaagggaacacaaagaggagataagaattttcttctacatgtattctgcgtttctcagccttctgtggtgttactatcatcaatgaaaaggcatttaagatccttaagttagaaaaatcttttctgcccaattccccacttcttgtttggaaacaagaacatgctctgcaagacctgtaagcacagatttaatttccatcatgatgatgatgataaaattttaaaaatggtgaacattcatatagtactaactatatgccaagcactgttctaagtaccgtgcaactattagttcatttaatccttacaactccactatgacttccgtggttagctaataatgtgttacctccatttgcagatgaggaaaatgaggccagaggggttcactcacttgcccacttcctccctgcttggacgtgtgtaagactggtgcctggtttttggctccaggctggctcctggtggctcccctgctctctccagcttagcatttatgaaagttattccctgtgttttcagagttctaaccgctagtctttgagtgggtgaatctggcagcagctgtgttattacatcagatcctgcttgatgagcaaacttctcctcctggaggagcagggctggagggctggagaggaaggatctagcaagagactttgagttctataactctttcccttaaatatctagcccaggggtctaaatactgctttacaggccctaaaaagaagtcatgagtgtacctct

SEQ ID NO: 127875 - DNA, 1033 bp, Homo sapiens
tatggggtagctggccctaatttcttttatttcttggggaaagctgcagagtgaaatgaaacacctggagtggagattgaaactagaaaatgtgtgctgcccttccgggactcccttccacagggccatagcctttggaaagagccttatacttcgttaaatgattggtctgctcttctcagttcttcgaagccatctttctgtatgtaccaagcacgattggcgcctcactaatgcccttcatgccttccaagccctagccagatggaattgtgtgcttttccataaccatatttcccgattctgcaaccttgctatttgagctttctgtacatggaaaggtcctctttcattcccccagctcccaatgctagccatcccaaaagagccagcttgaataccactttctttatgaagcctcctctgatcccttagctggaattgccttcttcctcctctaaactttaaatcactttaagtcttctgtaatatttaccacattctacctattatcacatccttaacaggtcttaacttccctacagattatgaactcctttcaggggttgaatttatcttggtttctgccctcactggcttgaatggagtaaatgttcaataaatatctgttgaatggatgtgctaattccagccacctgtgtgtccatttccaggttatagcagcaagcattacctaccagcatcccacaaccgcaagttcagactccaccttggtatctggcagatggttctgaacaatggtttgccacctcctcctcagaacctaggcccccatgcctcctcctcggaacctaggccttcatgcagcccccttgctgcccagagctcaccactctgatgacagttctgaattgaactgtccttgcctccaagtctaggttccacgtggatcagtcagggagaggaatgtataccagattagcaacccataagtcagtgccagtgctgtcactttgtaattcagaaatatgaactttttttttaagtcaagtcagtgatcttcaccactgaa

SEQ ID NO: 127876 - DNA, 1102 bp, Homo sapiens
ctattgccacaattttacttgaacctttaaggatgatgtcctatagtctcaaaccagaagataccaaaatggagaaaagacaaaatgaagggaataagagcaacattctttaaactacggggaacacggagtaaaaaaatcaaacaagacgacctatactatagttgagatgaaaataagaattttgccagtgttgcagaagttttgagaaatatttgctagggaagctggggtcgggggacactggggcaagaggaaaactcgttccttgctccagtgtcttgctacggaagcttctgcaagttcttctggctctcgtctggcatatatttagaccctggcccttccaaatgtaataacatctcattggtctcctcatttgccatgtctgcaagactttaattcatttgaactttctatctgaaaggcacaaactaaaacatggttatcttgttacttaaatacactgaggcagcaaggcctggtgttaaagacctaaaatatcttcagtgtaaaagccacagcattagaagagagctttcccattgcatatatatttttttcttatcttgtaacaccagggcccttaagcaatggttccaggaatggaagaaaagccaatcctctctactttttcatgctactcgtacaatcaaataacatcatgtggttattatggacttttaaaattcgttgcatttattcgtcagtgtgaacacacacacacaagattatttctctttctccaaaatatccaatgagccatgttgctgtcagctgacctttgctgcagaaaggtacctttctccaagtgtttgtgccaacagatgagctaaaagcagttaccaagtaacaaagtggaatactccacaataaaccctcttccaaccagcataggtgggaagttcatggattctggtcaaacaaacattttatttcatagagaagtactttatagatcatttgtggattgccagtttttttaaaaaatagatccacaataaaatgcatttgatttaaactctattaaacaaaattcaataattctcagatgattcagataaacttcaggatcccacactccttctgaatcatctgggaa

SEQ ID NO: 127877 - DNA, 1022 bp, Homo sapiens
accagcctggccagcttggcaaaaccccatctctactaaaatacaaaaattagctgggcatggtggcatgtgcctgtaatcccagctgctcgggaggctgaggtaggagaatcacttgatcccaggaggtggaggtggcagtgagccgagattgtgctgctgcactccagcccgggtgacagtgcaagactgggtctcaaaaaaaaaaaaaaaaaaaaaaaaaaaactaacccacagtttccaaaggcaacttgcttttgtgcagaatgttttagtttaagttgttatttggtcattgtaaattatcttctgtagctattggattcatgtttttcaaatagttaaaagtttgaaagctagctgactaggtcgctaaacttaaggaactgaaccatccttttagacgtatgtggttcattaagcagtgaagttcagaaaagggctcagggctgttcctgccaagaggttggtgaagacacgtggcaagtggcacgctcaagaggttgtctttgtaatgttgcagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacaggtactgtcctctttgggacggggagtttctaacttgcgtcttagcctgtccgttgaatggaatttgttgagcagagcattcctttctcagcccaactcaaccctttttcaatctaactggtttaattattttgcagtcattttaggcaactaatctgattagacaggcaatctgatttagacactaggacacactattctatttctctccaccccgttcccatctcataaacataccccagttgaaggcttttatttcatttcacaatctagcatttgtttaatttaataagtatggtgtgctatatcttaaaaataagtatggtctattttttctgtttaattctttcttt

SEQ ID NO: 127878 - DNA, 1199 bp, Homo sapiens
ccactcaaaaagtgaggggtgctgaggtatctaaacactcaggctatcaatttttgtttgaaaactgctcccaggggacattaataccgaaagcacttctggcatgttgagtagactccagtccccagagaaaggcttgcaaatgctgtcagctgaaagccaggcaggcgtgtactaaaatggtaacgtactggggatatgggcaagcttggcactactggcatctgctgtagtcctgggtagcacaggctgtatgaatgctgctgactgatgaatgagcaagctgtctttggtgttgttctttctgttgtacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcag

SEQ ID NO: 127879 - DNA, 1223 bp, Homo sapiens
cagatctagctaaactgataggtttccttttctttctttcccatttgtgtctctctcacagattctctcaccatccaggaagaaacctgtctaagcaacgtggtcattcttccatcaaagccatcctaataattgctcttcccagtgggaactgcaaacagctacttttacatgaagttcccagaacttagtggtttccaaacaatagtactaccactgctcttgaaaataaaaacctcagtgagatcagggatgatcttaccttcttaaaattgtggtaaaggtgtttgttcacaggctaaaggaccatagctcattctctaagaatttcacctgattccaactctaccacatctgagtggtttctttctgagttttctgccttcctaacaattttgggtcttacttgatgataccaaccaaaacctaataagatttttcttgttctgtttcttcctgatatgtactgttggttagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcaggtaagaagtagcaactagttaatagaaactgtgttcacatgcaaagaaaaaaaaaaaaaagtcagtcttcccatcctgtgcttccagacagaaacgtgctaagcaggcagcatgcttttgttgtgaggtcattagccattgtcttagagatactcagtcagcaggtccagttcttatatcactaacagaagaccagcagtcatcgctcagacagggcttagtctgcttttcccattattttgaaaggcagatcatgcttggcatccatgtttttgttcactgaccttttgtgagattagtgtattagaaaacattataactgggattcatgtcattcaatgattctctatatggtctgaccaccttcctaagagacctttctcagtaccattttcaagaatgcattttctaaaggttgtaaataaatattgcataagactaagattgttttgtggcgaaatacttgggaaacactggattaagctaaattcctcagatttctttaccacatgactttgagagcccttcatgttcattttcattggaagtctctaagagggagtgagaggtatggacctactgctctattttatacagttt

SEQ ID NO: 127880 - DNA, 1030 bp, Homo sapiens
tcagtttcaacatataaatgttggaccatagcacctcctttcagctgtttcacagcttctctttgtttacaacatatggaaaggagggacagtagtgaaatttttatctgttgtttattagatgctttggcatacattaaaatgacattcggtgattatctctcaattttactgatccacattctccatgtgcctcattcctttgagcaactgagaatagagacatctaaaatttataaaataggaaagtatattttaaaagtttaagctgcttttcatgctagctgttcattttttctttgtcatgattaaaagccagctggaaatggtacaggtgcaaattttaaagcaattattatgggaggaggtgaaatgtgacttggaaagggtccttttccaggatggctttggtcctatgacagccttcatggagcacagctcctatttgatgtaaaacagagtgctgccaagagaacagaaaaggagcaggaatcagctgagtcagggagatgatagaatagttgagatgtagggaaaacacagtggactcaagaaagtagcatccttgatttataatcagtccaccattattgccagtggcagtttctttgagaattaacatcattgagcatctagcacagtgccttacatcatattgaagatacttaataaaaatttgttaaatgatgaataaaggaatgaatcttcagagattgggacttttaacatttcattttccatcaacctagctaggttataaagcatcaacaatggacaaagccatgagagaattatacccaggtctggccgggcacagtggctcacacctgtgatcccagcattttgggaggccgaggtggatggatcacctgaggtcaggagttctagaccttcctggccaatctggtgaaaccccatccctactaaaaatacaaaaattagccaggtgtgatggcgcacacctgtaatcccaggtatttgggaggctgaggcaggagaaccacttgaacttgggaggcagaggttacag

SEQ ID NO: 127881 - DNA, 1108 bp, Homo sapiens
taatgatattttgaatttgctttgaaaattccttcccaggtaaagtttacttcattctttaatattttggatgattgcccctttgtaggaaactgctggcttgaaggtaggggtttctagccgcatcaatgaatggctaactaaaaccccagatggaaacaagtcacctgctcccaaaccttctgtaagtacctttaggtttttctgagtttctttgatctcccagcttctaccagcagaagaaaacaagcagttggtctgtttacctaggaatggcagtgcccctgttctttgctttccctgatgaatagcaaacaggaaagtgttcagatttacaacagttctaagaagctgcatctcagttactcagagggtaaaatggaaccaaataatcacctctacaccctaactgagaggaggaatcagctagaatactgaggcagttcaaatttagatcctttactcgtctatttgtttagcttctattctataaattctggatagaaatttgaaaatgaaaggtcacatcattttggctacttctttgtcaagagcacccctaaacttattcccaaaagaatatgtatgttgcctattgggaacccatatgttccaatttgcctcatttttataacttggcacaaaaatgcagttattgggtagctgttgaaataattggtctaattgtgttgtcagcacctcctgaggaaagtcataaaactggaaactagaaaaactggttatgaatgatgtttttgagaatctaaaattttcttaatttattaagtgcagctatcttactaaaaagtacatttcttttcacctttttgttgaatgtatacgacaattgcttgcatttgtcattataataagaaaacgtatcaagctccccactgtatattgctgagctttccctgttaagtttgcttttatagctttgttggtgcccaagggagctgagagtccactgtcataatcctacattctagaggaagaagaaaaagtttccaatcctaggcctctgtgcatttaattgcatccattggctccatgccatttaattgcatttgttggctccatatataatctccaaagtcattaaattttg

SEQ ID NO: 127882 - DNA, 2644 bp, Homo sapiens
ggcagaggttgcagtgagctgagatcacaccactgcactccagcctgggtgacagagcaagattccatctcaaaaaaataaaaagtaaaataaaagatcatatttgaatggaatgccgataataatcctccctttcataaatatttattcctgccatactattattcatttttcttctgactataaaaaccatctgcctgaaacactgcaggctgtcagtttcacactacaggctgtcaatttcaagttctcttctcttggcaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagt

SEQ ID NO: 127883 - DNA, 1093 bp, Homo sapiens
cgtacagtatcacaccaaaacaccagatcactgcacagcctgcttggcgtggccccatactagtctatgtgaattgtgttcctggcattgtatcacacagtagctctagaaggagaactgagaaaaagttgtgactgagttcactagcaaaccttgagaatacagttccaggaagtggtgaggaattatagttcatcactgtatttaactcgttagacaaatagtgtgactacatttaagaagagtcaaagtagatgatttgctagaaaagctacgagaaacatgtttttaaaccagtagtgagcttttagaataaattaatagtataaaagtcaactatcttttggctactgtgaagatcaatcatcacaaaatttcattagtacttttataaacagtgccatgaattataaaacatttataatgatacccacacattgaatagtgttgaaaggaaaaaaggaactatataaaaattacaggagttggtatttttcttcttcccactcatgattgtgtttgaatctttttctcagctgactcttttggtgatcccttcttcccccggactacacagatactattagaatatcagctagggagatgggtgccacgtcttcgtgaaccaagggatttatatggtgtctcttcttctggtccattgagcccaacacggtggccataccattgtgaagtcatcgatgaaaaagtccagcatattggtatgtttttagcagtttgggggattcagacattagcaaacttactttgccaaccttaattttaatgaggagactcacaatgttagaaaacagcacattccaacagaaatataacatgagccacataatgtaattttaaatttgcttgtagccacatttaaaaaggcaaaaagaagaaaatgaaattaactttaaaaatggattttatttaacccaaatatatccagaatatttcacattctttttgtccaaagtcttcagaatctggtgtgcatttatctttacagacatttgaattgagatcagccacatttcaagtgttcagtagccacatgggcttaaatggaggcacttgcagcatttgcttggct

SEQ ID NO: 127884 - DNA, 1123 bp, Homo sapiens
agagggtgggtgctcaggatatgggtacattgcctggcctggtcacattggctttgtagttgcttctagatacatcctgtgttactgacagatcagcatgttagggaaataaaacacgtatgttgagcctgcgttttcccgtactccacagagccgcaaacaggaaaaggcctgcgagcagccggccctggcgggggctgataacccagagcactcccctccctgctccgtgtcgcctcacacaagttctgggagcagcagtgaggaagaggacagtgggaaacaggcactggctccaggcctcagcccttcccagaggccggggggttccagctctgcctgtagcaggagccctgaggaggaggaggaagaggatgtgctgaaatacgtccgggagatctttttcagctagggcataaactgtgcactgaactgtctgccgagagcagctggaggacagctgagcttccactggtgctgctgggccgcccgcctgtgggaatggggctctctgtgctcctacctttgtgccttcttgggcctggcagattcacctcaggccagaagcccctggacactccgggccttggggctgccgttctgagtgtgcggaaggcaggactcaaaatgagatcccatttgactccctctgtatgtactgtgccctctcctggctcttgaggctctggagtcccaattgtctgtgttagtcagtgaccaggttccagggaaaatgatgtcatgtggtggtccaacttactggaaccaaagagacagtactttgcaaagaaaaggatcactgccaggtgcactggaattgctacagtttagtccgcatgatctctcctgaaggaggaagcctgtttcaaaaatagtttccatcatgagtctatcaatgagctcccacctctccagccagcctagaaagcaaacgagctgcccacagttctctgccctgtctgggaggttgaggccacagtgtatagactggtaagccagacaggcctcctcccgcaagctgctaccttgctttcacctgtaccttggtccccgggcagctagctataaagcaagagggacaggagcccagaagagacactgaggacaagagatcacaccagag

SEQ ID NO: 127885 - DNA, 1032 bp, Homo sapiens
cccgaggccctgctctcctgcagcttgcattccccagtatgggacatgaaccttcaacaaataagcagattcatgagcacctgccaggtagtgagaagtgatgctgtagtgagaacaaccagtgtgcgtgcaagaggcaccagcccacagcaagttcaaggcagctgagaaaatgcctttttttaaggagccgctcagggacttgttttccacttcagatggaccagctgtagttgggaaagtgcaagcatttcctggttcaaaaagttaaacagactttctggaaaggtgggcatgtgtgtctggcctcaggcacatcctcaggtaggccactgaaagtggatcaagtgtgtgtaactggtgtttgctgacacctcctcctctttcctgtcctcttgcagctgggtggcgatgagaaggttctggagagctgcttgagcctaggtggccaccgagcccctgtggtcaccgtggactggagcactgccatggactgtgggacctgcctcaccgcctccatggatggcaagatcaagctgaccaccctcctggcccataaagcctgatgacttgccccaagggccacccgaggaagcagtattatctgcggtggggggaggagatataggacaggaaaaccacgtgctccactccagctccctgccagtgcagtgactctgcagggaaagactggcaaggaggctcaggtgcttccatctgtggtgactggaatgggacccacgtggagtaggtgacatatgcttcccagagactggtattgtggctgtgccaggagtacatgtgagactatgggaggaaagctccggaagaaggagaaacattgcagtggctactgtgttggcccagtagaaattgacagtattttgtatatatgtgcccatttatctttttcttttttaaaaaaagagaatactcttgtggtcccctgatgtctctttctaggatgtgtgtcactttgcttcagtgacagccctcccacccagcctggctctgctggccctgaactgaacc

SEQ ID NO: 127886 - DNA, 1096 bp, Homo sapiens
aggttggatgcattcctcagtagaagcatgcacctctctgacggtttaaagaggaaggcagattagagagaggtatttgaccttcagaaacagccagttaaagcagaagccccagctggtgataataatagtagtggttgaagaaacagaggtacacacaggtgaggaagacagtgattggtgagtcacgatgcaaacccaggcagccggattccagacctccacatagccaagtattgcaccagatgaaatagctctagtggtggtgccagttctttctgatggaaataaaatgcgagccaaatacgtaatttaatttttttagtagctatgttaaaaaaaaaacaagatgaagttaattttaatgatatattttatttggcctagtatattcaaaacatcatttcaatatgtaatggatataaacaaaatgttaatgagctattttattcttttcatgccaagtctttgaattccagtgtcaattttacatctctagcacatcttgatttggactaaccacatttcatttgctcagtagcacacgtgaccagtggctattggacaagacagctctgagtttactgtgaccctcaaagaagagccgcagacttcacccttgtaacagataagctgctggctccctttgtgcaaaaaaatgatgccaaggataataccaccttaaagcccaggctcttggacctgacccaggcctggtcacttaacgtcatccatagcccgggaggtctatgttcttggtttttccacatcctgtttcagccctctgaccctgtggtgtgtttgctgaccagtgccatggtgtgcagccaaaggaatgcctccctctcccagtcacctcgtgtgggcttcctgtcctcgctgctgcctcagagtaagaagagcccctcaaggttgtcgcctgctcagggccctcctcaacctcagagctcggccaagaaagagtccttcggtggtcaggtaagcacaagtcctgcctctctaactctggccaagaaggccgtgacagctccctgtgcttccagacctcctggtcaagtgtagacttgtttgccctccttttaggactgatttcttg

SEQ ID NO: 127887 - DNA, 1051 bp, Homo sapiens
atgaggccagacctagagaaagtcttagagacaagactgtagggagcgactatttcattaagcccgcaagagcccacagcaccgctcctatactctgttctctgtgtccctgtgtctcatgtgttttactggtgtgtcaagggtttgggaaggacgtttaaacatttcaggggctggcttattctttaacttcgtgcaccagtccctgtgatcctgaactttgatgcggagtgtcagaggactaaccaggttcaagaagaaaatgaagttctgcgtcagaaggtttgttctgaacaggcttgctcctgaggaagtacttctgctttttgtgtgtgaaattaggtagtggcagtggaacactatattaatcaggtttccactgccactacctaatttctcagatggaaatgagtcaccagaaagtcagtattggggatttggagagtaacagtctctgaaaaccagaggcgagattcatattttaagtcagatatgtagcatgaacaatatagtaacagtaattaacttttaaggagaaaaagactatatgcatccatgccaccttataactaacctgttttcatgtgtctgttttgtctttccacgtatagctatatatgtgtgtatatatatatacacatatatatgtaaactatatgtatatatataaactatatatacacacacacacatatatatagtttataacccatatataatttagttgttcctactcagctatatgcttctctagtttgataaaacaatagagccaggggacccacatttgcctgtacatgttgcctgaggaacatttctctttcctgaaattaagatctccttaggtgatattgttaggaaaaggaagattataggctgtttaggttatggggtttaagattcttgggatttggggtgtgtgtatatgtaattttcttcaggcaaaaggttaaaaacgctgtagttcattaacaggttttttttttttttccattccagagtcaggctttgagagttctaaagcctgattttgtagattctaaaaagcaaa

SEQ ID NO: 127888 - DNA, 1042 bp, Homo sapiens
gcgccggggcgccggagacctcagcgcgtccgaccccagcttgacggatgaggaactgagaccctcagacggacaggacctgcctgaagccgccccccgagtcaggagcatcgccgaggctggagccccgatgccccggctcctggtctagggttctgtctccactccagcctccttggccaggatggcgatgaggttttaggagccgaggttaggtagatggttgcgttttggcaacagatattcgtgttggcttccagtggcagtggaagcaaagaagtctgcagtccaaaacgttagctgcgttcaagtatctgcggtgtttgtttaaaatggcctcgtcagggactcatcggcaattttgcttctgcagttgtggaagacctcatggcacattagagaaacccaaacttcccctgctctaaaatgattttccattgcgaggttcttggaatgtatatgtgtgtgatttgtatgtttgtgtgtactgacttcaatgagaggcagtgagctaacagcaagagcactggaggggagttaggagatctggtttcctgcctggccaaagttagtggctacttagtggcaaaagcaaatcatttcacccctctgggcttcagtggcctgatctataaactaggggcattggattggtattgatatccaaacccttttccagattctgtactctgctgtaattgctcctcacaagaaggtgacttccttggctgacactctgagcagctaccacggcttcgtggaactttgatgacttgaaggagtcagtccatgcacctcctcatgatccttgggatctgggaattgtggagattgtctcatagctcttcttcaccccacccccttttttaaaaatgtgaggtaactgaaactacagttaagcaacactgccatttttttttcttttttgacagaaagtctcactctgtcgcttaggctggagtgcagtggcacgatctcagctcactgcaacctctgccttctgggttcaagcgattctcctgcctcagcctcccgagtagct

SEQ ID NO: 127889 - DNA, 1027 bp, Homo sapiens
ggcctactgtttttcacagcgatgtagccatggacttcgatggataattgataaggtcacctggcaagttctggtttagagggtaaagcatgtggcagataatcaagaatattttcctcaatcaatctcatcaatgagataattagtagcaattatgcctgaaccttggtttttgcctaagagtgcagctgtaaattttcatgcattccccacgtgttctaatgaaatctggaggaagcatatctgacataattagtcactctccaagttaccctgagagcaccccatctccttcagttaatgcaaccccctgctgtcctttatcaggccttggtgacctccttgaggcctgcagatccaaccagggcagttgaataggcttcactctgtgtcctcccagaggccctccagatctaagtgggcttatttgcagttgatatcctcatacctcattcctgtagagtggggagaaacaaggggaaactgttgctgataaagtggtgaagaggaaaatctcaggtcgactccatgattcactttaaatgaggtggggcagcagcctgaacacaggggcccagcccaatacctcatctgttcccccttcctgtaagataataacagtacgggtgatgcatgaatgagcaacgtatgacttacaaaacatgtaatgctcactacaccatttgaggcaggtttgattattcagcttatggtacagaggaagaaactcaggcgtagacagattaagtgactcacctgtttcccattccatcgtgtttgctaagtgtctcagtctgctcaaaagacaatagactgggtagctgaaacaacagaaatgttattacagttctggcgggtggaagtctgagatcagggtgcccgcatggtcgggctctggtgagggcccgctattggcttgcagacagccaccttctgtgctgtgtccttacatggcaggggtggggaggggaaaagagtttcttcttataagggcactgatcccatcacgagggcgtcaccatcctga

SEQ ID NO: 127890 - DNA, 1041 bp, Homo sapiens
gattacaggcgtgagccaccgcgcctggccaagtgtcctatttcaactgaataatcaggactgaaaaggcctgtggggctagccttcttgtaagttctgtgaaaagcacaaactaatcagaagttagggttcaaggaatttataccctaattaaacatgcaaagaaaagagagaaacacaattcagaaataaaatcatgctcatgtctttagactaaggtgggggcagaaataaacttgagtttggtttcacccctgcaaatgggcttccctctcagatcctaatgagtgactacctgagacagataggttgtaaaacctaacagatagcttatgaactaaaggccaagtaaatttgattgttggttaagcagtatttaatgatggacttttctagattagaaacaagaatgccaatcttgcaataagacttcagaagatcttagcacttcctaccatgttaaatacttagaagggaaaagtgagaggtaatagccactgttttgggcataagagctaacagctgcttcatccagggtgggcagcagctgtaattctcaactgtggatggctgcctccttggtatggctttagaggtgtatcccctaaagatcttccttacttatgtgctcacttctgaaattcacataaaggaatgcatcaccattcatttcaaaagaagacatcaagtttaaaaggcaatcgctagaggaagaaaatattgactatgtgaaactccagattttaactaatctctggaattattcatgatttttgcataattctggtaatttctttttctggagtgatgccaggcgatatgtctccctttctattatccttggaatatctcaaatgtggagcaagaactcttgccacaaagcgactccaatgtctcatgcttacttgcatacagtttggctgcatccagccctggcctgggtccttttcatctaccatcttccctgctggctgagccctaccttgccctagctctgtacctgcctctggttctgcagaaaggtcatgctcaccaccaggg

SEQ ID NO: 127891 - DNA, 1870 bp, Homo sapiens
ggagtttaaaattgtaatctcttctgtctttccttttggttttgctttctaaatttgtttgacgaccttattctttccacacaaactcaccattttccctcttttttcttttctctccttaggtattccagcgtcttcaggaaacagtttagactctcttcaagatgacaatcctccacactggctaaaatcccttcaggccctcacagagatggacggccccagcgctgctccatcacagacccaccacagcgcccccttcagcacacagatcccgctgcacagagccagttggaatccctaccctcctccttcaaacccttccagcttccactccccacccccaggctttcagacagccttcagaccccccagcaaaacccccacagatttactacagagttcaacactggaccgccattaggcaaagaggagcaaccattagaaaatgcaggatttgtcccactctgttttctccctctcagcccaccacccacagctcccttctcatctcttatgttctgaagaatccagtacctgatcaattttttttctccctaaccccagatgcaatgcgatcacagggtcattaccatctctttattaattgtaaaaatttttgttgatccagcatttgagtgacactgttgaatgtttctaaaaatgcctttttaaggagagaaaaaaaaatcaaagggcagtctcaatacttagaaaattattgtttgtctgttgcgcataataatgacataatctgcttagcagaaaatgacgattaatctataggaaagctcaagtaaatgcattatcaactgcagaagtttgaaaaccaggttcatttacgtgagattgctaaatgcatgggggaaagcagtggtcctagcatccatcttgtattcagcttatcattattgcagggaaaatgcttttaatttaaattaatttttaattcttttggcaagttgatggcaaggacttgattgtgtcattaagcaaaagaatgtattggaagttgatggaaagacaaattcatctgtagtagtaactggccgattgctaaagagttcataaggaggtgagaagtaatttttttaaaggagaaaaattttttggctttagatttaaagtaaattgaaatgttttaaagaaaaaagtattcacagatttaatacctattaataatataagagctgaaatgtaagtcatttcttcagtccttctcctctgtcggaatcttttttgttttaccataaattcacctgacgagggcactctgagatagcactgctctggggccatctgatcaccatcgggagcaaatctctgacctccttgcctgcagcttttacttaaccctgtagtttctggacgtttgtgcagtattgaaaagacaggagaaaagaaaacagaaacctggttataacctgacgctaaaactaaaaacaaggaaatgtacctctttcttcagaattaaaactaaaatcttaaataaaacagaaaacttgatggtgacacttgggttgtccttgtttttgtttttctgttttgttggatgtgagtttgaaaggttttgtgacaagtagccatcagatgtttccatttgattttacatcttcaacagtggggagggaggatggtttagaagaagaaagtggaggagaaacaaccattttattgacagtcaatggcatccttgacgttcagcccatcttgtcctcaagaatccctcttccagtgcctttcagtagaagattcctctttctgctattgtattatgcatgccaagccttcccaactgagaagccttatgtgccagtaatggagaggttattgacatgttgagatgttggttctctttagggagacctgg

SEQ ID NO: 127892 - DNA, 2003 bp, Homo sapiens
ggggaggaggggtgtcaagattgttgcattataaactagctaatttatttcccaaggtatcctgtaatcatagtgcacctgggaggatctaaatttctcactgtttctgcatcatgcgccatatgtgaatttctttggctaacatacccttgcttgatttgattagtctacaattacaggaacaaatgtcccttaaaacaaacttttttttagagtagttttaggttcacagcaaaactgagtgggaagtacggagaattgtcatataacccctctgcctttattgtcttttgactttattactaattttcaaataagatttatgtaaatgcaagtgttattctgttaatgcaaaattaaatgttcctcaatttcattgctcactaaatggtaaagcaaaagttaggagcagattgttctgagttatgggatattctctctctccctattcagtagaagagggaggatcatttgcatggacttcttagggacattagccactcggtgtaagatcatttatcttcctgaaaatgttcccatgtagttatacatcatctttttatttctgggggattttatttttcttataggaagttttccctgtttggcttttgcctaattggaagctattttaagttattcagcatgacagttggactgctttaaaagttagagtgtaccatagccgtaaaccttactgtgattgagagtgttctaggacttatatttatgatcttgtttgtgtctcatgtagttagggagccagggggaaactagtgattgtattcttgagcagaatttttttctcctggccgcaaagtccagtttcttcctttagtcacaatatctctctgctaatcatggccagtggacacactataatgcttctctgtttctcttttgcctcctttcaatcatgggtcttcccctgggctttccctttaatatttgaccctttaaaaaattaatagtctgtacagagtagatcgagagagtaagcttgcttgcttttttttggacagggttcaggttcaagttctcaataacaagttttgtgaacttggggaaattattcctgagtctgtttctttatctagtaaatgcagattatccttgtctgcctgcctctcagggctgttgtgaagatcacatgaaataattgactatgagagtgccttgtaaaccatacaacacatacaaatgtaaaataatatgcaaatataagaaatgtgaggtttagtaaattacatcaattatgaaatgaaagtagggttggagaatttattttcccttctgttgtcttgttttgtgtagcctagagtgctttttcttcatcttaataagttcagagatgaccttcgttcagtttagttgtagtattttatctttttataaataaggtcaatggagttaaatgcttcacttgttgaaacatgatataatttggcattgatcagtggttggtgcaaagcaaaatttcaaaaagaaaattctgattttgctaagcagcatagatcgtgcctgttagaacatcctcctcctccttctcagcgttgattgccaatcagttctgtagaatcagaaatatttttctatgcttttttcaaaaactccagtttgtaatttgacttacattgctattttcaaaaataaaacaactatctaagtatttgttaaacaattaggtagttgttatacttcacccttttccccctgaccagttagttatactatgtggattctggatggtagtagatcaagttagtttagtcacaatttataaaaagccttttctatgttgctagtgtcttctcatgtttgatactattcataaatagacccagaaaactgtaggactccgggactcaggctgtgaatgattggtagaactgttggagtagagcaggcagactgtgttggaaattattccatctagaaggtatcagctcctgcctcctcggccttagtgactaaatggaaatacattcttttcaaattcaaaa

SEQ ID NO: 127893 - DNA, 1829 bp, Homo sapiens
aaggaatagtggctgaagtagaaaaatgggtagaatatatcttagagacttttgtttaatatcctgcacacataatagtggagtatttgtttttaataaaacattccttctttaaacagttttgatgcgttggactttttaaaagtatatttgcttgtgttttggcatctgaaatgctattaaaaacatatcatcttagtggctcatttccttcagtttacatgcagagaagcctcttggaccccaaaacttaacttactcctcctgcattcagaaagctttgcatctttttggagagaaccatctgttcacagcattatacagataggaattaaacagattttgttggggaaagtcactttccagctcttctcaagtcagaccctcaagtctgcagatatcttgatgcatgtaacatttctaagacactgagctacatgctgaagaatgtacaggatgtccccatcaggcttttcagcggagttgtgagaggtgaagtatgagtacatggaaaggtggacagtaactgcagtcgatggcacggcatggtgtgctgccagatgaatggttcagaccctaagtgctggccggtggaagagaagagacttcgacttttggaagattgaataaaaactacttgaagacaacaagaaagcattctagacaaggagaatggagggaatagagtttagaaagcacaagtcatatgtagcgtgtctggatttttctgtttatgtcatttctactagtataaacaaatattgccttttttgttgttgttgttttgactgttactttgttcaggttgtttctgctcagaactctttttttatttgggttcttaagattttccacttaatccaaattctactttcagatctattaaacccttaagattttgtctgtgacctagtggagtattggtgtgtcttgcattataataaacatagttgtagaaatttgagtgtaaactatttaactagaataacatttttcataaactgattttataatgtctgtaacaattcatttactaagaagtcattttctctgcatattttagttaataaattggaatgatttttgtgactgccctgatgtacagtacacttatattatgaaggctttcttttaaatttcaatatgacaaattttgtctgctctttgaagtttagttcagcataaatcatttgtatttgagtcacttagagattcattgttgaggtttgaggaagtttagactttgttcaaaccaagactttgttcaaatgaagatgcactccatcccaaaactggtaggagatcacttataagagggaggggtgtgggggcaggagctaagacaggttattccctatgtccttctaaaaatgcacaaaggtttgaaagtctaaatggcaaagagttaatcatagtaggaaccaggtttctgatgtgtagccacttgcaccaagaaagatttgtttaagtaacctaaccactggagcctgtggttttgaactataaaggacaagagtgaagatggaagacaaaagctttttagaaaaacaaaatcaggttgtattgagccttttggtaatgaccattaaatatggctcaaaaactgaagtgcagaatgaacacttttaggtgtattttgtgactgggtctctcagtgactgcttcccggtaagggtgtatttattatttaatgagaagaccttgaggagggggtaccaaaaataaagtagaggcaggaattccaagacggcacaatatcctgatttggtggcacaaaaatatattcgtggaaacaaatctactggaattgtcttgtttgggggcttgtt

SEQ ID NO: 127894 - DNA, 1148 bp, Homo sapiens
ggctgagcgacgcagcgagactccgtctccaaaaaaaaaaaaaaaaaacatggtagcaaacgttcagggttatatgtttgggaaacatacagtacctactgaagttcaggttcaggcattgtctactacatagaaatgattaaatcgaggtccttttcctagaggagctcaaagtctagttgtaaaaagtgaacatgtaaacaaatgattgcaatacactgtggtatttgcaaaatagcgaggatgcctgccatctaagaactcaagtataattattcccattccctgcttttgtaaatcctaaaattatgtcacgtcctcctagggtttctgttatttttgcagtagccaaccagttcttcgttggtcagaattaagtccagaataaaagttttcttccttattttcaccttggaaaagagagatcgtcagcaaggaatgttttatcaggtttattttcttctagcagatttagacttcagagatgttagggtggttgacaccttccatgtctctgcaattttgtcatttgttttggggaagtcatattgggtgaatattctggtgatctgtgtattgtctccttattttacattcccttgaccatctttggatctcctcacagggctttgttcatggtcactgctcagttttgtgctcacttaaatgcttccctccaggctgctgctttgacattgtaaagatcttttatatgaatcttttttgtcccttgccctcatttagcgttgcttacatattgtggttcgggtctcatctgatccagtctgtgatgcttctaagggtgtatgtatcttttatattcaaatttgtttactttttcctctttttttatataactttgcacatgagtattttttattttttcttagattctgattccttagatccttcataaagcagccatctagattcttctggttctcattaatctgattctccttcaaaacagatttatagatccttataggaacattctagaagagaataatatacattatgccaaacacatctacttatattttgaaatgttcccactgtatttttttatttgctgcctgtggcctgtgtgtccctgtgttctctatgggatgccctttccctcttccacatcagctgcttttcctctg

SEQ ID NO: 127895 - DNA, 1575 bp, Homo sapiens
actgtaaggaggaataaaaagcaaaatagtctttttaaaacatagactttaatttttagagctattttaggttcacagcaaaattgagtggaaggtacaaagacttctcattatattccctgccccatcacatgcacagtgttctccattatcagcacccccaaccagggtggaacatatgttacagtggatgaagccaattgatgatctgggtggtgaataggtggaacacagaggagtttcagggtcatttttagaaagtacagattagttttaaaactaatgtagctttttcagattgtcttcttccacttagtaatgtgtgtttaagtttccccagccttaatttttaatcacacattttacatagctaaaatcattgagtttcagagtatcaatgcttattttaaaaaacagacatttattttaaaaacaatctgaaaaccttaataaatgtctcttaatgagaaagaactcttaaagatgtatgcttggtctgttgtattggaaatgtttatcaccataactatatccatctccatttcatttagttttataaaataatgaagttatatcattttctgaaataatttttcttctgaaatgaaagtaaatactcttaatgcctaaaaaatactttctaaaaatgaagctcataaccagattatgaagaatctgtcaattaaaatgatgtttcagaaaagtgggaattttattcttatttgggatttttgttatgttgatttaaatgcttaagacaattcgatgctgataggagccatcttttagaaaaagataagactgactgatctttactattgaaataaagtgtgctgtgtaatcaaatgcagtaaagaactgggtttgatgttttaaataacttttagataacttggaagtcttttaatttggaaaattatgaacatcagcaatcttaggaatttcaataggtatataaccataaagggatttgctgtataggaagcacaatactttcatctgaatgtaaacctgaagagagacttctgccccaataaaaatattttattgctactaaacaatcaaaagctattactgacttcatttggaatggccagtcccgagtgatctgctaagaaataagcagaacttcacttgactagccttaaaaaaataaaaattaaaattaaaaaaaagcagaacagcatggtttttaggaggctgttagagaatgtcatagcatcaagctccagagaaaatggtacagagtagacatgcaataaatgtttgtggaaggaaaattgatggttgagagtggtgtcaattcggaggcctgcaaagcatggatgtgttttgtgttaatctggacttttggaagcatttagtcagattcatttgcatatgagttataattcattttttggttcttttctggcattgtggtgttcattgttaagattttcccccctacacgtcacccactgactatgtgattaatttttcttctttcttttttttttttcctctgaacttgggaaacctcagctcttggcttttccttatttttccaacaccccctgtacacacatacacaca

SEQ ID NO: 127896 - DNA, 1765 bp, Homo sapiens
taggggattggttccacagattgcaaaattcttggattctcaagtcctcgatataagacagtgtagtatttgcatatgacctgcacatatatgggaggccgtatattttaaataatctctagattacttctaatacctattacaatgtaagtgctatgtaaatagttgttatattgtttagagactgacgaaaactgcatgcttaataaattacacaattttttaaaaaaattttctattcgatgttggttgaatccacaaatgtgaaaaccccaggtacctggagtcaactgtgtggttttttttttttctcctagtcagttaataataaatattcctagttgggaagcaaccttagttttctaataaagtatttttaaactcactccgtatatgtcagctgaaatatcaactgtgacatttaaaaaggataatgcttctaagtacaaatcattgctcaagaatactatgtttgtgaaaccttgttgatggattgagaagccactgctccttggacctccttatcaccctgtgatttgcttctgtgagttgtaatcgagccacctaacattgctggtcatactagccttccacttcttagtcaggggctatttccaaagaatcactcttgataatttgagatgcattaagaagattctactctgttttttggtcttttagagagtcttctctgggtttgagttatagagaaatcgagtttaggtacctagaactgagagcaagcctaagtaatctaagctacttgagaaatggactgaagtacccagatgttccataaaacagcttgaagttgttgaccttgagaaccatttccttttctccaggttcctcttgaccacacttcctaaggcaactattgacttcactgtcttagcccactttacctttattctaagagttcctggaagctccaagctgaccctggaacatactgtgcttataacaattttgttattccagctcctgttgggtgctcagacccactattgtgctgttacaaagcaacatcccaaaatgctttttcccctcatataatttataaagcctttaatgcatccattacctttctttcttttttatagcgggtgaaattcacataacgttcaattaattattttaaagtgtatgatgcagtgacccagtaccattctttaattatctcaatggtaaaatagcagaataagtaacctactctgctgtaagaattttagtctgtttcttgttggggctgtgtggtaatagctgcttctagactctgtgttttacccagtaggctgaaaggcaaatgttaaacctttaaatattccgtatttctgcatagcagtactactgcaacttaagcttgtgaatcaagcaacttgtatacacccttttaaaaaggcagtggggggcagtgcaaggagctctaggcaagagacacttaggagatttgcttttctgagtggtaaaaatgtttgaagcaactctaaatagctttgaaatgttagtaatagtcttactgtcttcatgacatttaattagccttctgtaagagtttgtttagcaaaggtaaaccataagcctagccctctatatgcatgtgtggttgaatgtgtgtgtgtttttatataaagcaattttcagttaaatcttccacttaatgaatgtagtagaggaagatgtctcatgtcattttggtgaccttgacctatgtctattcatgtatttattcctgctgtgttccaattcatatcttcaggataaa

SEQ ID NO: 127897 - DNA, 1068 bp, Homo sapiens
cttttaaaggagattaaaaaaaaaagtcttttgtgagaataagcccagaaatgcattgtaaatagttgcttagttgctgtgtaaagataagagtcagcttaaagatctctaaagttgaaatatatgtggttttgtatgttcctctggtttagcacaaagcataggagtggaaaaagcaaatattgagtgtttggttaaaaggggaaaaagacaaagacatagagacattcaagaagaccacattgaaatgtataatcttgtgccaagaagagtctattaaggcagtttcctgtgaagaaatggtgtgagtgatgtggaagggagttgaatgattttagattttgatgatgacaaagaacatgttagtgttgctaagggaatgataactaggagactgtggtcactgtgataaccactcaatgctaaatgatgattgagaaccagagaaaggagagggttggagtttggaaagaagcttgtcttttgtaaccgtctatatactctctcctccagtcttttcatgagtgtaggaagtcaaactatgtgagagagaattgtagaaagcatggaagcaattccatgcatccgcagatgggcacctggggaatcctgggtcaggtttccggtgagttgaaaatgatcaaaggaaaacttccttcctcaaagcatcgtaggaggacatggaagcagagtgctggggaggaccaggaaaagccagggatgagatgagacagctataagtaagcagccccagtgagtgtgaaggattggtagaaatgttactgatgatgtgaaagatttagacagagggattaggtatggtgtatgatgagtttggtagttgaggagcccttattacaggtaatatagcttctcccaagctcacttgcaaactggaaggcttttttaaaaatgggcttccacctatgaagggaaagcatctgctcttacatagttggattaggtcattctgctttatttatatatcaaataagaattaaggtactggtgaacagtagagataaagtaagaattttattgtaacaggttataaaaatattttgataa

SEQ ID NO: 127898 - DNA, 2032 bp, Homo sapiens
catgtgtagaaactgttttgttctctctcttttgcacttttgcactttctttttgaatggttgttaattatgcatagatggttaaaagataattattgtagcctaaatgcaatataatctcttttctaatgcactgcctagtataccaggaaatgcctcaaaaacagaacttcagtttatagttgacttatctgaaacttgaatacggagtaaacattgtatgtgaaaagcaaccatagtagtgtaacattgttactgaacaaacagtaattctgtgggatattgttttggaaatttcattgtttaataattaaaatgtgataataagataatattataagtacctgaccagaatgagactaaggcagaagagaagagattggatgtcctctaaaattaggccacctaaattgtaacagataattttaatcaagagaatagtggagtactttattaggacataatgtgaagtgatatttctgaaaacacatttcttgaaatagttttaaaactgataataaaggaaaagaaactgtacttagtttggagcagtggacaaaagctgattcagaaaacatgaccatattctgcctacatgaagcatctgggaagaaagggaaagtcacacctcctcttgagattttaaccattatgataaaaggtatgctttaatttgttaaaaaaaaaagtatgaaaggggataatgtgaatacaaaaaagaagcctagagattgaaaataataataatagaacatgttattaggagatggtacttaatgtcatgttggagttggagttttcaaggttacctctatataaaattggattattttctgttagatataatgtgacaaattaaatgactttatcccaaggtacagtgaggtaaacaaaaatctattcttagatatccttagatttggttaactgaggctgtagaagcagcgaattgtctagccatttaagttatttttgtaaaattcagcataaacatcaatctctaatttctatctagaagtgactttaagacattacaagaacattgccaatttggaaaatgccaataaaatactgtagacttattaatattgtagacttattatcagtcttttactatagcttaatttaattatggttttcatttttactgtaagaggccaagacttcacttatgtctcctgtggagctgaggctcctgggccttgttattataacaaactctggctccttgtaatgatgcttactagctcaaagccttctccagcattcagtgttagcctttcattgcctggatcttcttacaaagccatagcaagtggttagtgccatttgctccttggtgttgagagatatacctgttaaatgaggcttctttcctttctcattcatagccagcgtggaaaaatcatcaggtagtttgcccagatttgccagagccctaaataaaatggcaaaacgatctccctgcctgcttctcctccccacccccacttacatgcacaccgtaaatcaagaaatgctttttgggcaattagactttatcttctaaatttttgcatagaatggctaaacatgatcttttgcctcactttgtaattcctacaccttccttgtaagcttcaccttttgcttacctaatattttatttaaacatggttttttaaaaaacctgaagctttaaaatcatagtcataattaattttacactaaaggacagaagaaattatacaacacataaaagaagccactacttcacatagcaagcaaattgaaatcaaaatgacagaagaatgagaaattctttaaaagcttcaggttttttttgttgttgttgttaaattcctgcatgatgcatcatgtgcaagggaaacttaatatacttttacacccttaacctttataaagtgactagcttttcccttaacataggaatttttaacctggagcccagatttttgagagtacacacaaaattgtgggtttgtgtgcatgtacatatgtccatttttttctagggagaagatccatagtt

SEQ ID NO: 127899 - DNA, 1772 bp, Homo sapiens
ttggtttgttcagtgaattattaaagattgatatatctgaaacctatcatgggaaaaacagttgccagaggtttgacagaaatgcagcttcctttttttttgatctaattgaaaactgtttttgtgtttaaaattagtagttatttccttaattaggtgaaacctttttagcagcatttggtttactaagtttagaaatatttttgacataaatattcttgggggaaattttgattcgtgggcagttacagtaaattcattcagatctttttttttattattattggaaccatatgccttctttctacaaagtgatttaccttgtcctaaaacgtgactttgttttgtccaattccttcattttaggaatagcaaagctgtgttccagaaagcttaaataatttgttaaaggtcacatattcaattagtagtggaattagggtaagaacttagatctcaaattcaacaatggaaatgtttttgcactacaacgatgccctccttcataaatgaagatcactggcatgtgctttaacttggctttcttcccgtggcaattgtttttgctctcacacacttggaagtccctttttatcaacagtatcaactcatgagacaaattggcccagctcaggggtatatggcctattgttacaaaatagaataaagtgtatcgacttgatagaaatcagtctgtttcttagtccttattaatatcattttcttgctaagaactctagtctaaaatttgctttacagagcctcattgctatgttcttggggtttataagaatctttgccaatttactgaaaaactacaaaatcacctgttatatggattgacagactctttttctgctttgtcagttatccttccacatgtaattttgcagatttgttttaaaaaaatattctgccaagttgtttttattccatgatgttaaaaattatttggaaaacataagtcagtaagcattgttgtttcaagatatacctcaaaaaatatttgaaactgtttaggattggatttttttttcatgtttttgttaatttaaactttacttttgagagggcatttttctttaaattttctttgtttctatatgaactgttttaacagtgacttgattgaattttgagtcatgtgtgaaacaagtcacttgtagtcaaataattttcagttataatcaggagaaccgatctcattcatctataattctctgacctagaagtagtcatctcattttcagtcaattggatcattgtactgttaacattttactatttttcaattacttcaaaggtaaacttgaattttcagatgctgtatgttaatttactagttaatatttatagctttcatttttttctagtacataatttatgctttcaaaacatggatttgtaatttttctcttttaaaaatcagttttcacttctgtaaatcaaggtttaattttttcacaaaatactattaatatttaccatttactaggagtatctataagggtccaattggcttggaaaagaatggctttcctggtctttttttttttttttttttttggtagtatgtttataatctaaatctattgtatttgttcttatctctgaaacaatattactcaggatatatttagaatataactactttccaagtacttgataagtttatattttaaaattcatgtcttgtttcacacctggattccaaacattaagcatgtattttatatatgtatcagtattccaaatattgaaatcatttttaa

SEQ ID NO: 127900 - DNA, 1384 bp, Homo sapiens
atttgatggaagtgacttaggttggttttgattatgaatggttgagagtataattggagtgtcaagtacatttttttcctttgattagcaaaatcagtctatatcattcagtttttgaagctagtagcttaagagttaagtaactgctagaagtacataaggccttttgtaattatatgatcttaatgtgctaagaagtcacatagattttgcacttacttaatttgtaaaatgacatgtttaactttcagtagcatggatacttattaagtatgaaaatgagctatgtatctgatattcatcactatttttcttcccaacagaaacaatcccagtatcatcctctacagactggcaagcagcttttggctttggttcttctaaacaaccagaggatgacttgggttttgatcccttcgatgtcactcgaaaagccttagcagacctgattgagaaggaactgtccgttcaagaccaaccttccctttcgcccacatctcttcagaactcctcttcacacactacaaccgccaaaggtccaggctctggattcctgcatcctgctgcagctacaaatgccaattctctcaatagtaccttttcagtcttgccccagaggttccctcaatttcagcagcaccgagcggtttataattcattcagttttccaggccaggcagcccgctatccttggatggcctttccacgcaatagcatcatgcacttgaaccacacagcaaaccccacctcaaatagtaatttcttggacttgaatctcccgccacagcacaacacaggtctgggagggatccctgtagcaggtaggttcatttaaaacctttgagaatttttgaataactcatattttcaggttgttgggtggatagggaagtaactgttgaataacagagtactaatatcttggaaatgtctatgaaagattagtctttatcataatctaaaatatatttttcattagatggatgccttgtaatattgagctttataaggatggtggagtattatacttagttattgtttggaagcattttacttaataggataattaccaaactttcatatggtatacaaatgcaaaatgaaaaagaagaaaatggtctctgaagttatggtactataaagtccaacaccgtggtgaaaattatgattttatattctaaagtaaaatggttaaaaaaaatttttttaatgataattaatgagagcatgagggataaagccactctctacctacttttggcagttacttgttttgactgatacacatatacacacacatcaaaactgagctataaatatacttgagaactctgattatgaatgttttacaagcatatcatatgtctcagacatacaccttttg

SEQ ID NO: 127901 - DNA, 1045 bp, Homo sapiens
aatttttttcctataacacagtatcagaacaatacatttgagtaacgatagtcatgtaccacatatcaatgttttgttttggtcaacaatggctggaccacatatacaatggtggttctatataattagaaataacttttttactgtaccttttctatttttagatatatttagatacacaaatgcttacccttatgttacattgcctacagtattcaaaacagtaacatgctgtacaggtttgcagcgtaggagcactaggcactatatagcctcagtgtgtagtaaaccatgccatctaggtttatgtgagtgcacactttaatgtttccacaatgacaaaatcacctatcaatgcatgtctcaaaatgtatcccatcattaagcaacccatgactatttttgttcatgtgctgagttaaataaagttagttataggaatgatatcagtacactgttgcagtgcttatagagattttattttgtctttaagtcagtcaagataaaatggatttgaagtcagtgatttactttaccatggtactacattttctctatgtgaaaataaaatgttaatgtttttgtttgaatcagtagtttgcccaaaaatgtttcttttgtctcatttctcatgccttctctagggttatgattagtatatagaaatattaaaagaaatatattgctcttaaaaacctatggagaatatttcaataacttttatgccctctgtcaaacacccagaaaaatgtcagtattatttcaaaaactgaaatggggaatatgtttatcacatgcacaaaaataaatggtaggttagacttttgatctattaattgtaagcagtgccttttttccccctataagctattattttacccattatttttggagaatctaattacaatgtaagttccttaagggtagagattttatacaggttgagtatccctagttgaaaactcttgggaacagaagtgttttggatttcagatttttttttcttttggattttgggatacttgcattatacttattgggcgaa

SEQ ID NO: 127902 - DNA, 1054 bp, Homo sapiens
cgtagtgctacacccagcttcttgttctgttaatagctaattatgccacttagatgtggccatgttttagtagcaaagtaatactttacatgttaatgtatatttgaagcctgtgtcaaagtatattctgtaaaggcaagttttacctgttgataacttaaatatatcctttgtgttagcaagtgtttaaaaatatctcagaattacttagggactctggtaaatggcaaaattaagatagattctttgaaatgaatatatgtgggagtatttaatttagaagcaaaatgaatatgtatttgtatatatggtaacatgacagtgaaatttggaaatgtctgttatgttgacttttatccttatgtaaattttatgtttaaaatgtaagtaaattttatattttgtttaaaatgtaagtaaaaatcagtaagtcactttgactatttttcttttgaatttggtaagcagaaaaactaaaccttctaacttttttttagtccacccccatccttgaaaatgttttttctttgattcttctactatgtaattggtttatgttgcaaatttttttaaagtaatcatgagactatatttagtgatttggttggcatcgccattaaggaagtagtaaaagaaagtaaaattcaagcattgcctttggagcaagttagaagaaatcaaaacttggctgaacatctacaaatccaaactgagacccagctgtgtcagtgactacctgtttgcagacagttttgaatttgatttctttatctgtaaaacaaagtaattaaatttgattttagtgatttcttctacttgtgaaatctaataatttgagagactttgaggagtcttgatgccttttcattgtgttcctcttctctttgtttcagtgatcatcaaataccagatgcctcaatttagactaattgaatagaattttcatgatggagtctggatatatactttttactttaaataaataaatatgtatatattttgtgcatatatgtattttaaaaagctctgttgcccttttgggttaatttacaaa

SEQ ID NO: 127903 - DNA, 2451 bp, Homo sapiens
aactcaaaatttagtgccataggaaatatttataggtccaatagaaacaagcaagtggcctctcagaacagggaacgatgcattgtgcagtatatatgacacaattatgctcagttaagtgcaattgccctcacttgttattgttttgatttgttccgttttggttttgttgtataacatctatttagaccataatttaaaaaaattaacatccctgaaggtaagtaaaactattcttccagtctagatatacatgcaaatagtaaaatgttactcaaagtaagttcattatcatttatttttgtgtctaattagcttccacaggcaatctttgcctaatttttcccataatatttgtgacattgccttttgatgtacacctacccagctagagtaagcatagcattcttttgtgtatagagcagaggttggcaaactttttctgtaaaggccagttagtaaatattttagggtttctgagctatgtatgtagtcttctgtcacaactactttactctgcctctgttgcactactacatcctgcctttgtagcagaatggcagccaaatacaatatgtaaatgaatgggcatgaccatgttccagtaaaactttatttataaaaacaggcaactggctgtaaattgctgaccctgggtctagagtttaaaatacattaatttttattttacttttgataaccatagaagaaaagagaaagcaaaaactaattcatggaagttttacttagtgtcaagataatgaagaatatagtaaaactgttcatctatgtattacttcaagtgctaatctccaaattaaaaaggagactgatgaattttggctgattttcagaaaactcagtgttacaagacttaattcttacatgaaagacttggaagtaggtttaaagtggaccttacactttttgagctagcaaaaatgttcttcccttaatatgcttttctgtacaataaatgggttgatgaaatgccttaatttaatttatcagatatatatcatataattttgttggaatgactttcattgatctagaagttttgtgatatcctcacaggtttctcttacttgttttatttaaaaatttatttaaaatttatttaatattttattttttaaaaatattatttattttatttaaaatatatttaataattcagaagattattcagtattttataccagccattttgtgaatcccactgcagttttaatttcttctttcgttaggcgggtaaacaccaagaatatgaacagaagctacttcaagaattatataaattaaatcccaattttcttcagctatctacgggttcagttgataaaaataagaacaaagtgacaccactgcagaggtatgatacgtaagtattgatattgatagtcagacatcttaccttcttatcagttgatcttctcttttcattttagatctttttcaggcaaaatccttgttgacaaggtctgtcatttatgcagaattgtttagctgtatgggaaatgttgagtcacaatttctgggtttgaatgcttgctgcctacttttccctggtaacacttcagactagctttttgatgggttcaccttttgtggtgatttgcagactactctgagcccagggaatactttccttattaaagagaaaattaagggattttaggttttaaaaggctctgattacctaattgaggtcccccttgatataattagggggaaaatactataaaagggaaagtgggtgttatctgaaggaagccttgtgtgttggggacacagatattcaaggatatctagttccaggaatcactaaagtcatttaaatcctgtaaatgaacagggagtatcccatattcagaatcttacttatcttaggagaccagtcatctcctatcttccatctcattatggttttgggtaaactatattgtgtcaatgcttaaataaatttatggtcttcagtagagagtctcattctgatatgttgatcttcttatcttagattatattttgttatggcctgtcagaaaatcatattaataaatataatttgggaattttattctatcctgaactttctttaaatttgatgtgttaggttttttgttcttttttatttgataagtttaacttttatcaaatgaattttaaaagtaaatgttgtaattaatttatgttgatgatctttttttaaaattccaaagttaaatttgtttgaatgttgtcctaatgtctaggtgttaaatattatagcccagtgtctgtttggtgctaaaatgatgtaagaactattttcaaacatagctaataataactacatggattattgtttgagtccatttcttcaaaaacacattctttaaattttgaagtctgtgtttattcattttaagagtaaagattatttaaattattaaaaactaaattagacac

SEQ ID NO: 127904 - DNA, 1828 bp, Homo sapiens
ctttgtaattacgtataatatgaaatttgtttctggctcaataaacagcttcaggcatgtcttgcagggcattcagaaattgtgcgggacaattctttgttgtacggggctagcctgagccttgaaagacatctctggtccccatccactgaacaccagtagactctcccagtcactttaacagtctctcccaataaaagtttccacaaatttccagactgccccttgagtgcttccctcattgagaactactgccttaaacctatgatgctgatgcaggacaacctgtgaccggcctgactgaaccctttggagcaggtatcttagctatgacgctggttgctgagttggtatgcatccagctggaatattgaatgcagttccaaactccactagccagaaagctttttcaaactctgctcttctctctttatcaaccctgagactttgctacggatgacttaagggtcattgtgttagccactgttactatcatatccctcaggggttttgggtggaaaagagattgaaactcagtgtaattacctcaccttctaatccattagaattggctacagcaaacataacagttaccttatacttacaagcacctaaaataaaatataagattaattactttctattaattaggtagaagactaagaattaatgatacacccgccgtagatttattcatgaagctttgattctatcaaatgcagaacataatagctaaattataagtctgtaagaatattatcaaatatgaatgggaagaaatactttacacacacttgaatagttacatgcagaaagctttcatttgcagagagcttgctatttggagagattgtaggaacagtaggtctaaagatacattctaggaaaacagaattttgaggtagttgcaaattatgtgagatgtctttttatcaagttacataccggtcaaattagccaaggttaagtttgtaagagaagctgaaagaatgcatatagtgttcacaaagtaaaggagatgaggtacgtaggtaccaccaagaagtaaccaggtaataaagaaagaaacgtgtaaatttgtttccgaaatgttacgtaccaggaaaagtaggggaaaaagcctcatgagacagatgagaaatggtaaaactgattgacataggaaactgtatgcacaatgataaatcataaagcatagagggttgagtgggcactctgttacttgaaatttgtgatttataaacagtgttatatgcaatagatttatgagtaaagactgtctttatgtctgttctttcaattctgtctttacctttaatacataattttggtcattgtttttgaagaattgctttcgtgtaaggatcatctcttaatggcaatgtagttaagatctttgatctgttttgtgtttaagaatactgtacaggtaagatcccatagactattggagcagttattagaacatagtagataataccaaatttagtgagtctcagtttctattcagtgggtcaagaaaaaaaatagcttttaaactcttttgatttcctataggttagctacacaaactgcaattaggaggtagtgacatttattagaaaactttaaaaattatctttttccttttgctgaagagggatgatgaatgtctccattataaggataaagttgtttaaaatggggacagtttataccttatttcttcttcttttataggttttaaaacgaccagaatattttgggaagtttggtaaaatacataaagttgtcatcaataatagcacatcatatgcaggctcacaggtaactaattttagggattttt

SEQ ID NO: 127905 - DNA, 1067 bp, Homo sapiens
ctgacaatctgtgaaaattggataatgattctattttgctgttaaggctaacatgtgatatgaatactctgtttcttttctcttttctgtgtctgtataagaaccaacagtggaggtgcagttgtttgaactcactagagattttagtaacctagattttaaaaattctgcccaagtagtaattcttgatttttcagaactattactatactgtctcatcattcttattcattttaagccagtttggaggaagagggagaatttggtaatgtgaaataaaggacccaatttctttgtcattcattcgggggaggagagagcttaaccttgtttcttagtacctcttttttctcttcttccaccaaaagccttgttagagtaatgtcgaactcatactttccttgaggcccttggatatgcatctggtaatttttagtttctgatataccatgagatactgactagattgttgagaaggcaaatataagctgatcgacaggcagagtgtttacttggtaggagagagctggttttgggggatcttccaaaagatccttgagaagaatttaaagtaatacttggcatggtaccaatcagaggaaagattgtagtgaacatgcttaaggagataggaaccttgggaattggctgagcgtgttaaaggccccagaaggaggatctttaaggagtctaatgtctgtttttgtaaaaattaatttaaaaaatagttaatctttattgatgatgtgtttatatgtgttgcaactatacagggcttcaaaatcaatacgaaatgattttgaccccgcgaaagtcagggacattagtaagaaggatctgtcatggatgataaacatggaggcaactcaagagttactatgacctaggtccagggatgctggcagtcgttagttacatgatactcaggacatcaagttctttccaaatccaaaggagtggtctagagttgatatagaaaaagacttctttagtaagaaatgttcagcaaagagctcattttaggtgtatgactcaccttctgtagccagttctccctcttttttttt

SEQ ID NO: 127906 - DNA, 1040 bp, Homo sapiens
tctctttaagagattgataaattaaaaggcaaaagctcatatatcatgtttagctatactgtgagtcttataagaagctgggaggcaaccccattaactcaccagaatacagaactcagtctcacaatttcttagatatagttcctctcaaaccttttcctcaaagattaaattctgaaaataaccttgtgattaagagaagaaggctgtccaccaacagacttatctgttatttcttccttattgtgagcttaatggcatgacaagcagaggcaaagaggcttacatcagttcttcaaagtatgaagtcaaaaaggtcagagcttccacagcatggcaacagctttgcagatgcccacatcgtgatagttgaaatagcaaagcccagcaaaggttaaagctgaaagtgccaaaagccctgccttggcagctttctgcgaggcatccccatgaacatagtcagtaacaacttgtccaaggccccagtgaccatgaagagtgagggtcgcagccagggaatagcccatcgcagagcaaggattcaaacaagcagccggaagcagacccaggagcaaaacactgaaaaccttcttgctagtccagtggagagatgcagccttggaaccagaatggtggctcggtgacaagtgtatgtgctgtactccacatcattctgggataggtcggtcctgaagaaatgctgagatataagcaggtctgaccactggcgttcacagcaacagagctcgacctccttgggcactgcaaagggcactcagcctccagagaaccgccatctcgttcctgaggatgactgaatatattctaatattccatggtatggatataccacattttgtgtatgcctccattgatggacacttggattactttccattttttggctattgtcaaaaatactgttaggaacactggtgcacaagtatctgttcaagtcctttcagttctttgaatatacacctaggagtgaaattgctgggtcatacactaattctaagtttaataaccaccaaactatt

SEQ ID NO: 127907 - DNA, 1554 bp, Homo sapiens
aaatcattttctttcatttaaaaatcattatttacccagatacctgttatctgccctcctttatgaattctgtcttactgtacgcttcctccatgtccccttatgccctacctagcccaaaacactgaaaggttggacttccatatgaatcaatgctttccatgaagtaaaactgcagaagtggtggcaggatattcctgaatgaagtttgagacagatacactggcagagatctcttggtgggcaaggagcataagattagtagcatgccatctggggttagaatttaggaggtggtagaatgtaagtgactagctgacagtttggctaaagaagtggttgcatttaaccaggctaataaacatgagcttaaaaaaaaattcactggctaagactgggtcttgcacttcattttcagtttagtgtttctccttggattaattttttctgttttatccattactagtggtatactgtaaattgatgtacagaagtatctctaaaaagactaatttataggagtccagacggactagaagggttttaagcttataatacctggatccttttgttttaattaggtttctagataagtccttacaaacttcaaaggtgttataccctatcagatactttttcccccaaataaaactgtatttttcagttgaaaataaattgatataggcaattccttttcttgacaaccttcacaagtgtggtagagaattatttagcacactaattagtctcagcttcgattttgtgcagatttgattttacctattaataacactttcatcgggcttagcctttaattttataaactcctggcctcctcctgagcattaaattgataggaaacatactgatgctaatctctaattatacattcagaagttttttcatctcatcactctattgtccctttttatttgtccgtcatacttaaattttcaactaatttaatatagtttttctcattatacaagtaaacgttcatttctaaagattgaaaaataaaaggaagaaaacgaactacctctagccctctactcagtgacagacactgctattttcttttctttttcttttcttgagatggagtttcactcttgttgcccaggctggaatgcagtgatacgacctcagctcactgcaacctccgcctcccaggttcatgtggttctcctgcctcagcctctcaagtagctgggattacaagtgtgtgccaccacgcttggctaatttttgtatttttagtagaaacagggtttcgccatgttggccaggctggtctcgaactcctgacctcaggtgatccacctgccttggcctcccaaagttctgggacaggcgtgagccaccatgcctgtccctattttcttacatgtcctttgatacactcttttattactattcctcttttagagacaggttcttactctgtcacccaggctatggtgtagtgacgtgatcatagctcactgcagccttgaactcctgggctcaagcgatccttctgcctcagcctccgcagtagctggcactacaggt

SEQ ID NO: 127908 - DNA, 1143 bp, Homo sapiens
caataaatgactttaaaatttgtgaaagaaatgaagaagtgtgcttaaattaaaaagtgtgcttaattaaagcaccaacttccttgttttctctctgttctttcctttatttttaccattcgcacactgtgtttcctcagatattcatattttccagaagttttttatctttttttaattaaaaaaatttttggagacagggtcttgctctgtcatccaggctggagtgcagtagcatgatcatagctcattgcatcctcaaacccctgggctcgagagccttttgctccaatctcttaactagctggaactacacatgcacgtcaccatgctcagctaatttattttttatttttgtggatatggggtcttgctatattgtccaggctggttttgaactcctgacctcaagctattttttcatctcagcctcccaaagtgccgggattacaggcatgatccactgtgccaggccccagaaattttatgtctttacatcataaagtgttgactaaagaaggctgactcacagcgatggtggggaaagtagtggcagcatggaatagacagatttgcacagtagtttgcatagctatgtttagaccgtagttgataaattttgaaatcttgaagaacctgaaatttgcctgtgtaaacagagtgaaggtgacagagtgcttagtaaatttattaatcattaatatttcttccttgagcaacatcatcatcatcatgatcatcataaatgcctagtattatgtctgatacatagtatatgcctaataggatctttcgttttaaaaagagttaaacttgagtttcctggaaaatacacagatggtgaaagataaaagtaaacattactaaaaactgaaatgctctgtcctagaaatggaaatgtacagttatgcatcgcttaacaatatggctagttttgaaaaatgcatcattagattattttgttgttgtgtgaatgtcatggagtgtacttacacaaacctagatggtgcagcctactgtacacctaggctatttggtatagtctatgctcctaggctacaaacctgtatggtatgttgctgtagtgaatactgaaagcatttgtaacacaatggtatttgtgtattatacatatctaaacat

SEQ ID NO: 127909 - DNA, 1188 bp, Homo sapiens
acacatcaccaccaacaacaaaaaactgctcatgaacatttatgtataagcccttttgtggatgtatgttttcatttttcttgggttaatatatagaattggaattgctaggccatataggaaatatatgtttaaaactattttcccctggaccatagtgatagaggggaatggaggtgagaggtaagtcaaggctataccataaatgaccttatagttcatattaaggagggttttatcccaagtataaaaaaagccatggaagtgatgtaggagaataaaaccatcaaattacatttttacacctgactgctttttgtagattgagttaaaggtgaagctgaaggaggaagatccagtgaagaggatatgtcagttagaactctgttgcaaagaacataaaacttgaccaaactagcttaaacaaaaagagaatttttgtttcacataaatgagaaggtccaggaagcattgttcattctcaaatatttaaatactaaatatgtctgattccaaaatttgtatttcatcagctcttacctctcttctgaactctagatatgttcactaaagagatccttatgcttagaaaagtacctgatgtatatactagatactcaataaataatttgttgaataaacaaatgttcttgggcatccctcagagttatactgggaatcatacttgaaacctcctgctcttccgtttatcatcatcaataattatctatcctcctgacagattatttgtcaaacttgttcagttttctcaatcttcactgccattacacccctgatttctttcctacccttcttgagaaccttctgtggtcttcacatgctgcttctttctccattacagtctctaaaggttggagttactcaggccttggtcccatatcctcttctatttctttgtagccttccttggatggaaggtaaatattaaaaaaggaagataataagtataatattaagagtaaggcataagggtttgaattgattctgacatatagtgaactacatgctaatttgctgtaaagggaaagtggaaaacataccaataggtactctaagcaaaagtccagggaaggaatagatgtgtaaatttttttttttttttttttgagacagagtcttgctcgtcacccaggctagagtggagtgcagtggcatgatcttggttca

SEQ ID NO: 127910 - DNA, 1718 bp, Homo sapiens
ttcttaatgtcagtaagactataaattgtattttttttttttgagacagagtcttgctctgtcacccaggctggagtgtagtggcatgatcataacgcactgcaccctcggcctcccggattcaggcaatcctcccacctcaccctcccatgtagctgggactgtaggcatatgccaccatgcctgactaatcttttggtttttttatagagacagggtctccctgtgtttcccaggctggcctttaactacagggctcaagtgatccacccacttcaacctcccaaagtgctaggattgtaggtatgagctactgcaaccagcctttatttgcatcttttaaaagatttattttttacttttaacctttgtttagaattttgtgtaattcgtgtgttgcatatttaaacttctttgttctgtctctttaatttcctttggagccaatcattatctcttagggacaattcgaaagggttaaattctgtgagatgctatgacgtacttatggtgaggatcactttatatatatatatatatatatatatatatatatatatatatatatttttttttttttttttttttttttttttttttttttttgagtcggtgtctcgctctgtcgcccgggctggagtgcagtggcatgatctctgctcgctgcaagctccgcgtcccaggttcacgccattctcctgcctcagccttctgagtagctgggactacaggtgcccgccaccacgcctggctaattttttgtatttttagtagagacggggtgtcactgtgttatccaggatggtctcgatctcctgacctcatgatctgcccacctcggcctcccaaagtgctgggattacaggtgtgagccaccacgcccagcctgtatatttatatatgtatttttgagatagggtcttactctgtggcccacgctggagtacagtggtgtgatctcagctcactgcaacctccacctcccaggctcaagcgctactcctgcctcagccccccaagtagctggggctacaggcacttgccaccacacctggctaatttttgtatttttagtagagacagggtttcaccatgttgcccaggcaggtctggaactcctgagctcaagtgatccgcctgccttggcctcccaaaatgctgggattacaggtgtgagccaccgcgcctggccaatatattttatatagtaaggtctccttcagctagtcagcatgccttccaactctccgctaggcataggaacactgctcaaggtgccaatatattggctagcggagtgccaagatttacgtgtataacgtaagacacttatggaataatacaagtcattgtatatacaggagctgtagagttcagagaacggaagagtgtatgggtcaatagtttactttttattatctccgaccagctgataaaagacaataattaaatacatacatatatacataaaatagataatttactttcaaggctgctattctgcctataattttatgtcttgataatcttgcttcccaaaacataattttatcagatttctttaaacttagtctttaacttgattcttttatgcatacttattaccattttagttaggaagatgctacttttaggcatgtgtcacaactcataataattgcaaaatattctacagtttaatggtttttttgaggaccctcagattttataagtttata

SEQ ID NO: 127911 - DNA, 1822 bp, Homo sapiens
attgattaattgattgattcagacagagtttcattctgtcacccaggctgaagtgcagtggtgcgatctctgctcactgcaacctccacctcctggggctcaagagatcctcccaccttagcctccagagtagcagggaccacaggcacgtgccaccatgcctggctaatatttgtattttttgtaaagacagggtctccccagttgcccaggccggtcttgaactcctgaacacaagtgatctgagccaccgtgcccagccctattcttataatatcatttaaaggactgttcaacttgtaagctaagggtcatggcctggttgatttttatgaatatattcaatatccagaaaaacatttcacaaccagtaattattatttcactataactgtaacatacatctatcataaatgtgtgttgaaaaataggcaactgcatcagtaagaaatgccaatattttggttcttaattgctataaaaattaagagtgataccttagttgagacattggggaataataataaaattacctaacaactggaacaataaaatatttcattcaaataagagtgtgaaatatcatcatgaaagacaaattaagaattataatgactagaataattagcaaatatgttaattagtatagtaatacatataaatatgttttcacaaattaatatttataaacagataacaccacatttgattttaataaatacatatttgtgcatgttaataagcacatatctattatattaaatataaacatatttacacacagaagtacatatagtgtattcatatatcaacataaaatatatattggcataaaatataaggattatgtgtctgagtggttcagctctttgaaataaatatgtaaatttggtaatttccatgaatttattgttcagtgaatcaagttttatagaatgagtttgtttttgttatactaatatacaggattatatgttcaagtgcgtgtgttaccagattggaaacaggagggtcagttgtgtgtttattaaattatttgtccatctgtatgatgaaatgtattgcagccatgaagaagaatgaagtagagatgcatctattaagatggaagaatatgcagtgtcacgtaaagtgaaaaagggttcagaacaatgtactcattcttttccttttcaattaaaagagggtactacaagatatattcgtgagtgtatgtttatgtatatattgggtgtgtctataagaatacacaggaattgtttacagtggtttttattaggactttaaaagatggaaacaaaagttaatgggtgtccttttattgattttaattctgatcatccagtgagtaaaagtaaaattaattttttttttttttgagacaagagtctcactcggtcacccaggctggagtgcagtggcgcaatcccagctcactgcaacctctgcctcccaggttgaggtgattctcctgcctcagcctcctgagtagctggcactatgggcatgtgccaccatgcctggctaatttttgtatttttaacggagacggggttttgccattgttggccaggctggcctcgaactcctgacctcgagtgatctgcccacctcagcgtcccaaagtgccaggaaagcaggcgtgagccacaacatctggcctaaaattaaatatttatagcatatatattcattatagaatatgtgaaaaatgacaaaatagaagaaaagtcaaccaagataactattggtaaaagtttgctttaatgtgtttcctttcagtctttttgtttatttgtttgtttttgcaacttctgtctcc

SEQ ID NO: 127912 - DNA, 1083 bp, Homo sapiens
atgagctatgtcatgccactgcactccaggctgggcaacagagcaagacctcatctcttaaagaaaaaaatacaacatttccagaatctgcatttttgacaagactgtgtgatcaagtttggtaggcactggtttgaagggaagttaatcaaataggactgtatgtaagttgaattgtagatgagagaaattatggtaaggagtcagttcagattcctttatttcctatattagtaatccacttgaagtggagaccaaagggtatataaaaagagaattcttaaataaataagtgagatttaatgactaggatttagagaatggaggagagtgctatatcaatgattatgatcaagttttggcactgggcaactgaaaacttagtggaccagtgacaagaaatcaaaaccctaggtggcataaaaagccgtggtggttattctttactcccagactactagaaattattgttaacagaaaatcagcataataataacactggagaaaatcttgaaaaaggaatttagaaaaactcataatttcaaaatcctaaaataagcagcattttttgcaagttatcttattatgtgaactttttttagattgttagtagtttaaagccagtttgtacttttaatgtttcttatacttgtttcttcagaatttaattagttttaaaggaatttttctcattataaaatacataaactctcaaattctttttgttttgttttgtttttttgatgtaagttctcactctgtcacccagcctggagtgcagtggtgcgatcttggcttactgcagcctccacttcccaggctcaagcaatcctcctgcctcagcctctcgagtagctgggaccacaggtaccacgcccgactaatttttgtgttttttatagagaccaggtttctccatgttgccaggctgatctcaaactcctgaactcaagccatcctcctgcctccgcctcccaaagcactgggattacaggtgtgagccaccttgcctgggcatttttctttcttttttttgagtcaaattctttaaaaaaatacaaattataaataataactccagta

SEQ ID NO: 127913 - DNA, 1008 bp, Homo sapiens
gcctcccaaagtgctgggattacaggcgttagccactgtgctcggcctttcatctacttttatgagaggtattggtctgaagtttttctttctttctttcttctctctctcttttttttcctttttttgtgatatctttgtctggttttgatacctggctctctggaccaccggatttctttctttctttttttgatacagggtctcgctctgtcagccaggttagagtgcagtggtatgatcacagctcattgctccacctcccaggtccaagcgatcctttcactttagcctcctgagtggctgggattacagttgtgtaccaccacacctgaccgatttttaatttttttttgtttacagggtctctgcatgttgcccaggctgtttttggactactgggctcaagcaaccctcctgccttggcctcccaaagtgctgggattacaggcatgagccaccacactcctaggatttctttattgggagcttttaaactatgaattcagtttctttaattttttagattgatgcataatatcatatatttatggagtacatgtgagtattatatgcatagaatgtgtaatgatcaagtcagggcatttgaggtatctatcacctttaatatttattatttgtgttgggaacatttaaaattctttcttctagctactttgaaatacacagtactttgttgctgactatagtcaccagtactctgctattgaacattagaagttatttcttctatttgactgtatattttgtactcattaaccaacttctctttatcccctctcacccacccaccctctgcagcctctagtatctataattctatttgctacttctataagattaactcttttagtttctacatatgagtgagaacatgcagtatttgtcttgctgtgcctggcttatttcacttaatataataacctccagctcatctatgttgctgcaaatgacatgatttcattctttgaatgccaaatccattgt

SEQ ID NO: 127914 - DNA, 2955 bp, Homo sapiens
gactgatttctgttggctctctagacctagatttggattgattcataaacatttctttaaaaaaaagtgttttgttttgtttttgtcctgtgacacagcctcaggagactattcttatgtgccccaaaagaacaatttctgagttcatctgtgttgtgtatattaactctttgttcctttttattgctgagtagtattcagtggtgtgggtataccacagtttagctatttacccactgaaggacattttggttcttttcagtttctggctcaactaaaagctgttatgaacatttgtgtacatgttttcatataacataagtttttatttctctcagataaacgcccaagagcaaaattgctgggtcatctggtaagtatgcatttagttttcaaagaaactggtaaagtattttccagtatgtgagtacaattttgcattctcataagcattaaatgagtggtccagtttctttgtgttctagccagatagggtgttaccagttttttcattgtagtcattccaagagatccgtagtgatattttattgtggtgttttcttgcattccctaatggctaaagatgttcaacattttttcatatgcttattggcctttcgtaattccttttcagtgaattgtctgtttgtgtcttttgtccattttcaaattggttatctttactgttagattttttttaatctcttgagacttttctagatatctcattttcttctctttcattttatttttatttttctattaagttattggggtacaggtggtatttagttaagttctttagcggtgatttgtgagattttggtgagtgctttatacagtctggatactagttctttgtcagatatgtggtttgctagtattttctccctggttttaacttgtcttttcatcctctttgtagggttattcacagagtgaaagtttttaattttgatgaggttcagtatagcagttcttccttttgtggatcgtgcttttggtgtcaagtgtaacaactctttacctagtgccaatgcctgaagattttctctaagttttttcctaaaagttttatacttttacgttttacatttaagtgtgtgataacatttggatctagtttttgtataaagtaagtggtttaggttgataactcttcccccttcttgtcccgcttcccttcccccttcccttctccatccatggaagtcgcattgctctcgcaccatttattggaaaggctgtccttcttttattgaattgcttgtgcatcattgcgaaaaatcatttgggcatatttgtgtggacacatttctgggttttctgttctgttctattagtctatatgtctctttcttcatcagtaccacagttttaattgctgtagcggtatagttatccttaatatcgggaggcataattctacttgttttttgttttcacaaaactgctttaggtctcctaggacttttcctttccatataaattttagaatatgtttatctatatctacagaaacaaaaaaccgccagctgtggtggctcaagcctgtaatcccagcactttgggaggccgaggcaggtggatcatgaggtcaagagatcaagactatcctggccaacatggtgaaagcccgtctctataaaaatacaaaaattagctgggtgtggcggcacgcacctgtaatcccagctactcggaagactgaggcaggagaatcgcttgaatccgggaggcagaggttgcagtgagccaagatcgtgccactgcactccagcctggtgacagagcgagactccatctcaaaaaacaaacaaacaaacaaaatccttcctaagattttgctaggaattgcattatactatacatcaatttggggagtattgatatctttactatgttatattttcccgtcaatgaacatagtaagtctcttcagttatttagatctttgattttacgttagcattttgtaattttcagcatatagatcctgcatgtattttgttagatttatacctaactatttcattttctttggagcaattgtgaatagcattgtattttaaatttcagctttcatgtttattaatatatggaaatatgattgatttttgatttttgattttttttttttttttgagacagagtctcactctcttgcctaggctagagtgcagtggcacaatctcgactcactgcaacctccgcttcctgggttcaagtgatgcttgtgtctcagcctcccaagtagttggaattacaggtaacaccaccacacccagctaatttttgtatttttagtataaatggggtttcaccatgttggccaggctggtcgcaaactcctggtctcaagtgatctgcccgactcagctctcaaagtgctgggattacaggcacaaaataagactgatttttgtatgttgaccttgcatcttataaccttgctaaacttaattattttggggggatttttgggtagatttcttgggattttctagatagtcatgtcatctacaaatggggacagattttttcttctgttctagtctgtttgccttttattttcttgtgctggctggaatttccataattatgttggataagattggtgagaacagccaatcttgttttatacttgaagttaggggaaaatatactatttttcttttttaaattaaattaatttatttattttgagatgaggtcccactctgtcacccaggctagagtgcagtggcaagatctcggcccactgctaccttcgcctcccagggtcaagtgattcttctgcctcagcctcttgagtaactggtactataggcgcctgccaccacgtctggctaattttttgtatttttagtagagacggggttctaccatgttggccaggctggtttcggactcctgatctcaagtgatccgcctaccttggcctcccaaattggt

SEQ ID NO: 127915 - DNA, 1046 bp, Homo sapiens
tgacagagcaagagtccgtctcaaaaacaaacaaacaaacataaaaaccttaaagattgtattcaaatctattttgattctgatgaaagcaaggatgacagcaaaatactttaatatatgcatgctaacaaaagaacacaagttagacctgtgtcaccatatattctttgtcatgcctagcaagtattttcagctttggggaactctgaatgatagatggtgtattcatgtttgtagattgtggtttttattatatactattaaattctataatttaaacttgacatattagaggaaatattgttcttcattatttggagtaaaggattaattatacataactttttatagtcgaatgtagttttcagtttcagttttgaactctatttgtttttattacttctgctgggagtatgctgggtagtatggaaccaggcttcctacatatgaatgttggctctgccacttacttactatctgtgagacctaggttgttactttaccgtctttgggactcagcttcctcatttgtaaaatggagataccaggattgttgtgtggaataaatgggttaatgtatataaagtgcttggaatagtgtttggcacatcgtcgctttgtctaagtgtttgctgtttttatgcatttgaaggaataaaaaacattcatctttgaatttctctattaattcagtacacttgtaaaacaatgtctaagtactaaacatatattttcagtaatcacttgaccacatagaaatataaggaatgtgtttgaggggtaatcagaagattggcctgcctggaattcccttgaatcagagagtaatggaaaatgaacctgtatggatacaatagaaaatgattatcaagtgttttgaactaaggcatagaaaattagatgctgataagaggggaatcattgcaaggttgttattgttgtttttaagtcatgatagtgatgtgtttaaaatagtatttaggggaagatagttttgagtgtgcttggtagcatagaattatttcactataaggacagaggatttt

SEQ ID NO: 127916 - DNA, 1512 bp, Homo sapiens
tctccaaaaaaaaaaaaaaaaaggtttagtagaaaatagctaccagtgtttctgaatgattttaaagatattcactggagaataggagcttggaaaataaagaaatattatctttattacagtaagagaaatgaacatacttcatttgtaaaagagaaatttaggccttacctgcttcctatgtgtatattagttcagaacggttattaggagactactcacatttgaatagctataaccagtaaatattactggatgactttaataatggcctgatcagagctaaagaaaattctgatgaagtagggcattaaatatttctagctaccaactccctttaaggatgaataaaggtaggtccgcaggctgaggaagtatacagggagattgtgaaatgaaaacttatcctttcatttacttcgatatctttgttttgcacaggtaatattaaaaaacaggtctggttaaacatcagccgtatatgttttggttggaattttttttttaagttctgtgaactttgaagtttttttaaaattctttgttttggtttgtagaccctgcattaagccaactttctggatctgttgtgtatttctggatagcatactttgttttgtgaaggaaaattttacattttattttaaagctgggggaaaaaagtaggtttcttgtttctcgctttgtaaatgaggtagatgaataatactgtattgccacttattatcttcatgcttccttcaatgtctcaggtattcctctactgtatgtagcatgtggatctcaaagtttcccacagttgagtctgaaaacatctcaactgtgcttataattttaaaattaaacttaattttaccattttctttattgttattataaaatataggacctatcataatgccatgaaccttttagtgacttgggaaatagtgattaagatgatgcaacatagtacattattgggaaataatctgtttttcgttggcatcgcctctatccttagacctctttcattctagtaatatgacagaaatatttttgacattttaaaacttcctcatttagctgatcgtgtgtgctgttgaaaatgaacactagaatagaaagccattgccttctccttggggggtttgttttaacaggggttttcatgttttaattttggatttgagatttgagttgagatatccattgtgtagagaatcttgagaaggattatccatctttcttgctgtcaccagtgtatgtgggagggaagaaaatatcaaatatagggtatacaggagaaccttagtatttgggaatatcttcagtgatagctgccaaatccagtgttttccccaggaaatttgtatttaatcccttggagtatgggatgactttatgagtgtcatagtgggttgctgtgggtgaggagaggagaaaacgactccctgtttgaaaaatcttttccaaactgttcgaaaatttgagattaaattgaattaatctcaaattattaatagtttatgt

SEQ ID NO: 127917 - DNA, 1575 bp, Homo sapiens
ccgaggcgggcggatcacgagatcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaataaaaataaaaaaaaaaaaaaaaaaaaaaaaaaattagccggatgtggtggcacgtgcctgtaattccagctactcgggaggctgaggcaggagaatcatttgaacttgggagtcagaggttgcagtgatctgagattgcgccattgcactctagcctgggtgacagagtgagactttgtctccaaaaaaaaaaaaaaaaattagtagatcttatattactgcttttggaagcaattagtgaatgatgtaggcaaaatagtgattgaattttgaaaagcaattagactgaaatttcaaaggggtggagcatttcttaatagcaacaaacagatacatggtcattaatccaaatatctgaaattttctgagcatgtttttcagagtttggaatagagtggaagtgctaattttctgattatttaagaaccttttaatccattcccttagagcatcaggtgttttcagattgtgaattttctaaaataacattggctgatttgtgttattgaacattggttgtagcaacttttttccttttttcccctttattttctgcctcccatattttgcttaagatttttttctgaagttttaaagtttcatcagttatttgggtggaccgtcttgtgaatgctctaattgaagttgtataatataaacagtgttgcttttagtagttaggattaatttttcttttcatggaaatcctttctatttgattatattttttcctctaacttttattaattcttagatgagaattaggattctgcattaaatctttctgcacacatttttcttactgtcagtagggacctatgtcttccttgggtaaagaaaatgttatattttggttttgccatttaaaatgatataaagacgttattagtacttttttaaaaaggaacttttggtatttttaaacaagtacaaaagtaggtatgaaccaccatgtacctgttactcagcttcaaatagtatcaaatcttagtcattacattgtttcattcgtactagaactttttttctttttttttttgagatggtctctgttgcccaggctggagtgcagtggcatgatcctagctcattgtagccttgaactcctgggttcaagcaattctcccacctcagcctctcaggttgctctgactacaggcacaggaccatgcccagctaattttcttattttttgtggaaatgggggctcaccctgttgcccagggtagtctcaaacttctgggcttaagtgatcctcttatctcagcctcccaaagtgctgggattgcaggtgtgagccactatgctgtgatataataaaatgtctttat

SEQ ID NO: 127918 - DNA, 3908 bp, Homo sapiens
ttagcctcgccccagtcttggggtagcacatttccgcaaacaccgaggacacggaatcactagtgaaaaccgccgaccaaatgacattgaagcagcacacgcgtgcagagaaggaagcaaaacacgaagaaaggcatcagtccagcagccacgtgaggtgggcgatcccctccgccctctgagagaggacttcaactcccggcgtgcccctgggaggttaccctccgaggacttcaactcccagggtgctgcgggagcggccaccgcaacctcccactcagccgcccgccgctcctcccgcccctcccccgcccctcctggccggatcagcgtgcgcctgcgcacgggaggccggaggagtcttaccctaatgtaagatggtggcccgtctggctgtggaacccaccgaaagctgagagtctctctctcagccgtaaaggtcggactcgctgaagcaatcaggcccggttctgaagagttttttccccgacgctcgttcggtggtttcttgtgaggacgcggcagcccgtggagtcggctgagggaaaagcgaggcaaggcaggcgggtgagtctatgcggggctgggcttaggggaaacccggggctgaccggctacgagagagcggaggcttcgctgggactgtacaggccgcacccccctttctccccaccccccgcctcatcttcaccctcctcctccttggtcttcttcctcctcctcctcttcctccctctcccctttacgccacagcagttaccataaggaaaagggagcgggtcagaaggcagcgcggcggcaagcagcgactctccttcgagaatttctttaattggggagccgaggcggcttttggtctccagcttttccccctgcattttcaccggggcaggattcttaggtctcagccctccttgtttccccaatcccctgttccctgtctgacgtcctttccctctggcccccgtctcccaagaccaaagccatcacttccactctgatccgtgttggctgctgctgctcattaatcccactgctcattgcccactcgtcctgctgcttgtttttttgctccactgctaccactctggagttagcctttgcccccctctggtgcttgcaatcagcccacagtgtatctgccacactagagctgcttccgatttgcagtctttccttccaccacatctgtcatcttaaagctgccccttaagtatctagattatgctcctcctgctaacccacctgtttctcagccttcttgagaattgtccgttccttccctctttcctgtacagatcctttcaatatacacttccagaaaaagggaagccccgtggtggcccttgaaaagtaaaaggaagttgggaagtgaatgaagtgaggtaggatactattaaacgttatgagtgaagatcttttattcaggctactccggagaggaccgttttcgttttgctttctgtgatctatttgtcgcttattcgctctgttgtgttaggacttggctttttttcttttttttcgttttggaccggttttatcatgctactaagcgttctttggattgcctctccccaggacacttagtgtgggccctgatttataccaataaatattaaccccagcattacaaaataagataaatctggcgcacatacagaattcatctgtgaactccgctagcaaatataagtgatattttgattacatgtgggttatgtgtgggttctgtattgaggcttgatttttgactgagttttattgatgttcagcttaattgatgacattttatttatgatttgagtggaaatttcctctccagttaatatcagattttcttcttatttttggatttgggaagttctcttgacatttctaggatgatagttatcagaataaattgtcttgtcttgaaaatccattagttatgtatgcaaaagaaaaatcgacatttttatataaacctaagttcctcgtatttttctcatagaaaagaagggggctgggaaaagaatgacaaagctgtgcacatacatgcatttggtggaactcactgtcattgttatctacagtaaaaagcagaaaactggaagcaagaggtggcttatgatgtccatgttttggtgaaagcaaaattaagatgtactgactaatggtaaaatgggaagaagcagccctggctataatcagaccactgtgagataaagaattaccagaaaagcaaccaagattacatagttcaaatacatacatcccaagtttaaacatgacttacatgacattgtattcttaagatatatgtaaaaatgtttaaaatcagtgacagtctcatgtggcagtccattactgggttattgtaatttttacaaattttacctgtaaaatttggaatcttaacatttggcattatgttcacttgattgtgataaatggtctgttttaccaaatgtaaactaaggttagaaaagctgtttataaaacttttttctttcagccacttaagccccaatttgggggaccaaataaatacctactcttagaactgcaagcaatttatatagcaaactttgtgctaagttacaagttgagttttgggttttttttaatcacttacatttagtttatcagtaggagtgtatttaatagttgatctttaactctaaaaaatatactttttgttgtaatacactggtggagaagctttccacttttaaaaatcctaacacaggtttagaaactcttggcagtcatacttggctgaattgtaagcagtgagttctaggagaggattgtttgtctggtagaagggagtaagtgattttaatacatctttttttttaaaaaaaggtatttgtctcacgaaatattttctcaagtaattctttcccctccataatttttgcccgcagttactgaattcttcatttcagccctctgaagtcaaaaggaatttacttttgtatctttagtacgtttaaagaagatatctaaagttctttaacattttgataggaaatagggagctgagatttctaaatagttttgcttggttttagttttttgatctaacgttatgaacactgaagcttcatattttcatggtttcttttgataatttggaatactttctgccaggttgagtagttgaattcttgagatcaatagattatttctgtaagaaggttttgaacatgaatcgcttaaagttggcctattataaaattaggatgagacagttataatcaaatgacaaagtgcagaaaaataaaattgtttttgtaatgcccttcaacttgagtctaaatgggagtactagcgataacttgcaactcatttgttaaagaaagggtgttgccagtggatgaactcctagctttaggggagtcttattttaaaaatgattttgtgtgctttaaaggaatgaaaaaatatcttatcagtttaagcagtttggatttagaaatcttcccttttttcacctccctaatcttggctttaaaaggaatccatattcttcagtttaataaatttatctttttgttgttttgtatgagaaaaatattaaattttcttttctttctttttcttttcttttctttttttttttgagacagtctcgctctgtcactcaggctggagtgcagtggtgcgatcttggctcactgcaacctctgcctcccaggttcaagcgattctcctgcctcagtctcttgagtagctgggattacaggcgtgtgccaccatgcccggctaagttttgtatttttagtggagacggggtttcaccatgttggtcaggctggtcttgaactcctgacctcgtgatccgcccaccttggcctcccaaagggttgggattacagacgtgagccaccatgccaggcctaaaattaaattttctaatg

SEQ ID NO: 127919 - DNA, 1021 bp, Homo sapiens
accctgcggatgtggttaggccctggatgttcttgtacctttggagctgtagattttcggggtggaattgaatctagaaggtagtaaaggaactctggaagatttggggtggatcctctttcggtgattctcaattcgggccgtaccgccctccagtggtgtttgaatgagtgagtgcattttgattgtcatatttcctggggtacactgctgtcgcatagtaggcggggcaaggatgcagaaagtccttcatggtcagagcagtccggaaaaataatttggtgcctagaatgttaatgcctcgattgagatgctctgaagttcgcgggcaagattaagagtatatctgtgtggtaaatgcttgtgagaatctcacttaaaaggactcttttttaaagtattggttctattttccacaggactgatattcttgaaaagttgtctaaatctgttttgtaaatcaaatcatttcagaaaagctatgataaattataatgaaggctatgtttactgaacacatactatatcccagcattgcacttattatcgtgcttatctcattcagttcccgtttatacacctttggagtagttactgttacatactccgttttacagatttggaaatagaggcttcaaatagttacgtaatgtccccagagttaaacatctaatgatctaagtcagtcttaggtgcttaaactacttagtgctactgcttaagcacaacctaattcattttatgatattagacgtatatattagaaggttagtaatgaagttacatgcttaatattgcggtccttccttcccaattagatatgcttaacgtgtggttgtatataatacatttctctattttattttattttttaatttttctttttgagatggagtcttgctctgtctcccaggcgggagtgcagtgatgcgatccgcgatcctggctcgctgcaacctctgcctcccaggttgaagcaattctcctgcctcagcctcctgagtagctgggattacaggca

SEQ ID NO: 127920 - DNA, 1005 bp, Homo sapiens
cactgtgcctggcctatatacattcctttagtacatactcgccctaagctattataattattaaacaaatcattggagggaaaaggagttgccaacagcagcaaagagtgtacattgtataataaagccttgtgtcaggagtgtttaattggcaacataggaaacatttttaaaagccaagagtcaggagctggttttttaaaaaactaaacgtcttagggaaggaactctttttccatcaaggaatgaatgttgggttgagtgggtaaaggaaatgtgtcatatacatgcaatatgcataatacatatacatgcatatacataacataacgtatacatgcatatatatagtatccttatgcagccttaaaaaggaaggaaatcctgtcacataaaacaacgtggatgaaacttgaggacatactaagtgaaataagccagtcacaagacacaaatactacatgattccacttatatgaggtatctgaagtagtcatactcatagaaacagaaagtagaatggtggttgccaggggctgggaaaggggaaagtggggagttgtttagggggcatagagtttctgttttgcaagatgaaaaaagctgtgaagatctgttgcacaatgtgaatacactgaacactgctgaactgtacacttaaaatttgttgagattgcattctatgttatgtgcttcctttaaattacagttttaaaaaatcaaacatcttggagttgtaaggaaaaaatacagagattgtagagttctaagacctatggttggccaggtgtggtggcttatgcctgtaatcccagcactttgggaggctgaagtgggcagatcacctgaagtcaggagttcgagaccagcctggccaacatggtgaaaccctgtctctacaaaaatacaaaaattagcctggcatgatggcaggtgtctgtaatcccagctactcgggaggctgaggcaggagaattgcttgaacccaggaggaggaggttgcag

SEQ ID NO: 127921 - DNA, 1375 bp, Homo sapiens
ttatttttatttatttttttattttttgagatggagtcttactctgtagcccaggctggagtgcagtggcgtgatctcggctcactgcagcctccgcctcctgggttcaagcgattctcctgcctcagcctccctagcagctgggactacaggcgcatgccatcacgcctggctaattttttgtatttttggtagagacggggtttcgctgtgttggccaggacggtcttgatctcctgacctcgtgatgtggcccgccttggcctctcaaagtggtgggattacaggcgtgagccactgtgcccggccagattttacatttatgtatgattatgattaatgtttttcctcactgcagtataatcttaccaatacctcacacatggtgaatgagtgagtaaatgtgatttgctggaggtatccctaaacattaaggaaaataaatgtatttctcaactgactaaactacatggtaaaaatacatatttagtaattttgaaaaatttatagtgtcccttcatttgtaatcagtaaaaaagatatttactgtaatcctagcactttaggaggctgaggagggaggatcacttgaggccaggagttcaaggcaagcctgggcaacatagcaacatcccagttctacaaaaaatacaaaaattagccaggtctggtggtgcgcgtgcgcctgtaatcctagctactagagaagctgaggcaggaggttgcttgagcccaggagtttgaggctgtaatgagctgtgattgcctcactgcactccagcctgggtgacagcaagaccctgtcacaaaaaacaaacaaaaaaaaggtgtttactgaaattggtcaaactcaagacagattgaagataactctttgttgcggctacctttggtgttttttttttctttttcttctttgagacgaggtttcactctgttgcccacgctggagtgcagtggctcagtcatggcatactacagcctctaccctctgagactcaggtgatcctcccacttcagcctcatgagtagctgagactataggcacaagccaccatgcccagctatttttttttttttttttttgagacggagtcttgccctgtcacccaggctggagtgcaatggcatgatctcaggtgactgcaacctctgcctcctgggttcaagcaattctcctgccccggcctcccaagtaactgggattacaggtgttagccaccatgcccagctaatttttttgtgtgtgtttagtagagacagggtttcaccatgttggccatgctggtcttgaactcctgaccttgtgatctgcccacctcggcctcccaaagtgctggattacaggcatgagtcaccacgcccggcctgtttt

SEQ ID NO: 127922 - DNA, 1036 bp, Homo sapiens
tttttttctttttttttctttttttttgctttctttagtagaaagaaccccagcctgggaaccagttgagctgatttccagtcttggctgtaccactagagagttttatgaccacagacaagttacctgacttagctggatgtcggtttttctgtctgcaatagaggagctagattcaatgaccaatgtgtaacctttaagttccgaaactttagatgtatgatctatcagctaattctgtactgtacgtcatatgttaaatatttgcaccaaattatcttttaggaaataagactacattttatataacattaataaactgttacttgctctgctaagtaattaaacagttcatatatccatttgttatgtaccatttgaagaccttattatttttatttattatgtaattgaaaagttctgtagaaacttgaaaaatagtatgctattttgtatattttctccaaatttttcagatcagagtttagcagtcacagttattgagaaggtagtattggaataaaaagtttaaggttatgcaaaatattacttcataaaagtctgttctaaattagctgataagaaatacttctgtttgtcatgttaccaggctgaattatcatgaataagcttctgtaggtaacactttgggaccttgtctccagtgtgctattttcataacaattacaattttatcattgtagccaaaaaatgttcaacagcatgagaaggttcagaaagccagtacagagggagtcgccattcagggtcaacagggaactcgacttcttcctgaacagctcattaaagaagcctttattctcagtgacctttttgatattggagaattggcagctgttgagcttcttcttgctggtaggttgacatttaactgaaacagtggtaaaataatgcaaaattataaaatcactcatagtttaaaatagtttattgtttagattctatcatagtttctaaggctgcagtttggtaaaaccatattcaaaatatttccttttttaatctttgttgtttt

SEQ ID NO: 127923 - DNA, 2705 bp, Homo sapiens
agtggcccaaattatttttggattacaaagtgctgggattacagattacagtcttgagctcaggagttttagatcagcctgggcaacatgatgaaatcccatctctacaaaaaatagaataattaactgggcatgatggcatgcacctgcagtcccagctacctgggaggctgaggtgggagaaagacctgagcctgggacgtcaaggctgcagtgagccatgatcacgccactgcactccagcctgggtgacagagcaaggccctgtctcaaaaaaagagcgtttgctatacctattattatgaagaagcataaacaatattgtttaacgtagtttattgatttcttttcattacagtccagagctggcttccatgacaacacgctttacagatgagctgatggagcaaggattgacttataaagttcttacgctggtgtcacagattgatgtgaataatgagtttgagaaactacagcgagagagaggtttgggcagtgaaaaacatcgcaaagaggcaagggttcaatgaaatcaattcatgagttgtctgtcaaatctcagaggcagaaacatgacaattagaatgttcattttttcaagatgaattatgtagctgataccatgcctgattgccacttttctttttttttgcttttattatttttcattgacacaaaactgtacatatgtatagggtacagtgtggtattttgatacatatgtatgatatgtaataaatcataattagcatatccatcacctcaaacgtttattatttctttgtgttgggaacattcaaaattcactgtactactgtttgacagtacagtatacaataaattgttaattgtagtcagctcgtaatgtatattaaagtttgtagtcagctgtgtccataaaattgacttgcagttgtttcagcttcggtatagtcatttatgtgccattctagctctttttatgaaatgaacaagaaattggtcatcccaatttcttaaggaacttaaggataaggaataaacaatagggtttgttcagaattccagaggtgacgtcttaggatcacttgtggattttgataggtttttttattagcctttgtaaaaggtagtttgtactttggaataagaccaggcttcactgtaatttatttatactgatagtcatgtttttatttctaggtttctgatctcattaaggagtgcaggcagtctcttgcagaaagcctttttgcctgggcttgccagtcacctttaggcaaagaagacactctcctcctcattggacatttggaaagagtgacagttgaggctaatggctcactggatgcagtgaatctggctcttcttatggcgcttctatactgttttgatatcagttttatagagcaaagcacagaggaacgagatggtattgagttttatacattttcctacattaaaaaaatcagatttaaaattgtggggataacatttaaaaagggtgatattttagctactaaaatagtctgctctgttcctgtgtttgcagtccgttcatatttgaatatttatatataagatcacatttaaaaaacagctgcagtcctgttaattatttctgttttttggggggatttggaatggaaagtattaaagcatatattatacatgttcatgattgcacatgcctaatttacttaattgcttgtttctttaccattcatttacattttcaaactttttattaaaacattctgagacagtgactgtcatttcagtaatgtaatctttgatctgtgttttctgtgaagtaaataaaatttttgtgatctttagatagcatgatttctattttagaatttatgtgcagaaaaaatgagtgtctaacttttttcttgtttatttgtagtacacttataaaaatgactgaaaatagtgaaattgaaatttaggattattgtcattttctttttttgtttttagtatgtgtacaatcaacagtagtgtaccttttgggatgtagaaattaatgttaattggtcattattcttctgtgagaatgctcagattttctgacttttggatattattcctgtgtatcagaagtgagaatttatctggtgatcggtaaagtggtctatttttgtgttttcagatatgattcatcaacttccactgttgacagaaaaacagtacattgcaacaattcactctcgtcttcaggactcacagctttggaaactgcctgggctccaagccactgttagacttgcctgggcgctggcattgaggggaatatcccagctacctgatgtgacaggtgaattgattgtaggtaattttgttatgagaaacagcatgttagcacttaatgacatttttggaaggagtattatctttgacatacataagcataagcataggaagatatccagagttgtattaaatgaaacctttagtgtagtagtgaaatacagacttttttctccttgtctctcaaaaatatcatatgaaatactatttcccattcttggagccactgacaatgctcttttaccttcagggtatgagtttaaaatttggaatgacagtgtcacattaattttttttttttttgagatggagttttgctcttgttgcccaggctggagtgcaatggcacagtctcggctcactgcaacctctgccccccgggttcaagcgattctcctgcctcagcc

SEQ ID NO: 127924 - DNA, 2059 bp, Homo sapiens
ttcaaatgtacagtttttaaaagcaccctgaaaggtctacacttgtaatatattgtgcagttttggtaccatacctcctgaaaagtataaattgattatcataaatttgcccttaggattcttgtattatttttatttttataggatctatagtgatttttctctttaattcctaaaattggtaatttgtgtcttctcccccagttcttagttaaccttgcttgaagtttattgatcttattgatctttccagtgaattagcttttagcttcattgattttcttatattttgcttcaccattgttgatttttgctattatgtttattattttcttccctctgccttgggtttaatttgctcccttaattttgttttttaagatataagcttagattattgattttaaatatttcttttttctaatatgagcatttaataatgctatacatttacctccaatcactgctttagctatgccacacaaattttgatatgttgcattttcttttttgttcagtttaatatgttttctaattttccttgagacttctttgattgatgggttatttagcagtgtgttgtttaatttccaggtagttcacagactttcagatctctgtcacaggtttctagtttaattccgttgtgctcagagaacacgccttgtagaatttcagttgtattaaatttgttgaggtttgttttatggctcagaatatggcctatcttggtaaatattttatgtacacctgaaaggaacacatattttgctgctgttctgtggaatgttctacaagtgtcaattaagtcaagttggttgatgctgtttttcaagttttccatatccttactgattttctgtgtacttgttccattgaatattgagagaggagtgttgatatttccaactgtaattgtggatttgtctagctatgttttttttttttttaacagaatttgtttcttatttttgttggcatttagttcacacaaatgttgtgaagcagtgattctcaactgaggtataatgttcttcagagtgtgtttgggaaatgagtggggccagttttgcttgttatgatgactctggtgttgttattgatagttggtaggtagttccaaggatgctaaatgtcctggaatattcaggataatccaacccagtgaagaaacattgtgcccaaatgtcagtaatgtccccactgagaaatactacagttaagttcaacttttctatagtggaaaatgcattcaagttttaagatattatacattatgggtagtaatattgcaaataagattcctggcatgtttcttcatgtcacctaaagtggaatagatatttaaaaaatatattcttgtatgtagtcactttaagacagttgcctgatttcattattattagcatgtacaatacatttacatattaaaactatatctaataaatttaataggtgaaacagctgaggaatcgggcagatgaagatgctcgaatgattcacatgagtatgcagatgggtaatgaaccccccatttcacttagaagggacctggaacacttaatgcttttggtaagccattatattagaaagcttgtcctctttccctcctttcattattttttcccctaactttggaaaatttcaggtgtaatactttaaatgtccttttttttattgaaagtaatttttcagtcatagacatttccctacagtctttgcttactctttgcagattggcgagctatataaaaagaacccttttcatctggagcttgctctagaatattggtgtcccacagagcctcttcagactccgactatcatgggctcttatctaggggtggctcatcagcggccccctcaacgccaggtgagtctttaggttttcctcttttatactctggtactgtgatagagagtcttgaaaacatgaaagatattacttcctgattttattgctgttaacacaaatgatcactagtgtaacctttagagacttacactttttaaattttatttatttatttatttatgttgagacaaagtctcactctgt

SEQ ID NO: 127925 - DNA, 1034 bp, Homo sapiens
cctcagcctcccaaagtgctgggattgtaggcatgagccactgtacctggcccagatgccactttttaaactgtattgtttcagtgtttttctcatttaaaaaatacgttttgagccaggcacggtgcttcacacctgtaatacttgcactttgggaggccaaggtaggcagattacttgtgctcaggagttttagactagtctgagcaacatggtgaaccctgtctctacaaaaaatattttaaaaattagccagacatggtggtgcgtacctatggccccatttgcacgggaggctgaggtgggaggatcatttgggctgcagtgagctgtgattgtgctactacattccagcctgggtgacagagtaagaccctgtctcaaaagaaaaagaatgttttggagaaagatttccttaaaaatttttaaagtttttaagaaagctagcagtaatgaaaaatttgaaacatgtggaagagggaattattataaggaatgccccacattttaatttcacatcttaagttaacatcttatgatgtttgcttcatctactatattattattttatttatttatttatttatttattttgagacagagtcccactttgtcacccaagttggagtgcaatggcctgatctcggctcactgcaacctccgcctcctgggtttaagtgattctaccgcctcagcctcccaaggagctgggattacaggcacccgccatcatgcccagctaacttttgtattgttttagttgagacgggttttcaccatgttggtcaggctggtctcgaactcctgacctcaggtgatccacccaccttggcctcccaaagtgctgcgattacaggcgtgagccactgtgcccagcctgctatattatttttactttcgttttattttaaagtaaattataggcaaatacatgaattctatcccttaatatttaagtaagtatatctctcttaaaaatgttattttgctacatcatcataaaacctttttttttttttggagacggagtctct

SEQ ID NO: 127926 - DNA, 1043 bp, Homo sapiens
ggggtttcaccatgttggccaggatagtcttgatctcttgacctcgtgatctgcccgccttggcctcccaaagtgctgggattacaggtgtgaaccactgcgcccagccaaaccatttttaaacctagctgatttaatagttatttccagacatctgtagtgttttcagttctcagttccaactagtgagtttgagtaatactgttagttgttgataataggtttaaggcataaggaagaaaaagggaaaattaagaaatagacttaaagaacaggagtatgggaacgtggcattggtttgaccacagaacagaatatgcttaagttaccatcaaaaatgatttaaatttcctaggtctagatactaatttggctgggatataggaactctggattttaagtgtacttttgaattgctggttgatttttggatgagtaaatgtcacatgtcttatatttttaaaatctgagtggtcttatattttgtgacattgagatatttttttaaaaatgtacttttatttcataaaggtattttataattgcattaaattgctaatgacaagcttaaacaatttttcataaatagaatatcagttaaatttgtctgttgcgagggttaagtcagagcactacttttagtttatatgtagtctttattagctagtccgtgttgccttaaagttaagatatacattatataaaccatttgtttctctctttttcaggttgtcttgtcaaagtttgttaggcaaatgggtgacctgttgcctccaactatttatattccttatttgaagatgctccagggattggccaatgggcctcagtgtgcccactactgtttcagcctgctcaaagtcaatggtagtagtcatggtaaggaatatgtggatgttgttaaagtttgttgttatactcttttaagttcagtatcccactacctattaagaacattggtgtttgaactaggttctaccagaggtataaattattttcataacaatagggtgaaggaagcatgcatacagctttatgcatag

SEQ ID NO: 127927 - DNA, 4137 bp, Homo sapiens
agcactattaatatgttaatgtctgcataatactcttcacttcatagctaatagtttttattaccaagttttctttctttttctttggaaggttgaactaaatgaaatagaatcccggtgtgaagaatacccattgactcgggccttttgccagcttattagtactctggtggagagctcatttccttctaatttgggtgctggactgcggccccctggctttgacccttatttgcagttccttagagactctgtgtttctacgattccgtacaagagcttaccggagagcagctgaaaaggttatgttcagagaaaagcttttttctccttatgcatttactgctttttcttttatcaaaagtatatggtgctaaattcatgttagcttttgaaaggtagtaaaattcacagtctttgttttgaaatatctatgaagtggtctgattagtttatgtgcactaaaaaataagtttggtcattaaaacccaagcactgacattagtcatcagtaatctaattgataggagttcatatttcatatccttagtttaacaagttttgactaaaatggaacaaaaagtgtcacatttgttggaaacacactactactgcttattggaatggtttaggttagggattgaaataagtttaaacttgcacagcagtttctattgattagtggcactgggttgtggagtactggtttagcgggaaggagtattgtaatccattaggcatgtctgccatggatggaggctgagagagcactgatctttatgacacatttgctctggttgcaagacactaaccactgagcttatatatatcattttatataattccaatattaccacgtggcaggtactatttaatattcccattttacagatggaggcttagcaaggttaaggaacttgcctaaggtccaggaccaggatttgaacctaggactctgattccagatccaagctcatagccactaagctatgtaagagactcttccaggttctgatgtaattcacgttagtctataatactgtttattaaccttacagaatacccttggttgtatcttgtaggaatgtttctgctttattttggtagttggcgcagatcaagactccatctgaaaaaaacaagtgtatatatatatgaagaaattatatcatccttaattttgttgccaaaggaaggataactacttttagtctttttcctatgcctgtagacttaattaacaattgagataattagttatattactttgtatttcttttttgtcacttagcatcatggggatttttttcatgtcctaagatattctttgaaaatagtctttttagtgactgcataaaatctgttacttgtatctagcatagtttattcactgccctgtcattggatatagcttgttttttatatttagtcacaaataattgaagttctttttttttgtcaattgcattagaatttttgcttgccaggttgtaaaaataaacactgaggtggggtatacactttacttaggctctagaacttaacatgtatttcctgatgggaagaaaacaataacagcaaccatgcctcattaataaagtcatttcagatgaataatgagtgctgataattacagcactcatttcatcaaaatgttctgatacttttttacagttgttttaaatgtcttatatgctttttcttaaaaaggtcattgtgatctgagtgtttagagcattagttagccatattctctccagatgctatcacttttcacccatgcagagccacacttcaagtgttgctgcttttccctggctgccattgatttcagttccaccccaacttactctaaaaaactttccctcaattttgtgaatttattttacttgaaagtgttcttgagatctaatttatatgactattttaggacactagctgctcacacaaacagtgctttggattgagataaataacagcgtgttagaggcaattggtatgtttaccagtcctaaatccattattatgtggtaatatgccttttttatttaaataaaattttttgaaaattttggaaaatgcaaaacagtgaataatataaaaataatttaaaagtcactttatagtcccattttctaactcaaccttgatacaattatgtgcagtggaaataataattttaaaatagtaattcataaaaccaccctgtctgcaatgaccaaacccagtcttattaaaattctatgtagtggattttttaaacaaagttttaattttactggctatgcagttgtatataatttttttggcataagtatttttctttactggtacatagcttttaaatacattttgaataagaaggcgataatgggaatatttggggcaagcctaccagtgattgtgtcttcttaaccttctttgactatagtcacggatggaaccctggtctgagaatgagaaggcctgggcttgactttcagcctgtttgctgccaggctttatgatcttggggaattcattcactgctctgagcttcacttgcttcacttataaggaatttagatgagatgatttctcagattctttgcaggcaggcttgttagagaaaatgtgaaatgtttggcacttgaaaagtgtccaaatttgatgtttaattataaattgaatatgactagatactaaatgttttcaatgtattaatgaattccaaacatctataaaaatgtatctttaagaataatgcattgaaaatattttaccttgaaaatgagccaattcattatcttttagcaaaataaagcaaaatgaattgggatttctatattgcttagcgtaagtgaataaagtggacaagaaacttcactcattttctggaaaaagaagtgggaagagtgaaaagccttgcaaggccaccaccttggtctgttttattgttattgacctatttatatctttctatagtgggaagttgctgaggtggttttggaggtgttttataaattgctcagagattatgagcctcagcttgaagattttgtagaccagtttgtggaactacaaggtaatttaattctgtcactttcaaacaagttgtcaactatttataatttataaattatggctatgttatatataaattaaaaattatacttttaaattagaatttaatcttttgtttcattgttttaatcattttaatttttctgttcaagagaaaaaattattgaatggaagatcaagaacactgcattacaatttctctaatgagttaatagaatagctgactaactgctttgtgcagatttgcccttaggagaattactgctgtgtctctaaattgaaacttgcctttatctatctagatgccatctaatttacaagtctcatacatttcatataaatcaagggtgtgacaaaaatactaacccatcatctcttggaatatgttatgttctatttaggagaagaaatcatagcctataagccacctggatttagtctgatgtatcatctgctgaatgagtcaccaatgttggagcttgctctcagtttactggaagaaggagttaagcagcttgacacctatgccccctttcctggtatatgcttaaaagccttcatgtcttgcaaacagctttgatgttttcatcttttgtaaactgagaatttgaaatagatgatctctgaagtcatttttcactgtaagattctctctctgtatctgaagtggtgttttcagtgaatcatttaaatgagagtattgtaagtaaaaacagactaaagtacagagagaatctcactgtcactgtgtttcactgcagggtcttttgtaggtaaagtgatctttctatcattttaacatctttaacatccctaactttaaagtacttttttgtccatcccccacctcataatatttttaaaaggacttactatagtgcttgatacatagtggtcaataaattttacttgttattattaccactaattattatttattgaatgcttactatgtatttggctcttttaaaagcacattgcatatattaatgcattcaatctattcaaaaatgtgttagatcttcttatttccatttaacaaataaagaagctgaaatacaacgaagttatactg

SEQ ID NO: 127928 - DNA, 1020 bp, Homo sapiens
ctagaagtgtctccagacattgtcaaatgtgccctggggctcagccaccccattctgagaactgttgctctaaacaataagggaaaagataaagaagtgatttgagaatccattccatgggagttttctggattgcaaaataacgatgacttgcatagatgaatggttttgtgaagttggagctgaaattttgaaacaatgagagcataaatctctaggttttgctgctgaaagttggaaacaagagtctgaatctctagatctgaaaatctaaaacttgtcatttgtcttgttttcctaagaattgactgtgagtttttaagataaatttagaactttctaactttatttttggttgatagggaaaaaacacctggagaaagcagtacagcattgccttgcacttctcaatcttactctgcaaaaggaaaatctttttatggaccttctaagagagagtcaactggctctaatagtctgtcctttagaacagcttttgcagggaattaatcccagaactaagaaggcagataatgtggtaaacattgccaggtaagttacctttgtaggtagagaaatgaagtaaacagatagacattctagctttgattttcaaatctggttaggtatctagtgcatcacctttttttttatttttgcctcattttactttttttttttttttttttttgagatggagtctcgctctgtcgtccaggctagagtgcagtggtatgatctcagctcactgcaagctctgcctcctggattcaagcgattctcctgcctcagcctcctgagtagctgggattacaggtgagtgccaccatgctcagctatttttgtgtttttggtagagacggggtttcaccatgttggtgaggctggtcttgaactcctgacctcatgatctgcccgcctcagcctcccaaagtgctgggattataggcgtgaaccaccgcgcccagccttattttactgttgccttctttagctaccctgattttaattactctgaac

SEQ ID NO: 127929 - DNA, 1051 bp, Homo sapiens
atgtgctgatttttgggttgattttggtataaattgttattactgatttaacatcctcctagattattaaaggcaaaatcagctcagaaatagaaaatgggtgataagtaatacatttctaaagagagaagatgaaaattttattttatgttttagttaagatctcgtaacattgactatataatgaagaggtcagtaaacagcaatttcgtgattttttttttttttttaactagcttgatgctttgggaaggaaaattaggaagcaagttttgaaatcaatgaatttataaaacttttgtttctttaattatgtgtatagagagctaacttacggcaacttaaggaactgagttttctattaaaaatgtaactaaaacgtaaatacctaagcaggtttgcctatttttccttatggatgaatatttacatatatcaatcatagtttttctaatatttagaaacctgtaataatttgtcattttttaccttcatgttacttcagagtataagtcagaaactaatggctggatttgtggagtgtttggattgtgaagatgcagaagaatttgtacgtctggaagagggtatgccttagattaatgtgcatacacgcattcttttactttttatatatgcttaatttaaagaaaacacttgtaattgttaactgttttagtgatggtgtaagaggaattgagaatttgctagaatacaggttgagaatgcaaaatccaaaataaaatctgaaaccttttgaccaccaccaacatgactctcaaaggaaatgctcattggttcattttggattttggatttttggatttttggattatacatcaacctgtataatgcaaatattctaaaattcaaaaaaatctgaaatctgaagcacttctagtcccacacatttcagataaagagtactcaacttgtaaatttataaggtttttaggattccactttaaataaatctgaaatgaatgtgatagataatcaggcaaacgatctaaagaaaacatggagttggaatacaagttttgtatttttt

SEQ ID NO: 127930 - DNA, 1745 bp, Homo sapiens
aaatgttaaaccacatcattaattgaggtattataaaatcatgcaatttaagtttaatttttcttatgtatttgttttgtgaaatcaaaaccaaactatgatagttttttgagttatgtatttgaaaattactttaaaatattgttttatatatcagtgtcaaaatacgatagattcaggatctttgtgaaattaaaatcagtaatgaaaacttgattctcttttactcttcatttactttagcccatctttcgtaaatttatactagcttatttttttctttcttggtatcttttttttcctcttgtaattttacagagtgagaaattattatgttgctgagtttcataaattattgactttgttacatgggaaaatatctgttgagttacagaatttaagtctgttttgatactgtgttattactctgggaaacaaaatttacatgtttaaattctagaatatgaaatatctatgctgaaccagatgtcatggcttatgaaaactgcctcaatagagctaagggtaacctctctgaatcgtcagcggtcacatacccagaggctcctacacctcttactggatgacatgccagtgaaaccatactcaggtgagtattagtatttgttttattgtgctggtgactagttgtcgtgaagacaagcacaaatctgaagcttgtgcttagtatgtgactatagaccaaaactatcttctcacttttagaatttttttttcttaaaacacaaaaattttaactcatcttatgattgtcatttattattattttaagcatccatattacactataatcataccggtattatatacaaaattgtcagtggagtttgtcatactgagccagcatgacctaagctatttcagtatgtattattcatgcaaattaagcataaacttttaaaatcatctcattggcatgattgggtcttgccatttttgagaatctgattattctctttacaattgtgcagtggattccatagggacagaaataattagattaatgttggtagtaaatcctcatcaatctttacattttaattatccatttgcacagggctctttgatgtagaaacaatgacctagaaataagataccttgtgtttgttatttccaaataaatagttttaagagtatgttcttctttttctgattcaatattattgatattccaacagatggtgaaggaggaatagaagatgaaaacaggtctgtttctgggttccttcactttgacactgctacaaaaggtaatgccctttgaatttgtaataaatttattttatagacatatattaaaaaaaaaaaaacttcaagggattattatgcctgtgcctccaaactctgaactggtatagaaaagttatataaaggattaattgccacctgaaaattttttttataataggattatacaaaaggaaagaaaatatttttgttaatggatgtatcagaaataaaatcaaatttagattccaatacagttttcagtttcttgactattttatgctctttctgaaaatagcactgtctttgaaaatcaactgaatatgatggcttgcctttcttttcaatgtcccaagtaaaatcaaattactttttattatttctagtacgtcgaaaaattctaaatattcttgactcgattgacttcagtcaggagatccctgagcctttgcagttggatttttttgatcgggcccagattgaacaagttattgcta

SEQ ID NO: 127931 - DNA, 1329 bp, Homo sapiens
taatgattatagctgaaagcaggattctcactctaatttgcccttgtcctttaagatactggatgatgaagctgcgcaagagttaatgcctgtggtcgccggggcagtgttcacactgactgctcacctaagccaggccgtcctcactgaacagaaggaaacatcagtcttgggaccagcagaggcccattacgcttttatgcttgatagttgcttcacctcacctcctcctgaagagaacccattagtgggttttgcttctattggagattcttcactttacatcatattgaagaaactgttagacttcattttgaagacaggtttttttcatttaaattgtctataaattctatcttttgtatttgttttaactttaattgagaaaagattttcatttgacatcttcctaatctccctaggtggtggattccaacgagtgaggactcacttgtatggctctctgctttattacttacagattgcccagagacctgatgaaccagacaccttagaagcaggtagaatgagatcaattcctaatcttttctggattgggagatggttactttaaattgaaaaaaaaaatcacttctccatcttttgactaatcacaactgtaaaaaatgagtgttagtgtcatttttaaagcatttactcaaaagttgaggaagaatgtttagtttttaagaattatgaagtagtacatgagtactacttttaagataaccttcaaataatactttagctttatatacttctgtaactccctcacttgcctcaagtccgactgaacagtgtgctctacatagaatggtccaatgtctttctttcctttgtgctacatcagagtacttatctagttgattcttttaaaatatctcggcctggcatggtggctcacgcctgtaatcctagcactttgggaggccgaggcctgtggatcacctgaggtcaggagttcgagaccagcttggccaatatggtgaaaccccatctctactaaaaatcagaaaattagcagccatggtggcaggcatctgtaatcccagctactcaggaggctgaagcaggagaatcgcttgaacccaggaggcagaggtttcccagattgcgccactgccctccagcctgggcaacaagagtgaaactctgtctcaaaaagaaacacaaaagtctttgttattccatgatatggatgaaacacttatctgccattttccttattcacaggcatttcaattgtttctaaatttttattacaaaaatgctacatcaactttttttatatgcctatatttctcaaaaaggatactgcttaatggtgga

SEQ ID NO: 127932 - DNA, 1246 bp, Homo sapiens
tcccaaagtgctaggattacaggtgtgagccaccacgcctggcaattttaaaagatctcaataaaagataaaagattgattagcggctgggcacggtggctcacacctgtaatcccagcactttgggaggccaaggcaggcagatcacgaggtcaggagatcaagaccatcctggccaacatgatgaaaccccatctgtactaaaaatacaaaaattagctgggcatggtggcatgcacctgtagtcccagctactggggaggctgaggcaggagaatcgcttgaacctgggaggtggaggctgcagtgagccaagatcatgccactgcactccagcctggagacagagccaggctctgtctcaaaaaaaaaaagaaggaaaaaaaaaaagactgatgagcaggataaatacaggacgttggttctcatggagtcttgtaattcattttgatctctttcagaatgatttatccttttccaggtacaattattatcttagtgttatgaaacatgcatgaaataggtgcattgtgttattagagttaacctgcttggacccaccggtcagtgggcctttgtgtacaagcagtgatggaaggatttttttgttgcgttttttttttttcttccttagctcatacctagcatgtgaggtataattactcagttattacactgctttttactggagtgtttttttctgttttaatccttttagccaagaaaaccatgtgggaaaggctgacagcccctgaagatgtatttagcaaattacagcgagaaaacatagccattattgaaagttatggcgccgccctcatggaagtggtctgtcgagatgcttgtgatggtcatgagattggaagggtaaagcaactcttatttagtattataattgaataagtattttgacttattaaggtataaactgattcacggctgggtgtggtgcctcatgcctgtaatctcagtgctttcgaaggccaaggtgggtggatttcttgagtataggagtttgagactagcctgggcaacatggtgaaaccccgtctctacaaaaaatacaaaaaattagccagccatggtggcatgcacctgtagtcccagttacttgggaggctgaggtgggaaaattgcatgagcccaggaggcagaggttgcttgcggtgagctgtgatcgaggcacttcactccagcctgggctgcagagtgagaccctgctgcaaaaaataaaataaaataaatt

SEQ ID NO: 127933 - DNA, 1083 bp, Homo sapiens
ctgcctctgcctccctaagtgttgggatacaggggtgagccactgtgcccaacctagttattatttttctgtgttttctgtaatgagcattataaaacttcacagtgagaaaaaacagctgttaaaaaaatttcttttctctaacaagcaatgttagagtctactaaaatacatctaatgccactagtttaacgtgttaggttttgttttggaaatacatctttacctgagagctttcctttattgataaattgaggttctggagccatagtttttaacttctcaaaaaaaaataaaaaggaaattttgttgcaagtaacattctctttatgaaaaacattcttcatatttcatatctgatgtcagataaattcagttactgttgttgattttggtagcatctacatgttttggactttaatttattcttccttcagatgctggccctggctctacttgatagaattgtctccgtggataaacagcagcagtggcttttgtatctttctaacagtggctacttgaaggtcctcgtagacagcttggtagaagatgaccgtactttgcagagcttactcaccccacagcctccccttttaaaagcactttatacttatgaatctaaaatggtaaggctttctagacatttgatgttagatcaagaagtcgttttctcttggctatagatgtattaaagaaaattaatgtggcatacattctgaatatttctatcataagctggaatccttttttaaggagttttaaactttggaatcttcctagtgtgcaaaagatgagtgaaatgatcctcaaagggatagctggataatgggactgctgcttccctcactcactcaggttgctcatgatggcaatatgacagccagtgctccgtgaggacagagcaaaattgtcctctcacaatacaatttagactatagtagttgcctattgaaaatttccatgtagatatgctagttctattctaaacacagcattttcaatatagtatataattcattgtttctttgcctgcaaatctgttttaatttctttttcctcctagttaaaaggatcacaaat

SEQ ID NO: 127934 - DNA, 1026 bp, Homo sapiens
ttcttaactacattggtccatttttatactgttgtttgaatgaaacactgtagctaattaatagaatcataagacaggaaacaagagattgaaatttgttcttctataaaagaaagcagttattgtgataggagtaagctggcttctaaagtgtaatttaaccaggtatctattgagagagggctatgctaggccttgcaggctgggcatggtggctcacgcctgtaatcccagcacttcgggagactgacagatgataatactgcatttatatatgatagagaatgaaataatttaaatgagtgattttgctgtcaaaatttttttaaataccagaaattagttttattttgattacttttcagtgaaacactaacattccaacacacatttttttaaaaattaatattatatgtaatttagcctttcactgattgattaggcttatcatgaatctacaaccttgtattgctttattgtattttggaactgtgtcctaaaacactttgatttctggtaattttttctgctttctctaccatcaggccttaggccatctcaccaaggtagatgctgctgttctaaagtggcaccttattttatatcatagcaatctgggttgacgtcctacttcttttaggcctatgtggtcttcaagttagtactttttaaaactcagagactttgcctttcttcccctagattgagattaagattttttagtagaagtgggacattatgatataagacactggttccctaacaccaatcttgtattgactgaagcagaatcacctgaggagcctcttagagaagcacagatgactgagttctgtgaccagacattataagcttaggctaggaatctttattaaaaaacaaaaatgatcacaattctgagtgattcacatccttggcttgttttggcatatagtctgcctttaaaatgtttgtaagctagttgagatattcctaagtgaaaatactgaaagaggactccatgagtgtacattataaaatgccaaa

SEQ ID NO: 127935 - DNA, 2841 bp, Homo sapiens
cctcccaaagtgctgggattacaggcgtgagccaccatgcctggttcctatctctattataataaaaatgaatttttttaaaaaaagaattagacaaaagcttttatgtgatttccccatgtcatgctagttactgtttcatagaacagcttcttgaattcactagtcatttttatacccatttatattacattcttactctagttcatttggccaaacaataaagaaaataggggtcagataatagttttcatacagtagttctgagttatattcttctacagtagtctccaaatgtattaacttataagctttaaaataatcctttagtcttgtgaattttaaatgtttacttcctgaagagataaatatgtgagtgcagaaaacaattgcttatctgttactcatcctcacttattgtgaggctgagtattgtattactgagtattatggtaaagttgaaggttacttccttcaacattatttataaaatgaattatgcatttatatataattttctacttctacctgttttttctattcctcttccttttcaatggcttaggtattgcagtttcttatttcacattctgataccatacaagcaattctgcgctgtcaggatgttagtgctgggtctttgcaggaattggctctgctgacaggaattataagtaaagcagcacttcctggtgagttgattatgttgaaaggatttttaataattctttaaagactgacataaattaatagaatgagtttttttgttactttgcagctatatatgacttatttgaaattggtactgctaacagagcctttatttatgtaataagtttatgtttataaaatgatacatgcttggctgggtgtggtggctcatgcctgtgatctcatcactttgaaaggctgaggcaggatgattgcttgaggccaagggttcaagaccagcctgggcaacatagagacaccctgtctctaccaaaaaattttaaaaattagctgggtgttggggcattcacctgtggtcctggctacttgggaggttgaggtaggaggattacttgagttgggaaggttgagactgcagtcagccaagattatgccactgcaatccagtctgggcaacagaacaagactccgtctctgttttgttttgttttttttttttaagatataggcttattataaaaatattcaaaaggagataactaacactcaaaatctcaccacctagaaattaccaaatgttgacatttgataaattttcaaacattgctttatgtgtacgtacatatgagaaagggagggggagagagagaaagaaagcaacagagacatacagaggcaactaatgagaataggatgaccttttacatgctgttttaaaaaacaaatatttaattttacatgaatttatttatttttttattatactttaagctctagggtacatgtgcacaacattcaggtttgttacataggtatacatgtgaattttacatgaacacagacaaaaatctaattgaagagaaacgaaaggaattgccaaattccagacaaatgtttctttactactagagtatgtcaccttttaaaagatcactgcgagtaaggaaaaacattatgaaacattattaagatactttggttactttccccccttataatttctttactacatgtaaattttgaatcagttaactccctgatgggaaagatgaaatgatgacttcttttacacttcctcttccaccctcagatgatgtttgcttatatcattttaaccttgtcaggttttgtaacatttacatctgttatgcaaccataatatcctcagctacttagttttagttgtatatttacatggattcactgcaaaacaccagttgtgttccccaccatggcgtcaccattcacgagttctttcttttgatttatctcttggtatttttttttttctttctttctttctttctttttttttttgagacggagtcttgctctgtcgcccaggctagagtgcagtggcgcgatctcggctcactgcaagctccgcctccccgattcacgccattctcctgcctcagcctcccgagcagctgggactacaggcgcccgccaccacgcctggctaattttttgtatttttagtagagacggggtttcaccgtgttagccaggtcttgatctcctgaccttgtaatctgcccgcctcggcctcccaaagtgctgggattgcaggcttgagccaccgcgcccggcctatctcttggtatttttaatttgtactgaggttccttccctcaagaaaaagcatgctgtctcatattcctgaaattctctaagaatgtctgaaggttgtctttgttctttaatgacaggacggccgattatgattttcttttgcttagaatatgtaatataaatgatagtagctggcatttattaagcatgtatgtgccaggtactgttttaaatacttgacatgttaattgattggaagacacagcagtcttatgaggtagaactgtcattatccacattttacagctgaggaggctgaggcacagggaggttaacttgtccaaagtcacacagataacactgcatagtatagagtttcccaggcagtacgtcttttgaatctatatatgtaactacgaggctacactacctccatttttatgttgctttggagatgtctgaggcaacctctgaatccaccctataatccccaataattttttttgtctgggctgtctcggtggctgagccctctgggttgagagacgttgagagttggccagggctgagtacagtgccagctgagttacttgg

SEQ ID NO: 127936 - DNA, 1036 bp, Homo sapiens
aattgtgtatattgtttttgatgtggaggggtgtgtgtgtgtgtgtgtgtgtgtgtgtgtgtgtgtgtaaggtttatactttgatagagttctcaaaggactctttgcctaataaagggtaggctctgccaatgtgcatcagtcagatttctttattctcgcaggatttccagccttatgtatgtacctgattacagtggctcctaaccatttgttctttaaattataaatggcatttaaaagtaatcttgggttggttttaatgacaggttacatgtccttaaattctggggcatcccttgttttaaaacaggtcatttgaaattcatatgaaatgcttataagtggaacattgttttatgtcatcacctctattagatacccaagctccagtggttccatactggcgcctgcctggtttaggcattatcatctacctgctgaaacagagtgctaatgatttcttcagctattatgacagtcatcgacagagtgtcagcaagctacaaaatgtagagcagcttcccccagatgagataaaagaggtacgaatcttataatgagctggggggacttgagaaatcattgctgttactaggccagggtactcagactgagtaaagacaacgtatacagtatgactgaaggaattggaatgattcttctgtgtgatttgaagaagactccttcgccgtagcaccagccttataagcatagaaactcttgactgaaaaacagtgaagtgtagcacctgttcaagaaaatagaaaggcagctggcctttgaatgaagagttttgggtcatttatactctaaaatctgttctgagaaaggcttctgttacagattttttttttaatagaacttgggtaaatgtctctgtgccttcagcatcttcaatatctgtttagcaaatctttcaaacaaatgggatagcatatgagacttgactgccttccctcagtgacccagaagcattccctctacttacagtattaataactaaagatgctgcattaccaggattgctactaag

SEQ ID NO: 127937 - DNA, 1050 bp, Homo sapiens
tttatgaaatcatgcacttgaatgatgaccttgaaatataggaactgttcacttattctcatattatttgggcaccaaaaccaggtggaaggagataaacttaattttttcccagtaaatgcctaatgtatttccaaatcatagtttttgttcttatcttttagagtagctggtaatactgataaaatacatgggcactttctgttagggaagaaggtagggacatgagactgctggcacaggaccccaaggtccccacctctttcctcagcacaccttgctgcttcctcttgaggagccttcagtgagaccctgtctgttagactgaggctgtgggtacctcattaagtgagtgcagtctgtccttttttcttctcctccgaaactggtgtgtaaaacatatttgatgagattatgttcctttaatctgagctctggtatagttatcatagagacctgcctatttattctttggcgccatctggagtactacttgttacattgcatgcccacggattctcaagattccttatttgcctcgagaaccttgtttaaaagcagaagactgcaaggtaaactttctgctaaaaattaatgaaccataaatacctatttgtgccttgaaaagctagtaccagtttttttttatttttgtttccagattacttagagtgaattgggtgaatcaagagctgtttagtcactagacgtagctatttcttgcattttactttctgttcacgggacattgtgctgagcataagaatattctagagcctgctcatcagctgttccttagcttcttgctgcagttagggggctgatccagctctagaagaatggaggaggtctgctattatgctgattcttattgctggagtgggcctctgtgactgatggccatatattggatcccttaggtggaaggaaatagagaaaagctgagaaccctggtctggaccagtgaaatgctttctaggggcttccatttgctaaaagttgaaaattgagttcccaatcttgagccgtgtttttcatggtgctattgtt

SEQ ID NO: 127938 - DNA, 1277 bp, Homo sapiens
acaaaagcatgcaagtgggtttttaaaaattgcaaaatgaagtaaaaagtaaaagcttctttcccacctaccctcctgtcctccctccctcccttccttccctgcattctccttccctccctcccccgccagtcttactgacttcttgtatggcccttcaggaaatgtttttgtgtgtatgttagtatatcagcatcagcatcaacattcattgctatttaaagcaggtttttaaatttatacaagaaaagaaagcaggaaaaacatgagaattaaaccaaaaaattctaaggtagaaaatgtgaatgtttagttaatttagtaacacattacaaaaattcaaaagtatttacattgaaagaaccacattacaaaaattctaaagtgttttaaattggaagacttagaataaaagaaatatttgagacaacaattttaacaaaatgtcttttgtgtcaccgctagcttcaggctgatgcaatcaacgcttttggagaatcactacaaaagaaacttctggacattgaaggattatattcaaaagttcgatctcgatatagtttcatacaggctcttgtcagacgtatccgtggcctcttgaggatatcaaggaactgagagcccgtgcttatgctcttctatgagagagatgaattggggagaattgtctccattttatagattagtttctttctaaattatgaccaaaaatattttgctatttctttctttgtatatggacatcttttctgtaaacttcttcccctagttccatcctcactagtaaaaaataaatactttttaaaaaaacaaaacaaatgtatggttaatcttttgatcttttatcttttgatcagcattatcaggaatctaacaaataaacctacaacagtggtgattttcccatagagatattattctgaatgccagattaaaggcatagtctgaaaattctaattttttcaccctttgtagctacattacactattaacaatattcagggttactaaaatatagccatgctcttatagaatagtgtactcaatactgtgaaaatgtctgaaaaagtcaagctttttcctaaaattatttaggttttccttttttttgtttttttcttttctgcacgtaagttgacaatacaattgtcccttggtatctggtgattactggttctagggctcccacggataccaaaacctatgttttggcatgcatgttccttatataaaatggcattgtgtttgcatataatatagatacatcttcttgtata

SEQ ID NO: 127939 - DNA, 1015 bp, Homo sapiens
gactgaatactttaaaaactgaataatttttatttgatttaaaaaggaataacaatatccataaccaaaaaaagacaaaaaaattgcagcatgcaacaagaaaaatctgaactttggcttgagtttccaggacttgtagtcaagtatttatgtgggttgtgaggggataagagaatttagggtagctttatacagtgttaccatttattcttttttgttgttttatttttttcttatgtttggttggtgtcaccatttattcttttgtatgctgtttagcctctggagagggcatctctgtgtttatagaagaaaaatgtgactctcatgttgtacacagccctagactggacatcaaggtcttctaactgtcctaagcttcttaggaagatattgtctatgtattttagtttggaatcagactggcacaggactcggcatgcactataactcttactgttctattttttcagcttggatttacactgggcaacgtggttggaatgtatctggctcagaactatgatgtaagtggccatatccatgacttccttgattccatgtaactgttttagagtgacttttctttgtttgaggtaaggtgtgacttccagcataaatgtagtccatatggctgaggcaaaactcctgaatattgtagaatggtttgccattgtttgaaaaagtaatccaactcatgaaacagctgtcctccatatcaccacaagagggcaaaatcccttcagtttagctgggctcatgatcatcctcagctgtggcttgttagccgagagtaatattaagttgggctcttaaaattctttgggaaatcatgtgataagtgagaatttaaaaattaattggataatattttcagccccactatccagtagtagagatgacttagaattttggagatgcatctgggtagggggactgaaaaatatagatctatattccatctccaaaattctaagtgtagcacatttggggacagagttttgtgaagttgtat

SEQ ID NO: 127940 - DNA, 1070 bp, Homo sapiens
gaaataaccactatttagcagatctcttttggaggaagataaaagcttgtaaaaccatttatctttggaggaagagaagtacaagaatattgattaggtagatgcaaaattataataaccttttttctcttcaaagataccaaacctggctaaaaaacttgaagaaattaaaaaggacttggatgccaagaagaaaccccctagtgcatgagactgcctccagcactgccttcaggatatactgattctactgctcttgagggcctcgtttactatctgaaccaaaagcttttgttttcgtctccagcctcagcacttctcttctttgctagaccctgtgttttttgctttaaagcaagcaaaatggggccccaatttgagaactacccgacatttccaacatactcacctcttcccataatccctttccaactgcatgggaggttctaagactggaattatggtgctagattagtaaacatgacttttaatgagtagtgtcttctttatcgtttgcgatttttactaccttttttcaaaagaaaaattgatgagttttgtatagctggtcagatacaaataatagtgacttcacagtttagtaattataatgggtacttgttaaacatttggtactaaattatgttgctgcaaagtaattaaaattagtatctagagctagtttctggtgaattattcatttattttgtactgttgttaggcagctctgtagttgctaatttaaccaataagtcaatttgctattcatgaagaaacgattctgagaatcctgtcaggaattggggaatgaaaaaatacacaaaataatggtctttgtcccagtagagttcatagtctatttagtgtgcatgtttttccttaatgatgtatttgatctgacttttttccttctcaaaagaatcatacttgggattacaggtacatttgatgttatatgatggataagtgaaaagtttttaaaggagattttataccttttcacattaaaaaaggtatttatattattactttgtagtgattgtcttaagaaaaaatatagcccaaatgta

SEQ ID NO: 127941 - DNA, 1071 bp, Homo sapiens
gtataagtcctgttctttttagaataacatacaacgaggctttttcaccaaggtgtgctggagacagctcatcccagcttgcaagagctgactgataaattttcagaaattttgtgagcaggttaacatcatcttgagagcttgaagtcagccatgatgagattatttacaccacaaaaattcgcaaatattacaaatcagcactggtggttaagcatttaccagcacactaccactggctactgaatccctggaattttttaggtactcagagagggtcagagctcgacttaattcactttttaattctccctagggaaaaaaaaaaaaaaaaaaaaacaggaaaaacagaaataaagagcccctaaaatgttgggattagaggggatgctagaggccatctagtgaaaacactgtggacaagagaggtgacaagaacgtaatgctaacgagtatggacaaagagaacgagatccagaaccctatttccagccactgctctctgcaacatcccacacggactctacaaaaacaacagcaaaagagaataattgttttcactccactgtccctgcagtaaattttcccattttaaaaatgaaatatttgatttatttttttttttttttttttttttttttttgagatagagtcttgttctgtcacccagctagaatgcagtggcgagatcttggctccctgcaacctctgcctcccaggttcaagcaattctcgtgcctcagcctcctgagtagctgggactacaggtgtgtgccaccacacctggctaatttttttatttttagtagagacagggtttcaccatgtcaagcaatctgcccacctcagcctccaaagtgctaggattacaggcgtgagccaccgcgaccggcatgaaacatttgattttcaccatgcatttcctcaacctgagaagcaggcagctcaataatttcccataggttttacagaaaaagagccacttcttgcttctctgaagatttctagggagggagtgagagctgttctcagcaaggtggattatctgccttcaggtgacgggactattga

SEQ ID NO: 127942 - DNA, 1071 bp, Homo sapiens; identical to SEQ ID NO: 127941

SEQ ID NO: 127943 - DNA, 1039 bp, Homo sapiens
gccacccacacacagaatcacattggcatctcagttaatgctacgaaccagagcctcccatctgtgaaatgggaataatataggaatctccagatgggaagatcctttggcagcaacctggtttgtcccctgctccaggggccaccaatgctctccacgttcttgcagatggtgtcccagctcttacataagcacttcctggaatctaaatatcccacagagaaattcttccttctgcctgatttcaattcctccagggaaattccagctcattttgttctccataaaatagaaaacccttttcacaaaagatttgagtatattcaaacattacaaagtcaagaaaggaaggtttataaaatattcacacataaccttaccagcctaccttttcatttttctttatccccttccaaatataagccatatgtataaatatttgcaacacttataatcctaacgtagacaccattttgtagcgttcctcttctcattaaaaagcttcttcacacacaagctaatttacatctccgtcattcaggcaaatcgtcctcactgccatccttcctgtacaggttattccaggactcctcacccatgctccggaaaatgcagaatgggtgcttttgtgtgggggatgtgatgataaacttgatgtgacaacttgactggccacagggtgcccagattaagcattgcttctgggtgtgtctgtgagggtgtttctggatgggattagcatttggatcagtggactccataaagcagattgccctctcctatgtggatggacgttttccaatctgttgagggcctgaatagaacaaatggtggagggagcaggaattcaccccctctttctagcctcactacttgagctgggacatatcatcttctctctggacctcagactgggatctataccatctgctccccttgttctcaggccttcacgcctgtactgaattacaccactgtctttcctgggcctccagcttgcagatggcagatggcagactgtgggacttctcagcctcca

SEQ ID NO: 127944 - DNA, 1039 bp, Homo sapiens; identical to SEQ ID NO: 127943

SEQ ID NO: 127945 - DNA, 1109 bp, Homo sapiens
tatggtggcaagtgcctgtagacccagctacttgggaggctgaggtgggaggattgcttgagactgagaggtttgaggctacagtgagtgagctgtgtttgtgccactgcactccagtctaggcgacaaagcgagacccactctgaaaaaaagaattggggtctgtaaagaaagtttaaatctggttaaatacattttaaagggaatagagtccccttatataatgattgaagaacagaccagcatatgtggatggaaggcacacacctggtggaaagaaggagcttagagggaaattagtttgccattagagaatagctgtcataggacttttcatgcagcacagtataccagaccaccataagatttttttttttctctttctgtagcatcagtgattctcaaaatgtggtctctacaccaacagcattgccataacctggaagcttgataaaaatgcaagcttttggacgctagccaagacctactgaatcaaactcgggctggacccaacagtctatgttgtaacaagccctctaggtgattctgatgcgtgctgaagtttgaggaccattgaataagaccataagagcaagaaacagtcaaatagcctataaatagatgccatcaggcatgacttcctaaagagaaagtaaatggaagcctttaacatgtgaaatgtagcaaaactggccaagttttgaagctccagatgtccaggaaaatctttaaaaatgagtttcaaaggtatattctggccaaaagaagtcagggtgaaatgtaacaatggttccaaaggtgtaatactggtgaaaatgacccttagttattcttaggaggtttttccgccttatgtccccaaagctggattcctgagactcaagccttacccttaccttacctttccttgaattccaaagtaaagtggaaggtggaagccaggcacagtggctcacgcctgtaatcccagcactatgggaggccaaggtgggcagatcacttcaggtcaggagtttgagaccagcctggccaacatgggaaaaccccatctctaccaataatacaaaaattagttgggtgtgatggcgcacgcagctccttgggagggt

SEQ ID NO: 127946 - DNA, 1109 bp, Homo sapiens; identical to SEQ ID NO: 127945

SEQ ID NO: 127947 - DNA, 3604 bp, Homo sapiens
agtaaaatgacgaatacagtatttgttcttgatgtatataatactgaatgcactctacaaaaagtgtttcaaataagaaaaaaataatttgtcacaggaatactttagcaaagtgatttactttttccccgtttcatactgcacatagggatattatttttaaagcctaattagataaatatatctaacttgctcaacgtgctcttcctaatcatctcatccatgatagtataaataaaagccagtgattgcctgggttacaattcttagtgcctgaaaaataatgtggcatttttataattaatccataatgttgccaacttgtttgtttttctgcagtagaatagactccactagtaaaggaatttttaattcttgatgtaaacattaacctgtgccatgtgagctagtcttacattcccttcccccagttgtgggctcatttaatgagccctttcctctcttttccagggtgctgataagactgtgaaaggcccagatggactgaccgcctttgaagccactgacaaccaggcaatcaaagctcttctccagtgatggatggatggactgataactccggaagaatgactctcctgtggcctcacactgctgcctgtctgtctgtcactctctatctgccagcttcttcagctaaatactttaagaggggtgaggggagagagaaattcataacaaatccgactaccagaaaaaaaaaattgttttggaggaggggcaaaaggaaccatgatcaggcttttactgggattcctgatcaagtaagcctcttccctttctaataaaatatacaccttatacccaagggagagcaaagacaaaatacaccagtaacatttgaccttttcagctccctagctaatttattagattgtgttgaaggtctgattctacaaaggccaactctacatatttggtagccctaactgtctgagcagtagtggctgctgtgatgtaaacttagggtgctgagataagcaattagctctagccttctgccttaagaatgcactctactggggatttcctggcatagttaagagcgctgcctataaggttggtgaccaaatctttcctcggtgactttaagctttatgtgaaagcttagttaaggtgaggaggggcacactcctaaattgctggatgactgaactttggattttctctcccctttcacatggatttcatgtctctttagataaaactgactagttttatttataaaatcttaagttttggaagtctaaaggagaaaccattccagtatgcatatttttttctcctctagattcatacatttatatagcattgaaacactttcaaactcctgctggtagtaaaaggggatttaaaaatagaatcatagccataagcctgttagtatcatatgaagagagaacagttatcttagtacctatggattttctttatttgctgtttgaatggattgaccttggttatgtgttgagaattaaggaacattctttgaaatgcctctctcagacccatcttggaggctgattacttactgcaccaaagctatcactggggtgagatttactgtttggacaaatttagccccatcccttcaaaaatacacttgtaaccaggtttcccagagttgttgataggcttctgctgaacatatgccaacccacctgcataatatatttttgttgcttttataaatcatgcattacataaagtgtgacaacttcaaaatgtattctctgttcttggaatacagtgccctaaaatggtgttcttatgacctgcagaaaatatttacacatatttccaaatatttatttcatgagcagtacagctaattaaaatatataagcttaaattttatatcttacatttaaaatattaagattcctttgacttgccatccatataagcttgctaaaaatattaagaccaagtcatgcaataattgaatgtacctcaaatttttaggggagggtgggttagggactgatactcagattgtggataataattgaattggtttttaaaggcaacatagcattctacagcagggttaatctattatcaagaacagtcaccctggttaataacaagttttactgatcagttgctggttggttggttggttggcatgtgggtgtgtgggtgtataggtgtgtgtgggtgtgtgtgtgtatttttccccatgagtcctttttttaatcctgtggctttttcacttacaactagcctaaccctgtaattttcctacatccaagaaaacaatcacaaagtagtggtttaaatactttgttgtatttggctaattttgctgtcttaatgcagcctattaagagttgggttaaaaatcagtaatcagtactttattacatcactgaactaaaatatggagacatcctcattgaaaatggagggcactctatcagtctataactatcaacgtagtgcaacagggtgttttgatacctttgttttcacctcttgacataatgctatttaaaggcttgaatttttccctttatataattttcacctttactttcaaagtgttttgttgtagttggctattgcagagagtgcattgtcctatcattcctaaacctggtctgctttctacattcatggtatggaaaccatgtgattctttgtacagtttatcctgatgttgcttgtaatgcagtagaggctatttcgccttcgcttttctttctcgacctttttgtaaaccctataattatgaagcgattgcttgagaaaataacatataaacatagaatagaatagactgaccaagatggttcacagtttctttttttaactaggttatttataatgtatttctgaaccacttggcagacaaattcacaacacttaatgttcatattttgagtaaaggaagctaaaaccatgtttgctttctggtactacatgcattagcgaaaggttaagtaagttttgttctccactgaagtaatacttaacatctcagaaaaaattttgcatgttctgtagttttgtattaaatcagtcatttcatatgcactatatcaagtacaaacaggtagtttacctgtttatagtagtgtactaacaaagtctcccttgcagcttcagactgttatctataggcttatcgttcaaatacagcacttgaatatcccaagtagttcttctacgcatagctcacctttctaaacccagttaagcatggaagagaggtagtaggtaggtgcagtgtgtggaagctgcaaacaagtaggccttttattcattgatatcttttcccaagtactggattttaaatctgtatgtatctgtttgatttttttttctaatatttcagttgagctgctgttttcttccatgcaatattgtatactcaattgtgtatagaagaagctggtgagagtgccctcctacataaataagcaattgcagtgttttgcatgcaaaatataaaaaatttaaattgtcctgattctattttgtaaatggagaaacaatcatatctttctaagcggtaatggaggaagactagtgctttgtgcattttgatatatttgagttcattttttccacaatgtcatac

SEQ ID NO: 127948 - DNA, 1031 bp, Homo sapiens
ctctgtcctcctaggaaaaacaaaacaggatatattttttattctatagagaacccaaaccattgttctgtactccttattcccaaaacatgaggcttcaggtcattgagaccttgtggttgtaagtttccgttgttaaagagttgaaaacattaaatgagttcctgaaaagttggcttgatttgcatgtacattaggccctaagatgtcatcccagaaggttctctgtgtgtgtactgtgttgctaaattattgattgtgagttgtcttacttttaactagtttgttttttcttttgcttatgcccattttgttcttttgtgtctgaaccttgactttttttagccaaataagtgacatttggagatagctatgttggtagcagaccgtttgtaaccatgtagagctgttgttttatatgaaagagattttcttctttttgaaatcagcatagtacattttagttctgctttttcaaaattaattactttgattttattattgcataagcttctttaatggataccctgtagttttgttaggcagattttttttgaaaattgattatactctttcaaaaattcttagttgctaaaatagagttgttccagtgcatcttttaaaagttataatcagtgtttatattaagtctaatttgttctgccttttatcaaaagtagaattcttatggattattatgaattcacttgaaaagacttggtttaagaactttccagattcattgacatttccaatacattatccagttgatttatccttagcatacgaaaaaaggcaaaataataaacagggatttagaaactcagtatgatcacaactaataggggagaaatcagaaaaacaaacatgattgctagaatatttgaaatcaaactttatatgatatgctgtatcatttataatttattataaacccaaatacttaggtattattatctctcttttatggataaggaaaccatttatctcggggtggtctaactgcttgaaagtcaaatacaatgtaatgg

SEQ ID NO: 127949 - DNA, 1031 bp, Homo sapiens; identical to SEQ ID NO: 127948

SEQ ID NO: 127950 - DNA, 1031 bp, Homo sapiens; identical to SEQ ID NO: 127948

SEQ ID NO: 127951 - DNA, 1017 bp, Homo sapiens
ctaaccatgggatctgcagataaagacagctttaattcttccttttcgaaatggatgccttttatttcttttcatgcctggttgtactgattagaaccgctagtgcaacattgaagtggtaagaacagacatccttgtcttattcctgatcttaggaggaaagcattcagtctttcaccaattaagtatgatcttaaatgtaggttttttgtaggccaaggaagtttccttcttatcctagtttgctaaattctgatgacaaatgcatattgggtttttttttttttataatccattgagatggtcaatcatatggctttctctgtgttaaaatggtaaattatattcactgacttttcgaatattaaatcaaccttattcctgggataaaccccactggtcatggtatattatcctttttacatagtgttggattacgtttgctaaaattttgtgtaaaatttttccatcacttgtcatgaggaatattggcatacagtattttcttataacatctttgtcttgttttggaatcaaagtaatgctgaactcatagaatgagttgagataacatcccatcgcttccattttcgggaagagtgggtagaattggtattatttcttcccttaaatgtctggtagaattcacagtggtgccatctggagtctgaaggtttctttgtggggaggtaatctgttgtccaatattggcactttgtatcttcgctcttttcctgatgacgtttgctagaggcttatcagttgtattgatcttgaagaatcagcttgtgattcctctcatttttctgttttctgtttctttgatttttaccctgatctttattcttttctcttgcttattttggatttaattttttttctagtttcttatgatggaaatacaaagattattcatttgaaatctttctatttttccagtacaggcatttagtgctataaatttctctataagtactgctttgctaaggccctgctgacaaggatttttttctgtca

SEQ ID NO: 127952 - DNA, 1017 bp, Homo sapiens; identical to SEQ ID NO: 127951

SEQ ID NO: 127953 - DNA, 1017 bp, Homo sapiens; identical to SEQ ID NO: 127951

SEQ ID NO: 127954 - DNA, 1032 bp, Homo sapiens
atggtaattatccattgagactactaaaaggtgagctttctggtggattttgaggatccaacatgcttacaggtgagtgcttgtgagttgcattgataaatagccccttttaatcttcagcaggtctgatacatgtactctcttgtttacatgtacttctatttcacttgctgtgaaatagaagcctggtctctaacttccctttctctgtggtttcctttccctccagcctccattctaattacatctgccgttgacactctaataggtttgaaaagcaacaattgtgcaccatgtgaaaggatagaatctcttgaacctgagaaagatatcaactctaatctttagaaattccaagactcattgagatcacttttcactttcctaataaaatagccaatttaaaagaggtcctgattcaatctactttgcatttattggttttaggcagcttcccttttttttcttctttaaattattagtttctttcttataaaaatgtatcactgtgtgttgccctttctacagaagggctggtgacctattcagaaagcatatgtcagcttgtataagatacaggtgccctcagtagacagagaaacattagtatagattcttttctaattattaatgcttttagtcattttaaaaaatatataaaatagaggaagatctttttttacattggaacataaatgttcattcagatgtacataggctatataaagtgttttggtttgagattctaaacattttccttttattagtgcagataattaaaaatttaatgaattaaaactgatagaaattataacaatattatgagcttgttatttaaaaaagcaaagctgtattgaataaagtaaaatatcccattgactatttttcctacctatgtggttcctctctttaaaatataaaattgattaggtgtttttaaaacagaaaagaataaagaagacaaaaattggccaaaattttactatttagataactcctaacttttaaaaagtaaaattaaattaattcaga

SEQ ID NO: 127955 - DNA, 1032 bp, Homo sapiens; identical to SEQ ID NO: 127954

SEQ ID NO: 127956 - DNA, 1032 bp, Homo sapiens; identical to SEQ ID NO: 127954

SEQ ID NO: 127957 - DNA, 1047 bp, Homo sapiens
tccctgatttcacctgaaatgcttacatgtgtagtaaatagcaatgcagtttagtggcagtgtatttggggggtaaaatcatgatgaagaaagacaaactcaaacctcagccccaaatataaaactgaatcgacattgtggcagagtgggaaacttaaaattccaagctagcctgtctttccatcctgaaactgtgcctttgtaattatgagagaacttaacatgtgattttaatttagtgataatctaaaatgaatcttccaaaacaagtataattttatgacaaccacggatggcatcttgctcaccttctaaaagtgtgagaacccagtctagattttaactcttcaaagaataggacctgacctgggtttttgcttcagaggctgtgttaggaagcaagtaagcgaagcagtttcttaaaacttacaggattgtgcaaggcaaactgctgaaggtttttactttatttaatgccattacaatttagactttttggatgctgcttacctgcttagttttttgcagtggagttttaggacaggctgtcttctcgtcactgccttctcagctggtagccaactgaaacttgacttattggctatttcaatataaagctaaaaggtagaaattatttggtacacttaccagtggtgggacactgcaatactctggaagtaagtgggcttttgttttcctgtcatggtggaacctaggttgtttgatatacttgaaatacaaaaagttgattaagtactaactgaacttacagctaccaaaataacacaatgtatttagtgttttcctgacacattattttatgtcatccttgtgaatactgggaagtaagtcctattattggtcccattttacagattactgagatgcaggatacttaagaaaagttatggagatggtaaattgtgaagcaagaactaaattgctgactccaaaactgaaactctttaactgctccacgcactatctctcagtctaagatctaattgtgaaagcgtatcataccaagatttctagtaggacattccc

SEQ ID NO: 127958 - DNA, 1047 bp, Homo sapiens; identical to SEQ ID NO: 127957

SEQ ID NO: 127959 - DNA, 1047 bp, Homo sapiens; identical to SEQ ID NO: 127957

SEQ ID NO: 127960 - DNA, 1051 bp, Homo sapiens
cataatatgtacctaagcaccttgctctgtgatcaaatttaacaccctactaacttctaaggtcacagttgctactagtctcattccctagatgagaagacagagaacaagaaatggtaggaaacttgcctatgattgcatgctatacattgataaagttgacatcgtagcatttaaggcatttatctctgctgtcaatatcacttctggtcattttcttgtgtgtgcatatatgtatgtatatttatctctattatttatatattttaatccaatcatattatataaacttttaaaagaaacttgattatgaagaataacagttcaattctgagtgttgcaaatgtgtgaatctttggtgtcataggtttatagttcaagtgttgttataataaaatttcagaatgacaaatttcaggtaaaaatagcaccactaagtaatttgaagtcttttagaatcgtaaggagtggcatttgaactgagaaacaggcttatcaggaaatgtcatgctgacatccacagtggaggaatcgttcctgtgttcttatattagtaacagtccacccagagctcggcaatcagtccacttatgtaaaggcgcaatacacttagggccccttccacatttaacattctatcttattgctttcaaatttatttttagaggtgaattatttatgtcctcataggtgtagaaatagtcttaccactcagcacttttcatacagtaaaaggttacttcaaaagtgcagcggatatttactgcgggttttgttgccttgagtgtgcagggaataagggagctcttgcagaagtcagacttgggggtaaaggagaaagtttgcaggaaggtttgggggtagtacatgtgccaggtatgtttggcagggaaaaggagggggaaacatttatgaaatttttaaaaaataaaaataaatttcacaaatagaaatctgactttagagatacaattagtccaacagatacaacacttgttttttagatttttctatgtttttaatagataagtgaaaattagggtctgaatag

SEQ ID NO: 127961 - DNA, 1025 bp, Homo sapiens
gaagcttttttttaatgtgtttgacttatagaaattggatagaaaacagctaaagtataaagaagagtaccatatggatattgtaagtttcttttcctactaaacttggaatagttagacgtgcaatagaaatccatatttaattctctttccaacagcttaagaaatggaaagacttcttggtgtagccagggaacaccaatccagataattaaagggtttatttaaaatgggtttttaaagagatgtatgggaaactggggcaagttttcctggaaaatataaataacttaaaaacagactaaattgggatatgatttaggtgatggtgaccagatgttctccttagctatcagtagatgttaagacatgggttagaattgtggccaaaagaacataaatggtagaggaggtgaacatgtctgtgcttttggcaggatcaccaacccatgctgtcattactaagaactggtattttgtttaagtgcaggaactggatattctcaaataagaaggctgaagagtaagacatgattttggcattgttctatgtgtttagtttctctctcggtccttcatttagtggagaccatttctaaggctcacttggactctgaatcattacataggctttgaatcaagagcttccatgtggggtcattccttactttcattagagaccaagccaatccaattttcttttttctgcatttatatctgtcttgttccctctcttatttcacttttttcttaatgaaaggaagttctccttctagtgaaacagaaaatcttgctaatcaaggggcatatgaagcactgtaaaaaacatacttttgaaatcttgagggttaaaacacttatctctcagagaagacaggtacagttcaatttgggacacaaaccggataattagctggaaacatttctcgtctttatttactttaatatttaccttccacttgagtcgcagaaggaaaagcgggagaaccagccattcccactctcacattttccgcatgctttct

SEQ ID NO: 127962 - DNA, 1097 bp, Homo sapiens
tgagggagcctgcaagatagtaaagctgatttatcagaactagagaaaaagaattatgtacttcgtatcaaaataatttttctaaatttgatgcaaaactgatcaacgtcctatgagagaataaaactataaactttaaagcaatcatctcttcttgacatttgtgtctctataggacagaaatctatgttaacctacagttacacaattcttaggcctgcgaaacactattttagtatgacattataaggacattcaaactcctttttgccatttcaaattttggtcaatttttctaattagttataagactaaacccaaagtattatttatcttagaaaaagattaaacagggatatgattctagtatataagtatcaatttcctgcctaaacttataataggtactaggtctgtccataattatgttttcataatgtttcattaaggaaaatagagggatattcaggaaaacactatcaatttccaagatgatactatagagggcaaccatttaataagtacttatatgggccatgtaccatgttaagtgctttatgtacattttagtttaattagtaaacaatcgtgtgaggtacgtattattatccccattttgaaaatcaagtaaatgagtctcagtgaggttaaataatttagtcaaggttatgcagccagcatgagtcagaattgaaattcagtcttattctgagttttatattccctcctatgccctgttatactaccaaagtcttaaactctgagaaatttacaagggtgtttctagttaaacgcacgcatgaatgggtttagttttgcttgtgtgatagaacatgtgcaaaatggtcctttttcctttaaccattttgtaactgcctgtgataagcgacctttctgttccctactcactgaatgaaaacatacatgttttaaagaaaaataaaaccattctgtttagctcttggaagcctctgtttctcaaactgttttctttgtaacttatttatctttcttatatctcttctggcccccgatacgcctgtaggtgggctggatcctttccatcctggatgaactgcagctgagccctcagcctc

SEQ ID NO: 127963 - DNA, 1313 bp, Homo sapiens
aggccgaggcaggtggatcacctgaggtcgggagttcaagaccagcctgactaacatggagaaaccccatctctactaaaaatagaaaattagccggggtagtgatgcatgcctgcaatcccggcggcattacaggaggctgaggcaggagaatcgcttgaacccaggaggcggaggttgcggtaagccgagatcgtgccattgcactccagcctgggcaaaaagagcgaaactccctctcaaaaaaaaaaaaaaaaaaaaaaaaaaaaaaagacacacagagacacacacacagagaagaaggccatgtggtgatgggggcaggaattagagtgaggcagctgcaagccaaggccctccgaggatcgtggctctcctcagaagctaagagacaggcatgaaattcattctccctccaagccttcaaaagggtgttcaaccttgttgaaaccttgatttcagacttctagcctctaggagtgtgagagaatacatttctgttgttttaagctacccagtttgggttccccacagaacacccattgccattgagtgggatcttagtattcagtggaaaagtgtttgagaaatgctcacacaatgtttgcagttttcctaggactcatactcatcatctctgatccataacaacaaccttttggggtggtcatatcgggctgttcacttctacctaaagataaagaagagtcagagaggcttactcactatccagagctttatggcttctttgctttcttagggcagtgctaggaacctaatatagtagccattctataagtcgagttaccttatctagccatgcagataccgcagttacataggctcactgacacgtatgcacacaggtgcgtctacagcaggcttgagtgtttaggttgagtggtatgtggttgaggtgtaagtgagcagacaggcaggttggtgtcagaagctgggagctgcagggaacagagtaggtagatggtgaggtgagtgagcgtgtatgttgtgtaagaggaaaaatggaactgtcagacttcaggatgctgttaccagatatatcttctctatttttaaatgtgagcatgccaccctctttttgtggaccagctaataggtactgctttgcttttgttattgttttgttcttgtattttgctttagtcttttcctcgtagataatgtttggtgaaaatggcttaaccctacctgtgacaccctgccttaattctaagttttcttctaatgttgcttgcaatttgccaaatacagttttactgagaaagtgaatgaattgagttagagaggccatg

SEQ ID NO: 127964 - DNA, 1037 bp, Homo sapiens
aataaatcgagtttccatcaaagcttatagaaggatatgtatagcccccaacgattttaaccaggctgcctaaaagcacaaagtcccagaaccaagaccttttttgttgctttagctgttttaactccttgtttataaatttcatttggagagttttgagagttctggggagaacagggcctgtttaagtgaagttgggaatcaatgtcagggaaagacccagatgaacaggctctggattggaagtcgggaaacctggagctgaatctcagtgttactgctcagtgtgtgacattgagaactcgtgacctttgggccttggctaccttctaaaacagagagtaggattaaattcttttttattaatttatttttgtttctagacctgtaattaatcatttgcttctcttctaattttgttgtaaatttaattgacttaaatatcaggatttcaactttatgcatatgtatttttaattaaagtataattgcatggaattggattgaattaacgaaatccatgagaagctcagctgtttggactaaaatgctgtaaataatgaattaacattagtgtcttggttaattgcgtaaacactggtcctgggatgtaagataataaaaaatggaaaaaatgaaagccagtattacttacatatatacttttgaacaatttctactgatggactatgattttatacagagtcatcccttatttccaaattgctccctttaatccctttctgttactttttaggggatggctacctctcttgacaaatatatgaacagatacgtatatcctctttaaaccttgtatcagtaaatagcattgctatccactgaatgattattacttgttcactaatacctttaggccaggaaaagcaacaaggagaataaaggaaattttaggtagaagtaggaagaaacagagttgagaacgttcccagtttccttctgaagcttcctcataatttcataccaggtacttggccctattaactcatattacaaaacgtctgaaagatgaagaa

SEQ ID NO: 127965 - DNA, 1054 bp, Homo sapiens
tgtgaaggtaacaaacgtagaataatagttgtatattatgttgaagattcaataccaaaagtgattttttgagtgactcaatgggatgagtttcttaggaaacaaaacacaacctttggttcaatagtaattacatctttcaacatttcaatgtacattaaaataatcaaaaagtactttgagttcatatataatatgaagtaggatttaggctcaaataattacgcacagtttgttccctgacataaatcagaggtgaagtttgtgcggggcttgggacaatttttttattgcgtggactatcctttacattgtaggcagcttgtctaagtcagccaaaaagcactgtgagctgctttgaagacaagcaaagttagtgcccatatggtataagaaaaaagacaacaacacactaggtgattaagaactctcttggggaatcaaaccaagacactgagtaacttcttagacagctggttccttttctagaacaacaggatgagttcaccagtctctaatgtgtcaatctttaggaggtgttctgggtaagagacttcctgattctctggtgcttttctgctctgcaagaagaatcctgattctgttctcacgtgcagcatcacccagagagggagctggcaagatgaggatagatagaaaacgggagccacataaacctacaatcagactgaaactggaaccagaggaaattgagagaaatttgcaaagtgggtaattagaaaagggtatctctggcttatttgcatgttttccataaattttttttttttttttttgagacggagtctcgctgtcgcccaggctggagtgcagtggcacgatctccgctcactgcaggctccgccccctggggttcatgccattctctttcctcagcctcctaagtagctgggactacaggcgcccgccacctcgcccggctaattttttgtatttttagtagagatggggtttcaccgtgttagccaggatggtctcaatctcctgaccttgtgatctgcccgcctcggcctcccaaagtgctgggattaca

SEQ ID NO: 127966 - DNA, 1027 bp, Homo sapiens
cactccctttctgagacaataccactaatataataggtttgggcttctatcaaggttgtctggttagtcatcagggagcacagagtatttctgagttatacatgcttttccctgttgctttgcacaccctttgttcatttgcatgctacagggcactgctgtgtgtgctcatacttgcttattcttttaggcatatgccatagtattgccctaagtgaagctgggactttaatagtgattctacaagactccatttaatacccaattggtggtctggatgaggctaaaaggaacaacgtttctggactttaagagactttcaaaataggaggggagagggcagtgggtctcataactttccaccctgctccaccatcagactgacacattgttttggccagcatttctcaatctgggtttgccaggaacctagattttcacaatacaaatgtctaggcttcagagcttctaattttgtaggtctggggatgataattaaggtatttcccaagcttggctggtgacttatacagtggactgagaagagttgatctcactgtggctttagccctggctgcacatttgaatcaccgagggaggttttccaaatattgaagcctagtttctacccgtaccatttagatcagattctcaaaaaccagaccactggtcttaggcttctctctgcttttcaccaaaaagcaagatgtagaaaagagcagtaaacagagaggggtgattatattatgggaaaccacagagaagattcagtgtagtcctttttatggcggttatttttgtttctgttttctgattaggaaggagggatggaggataacaatatgaatgcctagaagctaaggacaaagccatttcaggtggaaggattcatacttacgaaggcatagaaatgagcgattacttttcctggtggaaagaccacatatgtggattcatgagggacacccttgcatgaaggacgacagggaggtggtgagtagggaaacccaacatctaggttgaagat

SEQ ID NO: 127967 - DNA, 1009 bp, Homo sapiens
aattccaatcctccatcaagccagctaatactccatcctcagtcctcagcttagaagtatagcatagtgagctctttcccatcttgcaagatggcgggtgaaaaagttgagaagccagatactaaagagaagaaacctgaagccaagaaggctgatgctggtggcaaggtgaaaaagggtaacctcaaggctaaaaagcccaagaaggggaagccccattgcagccgcaaccctgtcattgtcagaggaattggcaggtattcccgatctgctatgtattccagaaaggccatgtacaagaggaagtactcagccgctaaatccaaggttgaaaagaaaaagaaggagaaggttcttgcaactgttacaaaaccagttggtggtgacaagaacggcagtacccgggtggttaaacttcgcaaaatgcctagatattatcctactgaagatgtgcctcgaaagctgttgagccacagcaaaaaacccttcagtcagcacgtgagaaaactgcgagccagcattacccccgggaccattctgatcatcctcactggacgccacaggggcaagagggtggttttcctgaagcagctggctagtggcttgttacttgtgactggacctctggtcctcaatcgagttcctctacgaagaacacaccagaaatttgtcattgccacctcaaccaaaatcgatatcagcaatgtaaaaatcccaaaacatcttactgatgcttacttcaagaagaagaagctgcggaagcccagacaccaggaaggtgagatcttcgacacagaaaaagagaaatatgagattacggagcagtgcaagattgagcagaaagctgtggactcacaaattttaccaaaaatcaaagctattcctcagctccagggctacctgtgatctgtggttgccctgacgaatggaatttatcctcacaaattggtgttctaaatgtcttaagaacttaattaaatagttgactacgttaaaaaaaaaaaaaagt

SEQ ID NO: 127968 - DNA, 1928 bp, Homo sapiens
tgttacctgaacaagctaaaaatctaagggactttgcatttcaagttacctttgtctggaatgttcttctaccaaatattcaattgactgtctctctctctctctctcttacctaatgtaggggtctgctcagaggatgtcatgataccttatcaaaaggaaatcatgggccaggtgcagtggctcacccctataatcccagcactttgggaggccgaggtgggcggatcacaaggtcaggagatcgagactatcctggccaacatggtgaaaccccgtctctactaaaacacaaaaaattagctggatatggtgatatgtgcctgtaatcccagctactcaggaggctgaggcaggggaatcacttgagcccaggaggcggagtttgcagtgagccaagattgcaccattgtactccagcctgggtgacagagaaagactctgtctcaaaaaaaaaaaaaaaaaaaaaaaaaaaagggatatcatgataccttatcaaaatcagcatcccttgccctactcttgatcttgttcttcatcactgctgtcatgatttcactgtatactaagagtgtatttgtttgttgtttgactcgtctcccaggcagtaagctatctcaagcgggggcattgttgggcttttttgttttatgcccaccatccagaagacttcctgcacatgaggcgtaactattagctccataaatactagctgactgaatagcaacgtcagtaaccaagggaattggtttttgatttgcgtggctttttattttgacagccttggaaacaacagtgagtctgcccagttctcacaagtgtctagcatggcgcctggagcagagtttgcacatataaatgtgttgggtaaattagtgaatgaccaaatgaatgaataaagtcactttagtgctttaatcaccagtacatcttcagctaccctttagacccattcattacacagagttactatggcaaaggaacctaaccttgtctaagggttccatgaaggcctccctgaggagggtacttcatcatcatcatcatacctaacaggttctgagcacttactatgagccatctactgctttatgaactctaactgatttaatcctcacaacaaatctatgaggttgataatataattagtcccattttacagatggggaaaataaggcacagagaagtagattcatttatctcaggataggtaactaataaatggtagtctgtttccagagcctgtgcacttcaccactcactatgctatacttttttttttttttaacgtagtcaactatttaattaagttcttaagacatttagaacaccaatttgtgaggataaattccattcgtcagggcaaccacagatcacaggtagccctggagctgaggaatagctttgatttttggtaaaatttgtgagtccacagctttctgctcaatcttgcactgctccgtaatctcatatttctctttttctgtgtcgaagatctcaccttcctggtgtctgggcttccgcagcttcttcttcttgaagtaagcatcagtaagatgttttgggatttttacattgctgatatcgattttggttgaggtggcaatgacaaatttctggtgtgttcttcgtagaggaactcgattgaggaccagaggtccagtcacaagtaacaagccactagccagctgcttcaggaaaaccaccctcttgcccctgtggcgtccagtgaggatgatcagaatggtcccgggggtaatgctggctcgcagttttctcacgtgctgactgaagggttttttgctgtggctcaacagctttcgaggcacatcttcagtaggataatatctaggcattttgcgaagtttaaccacccgggtactgccgttcttgtcaccaccaactggttttgtaacagttgcaagaac

SEQ ID NO: 127969 - DNA, 1048 bp, Homo sapiens
ttgtatgcaaagtactcaggcattgcaaatcaggcaaagttgaaaacaccccagtattattagagctctaccacacagattctgcaacatggggaaactcaatttaatacattttcattgaatacctacctataagcctccgtggtatgaaaggcatacaaaatgtgtatttactatatatattgtaaagtgattatatatactattgtgaaactagatcactatttggtctactagctaatatttatatagatggtattagcatagctattgccacataggcaaagagatccatgttacagatgacagaattgcaggttttctcaagaacttctagtggattttaaagtattattggaaggtggaaacttttgttcagacacaaaagtgttgtactgaagtaaagattgctgcataaacatgcagtaatttatttaaaggtacatggtcctactagagcatgggcagttagtctagaggtcctgatcaagcatggtgtaggacagagagcttgtgtgggatttctatgtgggggcttggcaattctgggattaatttcagcaggttcctgaaggtcaagtgggccaagcttcaaacagaagacctgtggttatgtctattcagtggcgaggccagatttaggaagccgagaaatcaaacattatgaggaacaactagttccagaaatcaaggtcaggcaagggcaagaatgcaaggagaaatgtgagtcaagatagtgtcattgctgtcagaatacacatatgggcctgatttgaagaggaaagggtttgttctagggtttctttcagagtgagaggtttactacgtatggtggtgctaaggcacataatgatgatgaagaagaagatgacgatgatgccgtaatgataaaagctgccatttgttagatctgtgctatgtggcaagcactgttagttcaacaaatatttttagtacctagtatgtgcctacatactggggaaagaacaataagcaaaacagataaaattcttgttctcatgaagcttatgtttacgtggaaggagac

SEQ ID NO: 127970 - DNA, 1114 bp, Homo sapiens
cagcactacctactcaccagctctatagccctgtgcatctcatttctctgcagccgagtcctttcttgttagaaccttcaccctggctcctctacgacaagggtatctttcttctttattctggtgcttgcctccttatctggtttccccacttcttcttgcccttagtttctgctgatatgttcttttgtccagttgcctcttactgggtctccctgatgccagttgtgtgtccctgtgcaggtctctgctctactgtgacaatatgttctgcctgtttgcactttctcagtctttgcacttctgctcctacccaaccccactgagcaggtctagctccatatcctggatcccacccataggcttatccacaccagggagagttccacccctggctatgtctggaatcaggacttgctgcatgttgattcactcattcagcagtatttattgagcaccatttagggatgtgattggaagaagatctagtctcggtgctcatagacctcatgtgaaccaatgaggaatcagaattgaattttgattaaactcagggaccctgattcctcaaaaaaaatgataaatttggagtaaacttcaacaaccctttaagctcaagcactcagtccacaaaatttctctatttcagacatttctccctagcccttaaatcctctgtctacaagctgattgactaatatattcagctaaggttataaaagcaaccagggtttcttaggcagccaaaaagaagtcagagagcgaagaggagagaaaaagccaagaatgccatagatcctggatcaggtgggccagctaggggagcaaggtgggaagtacaagctttttgatgcctgagaccagtggtttgagtggggagcttgcttgggaaaaatcagcagggtccacagaaatgaaaggggatgtctaccaggagcagctaagaagagccgggagggaggtctggggggctcctggtcctcaccttgttttagggtgctgcccttgcctttttcaattaaagaaacagaaacagcagctatttggggttttgagcatggaaaggtggaggacagaggagctgtctgagttatcttaagaatctggttttact

SEQ ID NO: 127971 - DNA, 1051 bp, Homo sapiens
ttaattcatgtttcttaccatattgaattggtttttgccacttgtaacaaaaggattcctgatgaatgcctcctgtgtttggagtcttattttattcttcctctctgtagctgcagggtctaatatatacctaatttataatctgtgtaggtgccaattacatatgtaattgtgtgagcatatgtatataaaaacttagaagcagatatgcccctgagagcaaaataaagaataaagttcctaaaacatacagagaaaaagataatgtaggagaaagaaagcagacgttttaaagtatgcgttgtttgagcttttatgcgtctgtcaaacaaccctgaaagttccatcacgtgtgatattttaaattttgctcccaaatggagaaaggcatcttcccacccctctgctgtgagtcaaaccactcaagcagggctgtggctgtcagtgtgaagccagctcttccaaggacccaggggaagctgccatcgctgccgtttctgcctctgcctttctttgctcaaaagttggcaaatgctggtcatgtcgtggatctatttatagtaggcacacgtctacccaccttgttcttttcttagcatcaacttgacatgctatcaattatccatgaggtgaatgacaacacaagggaagttatttgaggcaggtgccctgaggtgagagatgagggggtggcagaggtcgcacagtgacagctccgaatgaaaagggtaaaacaaacgtcccttgctgcatctggctggtgaatgattgcagacaggttggtgggaaaccctgagctggtcacgcagcagtctcccactgcccttcttccctgtgcctgctgatgtttgaaaagcccatttgaaacagacaaggggcaggacctgaagatgtgatctccctccagtggaggtcatttttgttattctcttaagccacaggaggggaggacacaaggacctcctggggacagggggtggatgtggcagaggctgatactcttcctccacgtaggagcatttctggtgggagtgaagcagccaccggggga

SEQ ID NO: 127972 - DNA, 1070 bp, Homo sapiens
tctgcaaactctgggagtgcaaccacctctcctagatccaccaacaaaacagccagcaagcctagatgctatcatgtctgatgtcagatgtggttcagacacaaatctatttgttccccaaactgcacagactgctgaggacagatgtgaagccctctgtctgcctttttaaagtccctctttcttgacatgaggtgaagcggcaagccccactaaccactggctctccttgattgaagggttgtggactctcaacacatcaatagcttccttgaacaatccctccaaaactgtccaattcttgatccttttaaggaattatgagttttataaacagtttatagcaccttttttggtaaattttgcaaaacgtctagctcttttaaaaaaattatttcttgatgcttgaaagaaaatattcactgaaacatcatgttatgtgagcatcatttttctacccccatttagaaaaaagcatttctgactagttgcagaaggaattttgttacatggatatagaattggctgcatctagggatagattgaatggatgacaaagtgaaaccacgctttctttatgaaggttgtattttcaccttccttgtagacacccttccttttccagggtgcccttagataaacagctgtgcatcttacaggaattgcttacaatgatagatttcccctaagctcatgactgccaaatttgtctttgtagcccagacctctttctgagatgcagatccatatatctgatagcttactctacttctctgatcaaagtattacaagtttagctcacatcatcattactctaaataccattcctcattctgaatatctatttgccttcatgtaatttatctttagtcttaagaaatggtacttagaaacccttagttgtttaaatcagaaagttgggagtcatcaacagattcttaagttcttgtcaaccatgccactttagcaatctggtgatgtctctgaccgcctttcaaaacagtgtttgtaagaatacaggactactatggaaaccaatgatatggaaacacagttctgttatgaatgac

SEQ ID NO: 127973 - DNA, 1080 bp, Homo sapiens
gaagcccgagggaatggaaagtgaagggcatctccctgggatctagtcctttgagatgttggactttgagcaagctacgcaacttccccaaagttcagaattttaatctgtaaactaagataacagctatttcacaggttgttgtgagggagacaaaacaagctaaaatatataacaaagcaggcaaagatgtatacttcaagagtcactacctacctaggctggggcaattagaaattctaaatatatgtacataagtatttagcaaagttatatacttcaagagtcactacctacctaggctggggcaattagaaattctaaatatatgtacataagtatttagcacagatgataaaggatgggcaattcattctgagattaggctgtagttcttcttcagtatggaatcagagctcaattatctttaaccattgtgatttggggaatagttttggtcctaattgggtgtacatgatgcctttgtcttcagaagtctgatcaatcaggggatgctgcaccacaacccttatactacgttttagtgtttctcaatgtcaagagacttctgtaacagatttcagttctttctgatggctttgaaaaatgctagtaattctctgtctttctaatggagtattttgtgtttgttgtctcctgaggtcagaaaattactttggggaagttgacttttgtgagctgtgagtatggtgtgtgtgtgtgtgtgtgtgtgtgtgtgtgtgtgtgagagagagagagagagagagggagagagagagagagagaaagagagacagacagagagaattaaatctgtattgttagttcttggttagaatagagcttaatggatcttcccatttgtgaaaaccccataactcttcctgtgtaatatcattaaagagcctcctgacagcagtaggtaaggagtagctctggggtgttactttttaatcactttaagcccattttcgtgtgttattacagaaccatccctcttctttatcactgcatcttccaatagcacaccattgctccaggaccagaattcagcaacaattttagtttttctgttgacaa

SEQ ID NO: 127974 - DNA, 1802 bp, Homo sapiens
agacactttgaactgatgacactttgaatcgaattgatgaaaggatgatggggaattgttcagctgaagaggggtgggaagggtcttctacaaaggtcaagaggtcagcataagcacaggtatggccatgggaaatgacttggctgattaggaaataaaaagcaagttggtaaccgagaaatataacatgatcagttgggtcaagaagtgagacgagaatgataacagtgtttatcacttaaattgtcattttagtgttgctattcagtgagggagattttgtcataactcctgggatgctactggcatctagtggttagaggtcaggctgctgataaacatcctgcaatgcacaggatggcccctcacaacaaagaactctctggtccaaagtgtcattagtgccaaggtcgagactcccttcttcggatctttttacatttggattgcatcattcaggtcttaactcaaaagttccttctttagcagcttccttactcaccccctattgtcatataaaaatttgcctctccttctctgtcactctctattacaaaacaatgttttttgtctttataccttttgataccatctaatgttatattatgcatttgtttatttttattatctgtctctcctcttttaaaatataagcaccacaaggtctttgattggttcactgctgtatctctagagcttagaatagtgtgaggcacattggaaaatgcatggaaaagttcaatatatgggtgttctgagtggaagaatgtggtaagttggacatagactctgagttcctggaataatcacagtagttaacattcatttttaccattgatactaggccctgttccaagcattttgcatgtattaactcaatccccaaaacaacctcagggggtaggtatctgattatttccattctacatatgaaccaactgagaaagagagttattttcccaagatgtacatctagcaaggggcagtgttcaagaggtaaattgcccaaggtgatcttgtgtgtttattcacacatgctttttgtggctattagtctgagaatgctatggggagttgggggttaagtgacttgggaattggatttgaggggtttcaaacaatgcatccaaaacatagatggacgggaaatataatgaactaaatgttggtcatatcgcactcaagggacctgtgagccatcaaggtgaaggctaacatgaaaaggattctctcattcaagagaatggtttcagatgaagtgtggaatttgtaatgggaactgaaatcaggagagcagacttgattatttagggacaggttgatgatgggaacagacccagggaacaccctgacatcacaaatatataagggcctataatataatataaaagggtacccataatgaaaatagaaagagcagtagagtcacatttcaagttctgctttgggcacaagcttctatctaaagtctcttttctcccttgtagaactaatcttttctctctctgttctacctacagtattttatattttcaatgtattaagtgacataagagaggtgttagataatagctagtactacgagtgtcacctaagcccgtaaacttccacaggcctacatcttcatctttgttcatatccatgtccctagcgtgaacatccatagctgacatctagtagtctttcaatattaataaatagatgatgttgaatatgtgaattagaaaatgtttattgggagaataaatgtatcatttcattagaaaatttgtttgtaacccacatcaaaagaagaagaagaa

SEQ ID NO: 127975 - DNA, 1154 bp, Homo sapiens
ttcagaatttttaaacaatgttgttcttagttcctcttacttctaaaggacttttaagagtttttttaggtatttcatctttcccaattctctgtctgtgaccaggggtgaattggtaattttacatctttttttcaagcattccaagtagaggaggcaccccctgtgacttccagtggcattctgcagcaattaagtcgcattcattcagctcatcatttaccttgcagccatcaactcctttcaaaatatccctttgattgtcagtaactacggacgtgaagctgtgggtttcttccaggaacaatgctcttctctgtagcctgtgttctcccagttttctgggaagccctgagacttgtcattctcctagcagctcagatgtcattctcctcaaacacccagatttcatttagcaccaacgaggtgctcagtctgggatttctgagggactgtcactggggagaggctgttgctaatgaggtgcaaattggcagcagctggggaggagctgctctccccctctagggctgggccccaggggaggaggggagggttgctctgacattttcagaggaggttggtgaggggccgaaactagagactcctcaccctttagcaaggcctgatgccggctgggggaggcccttgcgtcttgctgagaggctggtctggtctcacacagccccacctccagagttgctgccagctggctaatttcttggctgccttttctggctggctttacttgcaagcaggagaggccatgatcagacacggggttttcccagacattggagagacagctaagaagacccacagcccccagagacactgtccttgggattggtgttctagaaggttatgaggttggggtttggtggtggaagaggggttactgtagcaactgttgaaacaagagagcccatccatctccccccagcatttgcccgcctgttttacatggaagagcctcttatgcattaaactgttcacctgagtgctcccaccagctgcgcttctctgcttctgcaaggtgcagggctctcacagccattttcatctgcaagggtctctgccagagctgtggcagagttttctgtgggatgaatcagaaactatgttctgatgaagagaaaatggagggcagtggg

SEQ ID NO: 127976 - DNA, 1049 bp, Homo sapiens
ctccagcctggtgacagagtgagactctgtctaaaaaaaaaaaaaaaaaaaaaaaaagtttctcccttttaaattggccccctctcaatgcaaagactaaggtgtggcatgtttcttttcctatgcaattgaagcaccgtcctcagtgtctgaagttacacaggaagctgccaagcatgggcttccctgacagcgcacaacctcggggctgcttggttttcatggctgtcttcattagcttgggctgctgtaacaaagtcccatagactgggcggcttctaaacaacagacatttctttctcatcattctggaggttggaagtctgagatcagggcaccaacatggtcaggttctggggaggaccctctttggggctgcagacagctctcttctcatggtgtcctcacagggtggaggtagtgaggctcctgggggtctctttctagaggggcactcatcccattcattagcgccccacccttgtgactgaatcacccccagtggccccaccttctagaaccatcacattgggggtgataatttcaacatgtgacttttgggaggacataaacaccagcctaccctgctttttctcacaatattccaggaagccacagacatcactcctcttgtccttcccagtggcctctgaaggccattcccagaggcagcaaaggcaatccatgcacttccaagctttttgtaagtgcagctcagagaaggaaaaagcttttcttggttcaaatactgaccgcaacgattaacttacctccctacctgtgaatattaatcattataagttactgattttgccaaatgcttacactgtgtcaagagctgctaaatattttacatttgggatttcactggaccgtcaattaagtagggactattattatttccattttacagagaaggacattgaggcttagagtttaagcagcttgcctgcaagtcacatagctgagtggcagagttaagatctgtgcccatatttgcatattgcttattacttccctattgcagcttttcttgtcctcttttcacc

SEQ ID NO: 127977 - DNA, 1956 bp, Homo sapiens
ctcagagggtttctggaaaaggggtcagtgaaaacattcttgtaaccctactctttctgagttagtgttcccttcccaaaaaccatataaagtattaagcctgtcacaccatgtgctgttatgtaagcaaacgcagatgacagaggtgtgtgggtttgggagggtgtgttttatttatgggggcaggtgtgtgaataattgggatccccatagacatcgcctggcctggaggccacagtcactagggcatgtgctctgtgtctaagtgttgacttctgatgactcctaaaacgccttcctggtgaggttgttgcttctgcgttcctcccatgcattttgttcgctgtgcgctgagggagttccccacctgagttgttctcttagttactcacacagatcaggtccaaatggatctttctttttatactttggtttctaaaaatagacagatggtggggagggggtagctctagggaggtatgctaggacactggcagttctacttcctagttatgatggcccgtctggcccctgggggaacagggactacattcagcctaatttaggagctgtgagttggaagggggtggtgattacatgaagcacagtgtaggctgctcctggcttattggtattcatcagagtcctcactgggtaggaagacaaagccagagtttgcaagggaaatcatttcagcttgcctcttgtcaggggtcattctctgagcctccttttttaaaatgtatgttgtgtggggttttggctttctgagttgcatgctcacacatgcacgtgtaagtgtgtacacacacaagcatagacatggacacagacgcagcatgtttctatagaagaataataacattgcgtctgctttacaatccttacatagaggtggattctacttcgtgaacatcatttccttttaaataaagctttacagtctccaattcctgcatcagtgtcacctcaggtgtctggttaaaagtgctcaccaccctagacttgcagaatcaaactgtctgtgggtgagaatttttaacacgctcctcaggcgatgtttatgcagactaatatatggggattgccaccctattttgcccccaagactaaacaattgatctttgaactcataaaccctccccatccaaaccaggccagtcagtctcaaagtcagaggaaagatggtgaaaaggaggtgcttccatctggagcatgtttgtgcctgggtaacaggaaattgtctccattttgatcactgttacttatttgttttggagtaatggtgaatggcctgcccactcgtcatggcggccattggtgctggactcctgcagcagggctggctgttttactgtgggatggatgaagggtgtgtaaaaaaagagcaggtttgtcaggagctgagggtcggctccttggtggggaccacaccacctcccttctgggggcacctgaggacagtgtctggtgggagcttatggagaggaggcaggaagacctcacagaatggagtctgagtgaaaggactgagttagggtatggagcatggctgcttgcgtgagggggatcatttgaggtggaggagtggagatttgcaggtaggcaaaaaatatcttttgaagaacatgtgtatttttggaatgaaacttgacaggcaaaaagaagggggctttgggagagagggtgtgtgtgtgtgtgtgtgtgtgtgtgtgtgtgtgtgtgtaggggggtctcatctgctccttctgttgctaaggaacatataagctagggtttaaaaataaatgaggagtgggtgggcatatgcagtgactcctgtctttttaggaaccagagccctttacaaaaagcctttaaataaccatttctggaggcagattattcattttgcttgacttttactttgttaagtaaaataaactgctttctgtactcctagatttcccctcatta

SEQ ID NO: 127978 - DNA, 1062 bp, Homo sapiens
tcctatccatttaaactgctgaaagcaaaatcattcttgtggccaacctgtccttaatttgctcaaattgggagaacttgtttcattggtactagctgggggtgaagatgtaagcccaggaaaaatctgcttgtccttctagcacctgaatgctattcgggggtagactgtggtgagaagcaagttatctgcgaaagcccacagcattctgtgaacaaatgatttgatgatgttttccagtgaacttatgtggctgtctaacattgttacatcacagcacacattttccgagaatccttgagacccaagagaaagcatctgctcataaaatctttccactttgccatatgcactgggtttgggggtgggggatgaggatgaggaggagcttcaactctttacaccactcacagggaactcttcccgggtgctctaactcaggagggtgtgttgtcagatccttttctatgccttgcagtgttcagaatttgcaaagaattttaccatctgctctgtgtgctgatgtcacacagagcagagtatataagactgttcttatccctcaaactttgccttttaaggagaggcacagttgtcccattttagggataaaacgtctcctttttttttttctgctcttgctctcttgtctttttcctggagaaaggctagaatctgtttcaaaggatggttttaaagacccttgactctgggcttgagggtccagttgagcaggcatctttgttctttcatatgttggcttcgtttcctgactctggaggtgctgtgagcgtttaagaaccacaggcttgagctgcaggtggctgtttgcctctctgccttaaacagagccgttcttgtttttcctctcctttctctctctctcttctaacctgcctgtgaatgcctgttactctgtgttggcatttccagtcacagcccccacctctggcctttctctctctcttctaacctgcctgtgaatgcctgttactctctgttggcatttccagtcacagcccccacctctggccactccttctgttgttctctgctggtcat

SEQ ID NO: 127979 - DNA, 1050 bp, Homo sapiens
gatttctagatgaaaagatcttttatctgagctatggagagtggaagaggacagggccgggagagtagatgaggaagtctttttcatctttcttcagtttttctctgggagactctgggaacagagctgaagtggtgcgaaagcaccttcacacttcctttgctgaggtgatccgctaattgcatgctatcaggaaatgtgtaagatgggagtgagatggtttcccagggggcccttcttcctgtgctccatcaagaaatacattttcacttgctggtgtctgagcagtgcctgtgtggctgctagagaatccttctggcttttctaagtgaatgcacctctctaagctgcaagctttctggatggccccaccctggtctcatccctgagaaatcttgtcattttttcccactggtatagttttcttctgcatgagtgatgcacatacactgcccggcccattagttgtaggcgtttgtggctcagtttgctccatttatttcttattttgttctcaggcatctttagggctgtgagctacagcttttctccttgagcatggatttgtagaatcataggagcttagacttgagatacaccttagatatcattgtattgaactgctaatcaccttattttacagaaggagaaactgaggcctggtggggttaaagtcatcttaacatttagaggtagaatggggacgagaacttggtcacttaacttttgaactggtccttactttggtttctcttgctgctatacctcttgctccttcaaggaccttgccccagcaagagccaactttagacttggacacaagggcccttgatttggactcagtgttttagagggccctgtgctggctctccttcagccatgtccccctccatgggatgtgtagttggcaggaccaaggggatgcatccatctggagctctcaccctagccctctagaacttactccagtacctaggatcctggaattccctgtccaaaggtcttagctcatttccagggcctatgtggacttctaccccaaatctgttc

SEQ ID NO: 127980 - DNA, 1063 bp, Homo sapiens
cctcatgaggtctaatgaagctctctctgccttgcgtatgcagattctccggcatacatcctgctcttctcacttctgtgccttcactcatgccatcacttcccttttcattcatactttttatttatttattttttgtgtgtgaaacagggtcttactctgttgctcaggctggagtgtagtagtgccatcatggctcatggcaacctcaacctcatgggttcaagcgattctcccacctcagcctcccaagtagcggggactgcagacatgcaccaccacgcccagctaaattttgtattttttgtagagatagggtttcaccatgttgcccaggctggtctgaaactcctgagctcaagtgatcctcccatcttggcctcccaaagtgttaggattaaaggcatgtgccacctcacccggtcccattcatactttcagtacaaatttcaaagtacagttcactactgtggtcaacaaataagaaattggcttatacagttgtcaccgaaaaggtatatttgctacggtatataaatgtgaggatgtttacatatgagcacttctcatgaaaatatcgtctgtcttcattccattagaaactaactcaggatttggtttgtaacaatgtaatcagggctggccctttatttgcctttattatcaataaagaaaggattaaattttaaaagttaataatacttagtgaaataatacttagtaaataatacttatttacttagtaaaagttaatacttagaatccatattgagacactatgtctttgcactgagtgacagacagtagtgcctttcagctttatgtactgcttcaaagtaattgctttcgtttgtataacaccagttattactatcaaatgcatcttactcttttaatttatgctgtgatgtggttcagaagtgtcatcaccataacaatgaatcccatagtggcttctgaatccagggttattggaggagaaatgtttcaagaatgaagttaaggacagcccttcctcattatcctggataaactgagataaggaaattcaatatccttgact

SEQ ID NO: 127981 - DNA, 1055 bp, Homo sapiens
gaagcctcgacttcctggtttaagcaatcctcctgcctcagcctcccaagtagctgggaccacagatgctcaccactgcacctagctagttaaaaatttttttttgtagagacagagtcttgcattgtagcccaggttggtgttgaactcatgggctcaagcaattctcttgccttggcatcccaaagtgctgggattacttgcgtgagccactgtgcccggctgcttctttctttcatgtttttaaatgtgcttatttatctatttttgaatagataatacatttacatgatttgacaaccaaaaagagtagctcattacatattcaaaatcctccctcctattctattccccatcaacccaggtttcttcctgcctttctcaggaagccaagtttctttcttttctatggattccttccagagtttctttaggcatactcacatgcaagcgaatacaagtatagattctttctttgctgttcatatctatcaatcttttccctcacatatttcattttcttttattctactttcaatcatccttcactgagcttttttggggagaaagactagtggtcgcttgttttgcttatgcctgatgccctgaacaagttcacatgtgtgcttgtcttttttcctgcagatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggtatgctcaattttcgtctgtttaaacaggttggattaaaagatacagatagatcctcattctccaataaggtgtttaatctttttggagttagtggctgtgtacatttaaggacatgcaacttcatatgtgtgtatatacatatgtatacatttaataagggtatgttgatttggtgccaacttcctttaaagccattgttcggaaaaaattagtagctaagctgatttcatt

SEQ ID NO: 127982 - DNA, 1032 bp, Homo sapiens
gccatcatgggaggaagcccggcctgatctttccttttgagaaagaggcccaagtgtccaggggtcccagcccagcacactcccagccagccttcccactaatgtgctgtgtcagggaacacagatgaaatcagctcacccacccagcccaacccacggaggagggagaagtaatatattaatattatggttaccttcagccactaaacattggggtggtttgctacacagcacgagctaactggacattgtgtgtgtagaagggacttcatatcgagcagtggatgaggtatttggtatgtgcgtagggtatctgtcacattatggttaagagaaactgagttcttcctcctttgtttcttgtagcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacggtaaactcagaggaggaggaagacctggaccttagcgcctttggttctgagctcttgagggtgtggagtgtgtattatattaaagagggtgtcagcacccttattagtgagatacctacagtgtgtacggccttgtgcttgggctgtggggaaaagcaaagaggcccaggacccatttctctacactgcccaggttcccttggaacttgctataactgaaggatggtcattactctctttcaccctatggcttcagcagcagagcagccttttgcaaatcaggccggcctatctggctggtcattcctaccagtacagtaagtctcttgtttcaaggggtcatgccatttttttttttttttctgagaaagaactattcctctatagaagcttcttgggcatcctctcaacccaattccatcatgttctattgaccccatgtcccccac

SEQ ID NO: 127983 - DNA, 1370 bp, Homo sapiens
attgaatatggaaggtgctattattattaaattttcttcgcattatttttattcctgttggtacttgttggatactcttgggccatggaaggacaggccctactaggctagaggctaatttgggttcagaaagaatgaagaagtgcattttgggggtatttgcagctatatgtgtaaataagccaagaagtaggcagattgaatttttatgtgctagctaattctgaatcttgcagctctcctttgttatcaggagccacttgtggggtgtttctcccttcatctcattaactgatttatttgtattgtgggcagatgctcttaaaatgaaacagtggattttttttccacatcaaattctaataactgctataggccattcaggattggcatgcatttgggaaagtggatcattacttgttttaatgatgaaaaattatgtagtttaaaaggaattagtatggtgcatgacccttgaagcaaatatcatatgtaaaaattcatttttacttaatatatacattaggaattagtttttaaaaataaaccatttctggccaggggcagtggctcacacctgtaatcccagcactttgggaagccgaggcgggtggatcacaagatcaggagttcgagaccagcctgaccaacatggtgaaaccccgtctctactaaaaatacaaaaattagctgggcgtggtggcgggaacctgtaatcccagctactcaggagactgaggcaagagaatcgcttgaacccaggaggtggaggttgcagtgagccgagatcgcaccactgtaccccagcctgggcgacagagtgagactctgtctcaaaaaacaaacaaacaaacaaaaaacccatttctgaaagcagtttgaggttcagagcaaaatcgaacagaaggtagaaagatttcccatatgtcctctgccccacacattcatagcctccgccactgtcaacatctaccatcatattggtagacatgatggtagatacattgacacattgttatcactcaaagtccatagttcacattagggttcactcttgtgtcgtacattctatagatttggacaaatgtataaagacgtgtctccaccattatagtatccgtgtcagagttccactgccctaaaaatcatctgtggtccacctatttattcctccttctcccagggtgactccttttacaaaatattgaatataccctaccaatggatttataataggtttcctttaaatatcatctctcaatgcctttattgcttaatctatttcacatacttcatttacaaaaaaaaaaggttcatctggatactaccaagcaaggtgtacatatatttatttatttaatttttttttt

SEQ ID NO: 127984 - DNA, 1070 bp, Homo sapiens
cagaaacagagcaggaggacttggtggggtagctgcagagtggcagagcccgaggctccaggctagtgagggagccaactcaaatgaaggtcgggccggaggaggcctggcacagttataaacctcctgtaaagacagggcaggggaaggaagtggatgtggaggtggatattctagacgtgacaccagccaagccaggctgtgactggtcttcagttaagaaatgtgtcttatataaatgtgtctactttgagcatttcaaaaattcttcttcctccctcccctcagttttcctgtaaaagtttctttaaaaaactcaacttggtcttggctagaccatcaggaataaagagatttatctaaacttaggccagggcagaacaactaacctgtgatctgggagcccaggtatgaagtcacaggcgccatcttagtctgacttccttttctaaaggagtgagccaaggggggcaaatggcgggatcaagacacaggtgtggagaggctcaggggagccccggagggcacaggccaggactacacccccagtttgaggctgactgaaagtgtcacaggttctccagctctcctgtttctcttcaggattcatttttcctcctcaagaatgtcttcagatagtagacccagagaagcgagggtgtaggtgagggagtggacagagatgtagccagttagtgggtatattagttttctcttgctacgggtgttgagcgggtgtggctgccataacaaaataccacagctgggtgcagaaatgtatgtctcgtgattctggaggttgggaagtctgagatcagggtgccagcatggttggtttctggtgagggctctcttcctggcttgtaaacagccaccttcttgctgtgtccttagtgggtagagtggagggaagagagagagcgagagagagagagagcgctagggcttcaacatttggatttcggtgggactcagttcagtctatggattgaactatatatatatatataactatatatatataactatatatataactatatatatataactatatatataactatata

SEQ ID NO: 127985 - DNA, 1606 bp, Homo sapiens
gggtaggtagggtggctgtcaaacactgagcaagacagacagtccctgtatattctagtgcaaaggcgggaaagcaggggccagatcataaaaactggaacagataaatcagtaagctaatttcacagactggcaaatgcagtgaagatgacaaaatgggacctgtggctaccgtaggggtcatggacactgtttctctaaggtgacatttgagttgaaaggctgagagcctgagggctgggcggggatatcctctcagccatggggaagttgggaaggaggctgagtatgtggaagagatggttaatagaaatcaaacacaaggagaaccttcaaagtcagatgataaatcaggtccatactaggaagatcttttccaagtttcccagaaaagtaaatcaaacctcaccaggcctctagatggttttaattacctttttgtagggctgctgaacagggtattagtcatatacttgacaataaggacttgtggatttttctcagagatattaatggatgggagtaaatttgcatttgaaattttatttttaaattacgaaaataacatattaccaaagttagagaaataagaaaagaaaaactcttatgttcccactatcctaccagccctattgtctattttgtatatttcttgaagactaggtctcactctgtcacccaggttatagtgcagtggcgtgatcctgactcactagagcctccacctcctgggcttaagcgatcctcccacctcagcctcctaagtagctgggactgcagctgtgcaccaccacgcccagctaattaaaacattttttttggtagagacagagtctccctatgttgcccagactggtctcgtctcgaactcctgggttcaagcagtccttctgcctcacctcccagagtgcaggggttacaggcatgagccaccatgtctggcctgttttgtgtgtttcttacagtctttttcatgtatatgattttagatagttaatacattgccctttgaatgcatgacagacatttcgccaataattccttgagcttatataccatacttatacatttcaataagtacaatcaattcttgttatttgcagtggttatggtctcttaagtcactgtgaacactgaactagcaaatactaaccctttgctgctaagggaaatagaggattaggttcttgcgggtgtctgattacatttttatcactaatcagtatataaccttgttttatgtgtgcttctgtttaaagacaccatacttaatgtatcaatatattgttggtttattaacattgagctacagccaagagtgctatcacccatacctgaacaaagcttatcgaacacgtggatttttttctgtgaggcatatcacagccgtcttgtacttaggacactagatagcacttcagcactgtgcttgggaggtgttttagacagcaacgtcaccaacaaaaagcacaaagatatgaaaaacatggcactaaatagaccatgaaaaggaacctgcgtaatagcctgagagctacagcaagaaggcagagtgtgccctttttcagccttagctgggcacgtgcatgtcagtgactcaaatttt

SEQ ID NO: 127986 - DNA, 1035 bp, Homo sapiens
gtccagggcaacatcagctgtggaggacaaggaagggatggggtgtgccaaaatggggtagaaacgacgctgtgttgtattggaaagaaaatagactttaaagtcagaaagaaaggtgaaaatagcaagcttttactgactggctgtgtgatcttgggaaggttatttaactccctaagtcttgtgtgcttcaaccacaaatgggaagagtataacctaccttgcagcattgtgttgaggattagggataatgcgtattaaagcagagatcctggcacacggtggtgctcagtcaacagtggctgttaggtatttacatggtgtcccaggaagtggatggggcatcacagtgaggggaggtgatggttggaagttcatgcaggtggccaacatgaggctgagctgccagtggttagaaggatcttaggaatgcagtgcagggcaggcttcctgttcctgggagggaaacttgtgagtcagtttccagcgatcgggagcaggggccacaggaacactccagttcagagacatggggcttggtgtctgggagagaatcgaagagccagaaccaaactgtctgatcaggttcaaatcaatagcaagggcacttgcggctgagtcatccggagtatctcttgttttgggttagcattagggagaagctagggttgggggagtgactgtgggaggagggctgggactcaagctaagcctagtgtttgttctccttttacatccgctagtagtgtggtgaccatgataacattccagaggctcttttcttcctgagtccttggcccaaagttaggtaaattgtctctaggtagataatgatgtcccgataatgagctcagagtccaaactgctaggctgatggagattcactcaccttttgccttggtctgctcaggccaccttaacaaagtaccatagactgggtggcttaaacagcagacgtttatttcttacagctctggagactgaaagtctgagatcagtgtgccagcatagttgagctctggtgagcgcccgctt

SEQ ID NO: 127987 - DNA, 1259 bp, Homo sapiens
tcctagtttgcctttcccaactcctccctctcagttgaaatcctgaggaccttcagcctatagctctagcagctttggagcctgtatggagaaatcccatgtcatgtattttaggagcctgggccactggttggggaagtctgaaagtaggcctgatttttacaggtgtctgcaatgcttggggtaagccctgggcaccagcaagtcttctcttcccctttctctggttgtgtttgtctaggcctggggttgccccccaccagtttggaacctttttaactgagcctgtggtcacttgcataactcagcctgggtgaccactctcctgagctgccccaggccaggcgaacccactggaacaatgaagctcctgctctgcccatccccacggtctagagcaaagagtctcagtcttggctgcacatcacacttacctgggagcttaaacaactttgatgcctgggtcccagcccaagagattctgatttaattggttctgggatgaggcctgggcatcaggcattttaaaagctctcccagtgcttccaaagtgaaaccgaggtgagaactactggcttggagtatgactactcaaagcatggtccatggtctggcaacattcatctcctgggagtttgtcacaaattcagaatctcaggccctactctagactttctgaattataatctgaagatccccagatgatccatgtgcatgtaaaatttgagaactgctggctagaatattctgctgcctcctgtgaggctgattggactcacccatcatccgcatgcaccaggtactgatgccagatcaagctagatggagcccaagaaactgatgtggcctcccctggatcccttcttggggatctgttctacatctgagtcaggctccctgctgtctccatttctgactgatcccttttatacctgtccactcagaagtcccagcatgtctcaaggccagagattgaaagagccaggcagtgttctttgttgttgttgttgttgttgttgttgttgttgttgtttttgagacggagtctcgatctgttgcccaggctggagtgcagtggcacgatctcggctcactgcaagctccgcctctcgggttcacgccattctcctgcctcagcctcccgagtagctgggactacaggcgcccaccaccacgcccggctaatttttttgtatttttagtagaggtggggtttcaccatgttagccaggatggtctcgatctcctgacctcgtgat

SEQ ID NO: 127988 - DNA, 1006 bp, Homo sapiens
ggtaatttataaaggaaagaggtttaattgactcacagttccacgtggctggggaggcctcacaatcttggtggaaggtgaaaggcacatcttacatggtggcaagcaagagagagcttgtgcaagggaacttctctttataaaaccatcagatcttgtgagacttattcactatcacgagaacgatacaggaaagacccacccccatgattcaatgacttcccactgcgtccctcccatgacacatgggaactgcgggagctaaattcaagatgagatttgggtggggacacagccaaatcacatcagcagggaacacaattcaaccccatagcactgggggttcactagagtttcataaggttcccaaggactcatggcggtgaccagagcagtgtgttttctactgaaagaaacctgtgggagttgaaaacctacagactgaaggttcttaagctgagtttatggcctcaagagggtctgggaacttctggaaatgctctttagggcattgtatgtgcagtgcatatgtgtgtctttcatcacattttcaaaaggtttgctgacctaacagtggtaaaagctaatgtcccagagactgtacctctaaagtagaagctgagaaggaacaggtctgtgcacactggtgtccaccaccagcataccccccacctcattgtgcagccccatccccctggagcattccagagaagctctgctccctcttgctgctgggcactaattagaccctgactgctggcaggtgagcttactgcccaagaactaaagagagagagctcttcccccaaaagctgccctgtgcctctgtactcgaaacctaaccctttgttgacttcttttactttttatttttggagcaaactctatttttggagaatacatgaaacgagtggctgtcttacatcataaaccagaaaaaccactgtgcttattaaaggcatttcggagtattctcaagattcggactcaaagcagacaatagtag

SEQ ID NO: 127989 - DNA, 1032 bp, Homo sapiens
ccagtgggagtggagttgatggcatggtggaaagggtgggctttcaaggcaggccattttgatgttgagggacacaggctctctggtgaccttgggtacattacttcacctatttggatttcagtttctttgcatgtcactgcctgatccataatagaagtacttttccaacctatcccctaagtcaaatgtcttctctttgagaacaaggtgtcccaaccttaggagtctgacatcattcagaaagtggagagagcctgtcattattctctctcatgcatctttatttcctctcctctccagctcctacattgtgctgtaaacacaggcctctgccttgaacacatgtttgccagatgctccctcttactcatttcttttctcttgtttactgccaggttttctcaagtgcgtggtcaccagccatggcctccatttccttagtctctaccctgtatcctctgcccgctgggtcctactgctcaacctctccctggctgctaaatccaatagtcttttctctgtccttacctgcagggcctcatgggactatttggcaatactgaccacaggattgtctcataactcgtttttgctttggcttccatgacactctggcaagcttagttcttcctccttttctggcttccataccagctgttaaatgtgagtgttttggtacttggccttctcttctctctgtatgttcccctgggctctgctataaacttcagtgcatctggttctcagttttttatacttgttatttgtcttttgacgaaaagcagatctttggagtttgactcaagcctgctaggtccacctgagcagcagaacagctctggctgggtaacccttgaattttcatgtgtttcttgatgtgtttcaaagaagagctgggatgttgatccttcttatcgctgcacccatttatctcagggcatgttgagtgactcagctctcttgcagtgtaaacccaagaggagctcatgggtcattcctgggattcagctgcttctacagtccgtgtca

SEQ ID NO: 127990 - DNA, 1104 bp, Homo sapiens
gcacctttcaacattctcgccccttttgtgttcccctcctttcttagacatcaagtgttcactgtaatgttctctttccaatttcatcccttcaaattttgctgtcaggaaagatttgataagctttcactagaaattttagtgttagtaagatttaacatgttaaccctaaatgggcatttatatttaacaataattacttcaggtcaaaagggtgaatctccacttggagaacctagggcgatagccaggtagtagtgggcgaatatttggggaatgggagaggaaccctcactgccctccattatttcataatgtggctcttattcataaggcagccttgtttatgtgttgctaatttgtctatgatctagaggatttcccttggcttagcaaaaaatctttgacggattattttactgtctctgaaattgttctcatgatagtaacattggttgggaggtggtagacataggcacagtcctgaaagatgagagggcagtacagagttttatatttgccctccttctcgaatgatccctgagttacagtgttcatgggaaacaggggtctctgatgtgacattgcttttgcaggagttataagatatagcatctagattaataattgaattaattacagtgcttgcagctagaagtaactgaaaatggattcagatcggctcatacagtaagtaaattatctcatgttgcaagaggttgtgaaatagagcccctggccgggcgcggtggctgacgcctgtaatcccagcactttggggggccaaggcaggtggatcacaaggtcaggagttcaagagcagcctggccgagatggtgaaaccctgtctctactaaaaatacaaaaattagctgggcgtggtggcgggcgcctgtaatcccagctactcgggaggctgaggcaggagaatcccttgaacctggggggtggaggttgcagtgagccaagatcatgccactgcactccagccttggtgacagagtgagattctgtctcaaaaaaaaaaaaaaaaaaagaaagaaaagaaaaaaaaagaaatagagctccttgttggctgattcagcagttcctcaatggaccttg

SEQ ID NO: 127991 - DNA, 1034 bp, Homo sapiens
tgtgtgtgtgtgtgttgaaagggctcctctacgttagggagaaaggcggctttatttgctttcttaaactgtacgaccaagaagtctccttcctccctcttcggaggaaaaaccagcagaggagtatggaaaatctgagacagttgcatatttaagaaaggctctggggaaggtgggacagctcaccagttgcttgttcagtcttatactaatgcctcagagatctcttgggggattaagctgtcccagagcacgcacatttcttttaaagtttttaatgtcaagtttttggtattaagtttgcaaaatgaaattttgttttcaatagccagcactgatcataggactttatgcaagatctctttgtttgattcttatccatgcagacgtttgtaatgggggtggggctggggtgaggggggacactaatgagaaaaccactggaggcttggctgcttccccttcacgcttttttaatggggtcagtaccaagatatttgaaactttcgcaaaatggcctgcaggctccacctctttggcctttgactctggctgacgttattttgagacaaggaatgagggcctccctgctgattcccaccgaagtatttgtggtggctgagagtggcttgtttaaaaaaaatgcagagtgcagggctgagagggagtggtagttcatgctggggcaaaagccagatgttcagtgtgatcttctgggctttgcttgctgagcttgtcatggggacactatgtgggcagcacggaggttggggtaccagatgtgcttcctgtcctcagtaaagaacttggagtatgttgttcctcaaatatcttttgatgaatgggtgctccaggagtttctactgacaggctacattttatccatatgcagaggggcagcccttctcttttgttcttgaagtattctttcgctgtgacagtgtctcatccagcagctgcaatgccacagctagggggttgtctttcagctggtgggatgaattacgcacaggcatctaccttgctgttctttg

SEQ ID NO: 127992 - DNA, 1539 bp, Homo sapiens
ggctcgtcgccgttcgccacccaaggtgagaaccggccgcggccgctggggagcccggggagagggccaggagggggcgggcgcccttgtgcggcgcgacccgctgtcatgtcgccgccgcccggggtgcgcggcgggggaggggcgagcaggagggtctgtgctggcgacggtgacatggagggcccgcgctctgcggcgtgtcgcgctcggccagcaacttccccgggcgctgtggacttgaccgcgccgccgccgccgccgctgctccgcattctcaacagccgggcggcccctgccactcgcacttttgcagacctctgtcggagtctcctgcagccggaatctcgggttctttgccggctgcagccagttaactgctacccgcccgctgcctccacaaagctttgtccaggtccatatgatcctgatcatctcgtctatactcacgttatttgagctgcaggggagaagggagggatgaagatgaagtgatggtgactttctttgatgattgattgcagatcggatgtcatttatttcttatcttgcatgtttggggctctttaccttaatgagttcccagttctcttccctctcctctgctggggacaaaggaaccaagagacgttgttttgttgtgtgtctctttcaaaggttttattttgagacggcgaagagaaataatacaaagtgatttgggttttctggtattttatagataaagctggaagttactgttctctttgtggtgtttattactgtaaaattagacttttgacaggtgttccattgctaactttgacaggtttgaaacatttaaagtaagtttgagtacagtttcgggtagaacacttggcggtttttaaattttattattgcaaatatttgagcacctcctttttaaaaatacagtgtaactggaaaagcatttttaatactttttagaggaaatagttgatttagtttgaaataaaatgctaattaagtaattatgctaggtcaaggggcgtatgaaatggatacttcaaatagattgtgggctgagactcatttatttgactgcatgttaggagcagtatccacttgtaggagacagttttccgtgggtctccgtttcttcactcttgccagcacccttgccagcgagatactgactgccctttgtttctattttttcacggatattatctaaagagcagccttggaagatagagatagtgtcttccaccagagcaaaaggcggggatacatattatccagtataataagaataacgtctccctctggagcgaaagggtaggcatgcttactgcccatcttaaaagattagggttccctaagcttagggttcctctcctgtagagaaggaactgcctgtgtagatgtcaactggctctctttacgttgtccaatgggaacctggagttctgagaactagtgcaaaaatcttttttttttttttttttttgagacggagtctcgctctgtcgcccaggctggagtgcagtggcgcgatctcggctcactgcaagctcc

SEQ ID NO: 127993 - DNA, 1027 bp, Homo sapiens
gctggatttaggattctggttaggcaatttttgcacttggaagacagccttctactgtcttctgacttacattgtagctgacaaaagtaggctaacaggcctacttttgtcttttttcatgataattcatccttttttctttgtatttaaggcttctctttgtctttgatttctgcagttttaggatggtatatttattttctttatcttttttttatagggatgggatcttattgttttgcccaggctggtctcaaactcctggcctcaagcaatcctcctgcttcagcctcccaaaatgttgggattacaggtgtgagccaccatgtccagtctagtgtgatgtatttagatgttagtttctttttattctacttgagagtcattgaacttgggaaacttgtaggctctgttacttcacttctacgaaattcttgcccattttattttctctcagtccatccttttgagactctgattaaatacttgttatataatcgatatgtatatgtctgtttctggactctattctgtttcattgtttgtatttctctcctttctcaaataccactctgattactgtagctctatccatagtaaatcttgaaatcaagtagcataagtcctccaaatttggtattttttgaattgttattgctattctctgtcttttgcattttcattaaattttaggatcagtttgttagttactacaaaatgatcccctgctgggattttaattgggattgcattgaatctttagatcagtttggagacatggaatctcaactgtgttgagtctaccaatctaataatgtttttaatgtctctatttaggtcttctttaatcttcattttgtggtttttactatacatgtcctgcatatctttggttaatattacccctatttcatgtagctttttttgggaatgctttaggattttttgcatatacaatcacatcacctgtgaatatagttttacttcttcctttccaatctggatttatttattttttattgtgtct

SEQ ID NO: 127994 - DNA, 1116 bp, Homo sapiens
tctctactaaaaatacaaaaaattagccggctgtggtggcacgttgcctgtagtcccagctacttgggaggctgaggcaggagaatcacttgaaccagggaggcagaggttgcagtgagctgagatcatgtcactacactccagcctgggagacagggcaagactccgtctcaaaaaaaaaaaccagtagcaacaacaacaaaaaaccgtcatgcagctcatgattgtatttactgtgtaatatgtagtgctttgtttttctagtactgaaaaaaaaggtacatctggggcttgggaatgaagttctggtagagatgtaaatttaggatttactaacatttggtttcaatttgttccttattaggtagaggtatatccatgactcagaatttatttgtagccttagaggtcatactttgagggagtcaatatagatgagattgtgctggtcctcatctacctgattcagaaagagccagctattgtcatctgattttagctggacggtacagggcttactgcccaggtttaccaggtaccagcctaggctagacctgttctgtgcatttactcatgtgaaattgttacaacaatcctgcctcagagttgttctaatggaagtggaatattgagcacactaactagaacacagcaagttctcaataggttaagtatcatgatgattatcatgtattactcttttatagaagatgaaaaagaggctcaaaaagattgattaggagttacagagcaatcaatgaagagggctaatctaggtcttgaacagttttaaagtccatgctatatctccatttaaatacttacattgtagagtgtgcacatgacatgtcattagtggttatgtgaccacgggccagtcgtagcacccagtttcctcatctgtaaattgggggtaacacttaatgttttataaagaatgtctagagttcttagctgtgtgaagctggaggcataatgaaaattacgtttactccatcttctctgaaatgcattgtgacatctttccagattttaagtattaattctttgccagtactgtgtgtttagatagatcttccatcttgaggcttgtcttctcattttgttcatggtaat

SEQ ID NO: 127995 - DNA, 1564 bp, Homo sapiens
gatttagatattttaaaatattttaaaatatagcttaatattttcctgcacaatgaccttcacaatcttttaaaatttatttctaagtacttaatatatttttgttgctattgtaaaaaaatttttttttcattaaatgtttgtttgttgtttgtttatacatatgaaattggcctttggattactttgtatttgttcttatgcatttcattaaaaaatatatctgggaaccttattgcagtcttccatagtttaaattatatggcatcaagtttatattagagtttttttttttttttaatactttaagttttagggtacatgtgcacaacgtgcaggtttgttacatatgtatacatgtgccatgttggtgtgctgcacccgttaactggtcatttatattagagttttaacttgtttgttatttttatttattgtttttaccaagcactacgaaagaccattcttttttgttcaaaggaatactatttgcatttgttaaaaggaaatggtgttttacactctgtggagattttaaacaaaaggagcatgtctgtgttctacttccagaaatcctaattttgcagatctagagaaaacctgagctccttgttcttttgaaaatctcccatatggttctgtacgtttctgttggaaaaccactgctagagaagttgctaaacagtaaaagcatttagcccatgatgatgtgggggaagggaggcatttcatttaaaattatgaaaaatttatttatcatttaatatttcatgtgtgatgtatagataaaattagtatatttacatagacaattgtttttaagtgacagcaggtatgaatttaaaaagaatggacattgaaaaagaacaaagtcacagtttgagatgtattggttaagtactcagtatatttgtattaaaacttagaatataattttgtttttcccagttggagtcattcgttgcccagtttgcagccaagaatgtgcagagagacacatcatagataacttttttgtgaaggacactactgaggttcccagcagtacagtagaaaagtcaaatcaggtaagtgtattacatcttgaaccttttgcctgccagctcttttttttttttttttttttttttttgagacagagtctcattcattctgttgcccaggcaggagttcacaagtggcgcaatctccgttcactgcaagctcctccccacaggttcacaccattctcctgcctcagcctcccgagtagctgggaccacaggcgtgtcaccatgcccggctagttttttgtatttttagtagagacggggtttcaccatgttagctaggatggtctcaatctcctgacctcttgatccgcccatctcagcctcccaaagtgctgggattacaggcgtgagccaccgcacctggcctctttttttttttttaattgagatggagtcttgcgttgttgcccaggctggagtacagtggtgcgatcttggctcacttccatctcctcctcctgggtttgagtgcttctctcatctcagcctcatgagtagctgggattacaggt

SEQ ID NO: 127996 - DNA, 1884 bp, Homo sapiens
ccacttccagcaaccctcaccaaagccactgaaaaatcctagcttgtcattatacagaaacacttgctccttttctaatttgttctctacattgtagccattgtgacataaaaatgcaaatctggccgtgtcactttcttaaaagcttttaatagacttatttggacaaacaccaaaattgccttgtgactctgcttaatctggcccctgtctcttgtcctagcttcttttgccagtcttcccctgaatcgcaccacttcagtcatacttaccttcgttcagttctttgaacctgcctgctcttcttgcttgggactttttgtacatgctgttctctcttcctagaagtaaaagccttcactgggtaatccctcctcatgctttccccagccttccaaccccactaaaatgagatccatttcttcatcatatgctcttataactttccatagatttcctttatggtaattctcagtttgtaattatatattgatgtgcttattctaataatgtacatctgccgcacatttaatcttcacaactactcagtaatatctgtattattaccctcatattaaagatgagtactctgtgtaacctgcccaagaccactgagctagtaagtgagggaactgggattttaacctgcactatgtacaagactgtagttatcataagggcagcgaccatgtttgcttttcctgactgttctgttctcacacctagcataatgtttgggaaatacctagttgaaatatttgggatgctgaattaaggagaaaatatacttatattcttgtctcttcacagtattttcatttcttatgtgtataatgtaacacacaaggtcagtttaaaatttcccaacaccattaggaggctaactgatttagcctggtacaattggtgtatcatgtacgcatagctcgagataggaccaccttttcattttctcaaaaatttacgtgccatggttcttttgtcaggtatgtacaagctgtgaggacaacgcagaagccaatgggttttgtgtagagtgtgttgaatggctctgcaagacgtgtatcagagctcatcagagggtaaagttcacaaaagaccacactgtcagacagaaagaggaagtatctccaggtaataaatgagatctttgcatttttttccttctatctttccccgtcttttcttccttcctgtattgacttgttttgacacatttgttttgataagtattaaatatactgttttaagtaaaagaggtttatattatcgaaatttaagtacttacaaattttggaaagtacgaatagatgtagaaccctgttttacattcatactgcctgtcctcctgcttctataaatgtcttcaattggtgtgaatatagaacaaatggagaaaaaaattgctttttcttatttttcttttatctctaagataacaacaaagagtgggcttaaatattttataactcttccttttgatattcttgttgtaaacctgcatcatgatatttgtctgatatgtggatagccagagaggcttttttatgtaattattatttccagttttatgtaattattattgtcttgtttttaatgtacagttcactcatatgttttttattttggtaaaatacatgcaacataaaatttgtcattttaactactaaatgtacaattcagtggtatttattacatttacacattgtgcaaccatcactactattttcaaaacttttttatcaccccaatcagcatctttgtaccctttaagtaataactccaattttctggccgggcgcggtggctcacgcctgttatcccagcactttgggaggcagaggcaggtggatcatgagatcaggagatcgagaccatcctggc

SEQ ID NO: 127997 - DNA, 1099 bp, Homo sapiens
gtgctcaagcaagcgatcctctcaactcagcttcctgaatagctgtgactacaagcgtgggccactgtgccaggcttgattttccaaattgcattttcaaaaaatctcctcccatatttgggatagaagacatccaggtggttcatactcatttaccagggctgtcttaagactttttaatgcaataaaacatatttttaactacacacttagttctttcatttactcctgaactaatgttaatttctacttggaaaatgaaaaggttatttactttttttttcctgaaatgctgacaatatgtgatatcttaatatctgtaattcttagtgaaagttatggtatagtataggtgaagctgtagtgtttatatcaatagatgtgaattcaaatgagcaatctaataattatttactattcaattatgttaattttcttctctttgtctcccattgtttctgcagaggcagttggtgtcaccagccagcgaccagtgttttgtccttttcataaaaaggagcagctgaagctgtactgtgagacatgtgacaaactgacatgtcgagactgtcagttgttagaacataaagagcataggtaccagcatctttggttatatatatagattcatatgcagctttagaggactaaaggactgctgccaaccctcatcaaatggcagtctgcaaataggttttgtttggccagcactatgctggcctgtactggggtttgtcacttttgacactattgatgttttgggctaggtaattctttattgttgaggactgatctgtgcattatatggtggtcagcatccttgacctctaccaactagttaccagtagcaaccctctaaccctccccagttgtgacaacaaaatgtggctccagacattggcaacgtcctatggagcaaaatcatcctgagttgagaacactggccaacacactgttttaaaatatatagaactagttgccagcattgtaaaatggggagattttacattttttaaatatctagatttctggcttttttgagaaaacggaagctgttctagccctgggtctgtatacttcatgtcaacatttgaggcat

SEQ ID NO: 127998 - DNA, 1011 bp, Homo sapiens
tcattatactgttgcttaaaagttttattacaaggcataacatcaagaattttgcccttctctgtctgtatttatcctgatttatcttgtggcccctagaacataactacctattatttaaaagtggtcttttaaaatgtttattttcagcaggcttgcataatgtagaaattacaaaatagttaataaatctgattatgtataattgactattttttgccaagtccaccaagtgaaagtgaactctgtaagcttataaaaactgaatgatggatgcatgtggttctcaaactttcaaaatatttatgtgtccataatctttcttgagggataatttgagaggtgagggaaacttgccttattagggatacgtttgatgttttaaaagattattatataaattctttataatcctattttatgtttttatgtctttttttattcttggactttttcctcattgtatatttttatatgaaataatttgcttatttcttcagataccaatttatagaagaagcttttcagaatcagaaagtgatcatagatacactaatcaccaaactgatggaaaaaacaaaatacataaaattcacaggaaatcagatccaaaacaggtaattttatggtattatgtaatcatttttatataatttgttaagtatattcacttttagaacattttccttaagtcacagttaagtaatacgttgttagatgactgcaataacacatgactgataagactttcccagaaacttagttggaaagcattcttttctgctgtaaaatttcaaaactaataataaactacacttagtattttaatagctcatttatctaataggtattgataacttattatcacttattttccaattttaaagaaataccaaaatttaaatgccaaatcaaccatttttttgccagtattgtaaaatattttaacacttgaataaacccttaattgttattttaaggtttgctgaaatttgagatgcctgccttatg

SEQ ID NO: 127999 - DNA, 1284 bp, Homo sapiens
gggtttaaactttttttattctgagtaattgaaaatttgtaatgaatatttattgaatgaatgaagagagataattataggcatttctaccatctagtggcaaaaggtagcaatcataaaataattaattttaaattaaacatctgcccttaatgaaatttatccctttgacttttttcttactgtttcactgagtatatggtttgatttatggtcaaagtttacatttttttttatgtaccgctgtcaattttttccactatcatttgttgaaaaaactttctgttgaattgtttttcagcacctttatagaccatatatatgtgtgggattattctgttccattgtgtttttctcattgctagtacttcactttcatgatcatgatcattgtagttttttatagtaagtcttaacatagtgtttttcaaatttcttcttttatttttataaatgatttgtgctttttttcttctacaaaataataacattgtgtgtaacaattttgatttctgaattgaggcaaaaaattaaacaatctttgttaagtgcaaattgcttacatatctttatagcctatgtgattataaaagggtacatttattagagtaactggtagtcatttttatgcatttgaccccatggcactgtttttcccttactcatcctattctaccatcatgaatatttaaatgacttttttgagattggttgcttctcaggcttatctggttcccttgatcctgtagtaatgttgatgtcaaacaattatctggaagaatttccagcaggaaataaagtctctgccagtttggtcttgagttttggagggtaactatgggagaagcttacagaagaaatgaagcttttaatttaatctcacaaagtttggtggatgctctgttattttctataagatattctggtgtggtaccgtatgtttttctttctgtaagagtgttgctggaatcaggagactggagagaccagtaggtgaaacaggaggattttattgagtgcactcatacccagcggattaatatccaaagaccaggcctagaacaaagactgggcctagaacaaaggctgggcctagaacaaagactggacttggcttttatacacacttctaaaaggggatgggctagtttgaaacaagcttacagtggcgtgaagcatagtggtgtgaaagctcaggtacagaagcagaacaaaggcagttaatcatactttgacaggttcataactcaggcttacaatgactcttgctatgcggcctagatg

SEQ ID NO: 128000 - DNA, 1662 bp, Homo sapiens
tccaaagaaacacttaataaatttttacagaggtcaaaaatagtctactaggcaaattactgtctctctgaacttaaattagatatggcagagccgttggatgttgttagtagtccatcaaacagacaactaccatttcctccttaattcaatgtagctcaagtgtattttccaaatctggaactgactagggctaggatctgggttcgctttttattgagaatgtaagtccatgttgtagtatagcaattttacttgtaaacatttctaatttgtctgagacagcagaaagtcctgttttcctcctttttccttgctaggtctaggatgaggtttttggttaggaacctttaaaataacccaagttcagtgtgctctacttttgattatccatcttctctaaggaaagcacatacatacctcctttagagaaatctatattcttttatgtagcttttgttagagtgcattggcccactcattcagtgcatctgttggctccgatgttaattctcaatagacaaataatatgatgccttttaagaaaattaccacatacaaagggtaagtgtcatctacaacacagcatgactctgttttgcacaaactacttgcaattccaactgttaaatagaatccctaaaaggtgaaatcatatgattgagtaaattatgtgatagagttactttataggtttgctggacagtacatctgttttatttgtgaatgttgaatttcatagacatttactgtactatagctaatctttccttttttgtgtattgtaacatgcatgaacagagttaaatcccagaatatgtaaaacctgatccagggccttgaggagtgaggggccacattgggatgcagttttttgccatagtgaaagtgatcctttatactaatagggaaaacagagtatttttagtttcagtaaattgagtaattagagattgtagttattctaatttgtttacctggaaatgaccatcaaagtctatgttacatgctgatactaattttgaaactattttcttgttttcagagccttgcaaaggaccatcgcatgaaacttatgcaacaacaacaggaagtggctggactctctaaacaattggagcatgtcatgcatttttctaaatgggcagtttccagtggcagcagtacagcattactttatagcaaacgactggtaagataaagtatgctatttaatatactgtaaaaatgcacagtaaaacaatggagccattgtaatgcttaaaatttattctgcttgtgcatcagtgctttttacctatttctaatatctatcaaaatattttggttttaatatttttacctggcataatttgggtgtaatttcagttttaatttatcattaattcctttttttgttctttccaagtattcactgtcttcatagcaattgaagttaatatcaaaaataaggatgatagtgaacattttctgattatctatagtgtgccaggtactaattctaagaatttccatgtaatatttaaacttttacctcattcttatgagatatacctattcaccccccttgtacacatgatgaaactaaggcatgtgattatgtaacatgtctaacatcacacaatatgaggtatagccagggtttataatatgatctcagac

SEQ ID NO: 128001 - DNA, 1102 bp, Homo sapiens
ctacttcccactttcattgtattcctacttgttactgtttagtttgggccttcatcagttcaaatcaattatttgcaacagttttccttctttcttggctgcttttaattagatcttccttgttccagtctacactaccaccagagcatagcttcttaatctttttagggcagtagtccagaatccctcttttgtttattgccttaagtctgaacccattgatctttctgtgtcttccattagttggtttaattttgtttacttggttttcttttttgaactccttttctatcagcccgtaccacctttcgttgtcttctgtagcttccactggcactagggtctcactgagatcttacccctgttactctaacacagaaagacttggcaatgtttggagatgtttttgattgtcacaccccaagctgggaagtatagagagatgccactggtatctaataattggtggaggccagggatgttgctaaacatcctgaaatgcagagacattcctccacaacaaggaattatctggcccaaaagtcaatagtgcagaggctgaaaaaccctgccggtgtaacaggctgtaacagactgctgaaaattcagcaactacttactgtttcatagaatttcatcatggttcccagtttcaatgtagtgctaagtgaacacattcaacaggacttcaatgcataattattcattcgttttatgaatgtatggtttccccctcctcaggacctgttactatgactagtgtacaccccccaatacgttcacctagtgcctccagcgttggaagccgaggaaggtaaactgactaaaccatattttctagtatataaaaatctctaattagatttcttttgccagtgttcaacatgttttgatactcaatatattttgaacaatttcctttatttttaattaaaattttaataactactatatattttaatgaattagttaagggattaacaaaagtacaaatttacctttgaagatagaagaatatttgtcaatatgttgaaaataagaaatgttggatattcatataatagcaaagaaaacataaaaatgaataggcataacacagtac

SEQ ID NO: 128002 - DNA, 1033 bp, Homo sapiens
ataaaattttatgctaatttgatctctaatgactaaatgttgattctactttaaaataaatatacagttattgaaattctatattttaagcaactgctctcctcttccctgcattatgcctgaaaattcctcctagctagtgaacccagttcttactttatcatatggaagaattgtctgagggagaaaagtttgcctttaatcccatgagaacatagtgaatctctgtaaaagctttttgacccactaccttctttaaatagtattgtgtaaatacatgattatttcattgtcttcaccaaagtattcactttgctactgactagagaaggaaatgagaaagcctaaaatcagatgccagttctaagatactaaatctggttgcctaattgtaaagcctcaggtttttaaaagtttaggtttattgaaacatctttctagatatataactatttagataggttaatatgtaaaacatttttatcataaatgaaacttgcatacaccagtttcatttgttatgcatcattaattgctgatgttaacatacttattgttgtgaagatacagtattttagaaagttgttgttatactttttatgaggtatttagcttaacattcttagattgctttttcttctctctcatacttacagctctggctcttccagcaaaccagcaggagctgactctacacacaaagtcccagtggtcatgctggagccaattcgaataaaacaagaaaacagtggaccaccggaaaattatgatttccctgttgttatagtgaagcaagaatcagatgaagaatctaggcctcaaaatgtaattatgaatgcttgcaatgctattcctatgcatggtgggtagggtgagagaatcttttaaatagctcttaggagtttttttttaatgttatatttaaaaggatttaaagacaatttgagggaatctctcagtaaattaaacaaaaagacaaagatggaaaaacaggaaagtttttaaaaatcagaggctcagatatggaggctgg

SEQ ID NO: 128003 - DNA, 1051 bp, Homo sapiens
gtatatatatatatatataggtcatgtggttgacttccactctacccaacccattctctaatttctgtagccatccccagacttagattttttctctatttattttggtattttttagtagaggttcatgtcttctaagccagttagcaataaacatatacccttctcctgaagattcctttgaagcagccaggtgctcaccagagagtggtctacagttcagaattgcattagtgataaaattttttttaaagccagttaaatatattttttttctactacaggccaattatccaagaagcatactcacctccctgctcttaaatagcagtcagagctctacttctgaggagactgtgctaagatcagatgcccctgatagtacaggagatcaacctggacttcaccaggacaattcctcaaatggaaagtctgaatggttggatccttcccagaagtcacctcttcatgttggagagacaaggaaagaggatgaccccaatgaggactggtgtgcagtttgtcaaaacggaggggaactcctctgctgtgaaaagtgccccaaagtattccatctttcttgtcatgtgcccacattgacaaattttccaaggtaagatagtacttcccttcccacattcttttactgtaaacttttgaagattattttaacagaaagcctttgaaaaaacttaaatgaaattccacttggcacaagtgtatactccaaaatcccaatgaatagtctaggttttcccatacccttccgcttattctttgtgcttctttcaaaaaactaatcattcagcctgagcaacacagggagaccctgtctgtctgtacaaaataaaaaattagccgggtatggtagtgcatgcctgtagtcccagctactcaggaggctgaggtgggaggattggttgagcctgagaggtcaaggctgcagtaagctgtgcttgcaccactgcaccccagactgggcaacagagcaagaccctctccctagtcattacaaaaagaaaaaaaaataacaggccctttaaattatcac

SEQ ID NO: 128004 - DNA, 1069 bp, Homo sapiens
atatttaactgtaaataacatttaaagctaccaagtcaacactttgttaccaaaaaaactcctttgctaaattattaagtagaacagtcaatatgaaagttgtcatgcaagaggggacgtgcccattcactgccagtactactcagtggttactgggataaacccataaagcagggaagtatatgaatagcagagcacatggttggaccttcggcatgcagaaaggtgccttaggtctggatgcatattgagaaggtccacctccagttctcctaagagacgtacgttcttcctttatagactattactaatttataatacacagactggagcaataagtgcaaatttattgttagaaaacttcaaatggttttctagtgattgtcttagttcattcaattacagggcctgttcccaaatattgggaaggagagcaaaactccgagaatcagtaatttttttgtattcatctgggttttaatttttagtctgacactttgggacctctgagattgttatttaaaataagctgtgaattcattgttttataatattttatctcagtttttatttatttttgcttagaagtgtgagcgcctacttttatttctttactgccatgaaatgagcctggcttttcaagaccctgttcctctaactgtaagtattaatgtcattttctgcatgtttacacagtggaatgcttttctggaattttatgagaatctagcttatattaccatttttcagtactttttaatatctaaaccttaaatcttaataatacatactgaatgctttgatcctatgtaggtacattttagtaagtggcccaaaacttctgttcatttctcaggtattctttcttctttcttttctcatctattttacttaccactgggatgtttagggtgatttctgttaattttctgtatttcaggagttttaggcatgtttccgaagctgttggaaaaaaaactttgaaataaagacatctctccctgctacattttccgtacttatttttctttataggtccagacttcaagtaaataagtagacgttacca

SEQ ID NO: 128005 - DNA, 2371 bp, Homo sapiens
cgcatgcctgtaaccccagctacgcgagaggctgaggtgagaggatcacttaagcccaggaggcaaagtttgcagtgagccgagattgtgtcactgcactccagcctgggtgacagagcaagaccctgtctcaaaaataataattggttaaacttttggaaaaagtcacacaaacctttaccagtgtgtgtggaaggcagtgggcacttgtaaacactgttaaatgggtttctttactaatggcaaatagcacagagaaaagcaatgagaacattctgaattttagagcacatctcatagaatatatttaggacaaggtggaatttagctatttgtattataacatctcatttttttaataggtgcctgattattacaaaataattaaaaatccaatggatttgtcaaccatcaagaaaagactacaagaagattattccatgtactcaaaacctgaagattttgtagctgattttagattgatctttcaaaactgtgctgaattcaatgaggtgaggctaggggagggaagggggcaggaaggaacagcagtgtgaaaatcattttattactaaacaccttgtcaacataggagaccaagatgtctgagttagaataaatttccaacttttcagatcagggaatgcaagagataattcagataactctgtccacatttatattcaaaggtttattagatggtgatggaaatgcaaattacagctgataactgaaagacaaaatgtttttctctgacctagacatattctttatcattcccacctgtatttcttatttttatgttgatcttgaaatattaaggatgtgggccaaatagctctaatttaaaaatttctcatctgtcagttcatctacacatcagtcagacttagaaccttttgctgctggtggtttgttctctgttactcattctaatagtactacatttaatttgttctaaaaatacctggttcatgatcctatggttatggaatcctaactgatatgtgtttggcaatatagtcctaccattaccaccttcttttagaataatccaggcttttacttttatcttttttccacacttctgaatcttttattttagctggccttctgtacagagactttgtctagtcctaaactattatttcaatgactatgcatgaacacttttcaaaacagctcattaatatatataatctcagaagtcaaaagtgtgtcctttttttactcatttttatttttactccacagcctgattcagaagtagccaatgctggtataaaacttgaaaattattttgaagaacttctaaagaacctctatccagaaaaaaggtttcccaaaccagaattcaggaatgaatcagaagataataaatttagtgatgattcagatgatgactttgtacagccccggaagaaacgcctcaaaagcattgaagaacgccagttgcttaaataatatgcagcaccactagcttgtgctggtttttagatttttttgttttcaaaaaaacatttgtcagtaatttaacatcactacaaaaagaagagtttgtgactattctcatctctgttttggacgtttactagactttgatttccttaatagcccatttctgttaacctcttatcactaagaaagaaaggaaagaaggagatgaatagaagaaagaaaatggaaagaaggaaaaaaggaggatagaaaaaggatggaagaaagaagcattgaaaacaaagacattcttcccacttcttggatttttaaaccacagtctggagtgatagctactgtagaaaggaaatagactttgtatgaactctttaagttgaaaagtaaaaaatatatgtggtttggatgtgtgctttaattcagctttagaaattaataccactacccgtgaattatatggcctgacaatatgaattaggtgtactgtactgaagaacagtactccacaaacatgggtggtaacaagagttccatcccaggaggccaaacggtgcaacagaagggtaggttagatgctattaagaaggcacttaatagtacatcatgtaagatggcaactgtattaaagaaaaatccggaaaacaaatgtttgatttttgtttttgtttttatcttgtctgtagaggtattttggtatagcaggttttcaaggccattttttatacatttctagatctagattttcaacttcttccactgagggaagtatatacatttgggtttgctgtgtgtctatgtgaggtttaattgtacaggtgatccttttacaacaagcctcattgtttgcagtatagcttttagtggaactacccaaaatataaatacagcagcgtgcactgtatttgatgtgagggtt

SEQ ID NO: 128006 - DNA, 2082 bp, Homo sapiens
accacgtaggagctaggatttactcagttccacctcactgacagcttttctaggtgccaagcaactgacttttcctgtgtaaggaagcccaagtacttgaccagtgatatatatggccatggcaaaagtataaatggatggatgtagaccatattcaacgcagaatacattttagatcggtatctggcattgtaatcattttgtcttttgaattaacatgccctgcttgtcttttctgaatggaagggtaggaaagtggaaggtactaaaaaggaaaatgtagttttagtttcttttctaagctaaagaactggctttactactgctatattttactaccacatagtagtgtagatgtagtataacttgcttaggaatgctttcaaaaaggttacctccatagtcaaaaaaagggggagtatacagctgattgttgcatttatgaaactgcatttcaatatgctatgctgttactgtgcttagacacttccttacgtttgagttccaaggagagagagtgagaagaggaactccttttgctgagctctggtccaaattaatgtgaatccccaaagtaaattgctgcatatgaacaacaggttttaggtttaaattgaagatacattcattttatatgtatttgttgtgaatgagagaaattgagtgatctgattggccattaaaattatggtgaatgggtcgggcgcagtggctcacgcctgtaatcccagcactttgggaggccgaggtgggtagatacctgaggtcaggagtttgagaccagcctgaccaacatggtgaaaccccatctctactaaaaataccaaaatcaccagggtgtggtggcccatgcctgtaatcctagctactcgggaggctgaggcaggagaatcggcttgaacccaggaggcagaggttgcagtgagctgagatcgcaccactgtagtccagcctgggtgtcagagcaagactctgtcacaaaaagaaaaattatggggaatggccgggcgcggtggctcacacctgtaatcccagcactttgggaggccgaggtgggtggatcacctgaagtcaggagctcaagaccagcctggccaacatggtgaaaccccacctcaacagaatatacaaaaaaattagctgggtgtggtggcgggtgcctgtaatctcagctactttgggatgctgaggcaggagaatagcttgaacccaggaggtggaggttgcagtgagtcgagattgcaccattgcactccagcctgggcaacaagagcaaaactctgtctcaaaaaaaaaaaaaaatggtgaccatgcgttcaaccatataatttcttactgaaattgagctcctccttttgaataaccatgtacatatttttaaaagtattttatagccctatgtaaattaatagttgatgtctttttataaatgtttattgcatattcatcttgaatgtgaatttactgttgtaattcacatactggtgtcatgtttctgagtgagaataatgctagtcagtcagatcacagatttttctccatgaaggttttacttattgagagggacatctgaggcagtagtcttcgtctttaatttttgggggcagattggtgctttggttttaataaaaactaactttgatggatttttactgtcaatattttaccacaaggattttttaatagaaaaattactgaatgttacttcagcagagttctatctactttgagtctccattactactactgttgttcccctagctgtaacattgatccatataggggcaagctactagtccataaatagctgtaataggaaaacagttttttaaaattctaacacgtgtatttcaccagccttaaaagatttaaaaaaaaatctgacaggaaggaaagcgggtggtaagtatcttggattattctgcctcataccagccactcccaaagtaggaggaccaaagatgccatgaagacttctagttgtctggaagttatttggggaaggggggaaagacacagagtggggacctttggaagtcattttaaaaatttagctatgttaattccacttgtaaagtttga

SEQ ID NO: 128007 - DNA, 1050 bp, Homo sapiens
acctcagcctcctgagtagctgggactataggtgcacgccaccaggtgtggctaattttgtatttttagtagagatggggtttcagcatgttggccaggctggtctcgaactcctgacctcaggtgatccgcccgcctcagcctcccaaagtgctgggattacaggtgtgagccacggcgcctggccattctatcatattcttaattgcaattagtgacgatatagtattggaatgattaaggatatttcaagataccaaagaaaacagaaggtcaaagggacttggggcaagtcagggctggatgcggggtggccttgggactcatgtcggtagagctgtgtcggggtccctcctgctcacagagtgaatggcccttcctttcatggtgtgtcttcacgtcctacagggccttctctctgcatcccaatccctgtgccttaaggaatgtcttcccttctggctgcctaggttcatagccggtgtgatcaacagggagaggatggcttcctttgagcggttactgtggcgaatctgccgaggaaacgtgtacttgaagttcagtgagatggacgcccctctggaggatcctgtgacggtgggaaccttgggctgcaaaaactttctctgagacttcccatagccctcagcagaagcgcttcgttctcccaaaacatgggggatctttagtttgatgagactaatatctatttcctttttttctcctttttttccttcccttttactttgttcctttttaaaaatatatatttgaaaggtcagttcaaggactgattcttgtcaacacctcataactggtttattcttcccagagacatagctatacttttctctagaacttagttatactagtactatcctaggcggcagctgtgtcttaaagaactgagaactgattgaggtcagcttctcaagcttcaatgtgcacgcgagcatagaggtcacccggggatcttgttaaaatgcaaattccaggccaggcatggtggcttatgcctgtaatctcagcgctttgggagcccaaggtggg

SEQ ID NO: 128008 - DNA, 1027 bp, Homo sapiens
ggctgaggcaggagaattgcttgaacccagaaggcagaagttgcagtgagctgagatcatgccattgcactccagcctgggcaacagagtgagactctgtctcaaaaagaaaaaaaaaaaaaaggaaggggtattagggaataatacatagaggttaagagtatggcttcagagtcctgcagacttgcgtttgagttcttctgccatcttgtgatcttgggcaaattacagcctcagtttcttcatgtaaaatgggaataaaagtcgcacctgtcgctttgtgaggaaggcataagctaacgtgtaaaagcacgcagcacagtgcatggcacgtagtaggcctcatcagtgtcagctaccgtgctgtgattgttctgttaatattaatggtagagaagcctgggcagggctggtggtgcatgccgtcgtccttgctgtcccttccccaccagacgtggacttctgcccacaagcagcccggtgctgccgcacaggagtggacgagtacggctggatcgcggcagctgttggctggagcctctggttcctcaccctcatcctgctctgtgtggacaaactgatgaagctgactccagatgagcccaaggacttgcaagcgtgagacccaggctcggtgcacaaaatggtgatcgccaccaatttgtggctaatggggaaggggagtaaggctaacatggtttctattatttaagtcattttcacctttaagcttcagttacttttacaagggaaagaagaaagagcgggagaaccaaataaggcaagccagtgctgcccttgcatgtcactcccaagggcccctgggctgtgcccaggtaactcctctctcaagatagtccctctgtaatgtatcctgttttaacctttcttctaggcaccaagggaggtgcacaagaaactataagacttagtctcatcatcaacattttcagaagcaagtgcataaccttctcaccaaaaccaggttatctgcttctgtccctggcttgagtcctgggcttaactg

SEQ ID NO: 128009 - DNA, 1113 bp, Homo sapiens
tgaaagagaaggagtgcaggagagtaagtctctcaaggacgttcaacaaaggaccagcagcatcttatcaggcgatcctcagaggctccaaggagcattggagagaatgcccctttctgggcttgatgtcttggttttggtttaataccaaatttctcttggtcttggtttaatacccgactcctcccaaattgaacgattatctttgtatgtcactcaaaaataccaggtttcctgaatatgttattaagaatttcagatatccaagcagaattttattatggacaccttgtaatgaattcaaatcgtgtgacagcaaacgggataaatggccccttctcacccagttccgctcagggccatacaggcttgcacatagagtgtgctaaaaatggtaacctcctttgagcattgcagaaagagggttctgtttcaaattgggctgaccgtaaaagcaattttgatgtctttcaaactaccataaagggattttaactgtatttttattcttagaaacaatacacctttaaacagatgtcaagaccaaagatgatgtataataaacagccggtggttatggtgtggtgtgagcaggcccccggatcaccagccctctgctggtggtcataaagcacacacagtttgtacttgcttcctctcgacgcctgccacaacagttttgccagtcaccaaactcagaaaaaactagctgtgtgagcagcaccgtaccctagcggtcttcagacattaagttcacgtcatccactgaaaggaagggtccttgcgttgacagcgtgtggctttggagtccgtttatggaagcactctacaatgaacagttgaattttatgtctattcttttttcctattttaaaagttctagtggtaacacaaactgtaaatttgagtcagaatgtttggagaaatgttgtttttttttttttcagagactactttgtcactcactgaccatgtctggttccttctctgaacttcattctccccataagccaaacaagaacagacctcccccgccacctcccaggcaccgtagttgtgagaatcagatgtgatcatgtgtgcagatgtcctgtgaggagggagcataaagca

SEQ ID NO: 128010 - DNA, 1113 bp, Homo sapiens
aaaaaaaaatccctcccaaagtggggcaaaaagctttatatttatttgattatccaaaatacagatcaaagtttagatctacattcttcattgtatttgctgtttcttaattgggcacacacaactcctggtcatgtcccagttcagcaccgatcgctaaggccgatcctgtagaatgcggctttcaagaggtcctaactgatcctttcttccactttgctgttgatttgttcacaaattatgtctgaatgagaaatcttctgtaagcagaagttatttaataattcccagcaccacgaaattgttatacatacatccctaccagtcacattccctgtgttcagagcctggaaatgaaattgagttcagttcagcctctctgtaatgaatcaagaaatgtaaaagagctttgagaccccaagggaaaggagagagttgcttctcatttctgattttattgtgctgttactctgtcgagtggctattaaaattgtcttatgctctttgggctaagaggggatcatctcgcttaagatgtactcctgatgtaaacatttcccccactttccaaataatggtaaagaaaacagtggcaagggctgttctgttttctggtacctgagtgaaactcagaagaaaagcaggcttagctaagagattttcactattaacctgtttttattagatcagcgaagacagtcatgcatcgcttaatgatggggatgcattctgagaaatgtgtcattaggctgttttgttgctgtgccaacatcctagattgtacttacacaacctacatggtatagcctactacacacctgggctgtgtggcatggcctattcctcttaggctacaaacctgtacagcatgttactgtactgaacacaatggtaagtatttgtgtatctaaacatagctaaacatagaaaaggtatggtaaaaatacaattttataatcttatgggactaccatcaatatgtagaccgtcattgaccaaaacatcctgatgtgtgcatgactgtacttttcattaaataacagataaggggctatagaatttggggctctgactgatcaaaacctgtgtatctgtgtcaagttttaagacccc

SEQ ID NO: 128011 - DNA, 1052 bp, Homo sapiens
tgtcctggaatcctgtaggttttcctgaactttacaggtgctttgctttgcagtgaatcttgattcccctgctaattttaggtatttgaacctccctacatggcatgcgtactaagcaaaattcagatgtattaatttttagtttaaaatctgaacgaatatagaaattatacatgtttgataacattcaaaaggaaattatttttaaatttctattaggtgaaattatgtaaaaacatataatggaaaatgttaagatctattagaaggattacctttttaactatagaaaattatgaagcatgtatttgtctgaaaattgccagttattttcaaaaaaagaaaatagtacctaggagaaatttacagcacctcacgatcaagaagtatttttattgtagaagatacctcatataaattaagtgggccaacctgaaaagatcagtgggaggaggaaaaaggtccagtttttaaattattttaaaattgcaaattaacaccataatgcaccatttcaatcatgaaattatttttataataatgtggcatggtaaagttagcatccagtttcttcatctatatgtactgggaatattcgtacttacctccttggttgtttagctgataaaagaagatgacagaagtgctcaaaatagtgcctagcatagcataaactttcaataaatattagctgccatgaccattgtcactattattttcagtggtggcataaattattaaatttttggaaggcagtttggcggtaggacttacagagcctttgatttggtaattccagttctggaaatccaggctcactctcctaaaatccaaaatattgggggaaaatgacgtgccaagatatttatcacggcattatttgcataatagcaaagaattgttagtttccccagatactcagtagtaagggcatccttgagtaaatcctgcagctacttaagatgaagaggtcataaaaagccagaaaagggggatttgagatttaccagttgcctcctatgtgtttgatgcttcatctgttttatgtcttt

SEQ ID NO: 128012 - DNA, 1050 bp, Homo sapiens
taatctttcacaagtgcctgtcttctcctggaactctgggtataaacagaacctggcatgcagtccatgttctagcgatgcttgttggattggagttgtggaattgccagcacagtcttgggtcagaagttgtgctcctctcatcagccttggattccgggttaacaatcttgtttgtgtgtgtgtatgtttcagctgcagatccctagtgtgaagggcttcgattttgctaagcagcatctgggtcagcacaataaagacgacatattgattattcatgagccagcgccactgccaggacctctgaaggaccacaccacgccctcggaaaatggagacgtgccaagccccaagtcaaagatcccttccaagaatgttcgtcacagaggaaggttattattgggctttctgtattattctttgttgcagagcatgcttctgttatcaggctgtgagtttctgatgtcacaggggctgatggtgagcgcagccctgcatgtgcagcccagcagactgatgacttgcccaaagtcacacaggagcccaagagtgtttccgagccactctcacgggctgccaaagaaggctgtgtgatttctttccccacacggttgaagatcatgaatcactatctgtgatggtttaggggtccccatcagacttgattagagattgaccagctcatgtgtatatatcctgaggggagcatgctaggcctcatggagataatatcagaaataacatagaaggagtgcacagcacatggtacacgctcagcctgtgtggactgctgtgtccatgcctgggatgccagcagctgctgtgacttcattgctttgcctgcaggtgaccttcatcacatcctcctgcgtttgctttgtttttctctggctgcttatgtatgtcacctttgtcaggatatcacacaagactcttcaccgcctcctccctgcctcgctccccattccccctctcaaagtatagcacatggagaattgcctattagttttccaggctacctggaagccccttctcaccctctgaccctgt

SEQ ID NO: 128013 - DNA, 1029 bp, Homo sapiens
tttttgagatggagtcttactctttcacctgggctggagtgcagtggcgcgatctcagtttactgaaatctccaactcctaggttgaagtgattctcctgcctcaccctcccgagtagctgggattacaggtgtgcaccaccataccatgtctggctgaattttttttttttttttttttttttttttaggggagatggggtttcaccatgttggccaggctggtctcgaactcctgacctcaggtgatctgcccgattcagcctcccgaaatgctgggattacagatgtgagccaccgtgcccagccaacaaatagcatgtttgatgacataatatcttaccacagctctagaagctgaggcctggcatccctagttgcaggctcaggggtctgtcatgggtttggtgtggggtgatgcttgtatccctggagaggaatcctgcatccactggtttgagtggggcacgtttttgaagagccctttctccttcggttttgtgccccattacttcttttgactacttctttctagaaattctttgttccctttgcttctactacatggaactttccaaattcttctgtttctttgaaatcacattctattttcttccttgtttcctttttctcttcttagccccaaactattagatgttctccaacactttatccacagaatctgtatttatgttgaaaaactcagctcccctacctgtctcctttatgtgggtggttcttgaagtcacatctgagcctgcaagttcccccaggctatggttcctcacctccagctacaccaagctgacatcctttggggcctcaaattaagcgtgtttgaaatgaaacctgtcattttgtctcgagccatcattcctatatgactcgcctctttcccttaacgtcactttcactcttcacgtgaaattcacgtcctcaatggcttctttctcttcctttgcctctcttgtctatttggcttctaggtctttctgcctgatccctagagctgttcattccttcccatgtt

SEQ ID NO: 128014 - DNA, 1035 bp, Homo sapiens
gtacaactccattggtcagttgctttattttctgttcaccctatttggaagcccacttacccaccttgatcattaaaaacgaacaatacataccttgaacattttaacttaaaatatatgaatggacatttatttgccaatccttcaacatatcccaagtcttgttttgttttgagtgttggtctactgagaggaattgtgtttggtctttcttacaataaacaacacccatgacgtgtcagtttcaggttccagtttgggtttctttagagaagagcaaagctacctgaatgcaaagttctctcgatttttaatacctccccccactccctatcttagagaagagcaaagctacctgaatgcaaagttctctcgatttttttaatacctccccccactccctatctcctaattttgcagacttttgagttaattcactcacacctaatttgacagcagattttttaagtaacccctctttcctatgtctttccaaagcattcaacttaagtgtttatagaaatagcaattttcttttccaacgtatgtttcaacagtttccatagtattcgagggtcacatcaggtttcagagcaaagacattgacttttggtcaacattgagctcacctggtgtgagcaaaaacatgccaggcctagaggagcactcactagtacagcataagtatcagtcagcgtgtttaccaagggagtggaacgtggtagtcagtccactgttactaacagtctgctggattaacatgcactttccgtgggtctcccagatttggaggactcatcctgctttaaaagcttgataaaaacaagcaaaagtcaaaaaacaaagaataaaagattgccctatttatttttaaactttattttggttgtcttgggtatgaaaaattctgcatattacaaacctagacctgtcgaatggaaaaaaaatatgcattactttaaaatttattttacttttgtaaaagcaaagaaagagtatttgtcttttcatatgaattaacaaaaaaatgcaaag

SEQ ID NO: 128015 - DNA, 1091 bp, Homo sapiens
gttgccaatggcaaatgtagagaccagcaatttaaatggcacatgtaaaataaggagctcggagccctcgctgatccttttctcaggacagaagctcagagttttgctggagtctaaaggggtaatcacattgttgcatattattagagaaatagagtgaaatgaaaaggtacgatatgtcaagtgtgctagattttgaaataagggcataaaaaactgtcttttaacaccagaaagagagaagttttgggatgaatcaaagtattatttgacccacaagattatgaatttatgaggtttattgtccatagacctgtggtgggtgggggtgattttgtcctccagggtgcatctggcagtgtctggggatgtttttggttgtaacttgggtggtgcaggatgggggtacctggtgggtagagggcagggatactactaaccatctacagtgcaccccatgtcaagggattgtcagtagagctgaggttgagaagccctgccctagcagaatgaggaggaaataccaataggctgaagaaaggattgggtagaaccattaatagtttcagagaaccagggatgtacctaatcctacagttaatgttgggaggatgatgctctcttatgacgtggtcagcacatcagagattgtggggatgattttagaccacctggactcgccagccctggttctgtgcagcctccctgccccttggccccagaaaagatgtagagcgagatgaagcaacctgttactccacacaaaggaactccccactgtccctcttcccatcaacagagagcaccatggtgattctgggcccctgaatggcttacggagcttattatgaggattggaataaatcctgagtgacacagccaggattcagcaacctgagagagggcatctagaaacatgagcttctgcaatgtgaatggtttctgctatctttcaggtggtaaatgtgtcgaggctggagggagatgacaatccggtacagctcatctactttgtggaggatcaagatggagaaagactcagtgcagtcaagtcttcggacctgattaacaaaatggacctccagagagca

SEQ ID NO: 128016 - DNA, 1019 bp, Homo sapiens
gggtggcttggcacctgggaagctttttttttttttttttttgtcttaggggagtgggtcagatatttagaggtatggcattgcagttgaaggcctttctaacctagtgcacaaaagtctgaacagtacttacgtactcaccagctgtccagtgtgcatgcagcacaggaactagctgggcacgagagagcatgtggggtagtgatagttgccattcacggggttcctgcatcttgcaagttctccttgccgaacacacagcatcccacgtcaaggtcctatcgctttgcatggtgccatccgcggtcttttccagataatttctatagcaattaagtaacttgcccatggttgtatctcaaagaaaacttaaaccagttctggttgaaaagcacatgctccttcctcccagaccacactggcaagtgattgtctgttgagatcatcttgtctgaaatagataactaaagatgggcaggcttccttttttcaagttagtttgtgagtccaagtctcaaggcaagacaatgaactcacaccaattccagaagtgttgagataagtgcagacaaaatgtttgatcttgcgtaggcgccctttgcgccaaagctcctgcagtgctgagttcctgggacttctggccgccagtctgggtaacactgagagcttggagctcttgtgggctgcatttcctggactctccccattcatgatcactttttctccttttgatgttttctgtctaggaattggcattttatggcaatcttgcattaatttcaaatacatatgtgcgcgcgcgcgcgcgcgcacacacacacacacacacacacacacacacacacacacacacacacacacacacacacactgtttttttactgctgacttgttttgggtgccacgtatgttttcatttaaatgtagttctcctgggcgtcatggagaagcaactccagaatgaagtgtttcaagccgagatggaacgcaagctggcccagctgctcagcgaggtttcc

SEQ ID NO: 128017 - DNA, 2122 bp, Homo sapiens
gtagctggcacagctttccccttgagctgtggggatctctttctacgtcagctccatctcctggtgggaaaattcgtcggagcgctgggtctggggcagaatatgtcagcgtgggcttctctctgggtgcagtgtgtggtcagagacaagcagacagggaacaccctccttccagcatctagataaagaggttcttcctaggggatggggcactttagtgtgtgtctcagggcagagctagctgcgttttcattcattttctttccttcttcggtgtgcacaggagttatcttagcctctgcccaccttcttggttagggcccagacccaccatagtcctcttaggcaggagtttgttttcctcaggaggcagtcttgttctgggtgagggcctggctgctgctagcacctctgttggcctgggtgtggcagttaggaaggacggaggaggaaggcaatacactcagctctttggcacagccttgtaattaattatactgattaccactgtgtagcctgctcttggtctcattcctgctgatctctgccacagagcccctcctggtcctcttggagagcgtggcccttggctctgctgcagcccatgcttgtgtatgttttggattctggctttctctgttctggtttatatcaatccaatcccatcctttcttcatcccccagaggtttgacggaatctctagttttcttccattctcagtgctgttgtggatttattcccctgtgttcagcttattgttatttcagtggcatttggggtgggaggagctgtacatgtgctcagttcatcacttaatgtaagaaacattttccataaactgagcagttaaactcttacaaaagggaaccaggttagaaagccagttacgtttcctttaaaaactttacctcctttaaaaaaatcggtgagaggacctgtgagagagaaatcatggttaagctttcagcagaatgttttattatagaagcttattctgactttattctttcagatcttgaatatcaccatcagttcctcaagggtgactcctcggcggggcccggtgaatatcatctttgcggttaaaagcacacagggatttttgaatgggtcggaagtgagcgagctgctcagaaacttgagtgtggtggagttcagtttctatctgggatacccagtgctgcagatcgcagagcgtgagtacagccctcttggacatgctggggaggtgatggcgggcatttttggtggaagacctcttcttaaaatttttttagttttttaaaagacttgattttttaaaaattatttttccataaggcgttggggtacaggtggtatttggttgcacgagtaagttatttagtggtgatttttgagatcctggtgcacccatcacccgagcagtatacactgctccacatttgtagtcttttatccctcctcccgccactcttccccccaagtctccaaagtccattgtatcattcttatgcctttgtgtcctcatagcttagctcccacatatcagtgagaacatacgatgtttggttttccattcctgaattatttcacttagaataatagtaaaagacttgagtttttttagtgaagtttttggattcacagcagatatgatcggagagttcacagatttcccatatacctcctgcttccgcacattcataacctccattatcagcatcccccagcacagtggcccatttgttacagtgatcaacctgcattggttgatcctgcatcattggttgaacctgcatcatcatccatagcccatagtttacattaaggttcaccctgggtgtcgtgcattctgtgggtttgaacaaatgtgtaatgacatgcaaatggcatggattctccattttagtatcatacagagtattttcacctggaccacttttttcaaatgaaatatctgatttgagtgccagaatataaatctgataaaactggattcaggccagatgggtctgcagagccctgctcacccaccgtgcctgactttattatttggagagtaaaggggtgctatcaaaaagtacacgaattctggaaaaggcataatttagggaggacgaatctgtggttgtcagagct

SEQ ID NO: 128018 - DNA, 1650 bp, Homo sapiens
acggcattactataccgttgccctccttgggggaggtctcacagcctccagaggaggtttgggccacaagtgcagacagatacactgatgtgaccactgtgttgagtcaaagcctagaagaaaccatctctccaagaacataccccactgtgactgcatcgcacgcagcccttgcattcagcaggacacattctccattgctttcaactcctcttgcatttgcgtcctctgcttcaccaactgatgtttcatctaacccctttctccctagcgactccagcaaaacatccgaattgcatagcaattcagccctccccggtcctgtggacaacactcatatcctgagcccggtgtcctcattcagaccatacacttggtgtgcggcctgcactgtgccttcacctcagcaagttctggccacgagcctcatggagaaagacgtgggatcaggggatggtgccgagactctgtgcatgaccgtgctggaagaaagcagcatctctctaatgagtagcgtcgtagcagacttctctgaatttgaggaagatcctcaagtatttaatacgcttttcccctccagacctatcgtcccactttcttctagatccatggaaatctcagagacgagtgttggcatttctgccgaggtggatatgagtagtgttacaaccacacaggttccccctgcccacggccgcctctctgtgccggcgtcacttgatcctactgctggctccttgtctgttgctgaaacccaagtgacgccatccagcgtgaccactgcatttttctcggtcatcaccagcattctccttgactcatctttctctgtcatagcaaacaaaaacacaccgtcgcttgccgtcagagacccgagtgtttttacgccttatagtctggttccttcagtggagtcttcacttttctctgaccaagaacgttccagtttttctgagcataaacccagaggtgctttggattttgcatccagctttttctcaacacccccgctggaactcagcggctccatctcttcgccttcggaagcacctgcgtctctgtctctgatgccgagtgacttgtcccccttcacatctcagtctttttctcccttggttgagacatttacattgtttgactctagtgatctgcagtcatctcagctgtctcttcccagttccacaaatcttgagttttcgcagctccagccaagttccgagctgcctttaaacaccatcatgttgctacctagccgttctgaggtgtcaccatggtcaagcttcccttctgattctctcgagtttgttgaagcgtctacggtttcactgacggattcagaagctcattttacctcagctttcattgaaactacctcctatcttgagtcttcactcatttcccatgaatccgcagtcactgcactggtgccccccggctctgagtcttttgacattttgactgccgggattcaagcaacatcaccattgaccactgtccacacaacgcccattttaactgagtcttctttgttctcaactctgacacctcctgacgaccaaatcagtgctctagacggtcacgtgtctgtcctggcctctttctccaaagccattcccactggtacggtgttgatcactgacgcgtacctgc

SEQ ID NO: 128019 - DNA, 1049 bp, Homo sapiens
gggttaggtttcaacatatgaattttagggggacacaaatattcagactatagcagtatgattcctaaaggtggcccctcctgactgcggcagagcacccgtaagtgaacatatccctggagggcttggaagtcaaactccccccaccttccttgatggtgtcatttgaccccaatgatcatctttctgcagattatcaccaatctctatcattggcccagatttctctctcaaaccctagagtcacatttccatccaccccgagttggctcctcaccgtccatgtgagtctcaaacgacaggctcctcttggtgaccccgcaccattcgtatgagccatttccacatctgtgaatctccttcctgcttcaggccactgtgctcgccaccccctctgcctggagcagccttcctgtctctctctctcggctcctcatcctttcctgaggttccttgctgtccatcacagcatcttgcttatttccttaccagtcttctctgttcatcattattgtctgtctcctcttctcagccataaagttgtgagcaggggacctttctatcttggctaacacttcacaccctgcacttagctcacatgaccggtaggtgtttgttggactcatgaatgaatgaatggacatgttagtctttgggctggacatgggaggcacactgataagacacagcctcttccttcaagtagctcacagtctggggtagggtggtggggcaggtgagtaatgagtaaatcaagaatgcaacctaagtgtcaagagagaagcacatgcagggttctggggaagatggaaaagggggttctggggtgtgatagttacgggaaggaggaggggcatggtggtcagagagcacgtcgaatagctggggcatgggctggttgtaggggagggtaatactaatggcacaggcgggaacggggagctgaaggctcttgtatctcagctgagggctttggctttctgaaggcttttaagagccactggaggattttgagaatggggtgacatagtttgattgtttctttcctt

SEQ ID NO: 128020 - DNA, 1048 bp, Homo sapiens
caaggaatctcagaaaagtttggttttgccttcagatgttagcaagtgtaattatgaggttagttattgcacgttttcttcattcttttaaaacttggtattgtatatgttttgtaagattcttcatatcaaaacaggagtctgtgtgtataatttcaaaacaaagtatatagtggaggtgtgcttgggaatttttttattaatggagtgtggacccaggcagtgtgagactaccccctgggctggctgcttggtgaggtcaggtgcatacaaaccccagctccacatgttactaacattcagcgttttcgggtttttcagcctctgtagcttcagtttcctcatttgtaaaggggtggttggggaaattaagtgatgtactgacggaaggtgcttctcccagaatttggcatatagtaggcattcagtacgtagaagccatcatggatgctagtaagttaacttgttttccatcatattttattttattaacgtttcatcttgggtcagctggtcaacatgggactgcagattacccaagaaactcagctgctcaactggatgaacagtggttctatactaatggacttaaaatggaagggagctagattttacttattatcctgcttggtgagaacgtggaagtagataaaatcccagtgaatgctctactgtggtttttctgcacccgttggcagtgggggctgctgggagaccaggggttgtttacctgctcccatcagcctctctccctgggccatgcagtaaagctgcagtgagtctcagagggttctcagttgggcagtctcacctgcagaggcgctgggcaatgcctgcgagcatttgttgttgtcatcatagtttggggaaaggcattacagacggggtggagtcagggattccaaaaaactgggggtctctagatgcctccattgctcaggctggagtccagtggcgtgatctcggctcactgcaacttctgcctccagagttcaagtgatcctcccacctcagcttcctgagtagctgagactacaggcgcacacca

SEQ ID NO: 128021 - DNA, 1066 bp, Homo sapiens
tgggagggtgaggcaggagaattgcttgaacccgggaggcagaggttgcaatgaaatgagatcgcgccactgcactccagcctgggtgacagagcaagactccatctcaaaataaaataagataaaataagataaggtaaaataaaataagcattttttgttacatgtttttgcttggttttgtttgggttgggagtgaaagggtgcagaggactgcattttcaatgctcactcctgcccgtttgggaacagctgctgcagtgcttgtcaggaagtgcctcacttaattctgaaaacagaacccagccagggagttgttacaagtcactagggacgtgggagccacaggttttctatcagtgccctgaatgatagaggcagctaattaccgtcattataattacactaggttgattttcccagataggaagacactgttctaactgatctaatttgttttcaagttgtgaccacccacctttcatctggagctcacaatgatgtgatttctttttcttgttgttaggcagcaggatttgttaaaaggtgagttaaaaaacctgggtgtgtgcaaatgcaaatctgcctgtaactttgtgactatggacaagttaccttgtcctgggtttcctcctcggtgtaagaaagggttaatgagattagcgctaatctcattaaccctctagctccttgtagctcatttctccctgtagctcctacatatcaagtcaacatcttggatgtcttggaatgcacttataagcagcatctgtcctttttctgttaggttgttttgtcatttctccttgcctggtagatgttctaggcccatgacctgctgaaggcagctcactctcaccattgcagatggctcttctttttaaaaactccctttattcttccctcttgcatccacacactcaagacccatactttgctttctcttattctttctctttgtctctttcttttttccatctcctttgttagcttcaggcaattacttctcattagtgaaattctaatcttgtggtccccacactctgagcatcatcactgcctctta

SEQ ID NO: 128022 - DNA, 1007 bp, Homo sapiens
acttgaccactttgaggcggaaaaggaaaggtggaaggagcagctaggggtggagagctgctgcacacagaacaaaaaccagaaagccgtgaacgctgctccgaatcctcctttctcgtgggagcagggccaaagggctactcagtggctgggaggaattggaacacatttgaaggtgtcccttggacctgtgagaattataaccagtgccctagaggggatggtacaatagaagcacagggaggacttcagggatcatggaacaggtccactctgcttaccaaagaggaaactaaggcagagaagtgccttgctcaaggtcacagtcatcactttccctgcctcccacccccgctcttggcccatagacatatccacacctgaagcctctgcagagatttcccatagctgggtggaaccagggttggggtgacagaatgagtctcttttaggcagtatacagctagtgcaaacaccttactctaacctaggacctcccgtctcagtcctgctcctgcgagttccagccctgtgtgtccagaggagaagagatcattgtcaagggtctcttggctttagtcaacaaagagagcccatctgatactcgtggattcatctgtcataagacacagcagataaatggtttccatctcctgagtgctttttgtgtgccagatgttgaattttatatacacgatccaatcacgttgtgagttaggcatagttatccccattttacagatgaggaaactaaggctttgagtttaggttggtttggcttcagactctatgacatgcttcctttctgtgcctgatggcttccccatatgaatgtggccatctgggtgtactgcagaggttgtggagaatataagtgcttctggtaactttaaaataaatagtgaagctgtttgcactgcccatccctaaccttctcttctttggaagtcctttcctgcttcccctctacccccaatacaaatattcaacctggagacatgaaatta

SEQ ID NO: 128023 - DNA, 1028 bp, Homo sapiens
ctgtgagtcacaagcagccagtgcccacagcagcgggagtatggttagcaccactacactatcatcaggctttcccccaaagattttaacagccactggtgatcagaagatgtcatttagtcttcagtttagctagagaagctatagtcttttggcttaaaagatagagtgaaaactaatattggccgggtgtggtggctcacacctgtaatcccagcacttttgagaggctgaggtgggcagatcacctgaggtgaggagttggagaccagcctggccaacatggtgaaaccccgtctcttctaaaaatacaaaaattagctggctgtggtggtgaacgcctgtattctcagctactcgggaggctgaggcaggagaattgcttgaacgcgggagatggaggttgcagtgagccaagatggtgccactgtactccagcctgggtgacagagcgagactccatctccccgctgccaaaaaaaaaagaaaaactaatatttcaggtgttccctcatttctgtaccaggtctgtttgctctacaacaaaggggaagccctgtatggctactgcaacctcaaggataaatgcaacaagtttcatgtgtgcaaatcctttgtgaaaggagaatgcaaacttcagacctgcaaacggtcccatcagcttatccatgctgcatctttgaagctgctacaggaccaaggactgaatattccaagtgttgttaattttcagataatctccacctacaagcatatgaagctgcacaagatgcttgaaaatacaggtaggaatatccaagaaggacagagaagtatcagcgatatggttttgcgatgcttcactgtgaagaagtaagaacagtgacatgaaagtgagtctgggggcaaagcagttcctatgttaatttcatctttgttcttgggaaagtttagaacaggcaacattgtattgtatagaacggtgatcctaaccaaaggagagaagggatggagtttatctttagcactgtcactgctagctactagaa

SEQ ID NO: 128024 - DNA, 1871 bp, Homo sapiens
ccctcacatgaacctgttcctctctcaggatctgtatgtaagtgaaaagcatcaccatctacccattggctcaagcagaaatctggaagtcatctttgactccttcctctccctcctgataaacatctaagcagtttctaagtctagttttacctcttaaatatctctgttcccttctaagttgtttgctgtgttttcttcagagcaagaaggttatattttttaaaatttacttagtaatgcacattcaaaacacacatcaagtcttcaggataaagttcaaaaccgctgtcatggccccatgtgatctctccctcccctacccctctatcatttagtttcttctgcgcaagccactctggcttcctttcagttttgtggttcccatttttagctagttcagtggttttcaatgggcatttctgcctttttttttctaaacgacaaatagaaatacatcttctttattatcctccaaatccaattcagaggtaatatgctccacctacacacaattttagaaataaattaaaaattaaataaaactaatatgaacataaagaggaaataaaaggtacctaacttgggcacagctgtaactgaagacctaatgaagtagtcagatgcttacaactatttataatgcatcaatttgaacttagaaggtaggagatcagatcatatgtgggaaaatgtaaaagcagggatatcagtgggcattagaataaaaactagggatacaataacttctttgcatatgacaatacttatttgtatataagagaaagaacgaaataacctttattgaaataaagatactatgcaagaaaatgtacagttgtcgaagtggagaaaatgaggatatattcttgcagacgagctataggtcatacatgaatgtctagtgagacattcaaaattcgtatagggtgcagagtaatttcttattgtgaggaactgtccaatgtattgcaagatgttctgcatacttggctctcacatactaaatgctagtagcgcccccacccccacgcccagtcacggtgacaaccacaaaccctatcagatctattcacctttttcagagcagatattttgtaacattctctttgctgacctgaaatgactcatagataatacaatctacttacacacatgaatttcttaaaaaaatcaatttaatgccctaactctcttattaaggagaaatagaaaagaagaaatttataatgaaaagaagatgaatttcattatgtaaacgctcaggcatgactacgctgtttgaaacagacagatgtttactcttccttgtaatgagtaggtttggatttaagagccgattagaggctacttcctgtaaacaagtacaggaaaatgaaactagacgggtgggggacactagaatgaaaaccagtgttagggtaaagacaaaacagactatgtacataatctgtatatgggaaaagaaagagcgaaattaccttacttaaggataataggacaagacaaattacagattgtctcagagaaaacaaatgagttactctctcggacaagctgtaggtcctacctaaatgtccagcaggacattagacagtcgtacagggtacagaataattcttcgttgtgtggcactaacccacacactgcaggacatcgttctccctggctgcatccactcagtgctgggagtagtccccagttattatgaaaccaccaataacccactgaccacagtgagaaccactgattttttccactgacctactgaatatctagcatccttagattggctcaactgttactttcctaaggagtccttctacagaataggtcagatcttggcctcccaaaccccttatttttaaaat

SEQ ID NO: 128025 - DNA, 1027 bp, Homo sapiens
aaagcttccatgaaaaatttcaagattgaaaagataaagaagatcgagaactcagagctcctggataaatttacatggttggtggccacgttatcgtgtttctttacataaaaccggaaaggattagttaatatccgtcctttgagatttatattcactgatttattttagtagttaacagttcctttaggcgctagtctttttttttttttttcattctatcaactctggcttctctctctcagccttactgctttacaattcaatgatttcatgtgtctatcttttaaaagttttcataaatttattattgtacagctgctgccttaaagttagtagctccgttgtgaaagctgatggagtgaaatttttagatgattagactttagctgggattaatgttatcaactggagtgggaaggggatgtctccgtgttaagtctcacatctcttatattaggaagaaatcgcagatgaaggaagaaggaaaactcctattttatgcgacaagccgtgcctatgtggaatctatctgttcgaataattttgacagtttcctacatgaaactcatgaaaacaaatacggaaaaggttagtgccgggatagagaagcgtaactagtagagtcataactcgggctttatatgtgcttctattaggaggtatatgtaattattttgtattaaccagagtgtccaggctctagtggtcctggagagacagtaagctcacggtaatatcaaatgcccaaatgagagtgaatcagttgacttggagcttgattgctggaccttagtccctgtcttctgttttctttctgggagtgaccaaagtcttcatacgtgcttgtaaactactccatctgttggtcttgttgtctaccattactactcacttctggcttggctcttcctgaacccatgtccatgcctgcgaagctatatgaggcttcagttgtcacagattggttttaattaaagagcgggagaagaggcctctccccatctcaggccacactgggtcacct

SEQ ID NO: 128026 - DNA, 1029 bp, Homo sapiens
ccttttattttttttccaattagaaagacaaacggaaaaattcaaacgtcgactcttcatacctggagtctctctatcaatcctgtccgaggggagttgtgccatttcaggcgggctcacggaactatgagctgagtttccaaggtgggtttctgtgtttggcagtgttgtgtgtcattgaaatccgcctgcagtgtacacgtgggagtgggagcagagtgggtatgcattgctatggccagggtcaaggtcaagatttagcaaggcggtggagtgcaagctagtggccatcagaagacctgtgttctagagctctggctgtgacgaacacttgctctgccaccctaggaggggcacctggcctatctaggcccacttctctcaactgcaaaatcaggggctcaaactaagtagtcttgggggtacttccagctctgccatgctgtttctgattctgggtgggcagctgcccagggagaggcaatatttcaggtgctggtgactacggtagaggccttgggcttttgggcaccttcagagttttagaaacttgctgtttcttttagggtttatcatctaggtcagtagttccatcatcacattgattaaagtactttgccttccaccgtgtttattggagctactatagaaaggtcttctggtgagctgccgccaatctacctgctgtgtttagttagatatcagggcaggaactgccctccttctgaaggtaccatcccattgggcaccccctgcacatgatcaagtgcttgccctttcgggacttgcaggtgctttggaagaggtaaaggagcctttctgaggtccctgaattcgcagatggtacctgcagttggatcctgtaccgcttagtgggccttagatgacgtagcttttacaaggaccattataccaagtatttggaaaaacagtctggcagtacatgtcaagtgacattaaaatatgctaatatgtttgtcttttcattcccttaggaacctttcttaggaaataattcactagaagaag

SEQ ID NO: 128027 - DNA, 1802 bp, Homo sapiens
acatgtactccaattgcagtcatacattaaagtatatattaatttttatttttatttatttatttatttttgagatggagtttcactcttatcacccatgctggagtgcaatggcgttatcttggctcactgcaacctccatctcctgggttcaagcgatcttcctgcctcagcctcccgagtagctgggattacaggcatgcaccaccaccacacccagctaatttttgtatttttagtagacatggggtttcaacatgttggacaggctagtcgtgaactcctgacctcaggttatccgcccacctcggcctcccaaagtgttgagattacagacgtgagccactgcgcccggccatatattaattatttttaaggaaccgcttgagacatgtcagctgcacttccctctttcctcaccatgagaggggagggtggaaccttgagatagctttctatgtataaacacataaaatgtacagagactactgctttgagctggaaaagagggtgagagtgagaacttaaaggactgtatggatgatggcatggttaattagaccagggaatgtgttaattcactcaagcagtgaaaccacatctggtacagatagtcactactattcattcagagtctggatttagatggacttaaaggactggaactagaagatcctaggctgacccatagtgggggcatagtaatagggagggaagtttaggtgagcagagcctctgtccttctgtctcagtgtcccttcctccctttaactcataggattaaagagagagagaaaacagaccttaagcaggtaatggaatcagggtgatgagaaacagaaaatgaaagcaagagattaaaatgaagccaaaaataatgcatgggctgggtgcggtggctcactcctgtaatcccagcactttgggaggccgaggtggggtggatcacctgaagtcaggagttcgagaccagcccggccaacatggtgaaaccctgtctctactaaaaatacaaaaaattagctgggtgtggtggcgcgtgcttgtaatcccagctactcaggagtctgaggcaggagaatcgcttgaacctgcaggcagaggttgcagtgagccgagattgcaccactgcactccagtctgggtgacaaaagtgagattccaaaaaaaaaaagataatgcagggacaaaggaatggcagcgtaaggttctacatatttaggttggtgtaaaattacttttgggttggtggtaattacttttaatggcaaaaactgattacttttgcacggaactaataattacgagtcagtgggctatacatttggctctgagctgcctaactgccaaagcaaacaaaatacttgggagaggcactactctgttatgttagtgaggcctgagaaaaacacctcctatagtgggccacatggcgggaaccctgtgtgctgtggtgaggtcctcaaccacaaacagccctaccatgaattcagcagcatattggtttccaaactgtcttagcagcagatacattttatcaaaccatctttcaaagactctaaacgagccaactagagtagagcagggctgccctggtggaataggatatgggctcagagctgtctcctggacccctccttgttgctcttctctctcctgtggtggcccatgtagcatctctgtggaacagagttctgctgaaactcccgtgtgtgtgaaaacacctatgatattaaactttgcacagattctttgtatgctcaagccaaggatgatgtcaaataagcgattctgtcaggcgc

SEQ ID NO: 128028 - DNA, 1077 bp, Homo sapiens
gaaatcatatattgtgtagcctctggaaaatttcatcgtgtattcctgagagaatgaaagtgaaaaaagcaaataatgtttaatgttattatgaaaatcactttaaccttgccaattttctgcaagggtctccacattttgataacgatttaaataataataaataattttaaaaatggaccaaatgcgaatttctaacttactttataacattgagccaatcaggagttttgtgggcacagttttattttgggatattttctgagggaagaatacattatgtaacaccattaattatgtggtgcaggcgagtcactttcctctctgcgtttccgtttttcttttatgtgtaggacctggagccatggaaagaaaacttgaagatctattttagccctgaaagtttaattctgtgctctcattagggaagacgagattgtagaaaacaggggtcaatgaagcattatgttaacttaatacttttctctctcagctgttctgtaggaagttatacaatcaattttcgggtaatgagttgtgattcctttcccatccgacgcctctccactccttcttctgtcaccaagccagccaattctgtcttcaccaccaaatggatttggtattggaagaatgaatctggcacatggattcagtatggagaagaggtgagcactgttcctccttgtagggggctcttgtttaaacttgtcaacttaaaaagaacactgttggctgggcacggtggctcatgcctgtaagcccagcactttgggaggctgaggcaggtggatcacctgagatcaggagttcgagaccagcctggccaacatggtgaaaccccatctctattaaaaatacaaaaattagccaggcgtggtggcaggcgcctataatccccgctactctggaggctgaggcaggagaatctcttgaacccgggaggtggaggttgtagtgagctgagatttcgccactgcattccagcctgggggatggattgagactctgtctccaaaataaataaataaataaaataaaaagaacactattaataaaatgtttgaagcctacatg

SEQ ID NO: 128029 - DNA, 1145 bp, Homo sapiens
gctcagtgtaagtcactgaaggacaaaggggcctctgtgtcttgagtctgcagcagagtggctatggctggtggtttttccttggatgttccccagttcttaaagggtagagagttagagggttttggttatggggtggtctggtgaggagattgactagtgaagacagggaagggccaaccagtagaaccacagggaataaactgccacatttattgacaataggaatatttcaactatgatttaagaaataaacatagctttcacaggactctgaggtccacatttttgttttatggaggggctgtctagatgctcatgggcaaaacataaatcataggaattttcttgaacatggcccccatttcagatattctttcccattgtgagaccaagtgctttgatttttggtttaaacattaagatcagcatacatgcatccttttttgtttcatagattctttatctgatgtcacaagtaccacatcttctagggtggatgatcatgactcagaggaaatttgtcttgaccatctgtgtaagggttgtccgcttaatggtgagtaacctaaggacttttctgtaagcttccaccttttggccattgtaaataacactgctatgaacatgggtgtgcaaatgccttctgaaaaccctgctttcaattcttttggatatatacccagaagtggagttgggggatcatatagtacttctatgtttaatttttttttttgaggaactattattcatagtggctataccatttttctttcccaccagcaatgcacaagcgttcaaatttctccacatcctcaccaacacttgttctttttgtgtgtgtttgtttgccttttttgtttgtttgttttgagacggagtctcactctgtcacccaggatggagtgcagtggtgtaatctcagctcactgcaacctctgccccctgggttcaagtgattctcctgcctcagcctcccaggtagctggggttacaggcgtgtgccaccccgtccggctaatttttgtatttttagtagagacggagtttttgcatgttggccaggctggtcttgaactcctgacctcaagtgatccacccgcctcggccttccaaagtgctgggattacaggcatgagccactg

SEQ ID NO: 128030 - DNA, 1565 bp, Homo sapiens
tgctgggttccttcatgatatagggctcactttgggtcctgtttgtagctaaccagcttacattgattcttccaagggttatcaaattgatcagtatcttttggttagtctgtggacctcttctgccccaagtaaatcaccaactgaatgtgactcatcaaagactgcagaatatgcatgtatttttccccctttggtatatctctgcttgcttcagagatttttgcacacgtgagcttgccttaatgaatgtttggcaaatacaagaaggtgttttgactctggctgttgtttctcccttctgtagatatgcaaaagttataagggagagggtcggcagcagatttgtaaccagcagccaccgtgttcaagactccacatctgtgaccacttcacccgagggaactgtcgttttcccaactgcctccggtcccataacctgatggacagaaaggtgctggccatcatgagggagcacgggctgaaccccgacgtggtccagaacatccaggacatctgcaacagcaagcacatgcagaagaatcccccagggcccagaggtaaaggccttttctttttcaattgtgtgaactctttttttttttttttttttgagacagagtctctctctgtcacccaagctggagtacagtggcgtgatctcagctcactgcaacctctgcctcccaggttcaagtgattctcctgcctcagcctcccgagtagctgggattacaggtgtgcaccaccacacccagctaatttttgtataaattagagacggggtttcgccatgttggccaggctggccttgaactccttacctaaggtaatctccctgcctcagcctttcaaagtgctgggattacaagcatgagccactgcacccggccaattgtgtgaactttcaaatcagcagaaatcacaaggaaagaaaaactgccataatcactctaccttgccgtgtaaaactcttcattttcccttccaaacttcatgcatatgtatacaccatttttacataattataatggtagtatacatgcagtgtttgcaattcaatttttatgcttagcactattgcccccccccccaggtttaaaaaagtgtatatcatttttctaaaaactaattaacaaagcttttttttaaggaaaagaaacaaacataaaattgtttagatttatcagctgttaacattttgtcccaattgctttagcactttctttctctctatgtatacatgcagctactcacacacacgtagaacattttggtgtttaaagcatttgatatatgtaaatatcatgacatttcacacctgaatatatcagcatgtatctcctcagaacaaggccattctcttacataatcacaagacaattaatacagaaaatttattattgatgcaaaactatgtataatttaatttatggtcctcagtgccatttctttaaaaaaaaaccaatattttaaaatttctaaaaaaagccacaataactcccattcccttctttccccagcccctggcaactaacattctgctttctgtttgtatgaatttg

SEQ ID NO: 128031 - DNA, 2401 bp, Homo sapiens
ttaaagtatatttaaaatgttaacaaagggccaggtgtggtagctcatacctgtaatcccagcactttaggaggctgaggcggatggatcacctgaggtcaggagttcaagaccagcctggctaacatggtgaaaccccgtctctactaaaaatacaaaaaattagccgggtgtggtggtgcgtgcctgtgtttccagctactcgggaggctgaggcaggaggattgctcgaacgcaggaggtggaggttgcagtgagccgaggttgcaccactgcactccagcctgggtgacaagagcaaaactctgcctcagaaaaaaaaagtaaaaaaaataaataaatatagtgtattctttaagcagaaccaacctgtgtctgttgtcagagaatatgggcacgggtctttgcagactgaaagttttatggctgatttctgtttctttgcatctgtgtagtagaaatactgaccattgtcgtgttttcttccaggaatttatgcaaatattctcatgaggttctctcagaagagaacttcaaagtcctgaaaaatcacgaactctctggactgaacaaagaggaattagcagtgctcctcctccaaagtgatcctttttttatgcccgaggtaagttgtgattcctcagtttaaggagggagaatattactggcagtattgtgtcacagatattttggagtaggagcagagaaaattcaaaattaatgccagggttctgcaggtggtagtcgaggctgttattgagtgaactaagagatcccagaaatttctctcctatttgaggttttataagaatttgagtctggaatacctcttccactgggctgcaagggaaccctgtgtgagtaagtatgagctgaagatctgatagtagtcagactacttgatgctttaaatcaaggtggcttcttggaggagatggactttggaatgaggttgggaagttggcggggaagatgagggtatgggctaagctgttgtaacagagaccccctcaaaatacagtgattcaaataaaatgtaattttgtttctctatctcttgataatctaggtcaggggtcagcaatctataacccagaggccaaatctggcctgccacccttttttttttttttttttttttttttttgagatggagtctcgctgtgttgcgcaggctggagtgcagtggcacgatcttagctcactgcaacctctgcctcccaggtttaagcaattctcctgcctcagcctcccaagtagcagggattacaggtgcctgccaccatgcccggctaatttttatattttagtagagacagggtttcaccatgttggccagcctggcctcgaactcccgacctcaagtgatctgcccaccttggcctcccaaagttctgggattacaggtgtgagccaccatacccggcctgtttttataaacaaagttttgttggaacacaaccacacctattcgtttatggctgctttcaccctgcaagggtgagttgagtagttgcagcagaaacagaatggcctacaaagcctaaaatatttactatctgatcctttatggaaaagatttgccaactcttggtctttcctgcatatggacaggggggtagcctgagttgttgggcagctagactcaatgatgtcatcaaggggctcaggtcagtaggtcagctctgttatcttcaaaatgtggcttccgtctctgtgtacaatgagtctgtactcactgtcaccattttctagccagtggaaatgtagagaggaagtaaatggaaggcaagcagtttccttttttaaaagatgtgacatggacattgtatatggcacatctgctcaatcacattgaccagagattattacatgtcacacttagctgaaagggagtctgggaaatgtagtttctgtctgggtaaccatgtgtctacctaaaacttgggagcttctattactagaagaaagacggggacaatggtggataattaacagtttcatccactcaggaatatagacttaaggatcagagaatactgtttaagcctggtatctggctggataaaatccatgaatagagaagttagcctcacagttaaagagaggcatagaaacataatgggtgagtggaagggatggagaaaatgtaagtaaagttgaaattcagttgcactttttttttcttttttcttttttttttttttttttttttttgagacaggatcttgctctgtcacccgggctgtagtgcaatgacatgatcagggctcactgcagccttgacctcctgggctgaagttatcctcctgcctaagccccccaagtatctgggactacaggcatgcaccaccatagctggctaacttttttttaaattttagtagggacagggtctcac

SEQ ID NO: 128032 - DNA, 1074 bp, Homo sapiens
ccacaccctttatgtgatttatgtccacgatctctgcttgcaccctgcttaaatagttgggggaacagtggcttaaataattcaggatgccgatttaaatttttttggtttgaaaaagtttcagatctgtttttgttcatttttccggcttgggtttttgcttgtgttttgggatgcgtgttcattcctggatcttcctcttatctgtcacctttgatttctcattttatcagtcatcagtttcccaaagtaggattatcgtgactactaaattaaataacataggtaaagttcctgtcacttagtaaatgcataataaatgttaatttctgtaattaacccaagtagaaggtaagtgtaaactgccccaccttcgtggctgatcaatatcctgaaattagggcaaagataaagcccctaagaagccgctggggagaagtctagggaatgtgggaaaacgaagcagaatttgccagggaaggggctgcaggtcagaccaagacgagacagagatgttgcaggttgagactgggttcagggtgagaatcacagaatctagaggaataagaagtttgcctgaggatggagatgaaaaatgagaaggaaaaccaggcccccaggtgggcagcaccacggaccccagccagtgcagcatgggctagctttgacttttctttcagacatgagcacctttggaaaagcctggacacctgaggttccaggcagagggctccccattaggctatctggcttcctttagttatttagaggaagtgctgacttcagggaccctggaagtgccacactcctcagctaggacaggacaggaacaattctgcatctctctgtgacctgcagaggtgccgtaggcttggctctaagttcaggacgtctgggctggagctaaagtggaagcaaagattcttaattccttctgactaacaagttgctatgtaatgcccaaccttgtttttactaaccctgtctttagactctccctttcctttaatcacctagccttgtttccacctgaattggctctcccttagctaagagagccagacagactccatc

SEQ ID NO: 128033 - DNA, 1054 bp, Homo sapiens
aagttatcacctcctactgcaactcgccctctttgtttgaggtttatctgctccaagtgtgggtagcattctgcaaacgcttgttttgtcctgggaaattcataataattagtaggagagctctttttgtactggcgagaggggagttcccacagcttctaaccaaccttctgtaggacctgttgtcctttttggggaggtggccctgagctgcctatactccaagtatgttcgtaaaaccagattgttagacatgcaaattcttggcctccaaccctagatttactgattcagacactccagggtgggggcccaggaatctaatggacctcctgtctaggtgatgctgatgcatcctaaaagattgagaatcaccctgggatgtctgggatggggcctgagaatttgcatttctgaaaacctcccaagtgatgctgatgatgttggcctagggaccaaattttcagcatcgctagcttagcaaaccccaagaggccacgggagactttcatactatttcctggctgaagcccactagccaatattaggcacctggagctgggacagagtgatcagaagaaagtcggaaggaaggttctgccacctgaaacctacacatgacccccttcaagctctgatcgtggcccatgctgctgagcttgtctgtacaatactaattttcactcgcgtccgtgtgaagagaccaccaaacaggctttgtgtgagcaacaaggctgtttatttcacctggatgcaggcgggctgagtccggaaagagagtcagcgaagggagatgagggtggggccgttttataggatttgggtaggtagtggaaaattatagtcaaagggggttgttctctggcgggcaggggccggggacacaaggtgctcagtgggggagcttttgagccaggatgagccaggagaaggaatttcacaaggtaatgtcatcagttaaggcagaaacaggccattttcacttcttttgtgattcttcagttacttcaggccatctggatgtatacgtgcaggtcacaggggatatgatggc

SEQ ID NO: 128034 - DNA, 1032 bp, Homo sapiens
cgtggctgcagccttaggttcaccattttctgcagtgagctggggctctctttgtgcctgctgtgttctgggtaatacagttgtggttaaaggaagctcatttttttcggctccaccctctgtgtctccccacatccttcgttaccctgctcatgtgatctcgtctggtctattctgtttctcctccatctcactaggggctctagaggcagtaaaccatccctaccctctaataacacggcaatttaatcttgaatatcagaagtacaaatatggggagtaggagcctcgtggctttaaaataatatcgcgttagggttggttttgactgatgacattttattctttagctcaatgttctctagattttatctttcacacatcctggttccttttttacctggcttatatcatggtgagtgatttcctgttttctatacaaatcaacgatctttttgtttttgccaaccctattaggtgttagggagcagaggggatgaaggagagaagggaaggagtacttcgatataattactgtccaaaaaaaaaaaaaaaagactcgggttactgtctctttttggtctgactgttgagttcagagctagtcctgtgtttaccgatttgtgaagtgcaagagctccgaggtgaacatccagttcaggaatctaactcagaatcaaatctgacaagcgcatccagtgattctcagctcagactgcacgtgggaatcacccgggctcccaccgcagtaagatgaagccagtctccagggtgtggcccagggttaggttattttcaacactgcccagttgatcattatgtgtagccaggaatgagaatcactgtgcaggctagttgtttagactgcacccgtggtgagagagagcgcttattgcctgggctaaaataacattttgttctgtggctggaagagaaaagtgaaaaggtcgtttgtttttaggcttttggcctgagctccttaaagagagacaattctgctcctttcaaggatgtctttgctgtttttttttt

SEQ ID NO: 128035 - DNA, 1017 bp, Homo sapiens
tattcatgatgttgtgcaactgttaccactattggaattccagaacattttcatcaccccaaagagaaaccccacaaccatcaggaaccagtcctcattctcccctttcctcagcccctggcgatctctaacctactttttgtttgttttccaattctggacatttcctgtaaatgggatctaataatatgtggccttttgtgtctgcttctttcactaaggaaaaatgatttgcattttactcttgcatgttctgtgttgtttgtgtgggcgtattcatctaggagaaatcttcctgaagttccttctgtaactaattctgcactgtccatggagtcatgttattgtcagactggtggccttagagacatgctgttttctgcaacatcgtgacacaaaagggtgcaccctgtaagaatcatttgggaatttttgttctcttttcacaaacactacatctcaaatttttaatttgatcaaatttgactctcggtgtctgcaattttctttagaaattaagctaacaaacattatgacattgtaatattgtgaaccatgataaaatcttaaatagtgacaaatgaagcatgtgataacacaatattttctactttttacataatgcagagatggcaaaattacacatttaaaataagtagatatatttttccatccattaaatggttctaatttgcttactgcttctgcctgtatttacttccaaaccaggtatctgcgagcttttcctgcggctactttggaacagaagaagccatagtaacatagaggtgaaaaaggggtaaaaggtttcaggagcacctaggatttcaggcccagtgagaaatcacttcaaccaaattgcagcaggggagctggtctcaggttgggaggagagaggggagacttatttcatgatcttttctctatttcccatacagggaagagatagtattttattattttttatgtattattttgtatttacttatttatttattaaaatagagacgggggtct

SEQ ID NO: 128036 - DNA, 1027 bp, Homo sapiens
tgccattttgcctgggctgctctcaaactcctaggcttaagcaatcttcccagcctcccaaagtgcaggattacaggcatgagccaccgctcccggccttgtttgactttttttttttttttttttttttttgtgacagagtctcgctctgttgccaggctggagtgcagtggcgtgatctcagctcgctgcaacctccgcctccccggttcaagcgattctcctgcctcagcctcccgcgtagctgggactacaggcgcctgccaccacgcctggctaattttttttcatttttgtattttagtagagacgggatttcactatgttgcccagtctggtctccaactcctgagctcaggcaatccgcccacctcagcctcccaaagtgctgggattacaggcgtgagccaccgcgcccggccttgacttcttaactagctacttacattgtccagtaactatatgaagttattaattcaaaaatttattttgcctgcatgatttctgttaactgtttcaagcaggctgcctaagggtctttaccttgctttgcggtttttgccgatgtgggtgtttcctctgggttctttcctgtttgtatgtctttccttttcggttaattcacattttgggtgggggtgggtagatgggaagaggactagttgactgtttcgcaagttgaatagaatactgaaaaacgcaagcatcagagaatatttattctgaacccataaaagttataactcacctcctgggataaataagtgttcacatttttcagttttgctcctcttttaaaatatactaaacaatcataacagacctaaggttatttttttctcatccccagtctcatttccctttcctaagaagcagcttcaatcatgattttggtgtgtatcttgtccttccatgattttataatttcctcttgtatatgtttgcatccatatacaaaatgtagtattttatgtgttttagaatttttattcaatgctgtgttttggagatctattcatattgctac

SEQ ID NO: 128037 - DNA, 1623 bp, Homo sapiens
gtaaaaaaaattacaattttaatatcatctattgtccagttggtattcaaatttccctgattgtcttataaatccaacttttattttcagggaaaaggatacatagacataatccttttaaaaaaagatttttttaaaattttttgagatagggtcacccaaggctggagtgcagtgacccgatctcagctcactgcaaactctgcctcccaggttcaagcaattctactgcctcagactcccaagtagctgggattataggtgtgtgccaccatgcttggctaattttttgtatttttagtagagatggggtttcgcgatgttggccaggccggtctcgaactcctgagctcaagcgatctgccggcctaggcctcccaaagtgctgggattacaggcctgagccactgcctcacctggcctataattgttttcatatgttacatatctaacatttaaatactttgtttcaatttgttgtaggcaatatgcttagaaattttagttttatgaagtttattatggtatatttttccctggtttgaaacagcaaaactgttttaaactcgttaattgggttgttaacctccacttttataagaatatatataatatagggattatttggtctatctaaatttggatggaccctccagagaagtcaataaagtttattttttttagtagagtgataaaatcttatttcctaacatttattggcagagccatatttttaatttcattttatatcacttttgaatttgggaattacaaacttttaatctattaatgtataaagtgttgtaataaggacctctgggagaattttttttttgtcctcgggtcctagaaaacatgtttttttcctccctacttatgttttaaaaatattctcctcttagcgagtaataaaaccttgtcttccaaaacttgccacttgtgagtttaagaactttctttgtagattaccagttaatggggtctgttaactaattgatacccatcttgacattactattcagttcactaaactggtctctgtttacagggggacgatttgcattgtgctgggtgtataaaattttgtctgtggtactattatttatagataggatttatcctgtctattctgtagttcctgtcttttcttttgcaatgtttttagtgatacattttagttgacaacagggcttgcttcaatgttggataattgttttggtgaatcggtttggatatttctatttgctttgctgaaatatatgcccacacatggagttctaatcccacttctgatgcaaaaataatcactatttatcgaacaaataactatgtgccaaccactatgataagcactttggagatgatatccaggttagtctttaggatagctcctaaggtagtattttaagtcccatccttattgtaggaaactcgggcatggagcctttcagaaatctactgaaagtaacataactagaagctggcaggattggtatttgaacctagatctgcatgacttccttttttttttctttagaaatgagatcttgctttgtcacccagactgaagtgcagtggcacggtcatagctcactgccacttcgaattcctaggctcagatga

SEQ ID NO: 128038 - DNA, 1114 bp, Homo sapiens
tagtgcctggaggagaccaggctcaacctccacccctttccccgcccgcccgcacgaatcagaagaataaagtgctctggagccagccagggcctagagaagcggtaggcaggtttgggaaggaaggaaagagcctcccgtctttggtatcttgagtctttccctccctactacctccttccctagacgtggcggagccagtaacccagccgccctgggcccccggtccgtctccgccggagcgagccgcaggtctctctgcttgtccctcccttcccggtcacccccatgcccctcatcaccgcttttctgatgcctggcgcgtagcaggggtggcccttttccaggttcctgaagttgtagcagccgcgggccttccctccgggtggtctctctacggtggcgcgcgcagttgaccgcctgccttgggacaactctcttaaatccctttgaagcagtgtggctcacgtctcgggccactgcttctgttgtttccgtttgccttttttttttttcgtctaaatgcagatgcgctgcaaggtttgggttaagactcttgagtgattttcttcccagtttctccctaagagagcttgctccctcgaggacagctgcacatctaaaaagatggcttccaggtccacattcgctgcccaggcctttcccttgatcccaagcccttcctctcccgcgtgtgtcctgtccatggagtcaaactcatcttttcccccaggcagggttttaatcctcctcacaatctgtcatcaccaagtcctttttgtgaagtctctttcccttcttggcggattctgccttcccatctaatttctgaatgaactgaatgaacgccttgttgaattaatgaatggccagtctttcctcccaccctttctgtcactatgtgctctgctcaattacttttctcgatacagtactttttacacttggcccattcttaaacactttgacttgtgtcccagggtttaaaatggttgtcagcaaactttttaggctggagtgcagtggctccacctcggttcactgcaacctccacctcccaggttcaagcgattctcctgcctcagcctcccgagtagctgggattacaggcatg

SEQ ID NO: 128039 - DNA, 1027 bp, Homo sapiens
ctaggtcggtctcagtcccatcccgatgctagccccgggaagctcctggagcgcctctggtttccgggtgcgaatagtaaactgctcgggaaaccccagaaccctccctttgaggaagggtgcagacggcgtctccgtttccacggaaacaggccgagccatgtcgtcacttccgccgacctgtctggactccagactgttgggaggaaaagaggaaaactgagcaacagccacgacagtggacgcgagcgtctcctctgtgcgcatgcgcccgctcagcggcctgcttctatttatgtgggggatccaacatggcggccgcggcgaccctggcgatggcggtgaagcccatcagaacgtagtagcggggaaggggacacggtccgcactcaccgtggcgccggcggagacggctgagggtggtggagggaagaaaagcgacagagagcaagaggaagggcgggcaggcacgcagcgcgccgtagaagcgagcgccggctcgagcaaaagcggagggccagaacagtggggatggcggagccgcgcagagtagcgttcattagcttgtcaccggtgcggcggcgcgaggccgagtacccggggcccgagcgtgagcccgagtacccccgcgagcccccccggctggagccgcagccgtaccgcgagccggcccgggcggagccgccggccccgcgggagcctgccccccgctcggacgcgcagcccccgtcgcgggagaagccgctcccccagcgcgaggtcagccgcgccgagccgcccatgtcgctgcagcgggagcccccgcggcccgagccgccgccgccgttcccgccgctgcccttgcagccgcccccgccgcgggagtcggcttcccgggctgagcagccgccgcggccgccgagggagacggtgcgcctggagctggtgcttaaggaccccaccgacgagagctgcgtggagttcagttacccggagctgctgctgtgcggagaacaacgggtacagaagattcttccctcctgcccca

SEQ ID NO: 128040 - DNA, 1147 bp, Homo sapiens
ccccagtctgaagcagagattgtgtaacccctctcgtatcatcctcatcctcatcactgtttgttttgctgggcgccgtggctgctgaggtgtgcttgcgtgcctgtgatatttttcttaatcgaagggaatttaagaataattaaaggttttcagagactaaggatcccactttaggaatggagaagtgggttagttaatctggttactaatttttctctcgtgttggtattggaaaacctttttagctttccttttttgtggagttcgttcatattgtaattgaatgggaaggtgtctcctgttttatttgacacctacccgtcatattatttaagtgtactatcattagtttatagaaggatattgtattcagcctttgtaattttcggaggatgatgaaaaaaatgtcagctttgaattttttaaaataattgaaaatatataggtatgcttttgatgtaagaggtgaacaatggagaaaggataggggttatgttcgtaattgtaatttttattgttgtgggttggtggatcttcagaagtaagttagaaaaggaaatgatagattaacagtaaggaaagagaacagttttctctgttgcttagcaattatacccgttattaggttttgctttagcttgagtctaatggactccagaagtcccttgttttgttttcatcttcaactacctttatggtcaaaatgactgactgcttagtcacaaagtatcatgttgaacaatttcactaggttttgtttacttcatggccagctaatgttttgatcattatttagaaatgttatgtggtcaaatcattacaaaatgttttcaaccaaaatgaattgtttaaaggtagagatcattttggtcacttccacctaacattttgctcgtcagactcacttgaatgccccttctttataaatctgaggtcacttttttcccaaaagaatattaaaaatattggattggagcatttttcaaacattgtatttgagctgctaatctaagttggtttgcagtttttgtaattttcataaattacaggagaaaagcattatctttggataaaaatacatagcaataacgacatttactggttcttactgtgtgctagacacagttctaagcactgcacatgg

SEQ ID NO: 128041 - DNA, 1717 bp, Homo sapiens
atcctcactttacaaatgtatgtaattttattagtacttctttccatagtgatacaatttgttagtaaaacaaaatttcttaaaattaactcatatagtttagaggattctgccaaaatgacgtaaaatgtaagtcgcagtagaaatacaaagacctttattatgtctctgtttatgctgtaatattcacacgatggcaaattaataatgtgtatcatttaattataaaaagaaaaaggtttgacaccctagctttgttaacttgataacaccagaactactactttcatgcaataggagaaagaggaaaaattccatttaatttttctgtatacttattaacagtataggtgtctattggcccaattatctcgtatatcaaccttctatttttttcatatacctctgaacaaaacaaaatccattgtatataatcacctttgcaacaaagatttgccacattttcctgtgattgctgccagtgtatatccttattatgcaagaaagcatagaaaacatatgtttaagtaaaattgtcatggtttcatgaaaggaaatcctagaagagagaccatcaaaaagcaaaatgcgaacattagaattggtctggaaagttggtggttcccaaaattagaagaattagaaaaggaagggctccacatttttgaaatagccatctatcactaaataagattttagctccagatgctgaaattggtagatgtggggctattaaaaaaaaacaaacaacaaaaggtgtgttacatatggataccattcatgtgggtgcatttaaatcagttcccttcttaaatactaaatgaacagtaaaaccctgatttactggaacataatcagaaatttttctatgctctatttgtattaatgaggaaagcacaattaaataatttatgttgggaaaataggaaaaacaaaaccacaggttagctaaacctttaaccttattgtctctaggcagtacagtgctgtgattgagatggtttaggatgatgactggcattggaatcatctctatcctgaaagattaatttggtcaccatttctggctaaagggtaatagtgcattttagaaataaattttggcaatgattgatacacaagaaaaggtttaactcttagtaaaccagaaaaatcagttaaccagaacacccatttgtgaacatgcttaattgaacatttactgtaaaaagaaaaataagtgattaagtgtgttaatgtaactatactatttgagaattccatggtatttcattgtttgcgtatttttgatgaaatttgtgaaagacctcctgaaaatggtgttgatgagttaagatcaaaggacaaaattattgcatcagttttgcatgtgggtagttgataattttcagattttttttcacctgaaaaaacaaaaaagcttaatcttgattgggggagggtgtttattcttaactgtgaaagaaaagtgagtccattttcttaaatttgtttttgtaggctgtcaagagaaaataagagctgtacttttgatacctacataaaatacataaaatattttagaatggcatataaggtgattcttattaaaaatatagatccatgtgtttatatttatacatataaaatgagtcataccatagtaagtatttgggcttcacagtgcaagagggagcagtttgtaataggcatggcgattgcttactgtccttaacct

SEQ ID NO: 128042 - DNA, 1095 bp, Homo sapiens
ttcctggggattttttttctttgttattttggatgaggtgaccatgtgatcattttgcaggtgaagacaatttggattgttgagttcttactcatcaaaacactgtgaaatgtatatgagtccattataactgtaaattttttttgctatgaaccaacttttttttttttagttttaatacttctgacttacttgttagtattaggaaaagttgtctcgtattggttaaatttaagatatagtctctgagtaataatataattaattatataacatgttatatattctcactagtttatttcctttcagatcacatttattgaaatagaattgaagtggttgttacataatgataaataaacaaacaataataatatttgtaatactaatggatacttctctttcttttcccattcaccttgaatcagaagaagctcattcacacagaagacccatttaatgatgaacatcaggagaggcaagaggtggaaatgttggctaagaagtttgaaatgaaatatgtgagtataataaactgatcacttaggtaattttatcctattgacctgtttgctttctgtggctggttgggagggcctataaatatccgttgcctgccttactttgttctcaccaatggaaaccaaatgaatggttagacagtcaaataaagattccaacaggcttgtgatagttaaagtagccatcattcatttttatttttatttatttattttggaaacagggtctcgctctggtgcccaggttggagtgccgtggtgcagtgttggctcactgcaacctccgcctcccaggttcaagcctttctcatgcctcagcctcccaagtagctgtgactacaggggcaacaccacacccagctaattttttgtatttttggtagagacggggtttcaccatgttggccaggctggtcgtgaactcctgacctcaagtgatccatcctgccaagtagccatcatttattatagtctttctagagtctgggcggtttgctttacatatattatctccaatctttgtaacaaaaccacaagctaagtaatattgaccatattttacagatgaggaaac

SEQ ID NO: 128043 - DNA, 1995 bp, Homo sapiens
ccagcactttaggaggccaaggcgagcagatcacctgaggtcaggggttcgagaccagcctggccaacatggtgaaaccctgcctctactaaaaatacaaaaattagctgggtgtggtagtgcgcacctgcagtcccagctactcgggaggctgaggcaggagaatcacttgaacctgggaggcagaggttgcagtaacctgagatcataccactgcactccagcctgagcggcaacagagtgagactccgtctcaaaaaaaatttgagggaagagaggctaattaagacattcattatgtttaggtgaaaaacaaaggccagcattctagtattgacagttagaatggaaaggaagctgtagatatggttaatcatggcaacaaagatttatggggagagacacttggaagcagaaattatgagagacttttgaaatagcattattgaggtataatttaaataaatataattcatccgttttaagcgtacagtttgatggattttaacagatgcgtgcaatcctgtaaccactactacaatcatgatacggaacaattgcatcaccccagaaaattccctttacagacagatctgtccctccaaacttagcctctggcatcctctgatctggttcctgtgactctaggcttttctgatgtttgtttgttggccttttctagggtttcctgtaaatggaatctcatgtcttctgcgtctgggtactttgacttagcatagtacttttgaaattcctccatgtattgcctgtgtcccttcttattgccgagcagtaatccactgtattcctactgtggattatgttccaccgttgtttatccgtccaccagatgatgaccgttgggttgtttccagtttttggctgccatgagtcaagttgctataaacgtgagagtgcaagtctgtgtgtgaatacacattttcatttctcttgggtgcatgtaacagtggggttgttaggtccaatggtaactgtatgcttaataagaaactacctgattcgctgagagagagctttaaaggaaaaaaaaaaaacaaaaaactaccaaaccattttccaaagtagccacatcattttgcattcctgctagtgatgaatcagagaacaattgctccatgtccatgttagcatttgatgtcatcactcttaattttagccaataatggttttaaggcagaaaaaatagtaaggatgaacaaaattggaatgtcaagtgggagaagctaatttagagacaaatgacagtggaaacactaatttcagttttgctttattagagtttaaggtgttttcaactaaaaaaatgaccctataggttctataacttctcatatagaatttttaaaagaatggcctgttggagttaggcagtcatgagtttgaagattggctcacctattttctgtgtgaccttagataagttacttgtcctttcctagccttcgttttccccatttgtcaaatgtgaaataatagatgattgtacttagtataggatctgatgcaaagttagcattcagtgaatggtagcttggtatttaaatatatattttatgccccagtaacttgtgaatttcttgcaaatctgagcattttttttctttctagctgttttattccccaactgtgttaattccccatactagtagtcagagtgattttgttaaacactgatcttgtcagttacttccttgtgctgatgccttccacttgtccttgtctgggtatgaatatcttaggaagaaaccttgatgaggtcctctgttgaaaaggtctcctttcaacctttttcctttctaccatttataattactgtagtcatttgtttaatctttctcttcccctctctgtacttaactgcttgtgtataactataaaatccatgaaggctggcacatggtaagtgctcagtaagtttgtttaatagatcatcttgttttaagttacttgaagacaaggacatttcatacttaa

SEQ ID NO: 128044 - DNA, 1058 bp, Homo sapiens
agtatgatgtatccctgttgacgttgactgtagtcacctagagaggtagtgttggccaggttttctactatgaagttactctgtccctcccctttttatactctttggaacaagtcactaagtgcaatttgcattcaaggtgtgggaggacttaaacctcctggagagggggactatctgcaaaaattatttgaattcttctaacaggtctttttaaactttatggaaacagcatgagtaccaaatcagtctaatgtatctgttctttgcagggtgggaaaccccgtaaacaccggaaggatcggctacaagatttaattgatataggctttggctatgatgagacagatccatttattgataactcagaggctgtgagtaatgtatctttaatatagcagcaaattcattgtttgtatgggatagtagaagtcaagggtaaagtaacttaaatagtgcagtgaatgtttttatttgtgctttttaaagccatgttcactacttaaagatttctttacccttttttttttttttaaagaatactgcagactgagaattttgtaattttgggtttgtctgtggtgaattgttattacattgttaaaatagaccaagttttatcaaacttttttctgtaaaaggccacatagtattttagactttgtgaaccctgtggtttctgtcacaactacacaagtttgccattgtagcatgagagcagccatagataatacctaaagaattagcatggctgcgttacaatgaaactttatctatggtctgtgaaatttaaatttcatataatttttcgtgtgttgtgaaatattaatttcttttgattttttttccaataatttttaaaatgtaaaatccatttctagcttgcaagctgtttgaaaacaagccggtgggctggatttggccagtgcatctcatggtttgctgactctgtacaatgtctttattttcatatgctctgctcctttccagttcctgaaagaatctcttgggattctctagtagttgctcattttcagaagtctaattatagcgttgac

SEQ ID NO: 128045 - DNA, 1104 bp, Homo sapiens
taaaaatacaaaaaattagccgggcgtggtggcgggcgcctgtagtcccagctactcgggaggctgaggcaggagaatggcttgaacccgggaggcggagcttgcagtgagccgagatcgcgccactgtactccagcctgggcaacagagtgagactccgtctcaaaaaaaacaaaaaaaaaattctgctgtcccgacataaacttatttaccatactaggcagtctggtctgtagaagtaacatattgccagtgccctttggagtaaaatggccttcgtcttacaaaaaaggttgtcaaccaataaatcagggcatggaatgttttccggagtcttgacctcgatttgtaacttggtgcagaagtctagattgtaatcttaattcagtttctaatttgctgtgtagccaggagcaagtcttttagcaccacccggttttctctgctatgacttgcttaccccacagaattactgagccttaaataaggtaatgaatgtaaactagctgaagaaacatgaagcaagtgcaaagcatcagtagaagtgttatgtgtacattttgaattctaaataacccaagaagtaacttagccatatataaatgggcatcacatgtactcacacttacataaatagcttttttaaattaataaactttcttttcttagagcagttttagagtcacagcaaaactgagcagaaagtacagagtttccatgaacaccttgcccgcatgcacacactgccttcccccgctcagcatgctgtaccacagtaggacatttgttagagttgatgagcccagacattgtgacacatcattgtcaccgaagtccatagttcacattagggttcattcttggggttgtacactttgtgggtttggacaaatgaataatgacacgtatctaccatggtagtatcacacagaagtgtagttttgcttcccttaaaatcttctgtgctctgcctattcattcctccttccctcctaatcactggcacctactggtcttaactgtcttcagagttctaccttttccagaatgtcttatagagaaaatcatatagtatgtaacttttataaatagcatttttaatat

SEQ ID NO: 128046 - DNA, 1042 bp, Homo sapiens
aaccttttaggttctgtagtgcacatagaagcatttaagccataggatttagaaaagatttctaggaggaagtaatagctaaactgagctgtttccccattttcttcactgtaatggccatttacctatttgcctttcgtgggtgacattccagattatactgaagaaggtgctattgtaatagtataagttaataagaaattaagaaaactgctctgtcacctgtcaaattattattttaattctgtgcctgcttatttatgtgacactttaacgtttaaaatcacacatagcctaactgatcatttttgtcttcacagagttgtggctctaaattcacacaagtctgaaaaaaagaagaaacgttataaagattctctttctctagctgccatgattagaaaattccagaaagagaaggatgcattaaagaaggagtctaaccccaaagtcccagtgaccttgtcaaccccttctctgaataaacccccatgtgctgctgcagcactggggaatgacgtcccggacttaaatctgagcagcggtgatccagaccttcccatttttgttagcacaaatgaacatgagctgtttcaggaagctgaaaatgccctagagatgctagatgattttgacttcgacagattactggatgctgcttctgatggtagccccctatctgagtcggggggtgaaaatggaaccaccacccagccaacctacacttctcaggttatgcccaaagtggtacctacactcccagagggtctacctgtacttcttgaaaaacgtatcgaagaccttcgtgtagtaagtgtaataattctcttgctttttatttgctgcacaaacataagaattaatgcttttgttcgtttgtttttattttccacataacactggtataattgcttttgttttttaaagataaaaataataaactacaatctgaacatttttataactttttatttgccatgtttccttttagacctttcttttttctttctttctttcttttttttttttttttagtagagac

SEQ ID NO: 128047 - DNA, 1005 bp, Homo sapiens
actgtttctctccggggagagtcaaaagaccatccttgggacatagcatctcagataagcagagtatcagcattccattaacaggctttcctgtttattcctctcatgtctatcttaaaacgaatcttcccattttttggagcccatctgctttttatttcacagagggtatgcctccagtttcacaagtactagtgttctgagttgaattttttttttcccttttagtcactttcttattccctcagcctctttttccgctttcctaaacaaacatgtcttattttctgtattgagttgcccttctaagagaatatggaacatgattatttagagtaggaactcccatgaagctatccagttgtattggtgatgccttgccattgcttccttatactagggaaaaaagagatcaatttgttggaatagggaaccccccctttttttcctgattgaatttgacccggatcaataaatatacaacatgctgatgatttccttgcctactacctagagcagacgttgctcataaatgtttttttcttttttctcttttgagacagggtgtcactctgttgcccagcctggagcagtgatgtgctcatggctcactggccttgacctgccgggcaattgccagtgggccgaggggtagtataatatctctttgaggaaaggagcttttggttaattacaaatttattgtgctttacccaaaaccatagagtttgcccctgtaacccaaaaaatatttccagcttgttcatggttattgaagttctactcttaaactagattgatagaatacttttatagcattactatttattggtatggggctgggcgcagtggctcacacctgtaatcccacactttgggatcaaaggccaaggcgggtggatcatctgaggtcaggagttcgagaccagcctgaccaacatggtgaaaccccatctctactaaaaatacaaaaaacttagctgggcatggtggcgggtgcctgta

SEQ ID NO: 128048 - DNA, 3037 bp, Homo sapiens
ctactcgggtggctgaggcacgataatcacttgaacccagaaggcggaggttgcagtgagccaagatggtgccactgcactccagcctgtgtgacagcgagactctgtctccaaaaaaaaaaaaaaaattgtttcagtaaagaaaagtcttataatatttctgcacctatgatggtgataaaagtatgttttaagtagttacatatatacttgtaagatgcttgtaagatgaaagtaataaattggttgattaaaactgtcagatgcaaacctactttcttttttgccctgaaaacgcacatgaataagagtttttgggttcctttcactttggccttgaccttgcatttttacttgcagcctaagtcaaaattactaaccataactgagagaacaggataccaacgtccggttggtagtcacccaaaccaaacacgtgtcttcgtgttccagagcagtgtctattcttagggtactggtttcccatcacaatggaaattaaccagtagtagtctatacaagtagaatacaatgattttgttttccgttttctgtatgaaagtgttcacggggcattttgaagagtgtaatggaacactattaataattatgctgggcgacagggaaaaactggaactcttcttggctaactggaatatgtcattctaattttgtatccagtgtgtcttaggaaaagtcagtgctgtagaagaaatgtccatatttagatatgctaatatttcaaatctataattggtatctaaaacataaattttatcttttgaggacctgcttacaagatttcgtaaatatgtctgataaaaacttctagtatgtttttctttttaggatgatcgtttaagagaacctctgcaaaaactgaaactggctgttagcaatgtcatgcctgaacagctatttaaataccaggaggactgccaggctcgtagtcaagctaagtgtgccaagtatgtatctcttctatttggactggcttttgcatttgagaagtgtatgtacgttatgtatgtatgtatgtatgtatgtatgtatgtatgtatgtatgtattttgagacggaatctcagtctgttgcccaggctggagtggaatggtacgatttcggctcagtacaacctccgcctcccgggttcaagccattctcctgcctcagcctcacaagtagctgggattacagacacgtgccaccacaccaggctaatttttgtatttttagtagagacagggtttcaccatgttgaccaggctggtctcaaactcctgacctcaggtgatccagctgcctcagcctcccaaagtgctgggattacaggcgtgggccactgcacctggacgtgcatttgagaagtacttttagctgttctgatgttaagtggacctcattctcaagtagaaatccacatatactgctgacttgatataattgagtattttgtaaatggcactcagttgctttgcagtcagagacaaaaggtgtctgttgattgattgtatggaggtgatcaagcaagagctgacactggtgagagatttcacaaccccagcttgactgactgtggttgaacacaagtgttttctgacctaaaaggtgaatgttggtgcctttacattataatctgaagtccttatttaccaaactactttataactcctttcaaatttgaagtattatgtggaaaggtagattccgtctttaccctctcttttaacattccattaagcaattcagcaagtatttatggagcatattatataggcagtgttgggttaaaagtttgttttgtaaagtgtttttcatttttagattgcagacagatgaagaacgagaaaaaaatggatctgaagaggatgatgatgagaaaccaggaaaacgtgtcataggaccaagaaagaaattccactgggatgacactatcaggtaagatttaattagttttcacttttaatatataatgcagaagtaagattcctcattaaaaaaaaatctataataaatataaaactagattggaagcaaccaaagattagtgtgtaggaaaaaattattcaagagaagattaattgggctctaatatcctcagagtattattgcttttattttcatatacactgtaatactttttacaaactaatctaataatggtgtaagtcatactggtttcagaaggtgaagtactttcaacatatttcttctttagccatctttctcaatagtatttctataccccaagtagagaaccatccctttcaatctttggtgctttgattaaagatatcaaaggaaattgtttcatattgcaggtttgactgtggtgcaatgaatgatatatgttagaaattgtttgttattttctgaatttttcacataatctgtattattgctgccaaatgtatgttcttctaaaaaaagtttcaaatttaattttcaatctgtttagaactttgttatgtaaccttgttgagatcaaattgggatgctatgagttagaaccaaataaaagccagtctgctgaagattatcttaagtcttttatggagacagaagtgaagcccctgtggcctaagggctggatgcaggcaaggtaagaaatgtgacttactggattttattttattttattattattgctgttattaaagatatacatacacatacacatatgtgacattgattttgctaagaacctaatatattcagcatgctgtctagtcatctcagatgatccttgctttgaaaaccttaagcacttaaatgacaaaacagtcgcgcacacagagatagatgtaaaggtgatattttacttaacattttttttaacacccaaatttgctagtagagaaaaagagaagagggaagactcccaaatggttatgaagtttgggagaggagctttataggggtaacatgaagatgaggaacctaatatgggattagagcataggaaaagagacacagccttagattctattcaaaatagtcagtgtagaggccaggcacagtggcttatgcctgtaat

SEQ ID NO: 128049 - DNA, 1047 bp, Homo sapiens
aagtaaaaattaataaacttggctagttcaacccatgattttaattaaattgctccatcttctatcaacagaaaagatctgttggccaggtgtggtagctcacccctataatctcagcactttaggaggccaagggccacagtgagaggattgcttgaggccagggattcaagaccagcctgggcagcatagtgagacccctgactctgcaaaaagttttaaaaattagctgggcatggtggcacacacctgtaattccagcttctttgaaagctgagttgggaggaccatttgagcccaggaggcctaggttatagtgagctatgaataaaactctccataaaatagattattgagtatactgtaccattataacttttacttggtaaataagcagtaatagtctactgaaaattaaattactttaaaaaataaaacaattatgttactatctgctataaagaaaataataattgtgttctttaaatttttccagaatgctttttaaggaaagccggagtgttcataatcatcttacttctgctccgtgagtaaatgcagactccagattgcttcatttattcacattatgtgctttagtgaacaaaagtatcatttattaaatgctagttggaataggacttaaaaagatcattttgaccattgactatttagacttcagaacacatttatctattgaaataattgtcagggtactctctaaacacctactaaatccacactgtgacacataatggcctgggattctggtagtagggaagcatgaaggctcagggattttcctttgttcctgggccttctacctgccagtctttttctccacctcttaatgtccatctgcatttgtaatctacagccctctgtgtcctgagtttaccaggacagatccatatgcacacccaccctcgctgcactgcagagtgttttattccacaaaattaacctattcttgaggtcttctgttcaaaaccgtgtatttccttagtgatgtgattactagagaaagatcttttatcccctccacat

SEQ ID NO: 128050 - DNA, 1744 bp, Homo sapiens
ttttagccaagtgaaataggcaaggtgaagtattttagcttgtcaacaatttaattattcaacaaacatttgaatactttgacttactatggaacttgttcttttttttcatcttcaaactttttcttagttttccaaaagtttcaagattccatagtaatttttcttgccctttttctccctgtcattttgacattttttatttgaatttttacattacaaaaatttttctttaaaagctcagggttttttttgttttggttaagttaaatctcattcacaccttcttggcatggtttaatttgagcctgcggttccttgaagctctttttttgggggggctattttatggtttatttacatttaattttttaaaaattgtattatctacatttcatgttttactagttgtttggcctttcaattaatctgaattggggaaaatgttgctacatacttcgtataaactgagcacttaaatacggttccttcaaagagctttccaaatagcagaaggaattatttaccacataattacaaagctatataactttctaatgagcaatataactgctactgaaatagccttttaaaatctttttatcttagggcaaagaaaaaggtgattcctgcacctaaacccaaagtaaaggtaagtactgaaacaaaatatttaattagttatagttggtgaatgttgaaatacattcctaagatgaaaaagatgtatggtatttagcagaggtcagtaggcactataagatagatgttttcaacttcataataatcttagtacttttgtatttgggagaatagattcctgtgtagcagtggggaatatgcatacaccaattgtgaagcttaactttattaatacttggaaatgctaggtaaaatacaacaaatattctttcatagcataggtgagattgaaaaatatgtaagaaaaattcataagaccagaaacaaaaaaggagctgacagtgttaatctgtcgcttacactttggttgcccttggaggcatttggcactttctacccatcactttatggtttctttttacgtttcttctcagagcatagcagttagggttttcttgggcttgtacaggttaaaacttgggatgaaatctgtgtaaagctggaccttcaaacaataacatctttagtaaaagaaaggactagaaagaaatccagcaaccagcagagacattaagtggctgtcttggactgggttctggtttgggggaagaatgtccttgctgaaaaattttcttggcttaggagtttcagttacactacctctacaatctgagaaaacgccaagctgaaaaagtagcttggttactggattagtagtgacccggggccactggcaaaagcaaattctctttggtataacgtgccctcttcagaggcctcaaaggcattcctcctataaaccatggcagacctgagcttgcagtctgaaatacagaatacatgagagaataagttactatgagtgagattcagtaggaacaataaacagcagttagatccctaagacggacaagtagtgcacttatggaatttagtacataaaataatttgactgaaaaatttttaatatttagagaaatagaaaagggaataaaaaatatcctatcaaaatagacaaagtagatttgaaagagaatcaaaatataacctctagaagtaaaaactataatcatttgaaattaaaattttaatgaaagctcat

SEQ ID NO: 128051 - DNA, 1424 bp, Homo sapiens
ctgccagtataaatctgcacagtattctattagagtggatttaatggttttataaataaaaattaatcaaaaagttattttaaaacagcagttttatactagtaatacttccaatattgggatacatttcctaccctttattgtgtactttttataatggaattttcactaatcatgtaagtggatggcatatcaaaacaaatgtgtttcatctgcattactcattcttcttagcagacatttgtgaccttaatgcagttacacttgtacttccaattggtagtgaggtttttaatcaggggttttagagtaaaagcttagaaaaaatactaaggaagttagagtgtaacagtattcttaacagcttgcttatgtaataccttaggaggtgatggtaaagacccttcctctccattctttccccactatgcttaaggtaagtgctatggttgtatcaatcagtatgtaatataacactctaggtttgtttgggtttgtttaagaaactaattgaagagactttgatacgacttttatgtaataggcttttgcttctcagtcttaaaaataaaatgagtcaaatacttttatctttaaaaataaatagttgcttttaaattattttgctctttgaatattataaactgtgctctagttctttttcttaaatattaagaaggttgattatttgagaaacagactctaacaactcttaggtattcagagttgtaattcttaatacccttgttttcttagcatagagccctgctcacagcggacacttagtggatatatattgaataaatgacaaatgagtaatttacaaataaattacagattcaccataataaatagcataatttatttatgcttggattgaatcgtctgccactttgacgtaccagtttttctatgtactggctgtagggtagctgcaggacagggcatacaaagaggcagaaatgcatggaagcagaaagtgaaggtcagcctcctagcaaaccatcccagacgagaaggggagagtcttaatataaaggcagaatttattctgagtgcaggggaataaaaagagaataatctgaacagatggatttggagcaggatttgaagatctaatgcaggtgggggaggctcatcagtaatgtaactagtatatgaatgttccttccacttggtgttaagtatgacagctatgtgcaatatatcagatactttgtcttgtgaggacagctcagtcaggagctctgtcatctcaaaaattatttttgttttgatagtctctgaagatttccagtagaaaaacaattgtaattgtcatgagaatcttttagttatttaaaattaactttgtaattttttattcaccatttctatttttttccatatgatgctttacattaggagtgtagtccaaaaaagga

SEQ ID NO: 128052 - DNA, 1250 bp, Homo sapiens
actctcctgttcctcctcacttattaagacttcagataagccacttatgtaccgccttcccttatctaccccctcacctggaaatggttctcaagggtcccaccccctggtttctaggacagtacctagcaccactacctccagtaactatttagccaaggctatggtgtcacagatctccacgcagggtttcaaatctcccttctcgatggctgcctccccaaaacttgccgcatctcccaagcctgccacatctcctaaacccctgccctcgcctaagccttctgcctcacccaagccctctctgtcagctaagccttcagtatcaactaaacttatttctaaatccaacccaactcccaagcctactgtatccccaagtagttccagtccaaatgcactagttgcccagggtagccactccagcactaacagcccagtccataaacagcccagtggaatgaacatcagcagacagtctcccaccttgaatttattgccctctagtcgcacttcaggccttccacctacaaaaaatcttcaggccccctcaaagctaacaaactcatcatccactggaactgttgggaagaacagcttgagtggaattgcaatgaatgtacctgccagcagaggtagcaaccttaactcaagcggagctaataggactagtctgtctgggggaacaggaagtggaacacagggtgctaccaaaccattgtctactccacatagaccatccactgcctcagggtcttcagtggtaacagccagtgtgcaggtatgtatgttctgtacgtccatgtgataaactataagattgtataatgtcgtctttcttgtgggtaactttaataagctttttatgatatgtggattgttctcaattggcttattacagcctgcagccatggaatgttcctgatgctgacatcacagtgacaggcacacttgtagttgaggtgtttgttgggatatggattttttttttttaagtaacaaaggtgcaccagcattcagctgtctgacagaacgatgtcttcattacaagcaaccatcactaaatcaactttaaaattatttgacaaaacaaaactaaaatggcttatttcaaactttctctcttatcaaagtccagaacaaagtagtaacttaggaatttaacgaacattcgcttagctcttcccttccctttttctcctgccaattttcttatttttcaatcaaatttatacattcatgttattttt

SEQ ID NO: 128053 - DNA, 1050 bp, Homo sapiens
ggactgatatggtctgatttgcatttcaaaagtttactctgggcgttgtggggaataggggaccagtgcactcaccaaagtagagtatgtggtttaaaaaaaaatttaattgcggccggtcgtggtggctcatgcctgtaaacccaggactttgggaggccgaggtgagcggatcacgaggtcaggagattgaggtcatcctggccaacatggtgaaaccccatctctactaaaaatacaaaaattagctgggtatggtggcacgtgcctgtaatctcagctacttgagaggctgaggcaggaggatcacttgaatcctggagttggaggttgcagtgagccgagattgcaccactgcagtccagcctggcaacagagggagacgccatctcaaaaaaaaaaaaaaaaaaaattaatgcccactacgggaagagcaaggattcccttcaatgttttttcccctgggaataaaatgtagaggtcacggaaagtatttttgattatggggcataatctggaactatttacctgcttcatgctgacttcttgtgcatgatcccagatgataccaacattggagtaccccactgctgaaaggtctccatcttttaggatagagagatttgcaaatacccatgtcacatttagattatctgatgcttccatttatatttataaacaaattaaagtggatatagaagttacttgaaagtgtaaaatgttagacagttatggcatagtatcacttttttgctatacttgagttatttaattttggaaattgccctccctaatttacattttgcttttttttttttttttgagacagggtctcactctgttgcccaggctggagtgcagtggtgcaatcttggctcactgcagcttccgcctctagggttcaagcagctctcctgcctcagcctccaagtacctgggattacaggcagacgccaccatgcccagctaatttttgtatttttagtagagacggtgtttcaccatgttggccaggctggtcttgaacccctggcctcaggtgattcaccc

SEQ ID NO: 128054 - DNA, 1113 bp, Homo sapiens
tcgaattcctgatctcatgatccgcccaccttggcctcccaaagtgctgggattacaggcatgagccaccgtgccttgccaactctggttaatttttaagttgatgcaggatcttttctttcccagttgcattaagatactattatttctaacttggtaattttttcctaaatgtacccattttatatattgtggttggcacagtacaggaaaagacaggcaaataagaaaaactgtcaggttcaaacatggagtggtgaagatttgtacttaagtgtaagagcaaattttggtaaaaaagaaagaatgggtttgttgactataatgttatcattttataatgcctgaaaactaaggtttcaggcctaagggactggaaagaatggaattccctgatgaaagcagttgacagaagatgggggaacccattggagaagatgatttcagctttggatatgtcaagttggtgctagatattcaagtggaattattctcttaactctcagatatgcaggatggaaattgagatgagaggccagaactatggatataaatttcagttgtaaaatttgttatttttattaacaaataaaggagaacaggggagggaggcagttaaagaaccaggaagaaggctgcttgcggatattcttcatttgtttgttgagcagtggtgtagcctcttaagtgtataaatatatgtaatgttatgtggcatgtgtgtgtggaaagattgtctgcatttttcttatacattaacttaagaagtaccccaccagaagcaaaaggacaaagatttttaaaataatcagtccttaattaataatgctcattgatacatgtaataaaactggaaagagctaacattcattagttatttttaaaatagtcaacaaattccattttcctgatcaaatttagatttagatggacacggtggctcacgcatgtaatcccagcactttgggaggctgaggcaggcggatcacttgagcacaggagtttgagaccatcctggccaacatggtgaaaccccgtctctactaaaaatacaaaaattagctgggcgtggtggtgcacacctgtagtcccagctactcaggaggctgaggc

SEQ ID NO: 128055 - DNA, 1033 bp, Homo sapiens
ggtgaggctcatggcgaggaagaacaccttggcctcgtctctctaagctgatgtgatgacagtaaaggataccaagaaggaccctgaaagcagcagtctgcagcagccgctgcaggaaagatgatgagacaaatagtaaagtgagtattttcagagaccgagctgaaattgcatggaattacttactcatggttcaggtgtttgggctaggaggcaaaagtggaggagtgcgagtggaaggttgggaattagtagattgagagagtgcgtgggtgttcatgtaagtgccactaaaataacagcgtctaaggaacctaccgtggtaatgaagagcctgtctcacaacgtttctgtcagagcagatgtaaggcacagtcttgcatctgtgaggatattatagaaaataaatcaatttgggttgctttatttcttatgtattttgacccctggtttctgcacagtccacagcaggagcatcattattggctaatgcctcacctctgactctcatgacatcacctttgtctgtaacaaatcaaaatgtgactccttttgggatgctgggtggccttgttccagtgaccatgcccttccagtttcccttggagatatttggctttggaacggacacagctggagtgacaaccacctcgggatctacctcagccgctttccaccatagcctaactcagagtaagtggggctcttctatttggttgggctgtctagcttgacagaacaggaaacctcacaaatttattctaattaagagtagtccagttggagttaatgaagattatagtttttttttttttttttaagaaatgcagtttatatatagtaagtcaaattattggacactggggttttatatacagtttttaagctatctataccacatttccatcttaatgaaatttttaagaggaagtcagttgtgttgggttatgtgcatacacatacattaacataagtaaattttcaaaaacgtgctctagttttagaaggccttcgaagtcaggtgctgtgcctg

SEQ ID NO: 128056 - DNA, 1069 bp, Homo sapiens
gggcagaagatttgcttgaacccaggaggtggaggttgcggtgagccgagatcacgccactgcactccagcctgtgcaacagagtaagactccgtctcaaaaaaaaaattaatatgatccaagctgtatgcattatgtccttgtaggcagccagatcgctctgaaatctgacattaggcagtcagattaggcaatgtgcataacacactgggctccagcttctcgttttccccagcagtctacctccatagacactgatattattctgaagcccattttcaggatcttttgagcagaaataactgcttagctgccctcttaactttggaagttgactaggcctcacttttttttttttttttggccactgcattaaaaatgacctttgaaccagtttaccattaaccacagtgcagagatgggaactgaggggcaatcttgaggcaacagattgccattaatcctctgaaagacctaagtggtgagctgtctcagtcttaaccttgagaatgagtataaaaccacagttgtgtaaaatgggtaacacagagtcgtggcacaaatgtcagcaatcccgatcttcctgaactctgactagtttaaatatctaaagagaatttccctgtgactaaagcatgtccccccctgggtgtagacagctgcttggtataatgaatccagctgagggtagtgtactcatgggcagattggcatgaatgtggccacctgcaaggaattaaacaagcaggattcttgtggctcaaaaagaccccagtgttcgctcttacacgaactatcaaatttatctgtgcagcactgctattccgaggggagaaaggaaatatgactgtcagtattttccaaataactaaagttaaaaagtttaaaatttttcaaccaggcatggtagctcatgcctgtaatcccagcattttgggaggccaaggcaggcggatggcttgagtccaggagttcgagaccaacctggtcaacatggtgaaacactatctctacaaaaaatacagaaaattttctggacatggtgctgtgcacctgtagtcccagctac

SEQ ID NO: 128057 - DNA, 3288 bp, Homo sapiens
gaaagatgtagtgggtccctcggaggtaggaattgtgtcttctggttcctttataaccctctcacagcatttgacacaattggctgggacgtaaatgataaatacttgttgaaatcatatttaaaaaacactgaaaaccacagtcatttgagagaagaggatcattgttgttgagtttttatctccatgatgttttatcaacctctataatgctatatggcatgcaagatattaaaagtgatatcttttcagagatgtcatccacaaaagataaaagttaattgttgtttttgctttgtttttgttagctggtttttgtaacatatggacccataccaatttaacgtctctttttctcagatggaggccaaagtaaaggggacactaaattaccacggaaatctcagtgactgcccagcaagcaaaggagacgaaatgtttagttgactgatggaatctacctgatgggaaagtacttatgtggtcatagggctgctgtttctgtcgatgtttacattctctcgtcccaagcactgtggtgaggaggaaaaagaaaagaaaacattacttgagcaaagccaggtgcaggaggaagaaatgcttttgtgcaaagttagtgacctttggtctcttctaaagaatgacagagttaccgtattaacagacttgaaagagactcagttgtcaaacccacagaaatacaaatttgatttttcccgggggaggaagaaggaagtgaagagaatttgggtaaactccatccatcctgggggttggatctgaacacttacagacataattggtaataaaaggcattaaaaactggaattaggccagtttgtcaggaataatgatcatgtctatttgaatggactgtgtagcagatttgccacaaaaagaaataataatgattctatctccgatagacagtagctgcatagcacaccctcgaaaatcctgaacaaacttgaatctcctccagtgtgtagcaacttccctcaatcagtggactaaagatccttcaggaaagttattttagcacagtgatatatattattaaatcatctagatttttaaaaatcaggaagttgagcctgttgctcttaagagatgaaacctagatgtcccctttttgtaaaagggtcaatttcatcttccgttcagaagcaggtacttaactcttttcttcaggtgatttgtgcatctagtattgactggttaattcttatttccattcttgatgttaaaatgtgactgtgttcacatttttctcctgagaaatggggatctttacagggttattgctttgctgcttttagcccttgcagcaacataaactctaagtttccccagttcatctaacttcacaacttctccttctgttcttttagctagtggtccttcaggtgattattagctattggtataaacaggtagaagtgtacactatgtttcttcattggtcattcaaatggcatgaatatagtttttgaatttttaagatggtattttaaagggaggaatcacattaggatcacaatcacgacatatttttactccctgtatccagtgtagtgaaattgtttggagcatttgagatcctaaagcttcactatttactcagtgtattggtatgtgagtaaatctgcagaaaataagactccttagttattatagcttccttatgcaaatagcatattcaacaaaggatgttaagggaaaaatttatggttctccttggatacatttgatttgatgggtttttttgccgcattattctagttttttaagcttctgaatattttcatactatatcagagaatggtgtaaactctaaatggtataagcttcatccatttataatgacactaacctaaaaaaaatagactggtagtgacaagatttattgcatatgtgtttattatacattaccctataccattagatttactcaattaagagtattaaccaggcccttttttcttttatacacaaaagtcccagataccctacaggactgtgaataaataaccacagatcggttcagatctgtatgcctatattttgacttcaaagtcacattggcttgcttcatagcgaaaaagttaataaataactgaaaactttagttccaagaacttgttacagtaaagggaaaggattatttcaaaggaatcactgatataatttcttgactctaagaatttagtttatcaataaaacaaatatggatgtagtatgaaccccagtagatattttggaaggatactgggaggatgttgcagagaggtttgacttgaattcagtatgtttgatgaagatttgcttggtttcaattaaggaagcttgcccaatttttttaattttttcaaatgtagtggacctcttgcttttacgaaatatgaataaaaaggtctttgcttcatactaggggaagtgatgggattttcctttgggaaggtagcctttgttttacttctcataccacaagagaagtcgaagtgcgtattaatttctcttcctgaatacttgtatatatgtttgtctgtatgtatatatacatacacacatacattcatataaatgactagtttgagtcaaaaaatcatttgaatttcttaaaaccatcaattctgaatcatgccatatgaagatccctggtgactgtcatcattagaaaagaacaagataatcagttcttttccctgtaacattttatactaaccagtaaaaatatctgaaggcccttggctccaagaatacaatgtggagattcttctgtgttctctttagtcttgattccttgaggactactgtcagatccctaccttaaacccccacctgcactgacgacttacattcatttcagtcaggaccccccttttatgttgtatgaatcagtcaaacatcgttgtatttctgtatagataaagtatgatcagagagtttctacatgtaaatagtaatctatttctttcctagatcataacattgaaaaaggtgcccatactttatggtcacctgtctttaccgtttttattactaaaaacaaacatataaattggttattttttagcacagagacttgtgactcatactgtatttttgcacttaaaaatcaaattatgttattttttaaaatggtgagtcattggaaaggatatctatagagcaacgtgtatttctgaagagcattagcaacatccaaatgcaaaaataatcagcacacatgattatatcccactccttgggattcttgattcaggaagattaagctgtttgttttca

SEQ ID NO: 128058 - DNA, 1072 bp, Homo sapiens
caattataattcttgtatgcttttgaggtcagagggtaaatgaaatcgtgattttaaaacagcctgaagaaaaaggttttgggaaaggaaatgaggctaatctgtagtcataaaattctgatactttgcggaaattagaagatggtgatagtgcattcttttgtgcccaccccccctctgatggatgttgttagcccaaattacatttttcatatcatggacattgaatagggtttattgaatcaggaaggtaaggggaagaaccgggcacatatgtgttggaatactgtgggtttgacacctggttgaaaacaacttattggacatgatttttaacccaggatatttttttcccaaagcagatctaaattgtttactacccagggttggaaagggcaggcacctctaatctagtctttgtcctctggttgccctctcccacacccctttccacctatacttggttcaagacattttctgaaacgaaaattctgctgttgttcaaactgccattggttatgagaactctgcgtcctttgggatcatctcttagaactccagtgatctatcatatttgctgctacatttgtaaaatgaactttgcctgtattggttgactttaatttacagttctttatttctaggatgttttgtcctctagtttgactcatgtatagaattaggatactttattttaggagtgtaccgtaaaagcacactggtccctttgttgtttttattatttaggtttggaatttgtttgctttttttttgtttgttttttgttttgtttctgtttttgtttttttttaaagttggaaatagaagaatgagaaaaatctataatcaggccaaacttgagaactttcctgtgcttcagcactgtaattctgctgacctaatgttctcaaaagaggcacttttactttctattgtgcatgtatgattgttgttttttgcttttgagggggcttttgtgtttgtaataatgaagcagaagaaaagtgcagtagtagataaatgatcacaacatgttatgcaattttattttataaaattttaaggggaaaag

SEQ ID NO: 128059 - DNA, 5709 bp, Homo sapiens
atatatgtgtaagatacatacattacatatatataaaactaggagctgctgtaccattgcatcctttccaaacactcccctttccatgtttgcaaaacttctgccttgtttattccattgcttttagttgattaaagtgggtggattagaaaagtatcttttcggccgggtgcggtggctcacgcctgtaatcccagctctttgggaggctgaggcaggtggatcacgaggtcaggagatcgagaccatcctggctaatatggtgaaaccccgtctctactaaaaatacaaaaaattagccaggcgtggtggcaggcgcctgtagtcccagctacttgggaggctgaggcaggagaatgacataaacccgggaggcggaagttgcagtgagctgagatcgcgccactgcactccagcctgggcgacagagcaagactccgtctcaaaaaaagaaaataaaagtatagaaaagtatcttttcacaagaggccaccttcgccctttgaatatctgcttgtagaagttaacaataacaacacacacacacacacacacacacacgtcagttactacaagtaaaataaacttagtgaatcattgactattcttggatataacccacttttctgtgctctttaaacttggcataagtaatataggagacagcattggaataacaagagtaccttgcaagtcacattggtaaggtgcgctagactaaacatgtgacaaggctagcgttagaaccgcagtttggtgtctaagtttagaagcaggttagcaactgtcaacatgaaaaatgtatcatattttcttctggaaaatgatttttgaagaaatcatatagctgcatatctatctgttaaaaggttaataaactcagaagtagaaagacttcagatgctgaggaaaacatataatctatagcattcttgagagattttccatttgctttttatttgctagataattacatttggcttaatctgattttatggttatttagatttctcccttgagcaaaataacataattttcagtatctaagattcatcgattttttgttgaaaacaaatagatgtgacatgttaagggagaccaagttgaaccatccctcagacccagtacaaatatacctagtaagtgcccccctttcaatacattctaattgggaagaagaagagactagtggcttaaaaggagaaagcagaagctcctggtagtgttacctgatagcagaacttaccaggcagttggaattcacgagtgttattcttgaatgactatgtctagggggaatattgtttaaccttcgtgcctcagattacccattagacaattgggtataatcatattcacctacctcccagggatatcagagactttactatttcaaaaatattttgagtttttgtaaaatgtcctatataattaaaaatagtattatcatcttcctgcagaggctaaaaaatgttttccttataatgagtataaaaagcaccctatggtttttaaatttaaaaaaatcactggaattttaatttagatacatatttgttatttaaacattatctttgaggtgggataaaatgtttagtttcaggttaacaagggagagaaataacactaagtttaagtagttttttttagccttttacggtgttactgtgatttttcgtcaaggttgtggagctaaagttagataaagttatgatgcttggttattggagttgataaatgatcctggaagttttaactgtctcacttttccatcttctcagtctaatttccttttattgcttgtttgaggacggatagctaagctttttaactttctaagaatgagtatgatgtctcattcttgcaaatcagagattgtgtactaattccattaactgtaggtgtatccagctctgcactgaaggggtgagcactacacacagtcagctggatactcttgtagccattgcacctttgtaattcatgcttcttcaacccatgaaagaggtggagccatcagctgctcaggttgtaagaaaatgggagacggaaggcaggattcactttctaactgggtcggggtggggaaggtcagggtagaaggaaacatgttttccccagctcccaggaggagacgaagatcattttatcccaccttccatccctgtatattaagtagtactactacatagaattttcccgttatcgtttaaaataatagcaacaggaaaagaaaaatggatgctgcagttttagttggggctaaatgctgagcaacgattgttggagtgtgtgtgtaaatttaaattgtagcacatattcagggtcaggaaagcaaaatgttggggatgaggaaccagtgttaccaggttcaagtgagttagtagaaagcaccaggtccaagcagacaaagcatctggttaatttccagaattggctaaggtccactgaatctctaatgatagggtgtgtgtgtgtgtgtgtgtgtgtgtgtgtgtgtctgtaagtcactttttggatttttgttgctttttccagataaggccttagtagcctctaaatatcaactatgcagataaacatactccttttttttttcacatgtccctgtcttttccattctcagataacaaatgttaagacccaaagaaataaggcataagggtttttgttgaatgtgtgtttgttcttctagggaaaattaacagaagcataaaatagagatactttgtgtgttcatctatcgtaaaatgtgaactctgtattcaaaaactatctacagatgctttcactggtgcaaagctgtagttagtatcatggaatgtctttgggttgttaatgataaaatcatcccagtgttcaattctgagagttttagattatatgacacaatgttcaggtttatagagctgaatgggtgatcaaactctaattaaaaatagctttgaatattaatgttgaattcttctttcttggtttcctttagtcttcattctttattcagagctcttaatcatattgctacactagaatatgaattgtatattaggagtctggggaggaaaggttaaattgtcttttacatcctcttctcactcactctggcaacctatcctgtgtccccatagaactgagaagtaaagccctgtgcaggcctgctttagaagactttacatcccagcagaggattcaggcagggactctcaggattttaatcagactgcctttgaataatgtgatattaaattttatttttctcatagactctcaaagtaccacttgcttgaaagtagctacttgtgatctttaatttccttatattgtgatagttctacttttcagtctttcctgtgtatctccatttcatagtgcgttagtacttaaacttcggacacttttccaaactgttaaacaagtcaggaatgcttttcagaatcgcagtagtattattagggtctctgtgtctaggacttacagtcatcagtggtcatcactgggactagaggtgttcttttttttcctcttctcctttgtattaaaaaatagattttgctactgtataatgcggcatttcatgacttcctcttgttacttttcaaggttattctaaagagatggagatcttcattagaggctatttctcataatagtctgccttgcttattttcatactccccctgaaataagcctacttttgcaaacaggccatatgaatcaaattttatgtttgttcctcacaaaattttctacacattatttgttcccactttgctaataataatataatgattttattgtaaatctgtgttttaaatattttataacagagcactaatggaaacctaataaatacaaacaagataactattacccaagataacatggaaatacttctgtttttgaagttaacaacaccgtctgccctcaaagcacatttaggagtatcaaccaagaccagccagttgacatgtttttctgtgtggcaacctgcccttaaattgtcagatcttaactatcttgtgtttgctgtgcttgcagccataagctttcctccttttttgcttatccctgctgtttgtagggttagtgtgccctctgtcagaaaattgggttttctttactatacctgcaaaattaccaagggttaccccaatattgtctagaggaattaaaaagaacttattctcagttgacaaaagtattactgttatacatagttaattggaaagttggccaactttggtcacctatttttgagtcttggctatgcctttgtaattagttacatataccttctgagaccttcagataatcaatgggcctttccccattagaggtaggttcccagcctacaagtatttcctgtgatccatggcaagcctccagagaaaagattcaagctttgcactgcccttttgttgattgtcattgaaaacttactttatttcagaaagtatcaaaaataccaaattggtctttcagagagtatgtaaatctggggcttgcccttggatttcacttgttaaacaccctcaaacttaaaagaagaaaatagatctccagctggtgaaaattttgtgccccaaataatatattaatccaagtctaccaaggtaactaagtaatggatgttttctctcttttattacaagcaagaaagttcatttgcagttgtaaaaatgattaccgaactccagacctatttgctataactgattggaaataatgattctgatttttagtctgggtaaacacatacttcggtgtgaattttgataagggaaagacttgtttggtagcccaaggaaaaacaggatgtatttatacagtgaatgttcactctgcagaggaacttccctccagttacatcttcctcatacattagccacctccacacttgacatagatgccaacatgtttcaaaaccaatcttgaaggagcctaaagagttgatggtcctctaggtgaaagacaagaattactgtattgcatttgcttatagggaggtgtgtttttgctaacttgaagggatatactgtatttcaaataagtgtgtgacttaatattttgggatttttttttcctcctttaaaaactggacctgaacacaagctttgagttgatgtttgtaataatctcaggacctgaaagattgtagcatttagtgtgtcttaaaaattatgtactgtaccagccatggatttttgtaaatatacctgtctcccttttttgtattttagtaaaaaaaaaaaaaaataaatttaaataaaagggggtggtgatgacatgtgaatgggtgcgggtatgtgtgcgtgtgtgtttgtataaggctcttttgagatgaactggtgcttgtttaatttccagctcaaatcggagcaggaatatggacaaactgctgctactgaaccctgcactgagccgaggtatttccatttggttaactaaacgctagctaccaggaaatgacgcagaagtcacgttcttcttcccactgccatcttgcctttgcattctcagttctacgtgccctttgaactttaatggtaaaacatttcacactttggatggtttgcttgtctctagtttttagaaagctcttatcactccttcctaagaaaaaagaagggcaggtaaatttttttaaccaaaaaaaaatcacacatttcataaaaccctgatgaattttggatatgtgagagggcataa

SEQ ID NO: 128060 - DNA, 1063 bp, Homo sapiens
ttcatctgagtggtcttacagatatttggtttagatgtagcgtcatggagtgattccacgtcaccaagatccagctctgtctccactctgccattccaagggcctggctccgcagggagtccgtgacagcctcagtctctctttctatagtcaaatgcctgctgtagtttcaaactacatgcgagtatgtgctgtggataatttcttactttgtactcaaatgcaaagtaatgcgtcaatcatatgccttgattcatagcacattgtcatcagtcagctggagaactcattccctcacttcattatccatgaagtttctcctcttccttagtccccactctgctctgtcccacaggcaccactctaacttttttgatatgtgccccttgtttcgcaggcattcttcgaagtaagtagtgttgtgtcgtgtgtatacaattttaattcataccaatagtactgtggtagccatgtttactgttttctacttacttagatacatccacgttgctatgcgtacatttagggtgttgcttcttactgctacacggattccctagtgtgcacgcaccacattatacatacctgttcccctcacagtgggtaactaggttatcttcaattccttattaccaaaaacaaggtgatagttagtcttcccttctgtcaactgcgtgttgatctttgctcatcgtgcaattgcattttggtttcttgttgtggacattaatctcttaccagttttagatgtgtcagttacttttgtctgttacctgtcttttaactttgtctgtgacatcctttattgaacgaaatcctttttaattaatctactttttgtcttatgtttgtgttttgggcagtttacttatgaaatatttccctagccctacaccacaaagatatcctccagcattttctcctatgagctttatagttttgccttcaccttttcatttacaatccatctggcatccacctttgtatactgtgtaatgtagggatccagctttatttttctgtatttagtgaagcagttttcccaataccacctaacagatca

SEQ ID NO: 128061 - DNA, 1036 bp, Homo sapiens
attgtagttgcagtggctcatgcctgtaatcccaacactttgggaggccaaggcaggcagatcacttgcggtcagacgttcaagaccagccttgccaacatggtgaaacccgtctctactaaaaatacaaaaattagccagacatggtagcgggtgcctgtaatcccagctactcaggaggctgaggcaggagaatcgcttgaaccgggaggcggaggttgcagtgagccaagatcatgccactgcactccagcttgggcgacagagtgagactccgtctcaaaaaaaaaaaaaacaaaccattctctatatattttgtataaaaagtcatattaatataaggacgaaatatataaatatgtaaaaattctatattagctataccttcacacagcccgcttcctaagtcaggctgtcatgagacacctgcagtgcatcaggtatcctggcgtgaggaaggggttactttttataatgataacttcttttactaaaatgggactctttctgtgtcagtttcaccagaggccccaaaggctgagaacaaaacattaggtgccaagtacttccacattctaaaggcaggaggagctagatcaccttcacagctcatgctgagattgtaaaactgttagctccacattgggaaggattagcttggcatccacgtcctggccgtggcggaatgtgagaggattgctttggagcaactgtctgtgtgctggacgttgcccttcttcccaggcaggagggggtgggtgccccatcttcagctcatgccaaataagggagcacttcaagaggaccatttcggaaagtgtgacatgtcttctggagtttgagggacacgtggactgggatttgactccatgttggtggctagcccctggagatggctgcctttggcatggtttgcactctcagagttcctgtaggcctgccgtggttctctagaaagggagacagccttgttccagccaaagggaacaccggagggatgggataacctcaatagaggggaggacttctggagcct

SEQ ID NO: 128062 - DNA, 1067 bp, Homo sapiens
agcctccggagtagctgggattacaggcatgcgccaccacgcccggctaattctgtatttttagtagagacagggtttctctgtgttggtcaggctggtttcaaacccccgacctaagatgatccgcccgcctcggcctcccaaagtactggtattacaggcgtgcgccaccacgcccggcctgcggaaatggcctcaacgcttcaaccggaagcagaaattgaccgcggcaggcgccatctaacggccgctggagcaaagctcctcctggaaattcgcaacaccggaaaaggtccggctgcttccggtaaaaacccaccagagctgacgttcagagggcgagtctcgaagatccggccaatttgcccagcgcgctgtgctccgcgacggcgcatgcccgcttttgcgcaggcgcggggactacggcgcaggcgcggagactattgcgcaggcaagcgcgtacgcagaagcgtgcgcgcgcccgttcaacgtccggagcatcggtgcagtttcgagggtaaagcctttggcgcggtgatgtggacttttgttctctaactacaactcccagcatacgtcacccctcacgtgggcgctaggtgtggtttcgtgggatagggtaaggcgaaaatgaagtgacgatgacgtaccaaagaggaaaatagttgaatatgttgtgtgagcgcgtcgtttgcagaagccccagtggcctaatggataaggcattggcctcctaagccagggattgtgggttcgagtcccatctggggtggcctgtgacttttgtccttttttcccctttctaaacaaagcgaaatatgccaactttactttttttttttttaaatgggaagtgtgtgtgtgtttttactagctggtgggctgcaattttcgagaatctgcacacacccatgtcctttgtctgagccgcaggtcccctgggatttggggagacgtcaatacgttgaattttgatatcccttttataaatcatttaaaaatgtcttctcagcgtgttccatatcaaatccacacccacaccccccgccgggcccgcttctcctgag

SEQ ID NO: 128063 - DNA, 13453 bp, Homo sapiens
ttctgtcccaagaaccggacggagagtgagggcacgagggtcgctgtcgggggctgtcgtcttccacgtacacgtcgtcgtgaggagcgcagtccggactcttcccgcaacccctccggctccctttccgcacgcctcgaggcggcggcggccaccgagacagcagcgcaccttcccccatcccttccccttatcccccagcccaaaagggcccggtctgcgccccacccccgcccgtccgcccgctacgccgccgccatgtcggcgcaggcccagatgcgcgcgatgctggaccagttgatgggcacctcccgggacggtaagtctctgccagggccctgggggtgggggaggggacggggacggcgaagggaaggggttccgagggcgcacctgggcgcgcgcgtgtggctgagtaaggggctcccagattggtaacacgaggtccccgtcccccgtcccatccaatcagggctcggcaggcgggcagggggggcggtgaccatgcggattggcgggaactgctgccaatggggtgaggcggggcctggaggcagaaaggagagtttgtgcttttaatgttgacttggctgagacgggagagcccgcgtctctgttgcgtagttggggggcccgttttgtcgctggttaggtacctgcggaaagctaaggcctccacccccgatataattccttaacccagagctttgggatcatccctcgccgccgtcctccagagtacctagagagaagcttccccctcctcttcctgggtcaggaggaaacctttattactaacccagtctcagagatgcaccctcgagccccacagaaacaaccatttttatggaaaatctgacccaaaccatggtttcttaagtgggtgtgtttggccccattttgtgagaaggaacatgttatggcctgtttttccgagagacctccattttgttagacaatttaatagaggctttgttcagtaaatattgacaaatgttgcatgtccctaacagaacgattttgaaaatttggtacccagtgaagtagaatagaggagaacaaagatcctttcaggcgtttagtttagaatctgtatagagagcccttaattgctggattatcctttgtcataaagagaatttctaaataaaatgatgaaatgctgttgcttttttggtgatgttaattagtaatgtactctcaaattcaacttaaatacattcaaatatgtaggaaaggtctagttcattactttcttaacacagcaaaatccttggtagtttttatgtgttgcttctttaggcagatagtttcttagccactaaggaaatgctttttttcttgagaagttatttaagtgtattgatttaagagaaaaggcacgtcttaaatttagtttttaagttactcttttaatttacatgagtgctttacagcaaaatatgagtaaattttaaaaattttattgcattcaaatctttcagcagtgcgtagagtggcttttcagtgttcacattttcagttttaataaaaacccatattgggaacttttatttgtagaatatatagacaaataggtgtagatggcaaacctacttgtggttgtgtagagaggaaagattgggaaggaaatgagttttgtatggaaagttaacattaacttaaaatgccactggagaaacttttaactgttatcatttctcacgtttagataagaatggttactttatcactgcagcatgtcttaacattcctccttttccaacatgagagagggtattgggaacgggtttcattggatcctagctaacagaataactaatctgtgtaataaaattaagttatttaagacgtgctttacatgatccttttaatccttgatggataccatttttgggatcttcttcatggattggatttcttagttttactgggagggtagttggatcaaggtaaaccatctcctgataagtttctgaattaggcagcccgtctagtattgcaaagctaaatttaaatatatatatttctgtgtgtgtagtcagcagaaacatggatttcttaaaatccactttgtgtatttttttatgtgtctgttactggatttttttttttaaccttcagacttagaggatttatgatcgaactcatatttacgagtccacagtattgtttagctgaaatgactggattttcactgctgtattgggttagaagtaaaaaatatactactttcaaggaaaaataattgagtggagttttttttagatatcaaaattaattctatatatgcaaaataatcagaacattcttttttttcttaccatttaatgagtttatatatatcattttatgattcaggacttttaataattaggattgttcttttttagcatacagtcaacttcaagttacccagggataggggaacatggaaacgtcccctgaataacaccatgtaatttgaaaccatttaatgggaacccttgtattggacacacaaacagcctatgggaacgctgttgggtgtctttggcactaagaggtggaaatgggtatccaggaggtgggagagagatggaaaaggtaggtaggagggtatttaaggcaactctgtccttttttttttttttttttaattccagagactataaagcagcgactctcttttttggaagtggggttcaaggtggcagtgaccccctccactcttagtgtcctgtctgtgaaggaatctgaagtggcacagagtcctggggctttgggaaaacattacctcctcaccccctcaaggtttcttccccctccccttcctgacagtttttaattagttccttttaaaattcattggagatttaagtctgttagttaaatataccttaacttgaattacataaagtagttaatcatttagattacctaaacttcactggaatccttaggagtaggaattttgttagcagggaaatggagaggtaattttggatcactgggcacttcaagaaaggacattcctgggtgagtggtggaagttgggggctttagacaatctgagggcagcatgatggtgccgggaggctgggcagggggactgccaggaggtgggagagaaatgcataagggaggtgggagggccaaagacaaactctgccttctttgcaattttgcctagggccctggtggtggcaaccgcctgtgtgccactgaaaatcgtgccgatgcctggcatactgcataaatggaagcagggtaccgcgtgagttgaaacattggtcacactatataaagtttgtatatgtgaatcagtgtaactcatacccatataactgggggtctgactgtatttggatttttctgataaggcatcatgggctaaggaaaagagcactgggctgagactcaggagacctggtttctagccccagctgtacctctaattgtaaccttgggtaagtcacttaaccttttttgcctcaagttaaatctgtaatttgttatatgggaaaccaaataatttcctatgttatactcagaaatgttgaaaaataaatatattttaagtttttttagaaaggagctataagtagatagtaattactagtttattttatcttgtttatgattcattacgttttataaatatctttctgttttagttgttagcagaggggagagggataatttgttttccctgaacatattcattctatttgaaagcagggaggagttgcacaggaaaatccaagaaacagtttgagaattgtctgtgtgacagttggaagaacccagtaccctcacacagactgtgatttttgctcagttggattaattgcaaggatgttccttagctaaagcccctttgccaacaaacacagtttggtcataagtctctagtcttgatcccaggaaagtctgggaagatgcaagcaataagaattaaataaaattgagggtgtggatttagattacatcctttttttttttttttttttttttttttgagacagggtctctgttgcccaggctggagtgcagtggcacgatctcggctcactgctacaacctccacctcctgggttcgagtgattctcctgcctcagcctcccgagtagctgggattacaggtggctgccactacgtctggctaatttttgtatttttagtagagatggggtttctccatgttggccaggatggtctcgaactcctgacctcgggtgatccaccatgcccagcctagattacattttaagcttagaaattaggtaagttatagaaggtagttctgagggttctgtatctcttaattgcttatacctttaaatgggagcagagaccaccttcgaaagattaaaataggcaggaatggcagcctgccctccaaaacaacaagtagactaggaatgttagatagaattttatagcatcattaattgtcccttatggttagggactgtttcgggcaagttaaaactttcaataattttaactattttaaatgttaatctttctaaattgtaggatatacttcctcagttaacatattaatcataatatttttgctgatcagttgtacagtagttatagtttgtgggatataaaactgaaaggatactcatcctcatacccaggaaaatactgttaagaaagccatttacttgttgctaatgtaaggttagtagtacataaccgtgtaatctgtaagatagtatgacatttctgcctttctgcaaaattactgaatcaaagtttgaagtagtgcgttctttaatggattttatttataaaatcatctttactgtaatctgtgttccttgacttttcatcaacattgaaaacattttctcttaattttttctcattaacataatgaaccatattcatttcttggtcagttgtgagccattcttttattccacttggattgttcattttaagtgaaggaggcggagcctttaatgtatacgcagacattttttaaataataacaggatatttcttagtctagagcttgtaaattctttaatataaggagttttataggattaaacagtagtttctctgcgtttcagttaactatttaactttatcagagtttcaggcatatccaaaacactgaaagcacctgcatagtgaatcaatgaaaaaagaaaagttttcctcattttgcattttgaactctgaataatatttctatctacacagcagcccagaaaacaataaaagtatcacttcatataacattgcatcgttcctggattctctacagttgtttagttctcctcaagtaagcatatgcttctgagacattcttttacttcaggtaaatataagcaaaacaaagaaaaatcattttgtctatttctgcatcagttctataaggagcaagtaaattcttttattttcgtttaggttggatgttgtcatataaggatagatggtagtgttcaacgtgttcaagatgggtagtaggaattcaatggccatgaggtgtcatggatcaaggtcaggtttagtgaatcaggtactcttcagtaacaggtggttcatacaaagcattgaagcttaaagttgctgtgagttcagcaagcaggagggttgagaagacaggcagatggtttaaaactaaaggtcaataagtgggcaagactagttaaatgaggcagatactccccaaagatggaattccagaaaggtgcttgaaaaggactgaattcttaaagcctactgctgttagtatgtagagttcttgaggaaacaagcagtttggcataacttaatctactaagaaactataagaaggtgaaggaagttggaacatcttactggaaaaagaatgagggagtgaagagggaatcttgtgaattcaaaacttgcagaaaagctattctgtttcctttttgtttaggttctcatgcactagcagctgctagaatagatattggaaggcagggccaaaataggtcagttgttcagttttgcaagattattgaggatatagagaaattaatttgtgaaaactctgaaatcatctgcagctccatgtttttgtttgaactgaataacttaggactttgagaagtcaaagccgtcagaaagtaacatgaagtccattcagctgaataaatgtcatattttgctattagcatagaaaagaatctttaaaacttctttccaaaaagcactcagtattgacccatatgttccagtatagttgtgaaccatgtacaactgatgtttgacttatttgactcaacatgaaaggaatttaaccagctgcccttgctgaatcttgtctcctgaatatggtaaatggtttttgtttttaatcttaataccttagatttctgcagaccccagttttctcttttagagttaactgataattattggatagtatctataatatacctggctgttctgttctgtactgtgctctagtattagtttaaatggtagacttttctcttaaagtaactttaatagtttaatagttaaagttacttgaaggtatgttttagatcagggactggcactatggcctcctgcttttggtaaataaagttttattggaacacatccatgccgattcatatacatgatgtctatggctgctttggcttacgacagcagagctgaatggttgcaacagagtcatatggcccgcaaaccgaaaacatttaccatttgactctaacaaaagcttgttgatcaccattctggtttagttattctaaaccaagtgtggtccttggagcagcaattcagcatcacctcagcatcacgtcgtattgttagaaatataaattcttggacccacctactgagtcagaaattctggatatgggccccagcaatccatgtttttagaaaccttccaggtgattctgatacacattaaaagtttgagaaaccctcttctagatcagtgtttcccaaatgtttgtcacacttattgcctttattattatttatttttattttttattttttggagacagagtctctgtctcccaggcgtgaaatgcagtggcctgatcttggctcactgcaacctccgcctctcgagttcaggcgattaccctagcttcccgagtggctgagatgacaggcatgcactgtcatgccctgctaatttttgtatttttagtagagatgaggttttgccatgttggccaggctggtctcaaactcctgacctcaagtgatctacctgccttggcctcccaaagtgctggtattacaggcgtgaaccaccatgcctggccttgcctttattattatttactgttttctgtttatttaatattttcctttatgtcaactcactttctaaaaattttaagttaattttaaaatgaaagtttataccaccataaaaataaatacaatgaaaacaaaatggtgtattatgtaactagactcttgtcacttagggttcctgtgctaaaaattagaagttgttaaatttattaaacaagtactgttgcaaaatgggaactttttttcttgacttaattgtgattaataatttccttactgagtggtatttaaaatgtcttgttggcaaaatcatgtaacacctaaagtcatcttttgtgcaaatctcatactttggaaattactgttccagggagtattcatgtgaaaggaaagctgtttgaactatatatatacctaagcctgtaagcagaaatgactggacagaaatacaagcctgtgagacagagagatctaggagatccctagagaggtccatcaagacctccaggatgaaattacctcatttagctcaatttctcacctctccgttagtgctttggtccacgggggtcagtgtttctgcaggatttcaccaactggttccacagtgggaatgtgaagaggtacctggctgtgggaaaagctgcttatcaaagagaggcctgatagaaatgctagggaaagtggctgtgagcctgcattatggacgggagcagagcggcagggcatgttgctaggactaagcagtcgattcacgtgagtctggacaccatgtataaatattttgaaaacttcctgttacaatttaatttactccattgtgttagagggagtgcttccctgcacatggtgttctgtatatttattggttgatgtgctttagggtatagtaattatttatagcaatagattgatacccaggttgcagagttgctttagttatatctttatttccttttcttagagattatagacataatttgcttctgtcatcttttgaccaaaaatctaatgggaatgaagaattacacttgaatgtttatttttaagtaataagttctgtgatagtgattataggtgtctgcatttaaaaaaatgttttaaaaagtacagaggtcaaacaagcatctgtatgattgaacaaatgttatttcgtatatttctgtcaaattttaaaaaatggataaagaggccgggcactgtggctcacgcctgtaatcccagcactttgggaggccaaggtgggtggatcacctgaggtcaggagttcaagaccagcctggccaacatggtgaaacctgtctctactaaaaatataaaaattagccagatgtggtggtgggtgcctgtaatcccagccacccgggaggctgaggttggagaattgtttgaacccaggagacggaggttgctgtgagcccacatggtgccaatgcactccagcctgggcgacagagtgagacaccgtctcaaaaaaaaaaaaaaagtaaaaagtgcataaagcattacaaataaagtcttttgtggtccccttcaccgtctcagtcctttccccagaggcaaccctttttgtaaatttgttgcatattcactgtgaggcagtatttctgctgtgttgtttagttttaaggctcacgtctccttcatggtgatctgtttttcattttaacttcttcctttatcattgggttgtctatcacctctgtcccttgatattttcatctttttttttcttttttatttcttttcctttggatttggggaggctctagttggcttctgtagctatcaccagctgatgagaacttgtcttttttaatagataaatcagccagttactttttctttgattattttcagctattgcttgatagccaaagatagctttcgttacttctaattttgtatatagaaagttctggatgatagaaggcaccggctatccagagtgcaattgttactatgtcagaattacagctctgcaagtaagtatcaaaatataaaatttagcaggctgtaactttttatgccatatatcttaaaataaattctatataacctattttaggacttaatgttaaagtaactattcaggcttttctgatgtctcttgtaaatttaagaagaggaataggctgatagatttcctaaagcacataccccccaaaacatgatagcattggtccctgccagctaccaagaccctttgcttgtattaatataatgagagaagataggtgcagggcatggaatagagccttggaatggagattctttagtattcctgttctcacattttcatcatcaccattctggttagcttcaaaagatcctacaaggtttttcttctactaacaaggctgttccccagtttcattcttataatcttgtgatatggattttcacagacaagtgggccagatttttaacattttaaaaacattaatctttgatcatatccagcaagaatgaacttgttctggagatttcttctacagtgggcatcacattttaaaaatgtttggcttgtcatggggattatggtggggggtgatactggtacctatttctgattataaacttatgggaccatatgaaccagaagattaagaaggatagcttttctgagctgtatagcacccttgtgtttacattttctggaggaaaggaaagctgctttgttttattaggaacgacttgatgtcacatttggaaggcagactgtcataattgttttttcccgttgccatctttggcatagtactctttcttccctttccttatgtaataaatatatgcctggaaagttttacatagatcaagacatattaaatgttttcaaagcatctgtattattatgttaagacatggtgatgagtccttttgtaaaatgaaccctatactttggatggtttaaatatacagtgggttaaactgagtgtatatattaacaggggaacatgtagcaagggagtaatgtttttttaaaaggttaattacaaaaggatttgtataggtggattttaagctgaattctaaaggaacaacaaaggtaggtgggagaagttggtagagtgggtgagaaagtttgaggaagatgtaaaaatgatcagattggctccttagtataagagttactgtgcagcagtaatcatcgcttttactttgattccacatgaagacacaagggttttttgtttgtttggtttgagacagagtcttgctctgtgagccaggctggagtgcagtggtgctatctcagctcactgcaacctccaactcccaggttcaagcgattctcccaccccagcctctgtagctgatattacagacctgtgccactacacccagctaatttttatatttttagtagtgatggggtttcaccatgttagccaggctggccttgaactcctgaccgcaggtgatctgcctgccttgcccacccaaagtgctgggattacaggcatgagccactgtgcccagtgacacaaggttttacttgtgcactgctttagatctcttcctgccctggactagactagaaattggccatggatctttatacagttcccacattattacgtgaactcagcagcttatgttggaagaaatggagggaaaaagagggaggaacgtttctctgcatttagggattcaaggggtcaggaaaacaagctttaagcttttggttgtacacctctctagctctagctttcctttcactgaggggttatggatcttatttcagagggaaggaaactgtcctgtcccaagcccactgtgacacgtgacccttaactagtatacctgtggggagggcttcagttgccaccctagagaatgtgggagggcttcccttcccctgcccccatttgtagacatgggagtgtctccattgctttgtatgctgttgcattctcctccctccttgttttccctaagctaagctctaagctaattctgtacaaaatactgattgtttttgtaaattgcttgccatgaatgcctgataatgtacagtgaaataggattctgcataccattaaatatgtcaaatattacaaactttaaggttcttttgaaattacaatactaaactcagttcacttttgcttagccttcacagttgttgatcacatagcatggtcatccactcacagcttaaaaaaatacagggagcatcggagagaatgggtaaagtaaaattttgatgtttttaaaatagcacctaaatctatgaaagttgatttggtttcttgtttgtatgggagggagagggtgggtagtactggggggagggggcggatattgggaagatagcatgcaaagtataaaatcatgtcagatactacctaggctaaggttgtaatgttactaataaaatttaagtgttaatataagtttcagaaaaggcaggaccatagaatggcagtgttgggaatgacagtgggcttattttttccctcctgatatatggaaggggattttgagaatagcagtatttgagtaaaatttagagaggaggcctctttttaaagtgacctgtctatattccctggtggaactgactgccttaggctctgatacattggtgacagacctggagatgaataatatgcatcctcatttttattgtatacttgtgactcaggtgttctcaaaggttataattcatgaaactcatgaaggtgttgaacaaaagagggaggaaagagagttgttgcttggtagagaatttggtagaaataggaattaatagaaaagttgatgtttctattaaaatgaaaaacacctcacttgctagagttctaaatcaagtttctaattctaaaaacttggctgtgtagttaagtacaaggcctgaataactattgtagaggttataggacagagagatctccatgtttttataggtgggatattttttgttgttgacagaagtaacttcgcctgatctctgttccattattttaattttttttttttactttatacactaaaaatttggattaaaaaatgaaaaatgtaagaaatcaaatgttactcaaaaagtattgttttgctcccaactctgcaattctacatgaagccatttgccaaagccagatatggtttacttactgttcccccaaaccttcttgctcttataagctttgtcaaagctattactccaggttgtagtgcttttttttctactttactttgatctaagtcctgtctttccttcaaattttggctacttattgcatgaagctttttccaatatttccattcttggtggtaattttagtctaagaattcctgaagtactacctaattgaaacacacatttgatacttggatcatgttatcttgtattataacttattactccattaatatatcctcggccgggtgcagtggctcctgcctataatcccagcatgttgggaggccgaggtgggagggtcatttgaggccaggagttggagatcagccttggcaacatagtgagaccctgtctctacaaaaaaatttaaaaaattaaaaaaattaatatgtcctatttctttagcaaaatcattggctccttgaggggagagagcttgtcttatatgcccctttgtaattccattgcctagcacagcagatgttgtcactaataggtttgattctgtgatttggatccaatgtcattgtgacaggatactttttcccccataataggttatttttatatgactttatgcccacaaaacccaaagataaaacacattaaattgaaaataatttcttgtattataaggtgatttggttcctatttgcagttctttcttctttttataaaataggtgctgttttacctagtttcttatgaaaaacatggtttgggccagatatcttgacagaaaccaaattaccagcatttttcttttaaaaattattgttggtttagctgaattgtactgccatggaataagcccaaataaatttgttaagtactgcatggttatgcagccagattgttttaaaatgtaaaccttaaagtccccaaggcagaactttaaaaatatcaataaacagtcagttgctattctctctcaaggtatttctgtatctcaaattattaagcgttttattatttcattgttttaaagatttctataatggctgctatttgatagctgtatttgttgagtttgctacg

SEQ ID NO: 128064 - DNA, 3061 bp, Homo sapiens
gaaacagattctgatcttaaaagctcaccagggaaaatatgtacaactattatgtatccataaaaattttaaaaaacacaaaaaagctcaccagggatactgcctggtttgctatattcctattaggaatttgttcatattttaactgatagctgtgtcttcagggcacaataacttaatatttgaatataagttgttaagcacaaatcagttactctgcctgatgaaatgtttgattagtaaaactccatgaatactgattttattctaaggcctgagccattagtttaacaaagcactgaaatgattctgctgttgccattaccaaaacatttagatacttttagcaggaagacttattagatacataagggatttttttgttttgttttgtttttgtttcaactttaaaattttatcattttaaaattgcttaatataattagggtacagatttaaaatgaaatttttttcttaaatggtaggaagcaaaaagcttctaattaaatagcattgacattctgatatgagtttatcatagcaccattctaacatgagcttgaggtcctcaccaaagtcttgatgaaacatactttttaaagaaataattttttaaaaccccacttggctcaaagacattgtccagagctccagctttggacttttacctgtagtcagtcatacaattatctggggttatacttgttaagtcagtatttaaaaaaatgaaacaccctgattttgttcacttttgtttttatataaaagaatctttacagtcaacatgtacttctagatgctgtattgaaattgctggcagagtttattctatacaaaatgaacaatctggccccttgttttatttgtaaaggttcaatgtatctatgcctgcctacctcaatctgcaagggagtgtcagaaaggccccgcattcgccaagccgtgagttatcgctaacttttcagatgtgttaatgaatgtggaacaaaagcagttgtgtttaaaaggaaaaaggaccatcaaaataacttttattatagtagcaggcgtaaacactaaactgaatattccaaattgtgtcaaaaataacctactagagacgagcttctagaaaacctattgttgaactgctctgaagctatcattttaactataaattactgttgttaaaattttatataccctggttgcaaattagaatgttttaaaaatatctttaaccacgttaaaacaatttgaacaaaatcttaccccatctaaaaatgatagtgtttagttgaatttaagttaagctctttagtatatgaccatatgaaggggtaaagttttaatcttttttgttatttacatgtgaaaatacagaaactaagtgattgaatcacatcctacacgaaagtttttggagtgctccaggcatatcatgtgaaatacagaggtatttatatctcttttggcaccaatagttcttgcttcagtaattcaccagtaggttttcattcatcgataatatatcagtttaaggctaaaataaaacacctacatttcttagggcttatcattctatatagaaagaggaaacatcctaatgagttttttcttttgtttttccaaagagattctaagcaaaaaaattttaactaacatctatattttgttattggagctagttacctttctttttcttagattctttaacgttttgagtagatagccatatttgataagcaggttggatgcttctgttgcttaggaggtaggtgtattgtgttatatgaagacagaatgaatttaaatatacccagtttggcagtatgaaaaagctcagactacataaaacttggaggtatggaacctttggacgcattaaagttaacgtttcattaggcaatgtgcctttgtttgactggtgtgtaagtccttcttccaggtttgtacgctcttaaacgcgttattctaccctctctaactcctcccagcagcaaaagggagacacttcagctggaacaaaatagtggaagaaatggcgtctggggttcagtggggattcgcagtgtgtatgcaatgtttgcaagattattttttatgtttttcaattactgtaaataaaaatatatcaatgcttagtgtcaagaagggaacattgtataccagtataaactctcttagtgggtctgcaagttgcttaacctctcggggcctcagttttctcatctgcaatatgaaggagttggactcgataatctttaaagtccattcctgctctaaaatcctatgcttttctgaagtactctatttaacagaatgcattgctttctcactttgactatttgaattatgtatgcagtacacttactgcaactgcatgttgtctaaaatagtttttctataggatgtatataaaaactaatccctcttgagctgatttataatgtgtgtatatagccacacataaaaagctagtaatagtagggctctcagaaaatactttccagttgtctaaccttgaatgttattaactcttctatattacaggagatacaactcgtcaacgaatcaaattcagtgatgacagagtatgcaagagtcaccttctcaactgttgtcctcatgatgtcctttctggaactgtatgtatttactaaatgtattgttagattactgatatgctgcagtaatgaactacttgataaagtcttaattctgtgtcaaaagaattgacttgtgaggggagatttgcatcctttattgtttgtttattcaggatgattacttaaatcttcagtaatgggtttcctcacaaaagtggttgatacgttttgttttataattttttccattcttcagagcagttttttaaaagcatgttttatttggaatacagaagtagttatatagcatttgtacttttagttcagaaataaaataatttatttttaaagttccttttactgttaaacagagtagacttttatctagtacggtatacatttttgttaagatttgtacacatttgtggaatcagtggggaaatatattagtaaatacttatatccacacagct

SEQ ID NO: 128065 - DNA, 1001 bp, Homo sapiens
tggtataatcgtagccagtgcagtcttgaactccagggttcaagtgatcctcctgcctcagcctcccaagtagcaaggactgcaggctcatgccaccattcccagctaattttaaaatttctgtagagagagactctcgccatgctgtccaggctcttctcaaactcctggcctcaagggatcctcacacctgggcctctcaaacatgctgggatatggaggtgaacaactgtacccagctgtaagatgactcttgaaattaaagaaagtagtaaaaaccagttattcccaaacaaagtaggaggtctggaagtcattgaagcagattgtttttcatagtctagtactggttaatatatttcagtgtcatattgatttctttgtacaatgagtctcaataaatgctttttccctaaggatcaggaattattctcttagtatttcctggaccctccagatgttttttagagataagtagttttatcaactgtattttaacacttctaaggaaacaagtgtgttctccgcaactatttgttgaaaaagggaatatggagttataaatacatcatttggaggatgtaattcattgaacacaatagtaagaaatgaaaacttgaaaacaataatttttttttttgagaccagagtcttgatgtgtctcccaggctggagtgcaatggcacaatcttggctcactgcagcctccacctcccaagttccagtgattctcatgcctcagccttccaagtagctgggattacaggcacccaccaccacgcctggctaatttttgtatttttagtagagatggggtttcaccatgttggctaagctggtcttaactcctggcctcacgtaatccacctgccttgacctctcaaagtgctgggattacaggcctgagccactgtgcccagcctaaaaatattctttatacaggcgattaaccacaaacatcaagcacatttacaaagaattacaaaatctctgtcactgga

SEQ ID NO: 128066 - DNA, 1181 bp, Homo sapiens
tgagccaccatgcctggccaccagtctggtttttgaggactccatctttatttgaaaaataggatgttcttcaaagcacattgacatctcaacaatttgatgtatatattcttttagtttggtttaaaattaacttgatcttttttgtgttgtggagctaaatgaactatgttgtgatatagaagctagcttttttcagattctgaaaagcttttccatatccatttattcttaaatacaagtgatccctgttcccatctgttggtagacaaaattggtgccatttttttcttctgacaccacgttttatatttgtctatgaaattttgtaatttggaagcccctacataaaaaagcatctgtatgacttaatatgtattctgacaagaactgtggttgttgaagcattttttaaaaaacttttttttgttttaatattatgtcttttttcccttccagagaatggatcttggagaatgtctgaaagtccatgacctggctttaagagcggattatgaaattgcatccaaagaacaagattttttctttgaacttgatgtatgtgattttgctttaatggtttgttgttatcttttgctgtaaaacattgtgaatgtggattaagatctcttaataggaaaaactcttagcagtttatcctctggttatatgaagggtaagactcaagtaagatcatgtactttcttgacaactcttttaaaaatatgaggtgagactgtattttaagaaaatgtgtaacagtcgtatgattcatatattcttttggaaattaagcatattcttcccaacaaaatagtaatgattaaggaaatatcaagcaaatgtaagcaactaatttatagtgtatataaggacctatctttagtaatatactgagtttttacattcatatttatttttgaatctacttatatatatatatacatgtatatatagttggccccccatatctgtcgttgaatctgtagaaggaaccaactgggattgtaaatatttagcagaagaaatggattgttgcatccgtactgaacatgtacagacattttgttcttgttattattccccaaacattacagtataactgtttacatagcatttacattgtattaggtattataagtaatctggagacattttaaagtatatgggaggatgtgtac

SEQ ID NO: 128067 - DNA, 1030 bp, Homo sapiens
ctcaaactcctaacttcaggtgatctacctgcttcggcctcccaaagtgctggaattataggcgtgacccaccacgcccagcttcttttttttttttttttaatgacagggtctcgctgtgtcacccagactggagtgcagtggcatcatcagggctcactgcagcctcagcctctttgggcccaagtgttccttccgcctcagcctcccgagaagctgagactacaggtgtgccccacccacctggctaaatttggattttaagtagaggcagagtttcgccaagttggccaggctggcctcaagtgatctgtctgccttagcctcctaaagtgctcaattactgacgtgagccaccgtgccccaccatggtagcattttaaaaagcaaagtgtgatttttgtatgaagatatttctgaataaaattgactttctgacagtaattgtctttaattaaactttgtaggccatggatcatctgcagtcattcattgcagattgtgatcgtagaacagaagtggccaagaaaagattagcagaaactcaagaagagattagtgctgaagtagcagcaaaggtaagaattttaatcatttcattagtacaaagtattatttcgactccttttgtttaagtttttattttgaaataattagatttgcaagagattgcaaagacatatacaaggaattctgtatactttcttgtctgccccagtgtaaacatcttatacaatatagtgcaatatcaaataaattgacattggtctaatccttatattttattcagattttgccagttatgcatgcatttatttgtgtatgcatgtctgtatgtatagctctgtgcagtttttttgtttttctttttgtttgagacagagttttgctgtgttgcccaggctggaatgcagtggtgtaatcttggcttgctgcaatctctgccttctgggctcaagtctcgtgcctcagccttctgagtaactgggattacaggtgtgcgtcaccaggcccagctaattttttttat

SEQ ID NO: 128068 - DNA, 1062 bp, Homo sapiens
taagggatcccatcccagaaagaagagtatatgcaaagtaacagaggtagaaaacaacagggtaagtttggggaaactataaattatgttgtgaggtgggggagtagcaagagatggtttagaaaagtacaaagggccagatcatggaagaaatcgtattttacactaggaatacaccacctcgccagaggatagaaagttatattgggcccagtagtagccctgacttcattgaggtaaggcaggcaggctcagaacatcctgatgtctcagtagttcatttgggatacgctcagaaagcattctttaaccacatactgccttagataacaagttttttctcagcagttctgaaatactttgaaatttaaaattcattctcttgtttattcatgatcttcttttttatttctttttaggcagaacgtgttcatgagttaaatgaagaaattggtaaattgttagccaaggtggaacaactaggagctgaagggaatgtggaggaatcccagaaagtaatggatgaagtagagaaagcacgggcaaagaaaagagaagcagaggtaaattcttaatagtagtagacgaattctgcttaatttggtaagactacaaataaaaagtagtagatgaaacttcagtatctatacttctctaagaacatgtatttgaatggaaattattgaacagttgttaaagagaagttgaactaaaagacaaaaacaaaacaaaactcggaaaaagctggttgtggtggtgcgtgcctttggtcccagctattttgcaggctaaggtggatcgcttgagtccagttcaagtccagccttcttctttttgtttttttgagatggagttttgctcttcttgctcaggcaggagtgcaatggcatgatctcagctcaccgcaacctctgcctcccgggttcaagcgattctcctgcctcagcctcccaagtagctgggattacaggcccatgccaccacacctggctaatatttatatttttagtagagacagggtttctccatgttggtcaggctggtcttgaacacccaacctca

SEQ ID NO: 128069 - DNA, 13256 bp, Homo sapiens
aagaaccagtcttctgattttattgtttttttcttgttttctatttcattgatttctgttcatgtttattatttccttatactccagtggagagaggcgctaaggatagaggatggggataaagggaacctataattttcataacaaaatagccatgcttttgtggtttttttttttttttttttttgagctggagtctcgccccagtgagccaccgtgcccagccacttttgtgtattttttagaaaacacttttggtataagcatagtatattttatttaattgtatgacttttagtgagatttatatggtcattgtttttctcacttttgtttaggaagtttatcggaattctatgccagcttccagttttcagcagcagaaacttcgagtctgtgaagtctgctctgcctatttaggacttcatgataatgacagacgactggctgatcattttgggggtaaactgcacctgggatttattgaaataagagagaagcttgaagaattaaaggtacattggtaaaatattcctcactttatcctcttgttcttttgatctgtatcagttgcctttttgtacaatattcttgactatgattcagtaatatagtatctaatgattaatactaaacagtgtaggattatagatggaaattcaagttggtttaatggatgctgcctgagaaacagacttaatattatcctgttattttgggagttaccattttatattagatatgacaccgagttagggatctttcaaactagttactaaaagagtcccataaaacttcattgttattgttcttttcaataaggtcaataagaatgtaataatataatatttataagaagtttgagaaaatgaacccaatattaatttgaaatattttgcaattctttattaaatagcaagcttgcagaatctctagttttattttatgctcctgcttccacttcagaaaggacttatgaaaaaatttatatttttttaaaaggacaatcactattacttaaataatataggcttttgtggggaagacaacacagtttttactcttgttgtttagaggggataaacacaaaaaagcatggtgatatttctgaagtggtaaagatgagtgttggtggatataatctatttaccttttaatatgctgatagctttttaagaattgtggcactgtagtgttttttcatgaattgaggtctggctgacagataggaaacatgggatagtcattttctttgtaactgttattgtcaactggaattaactcaaggtccatagcatttaaaataatatagaatcagaaaatgcctagggacatctccatattctcaggtaacagtgggctcttttcagtattctgagtagctagggtgatctcaagtaattttttaaaaatttcgaaaagagtcactatagcaaatagttactaggctccaagttaaaactccagtggttcctacttgggagtctttgcagatagacctagcaacagaactcaagcattttactcatatctttaaaaagcagcagcatcaggatggtaattggaagtgacctaaatatttccatattagaaatcacagggcatgggaacttgtgatttataatggttgatgtttttttaaaaaatacaaaataatactagaaaacatttagaggaggaaaatcttgtagaagtgacttggaaatgtcattaagaaatcatgaaaggctaggcgcagtggctcacgcctgtaatcctagcactttgggaggccaaggcgggcggatcacaaggtcaggagttcgagaccagtctggccaatatggtgaaatcctgtctctactaaaaatataaaaattagctgggtgtggtggcatgtgcctgtagtcccagctactctggagactgaggcaggagaatcacttgaacccgggaggtggaggttgcagtgagctgagattgtgccactgcactccaacctgggcgacagagcgagactctgtctcaaaaaaaaaaaaaaaaagtcatggagctgggtatggtggcttatgcctgtaatcccagcactttgggatgccaaggtggccagatcacttgaggccaggagttggagaccagcctgggcaacatggtgaaaccccatctccactaaaaaatattaatagaaaaattagctgggtgtggtgatgcacgcctgtaatcccagctcctcaggtggctgaggctggcaggtggaggttgcagtgagccgagatggtgctactgcactccagtctgggcaacagagtaagactgtctctaaaaaaaaaataataagatcataggccagtctcagtggctcgcacctgttaattccaacactttgggaggctgaggtgggaggatcactggagcccaggagttgtagacccatctgggcaacatagcgagattctgtctctattttaaaataatttgttttcacttaaaaaaaaaaacaaaaaaaaaaaccaagtagaaatcatggagaaaggtgaaattttacacattttccacaaaatggggaaagattatggaaagaagacttgtaggcctaatgattatttctggcagtacttcaaattgaattattaaacagattttgacagcagttgtactgtattagaaaccagataatataaagtttaggataaagctgtttaagaatggactcagtaaatattctcctcatttattactgtttttaagagagtcgtagctgagaagcaggagaaaagaaaccaggaacggctgaaacgaagagaagagagagagagagaagaaagggagaagctgaggaggtatggagtaatgggccaagtaattgaagttgaatctctgtggttctaaaaagagatataattgattttaaattttagatggtgataaatctgttatgggacgtgggaaacttctgcttactttaaaaaatattactgtgcgaattatataaatgtttaattatacaagtatcgtaactcttggccatttaacggaatgtgatttcctttaaaatgtgtggaagagtgaataaagaatgcttcgtatcttgtaagatttataacaaaatccagccgggcatggtggctcacgcctgtaattccagcactttgggaggccgaggcgggtggatcacgaggtcaggagatcgagaccatcctggctaacacggtgaaaccccgactctactaaaaatacaaaaaattagctgggcgaggtggcgggcgcctgtagtcccagctgcgcgggaggctgaggcaggagaatggcgtgaacctgggggggcagagcctgcagtgagctgagatcgggccactgcactccagcctgggcgacagcgagactctgtctcaaaaaaaaaaaaagatttataacaaaatccttttctagccctttgatttttcatattgggctagatttgcaccaggttagcatagaattattattttttttttatgatgtattttgttaacaaaaggtttaagggtggttgtttcattgaagggttttttttacattgaactttggttagttcctcaattctaggagccataaactattaaaaagtctaaaaatatctaaatgtatataattcctcttacattggtattcattaattgataaaatcttagaattctagtatttggaatgtctaaacattcttctgagtcacttttaccattggcagctaaaatcacatagcatcatggtggcaacatttttttgtaactcatctttttaacttcagcagctttaggatggacagttatatcacaaatgatttgcctgtagtcctaatttatagtgttccttgaatcatactacatttaaatgtcttaaatttaaataccttctctttagagttagcagatgtgcttaagctaattaaaaccctttgtagtattaggttatgctcacttccttcgatctttgagcatattatatactcagtatatttcaagaagtttaaacagacttcgtttgtgtcacatggcttataaccaggtaatctttttgcaccataaagacagtgaaacaaaactacatgtctatatggtccctttttaggagaagtgatgtcagtcctctattgagagagagagatttcttcatttactgtaaagtttacctcagagcttttatctacttgttcttttgtgtatagtaagtccttatgggaatattgcccagtattctaatatataagtggaattttcagtaatattgggaatctcattttaagattcaattgaggtgacagtaacatggaacagaatttctttgcaggactacattttcacatttgtagatgatgaaaaagtatatcacatcttactcctttgtttgccaaatggcaagtttcttttgacagtgattatataatgcaaatttcagaaacattaaaaaaaagtcgttgaatctgtgagcttaaagaaatatggaagtatggaagatgaggaaattagaaactagtataaaattatataagatgggataaaagaaaaaaatcataatcatttactgggtgcttattgtatgccagacactgtagtaaggaatttatccatattcatctaatctttataaaccccacccccactccaccccagtaaaatttatattagtatccctcttttgctagtgacagagtaagctgagagaggatatgtaacttacttaggtcacacagacagtgaatggtagaaccagaaataaaactcaaatctggctgatctcaaagtcatgctttcaacaatgctatatatcatccaaaaaaaaataataatccctgtggtgtcctactagccataatattcactttacatttcattgagcgttacctgtgtgctaggaaatgtgacaagtgccttaagtagagtatctcatttcatttgaagaaacacattgtaagattgaactaggtgttctagagattatagtatgaggttgtagctccaagagtatgtagatctcagaccatagaaatttcactcttttcccagaagggaaaaaagaaatgacagatataaaagaattttttccaagctggtaagtggtttctggaaaattagcaagttgtgatatgtaggttgagcatcccaaatccaaaaaatgaaatccagtgagcttcaaaatctgaaacttcttgagtgctggcagcatttaaaggagatgcttattagggcatttcagattttggtttctggatttagggatgctgaaccagtaaattataatgcagacacttcaaattttgaaaaaaatcggccacctgtaatcccagcacttcggaaggccaaggtggttggatcatttgcatccaggagttcaagaccaccctaggcaacaaaaaatgtaaaaattaaaaaaaaaaaaaacaaaaacaaaaaacagaaaaaatccgaaacacttatgatccttagcgtttcggagaaggagtactcaacctgtactgtgttttaatctcctaggaacatattctttaagagccaggtattcttgagttaagcaaaccctgcaaggtgaagaaatctgtcgagtttgtggtgtcttttggaaaattttgtgtgcgtaggtacacgccttgtatttataaaattaatgtaaacattagaaatcaggaagaatataatgtaacactgcactgttttcttatttatagccacttttctaaaaatacatattttttttttttaggtcccgatcacacagcaagaatccaaaaaggtaggtgtattacataagacaggtataagtagtgaagttgtctttttcaaaggtagtttttatagattgattaaatggtcctttaaaaattttcttttttggctgggcacggtgatgcatgcttgtaatcccagctactcaagaggctgaggcagaattgcttgaagccgggaggcagaggttgcagtgagccaagatagcaccactgcactccagcctgggcaacagaataggactctgtctttaaaaaaaaaaaaaaaaaaaaaaagaaaattttttttgaaatcatttagatgctcagagtagatacgtaaaaggattaattttttaaaaatcaatttgggtggtacatttaggaaacatgttctaagaggttgtagctgttgaaaacattagtaggttaatagttggataaaattttgattgatccactgtgggttaagcaaaaccaaaatgtttagtataccctccagtcttgactttatgtgagtttattacccattcctttatacagtgatcacagaaggctttcagagaggcatttgcagccttaaaagagcaagacaatactttgttttgactttcagcgttaatatttggggtttgaaacctttctttgtagtttttgctagttgctgatacatttttttgtctgagaaaggcagggaaatgtgttgtacttcatcattctttctcagttcttcacttgcccttctcattccagtcgttgagctttcttcatggatccattcccacctagaatgccctttctcagtcttttccaaattctaccattcctcttgttcagatcacatcttcttttagaaactttctgagttctcagctctagagactatttcccaagaagttttccctaaaaagtagagaatttgttgttatgaaagaaaaacctggctgagcgcagtgcctcacgcttataccatcacagctctttgggaggccgaggcagccagatcacctgaagtcaggagttcgagaccagcctggccaacatggcgaaactccatctctactaaaaacacaaaaattagccgggtgtggtggcaggtgcctgtaatcccagctacttgagaggctgaggcaggagaatcacttgaacccaggaggtggaggttacagtaagccgagattgtgccactgcattccagcttgggtgacagagtaagactgtctcaaaaaaagaaaaacaaaaaccttacagttctgttagcaacatctatcaatgatatttctgcctaaaacactaaaaaaactaaagaacattaataagtggggccagttgtgtcagctaatttatattattggtgaatttctctgatctagcatgataagtagaaacattaaactgtgatactgttattgtttactgtttgattaatataagctggtccctttgttgaaaacataaagtattgcacatagaacatctttagatatttgggccagaaatttaatttctattcctctagtcctgttacctagataatatgtttgccttgtaactgggctccttagttctctgtgcttgcccaccccccttcttcacctcattctatttttcacacgtcagccaggatgagcctttaaataaatgaaatacatcacatcagccctctgattctccaaaggtttttcatctcattcatatgagaagttaacatctttaccaaagcttttacatagggtgacggtgtggcctggggtgtccaatcttttggcttacctgggccacacatcagatacactaatgataactgatgagctggaaaaaaaattgcaaagaaatctcataatattttaagaaagtttacaaatttgtgttgggctgtattcaaagccatcctgggcagcatgcggcttggaggccgcaggttggacaagcttggcatagcccaaactgccctgggatagttctggtttatgtcttttatcccagaatatgtattaatagcttctcattacattcagtaacttattcagagccttctagtttgaatgataaagtacctggtcatcctgcctgtaagaccctgatattacttccttttgctcacttcattccagccacactggtcttttccttcaacatgctgagctttttcccacctcagggactttgcatctgtgttccctcagcctgaagcactcctctctgagatgactgattcacttgttccctttcttctttcagctttgcttcagtgccaacctatcagaaaagccttccctgcttattccgtataaatatttccactcttttctctttttccactctacgtaataacatcttttaatttttttttgagacggagtcttgctctgttgcccaggctggagtgcagtggcaaaatgccagctcactgcaacctccgcctcccaggttcaagtgattcttctaccttaggctccctagtagctaggattataggcacgtgccaccatgccctgctaagtttttttttttttttttttttttttttttgtatttttagtagagtaggggtttcaccatgttggccaggctggtcttgaactcctgacctcaagtgatccgcctgcctcagccttccaaagtgttgggattacaggcatgagtcaccatgtccagcaatagatcttttttttttttcttaaccacctgacatatctttatttactgcctacaaacctgtatagatccctttctatagtataagcactaagtttagtgcaggaactttgttttacttgctactcaacctcccctagtatagaacagtgcaaaaatacctagtgaatattttttggatgaaaaaattacctagaatttttaaaaagatgaataaagttatacattggaagaaatggcattcataataactcaaaatgagtggttaaacgaagtatgatttgataaaacttacactgagagttttatattttttccctctgcttccttttggaattactcttttcagctgtggaaataacgctttttttttttttttttttttgagacagggtctcactctgtcctgagtagctgggaccacaggcgtgtgccaccatgtccagctaatttttaaaaatttattgtagatacggggtctccctatgttgctcaggctggtcttgaactcctcccgtttaaggattaagcagtcctcccattgtggcctccccaagtgctgggattacagacacaagctattgtgcccagccagaaatactctttttaagtgtggctaaagctacgtccatgtcatgtacctttctttgactataatgttgacataagctgaatgccttttagcatcgttcataacaatcagttgaagataaactgtatttgtaaactatctcatatgtataatatgattttgaacttgctgtatcaaattatgagcaaacctcacattcttaaagtgacttaaatttaagagttttattgaggtataaaatatatatatatatatatatatatatatatatatatatatatatatatatgatttactctgaagtcagtgattttttagcagatttaaagctgtgcaactatcaccataatccagttgagaacatttccatcattcttaaagtgactcttctaacaaagttgcattcctttgtttccccttgttttctgtcaaacgtttatgtcctctccatgccatttccaccctcaccatgcacccccacccaccccacaagttagtttgtgacctggtggaggctataaaagtgtcttaccttgtgggtttttttcttttcaaaaaatgtctttattttgccagcaccttgatcgtatattttctggtttttcagaatgtttttcgttctctatttctgtgtattcattagaaatacattttttttgcaatctgagtcaagttctcaaaaatgattttcgcaagtgttctttctcccaaactgtttgctccttgaatagagaactgtcttactgtgtttgttttgtcttgctctctattgcccaggctggaatgcagtggtgtgaacacagctccctgtagccttgacttcctgggcttgggtgatcatccttccttagcctcccaaagtgctgggattaaaggcgtgagctactacccctggcccttactctgttttgattacactgtgactagacatgcatattgtgggcattaaaaacttacttctatggttatctcacctttctaattcagacaaagagtaatttgtcctgacgtattcttcctcatctcttctcttcccttctgtccaggtctgtcaggtacatatttaatttctagaggatacaaaaatgttcaagatatttaagtgcaattaaattcataacaaatctagataatatagcccctggcatatagtagtggttcaaaagttgctttcacttgaaaaactatttctgataataaatttatacattactgattgctctctgagaattatcaatcagtgtcttgtttttgagacagaatttcactcttttgcccaggctggactgcagcgatgtgatcaccaggtcattgcagcagccttgacctccctggctcaagagattctctcacctcagcttcctgagtagctgggactacaggcatgtgcctctgtgtccagctaatttttgtatgttttatagagacagagtttcgccatgttgcctaggctggtcttgaaatcctgagctcaagcgatcctcctgcctcagactcccaaagtgttgggattacaggtgtgagccacggcgcctggctgagaattattaatgttttattttgaattctagtatgtagttattaacacaccagcaattcagtgtagatttagctgacttggaatataattgacattaagactactgaaaaaaagtttctctttaaagaaaaggctttaataaatgagaaatatagtaattacaaaggtagaaacaaaatcaaatcttgtctggtagatccaggtccagagagcatcgcagacatcgatctcgctccatgtcacgtgaacgcaagaggagaactcgatccaaatctcgggagaaacgccatcgccacaggtcccgctccagcagccgtagccgcagccgtagccaccagagaagtcggcacagttctagagataggagcagagaacgatccaagaggaggtattgatgtgtcaatcagaggatatggagctaccttaatgttttagagttgtttatgtttacttatgttacttatgtttagagttcagattattggtttgaaacttttgcatctggtaatatgtacacatttatgtgtgggtgtacaacatttttctgtgattatatgggtagttttgaaagaatatacttatgagccagagcaagaaattggaaccaatatgtgtagaggttattgcttttctctgcttagtgtgtcttggaaaaaagttctttacaggtaaataattttaaataccaatacccttagtatggatcagcaaattaggggctctgagaagtcctttcattacaagagttgtttagctttgatttattgttttctaaacttatttgagctgggatgctttttcagagcagacacattctagtatattcttgttttatctgcactatagatatgtattgttacataccttcagcttggcaaggcagactaataaggaggttccaagacttcccttggtttaatgagaacattcaaaaggtgcaggcatagggtaaggtatgtttgaggacttgaatatctattaaggatagacaaaggattataatgtggtagaagagtttagcattcatagtctgtatagatcaaactgtcaaaacttctcaggtcacatgatggcccttaaaccaggtaatttctgtgtaacgtaagccatgtttaaaattgcttttttcttgacaactattcagaagtatatgtatgataaacattttttgagtgcctagtacctactagtcttacatattctgtggattactccacataaaatctataataaaatccacagaaagctgttaaaatctttcctatttttttttgactcaactttccattccctgaaatcactcacaagctgagtttgttaataggctctcaatattttatttcttatattctggccttgtttttagtatttcttaaggtgattttaataataattaattgtatatgttttactgtactagacttagtaaaacataagaaagacgtataacatagttgaacaactttaagttgctctaagaagtttcctatgtgaggctgggtgccatggctcacgcttataatcccagcactttgggagaccgagatgggcgtatcacttgagatcaggagttcaagaccagcctggccaaccaaccccatctctactaaaatacaaacattagccgggcatggtggcacatgcctgtaatcccagctactcaggaggctgaggaaggagaattgcttgaacacaaaggtggaggttgcagtgagccaagatcgcaccactgcactccagcctgggtgacagagcgagactccagctctcaaaacaaaaaaaaacaaacaaaaaaaaaaacaaaaagtctcctatgtgagttagaacaaaggattgacatctttgacaataattagactggcataagactaccacatgttataaagtgctaaactgcatatcatagaataaatgatccgagagtttagatgaggcaaataacagagtaatcaaaaatggcttcaggtagtcggtaaaatttgaacaggtagaatcagctaggaaaaagatattccatatagagtgaatatcctaggcaaatgcagagaatgaggagggagtttgtaaaggacagagtgatttgtaggcctcttatctcacactcttgaaactgattttgggggtctaccctcagtgcagtgttcagaaataagcattttttaaaagttacctgtcttatctgcacaatgaattttcagaattatcctgctaggtgatggaaggtttagacattttcctgtgtcaaatctgcccaactgtcattgttgttgctgaactcctaaatgtctttattggtgatgggtatgggaaggatgggcgtgaagtcccctaatctgagattgtgttattttagtccctgatgcttcctgcgttgatgaagttgtataggaatttttccaccatacatgatacatgatcatatctaagatgtcagcatgttcataaagaggattatttttgtaaaactattaaaagttttgcttttctcgagcactttctcatctttgaattcaaattattctcttttaaagcatcattctttgttttatactaaaaattaccagataattgctgttaaaacctacttggtatttcatacaacatcaagttattgctacatatttgggtttaatttttcaaggtaaaagttcttattgaaagccttttatgttttgctgttctcctttccctactgtgaaatacttgtctctgatacaagtagattctttgtgacctcttcctggcaatag

SEQ ID NO: 128070 - DNA, 2244 bp, Homo sapiens
ccggtagcctgtacaaccagcaagctatggatggtttttacattctaaaaagaaaagaactgccacaaagattgcatggacctgcagtaccccagatagtcaccatctggcccctattctaagccatttaaaatttagataatacatttctttcactttttaaagctgttatctatgtattattttttatattaaaataccttttatgaattggagaaactctgtgttgtctctgagatgagagtagcctgtaagaaattattttagccttctgaccctctgctatttgtttttcacccatcttcttgttttaatgcccttatcaactatggtagtgctctgtaatttgtcagaaaactgactcctctgtcatgggtatattcgtctatatatcttcagctatcaagagcttaatatttatcctattctttaatttgggtttttgggtttcccaacatattttgctcctcaaattaatatttttcagatcctcaaaagaaagattcagagaccaagacttagcatcatgtgacagagacaggagttcaagagacagatcacctcgtgacagagatcggaaagataagaagcggtcctatgagagtgctaatggcagatcagaagacaggaggagctctgaagagcgcgaagcaggggagatctaactagctgtgtacatttcttcagtccttaagcttcctacggagttacgtactattgtttagttcacagctgttcagggtgacagtgagcagatccagacaccagatccagctaggctagatgtacagtatctaacttgatctgaactgaacctgttttccttgatgatgcctaaaactacatccatagtttctggtgaacctgtaatacagttctgaaagtacagttttatataataagatgctgatctctttattctttcaagtaagagtgctagtgaacaaattgtgttacttgccttgggattttttgaacgtttgtaaaatgctgtcttcctagtccaaacagctgcagctttgggcatttttctttttaattattcttcctctgactttgtatcccttaatacctacactctccaattgtaagagaaagggggcagggaagcaatatagcttccattctaaggctgtattcccgttatgaattactagctgattacagttcagagcattgatcctggaatgtgtgctggagaaatttaaaatactggggttttttgtttaatggtgcctatttagagttggaagttgaacagctgttgcattacatacttttgcttttttattgaaattttgaaatcaaacgtcttgatttttctgttctgttgaattgctatgttcaggatgttctagggggtgggggcagggactcttttcgtaataagcacttgttttattttgtgtgtgtggagtataaaggctacacccttattgtaaaaaaataataataataaaatgaaagaaacaatcaccaccaccattattaaactgtaacttgtctagtaaattgtcactagaactatttgctgtgggcatttcctctattctgttacgtcattaacagtgccttactgtgcaaggcaccaaaggacataaatacgtacttgcaaagattccagatgagctgttcatgtgggccccttgctgactatattccagccacttcagggttgtttgtaatgaccgttatagagaagggctcgacctgcagaagaaactggggtgtttttattctcattcaacaaacccaaataaaaacagtatatgtaaccaacataatgagacttaagtttctgccttgaagagttgtatatccgttagtaacttaaactgtaattggcaggtatcacttgtgattctggaaattctgaggaacacagattccttaagtaatgaaattagtatctgtgggtatcattaactaaggtcacctttcaagaactgttaatgtcctttgtccccaagtttgacagatttgatgtcagaggcatgtgggcctctgtgaaggtgctgagagaatgggaaactaaggccattctaagtgataccagattacgttaaaaaccctcatcaagttcccaatttaccaagctatgcctcattaactgagggttttctgctgtatttggttccacacatgcaatttatatggcatttaatctgagagacccatctgcctcagtggcccatttcccttttatttttggttgctaagaaatgttttgtatctcctttgttc

SEQ ID NO: 128071 - DNA, 1796 bp, Homo sapiens
caccaggctaatttttgtatttttagtagagacagggtttcaaccatgttggccaggctggtctcgaactcctgacctcaagtgatcccccgcctcggcctcccaaagtgctgggagcacttcagtgtgagccaccgcgcccagcatcacgcccagcatcacgtgcgttttttaacctcacaggcgattccagccagcacctgtccctggggagccctgagcctgtggtacttggccctgaggctgggaggagctgaaaggctcctgatgtcccagacacaggatgtttgctgtgaggagcttggaagttaaaatagagtatgttctcagactgccaggttaatttgcagttggaataagaagcaagccgtgagaatcactaaagtgtttctaagatttttattgcttgtcaagtacatcctttagggctccgcgtctaaatatttaagattccagctttgctcttatcagagctcaaatgtggccacagttctcccaccctttgcctggtcataattcagaaccaacttatcaccatggtttgttctcattctccttctcttactcccaaccagtgacacccgggcttctgcttacagctggaggcactggccacctaccttccttccttggctgggagcatcaacagccaagcccctttacacggcagtcatcttgatgagttgctggggccaaagcctgccctccctccctctgtaagcagtatggattccttgtggccttctgagccttctccttgctactcaagagtttccaaatcaaaagacttgcagcctgttcctgttttttaaaagtatttataaaagctgaatgtcaattttctacttagagttataaatagaagcagatgctctggtttgttgatcagcacgctgtgttcttacaggggaagtcaaagaatccgaagtgtgcttggagcatagaactagcgcaagagggcgctagtgaggcggtgcggcgcgggcggccaggagctagggtttgaaaacagacttcggtttgagccctgaatctgccacttagaagctgtgtgcccttgggaagcgataataatacatttaccaaagtcagactagataaccccagcactgaggagttatccacatcatctcttcgtccttcacaacaataaatctataagctagaagttaccatctccagacttacagatgagattgctgaggcttaaaaaagtcaaaaaggtactcaaggtatcatgatagggcctgggggagttgaatgtagtttagattaaccccaggacctactactttatttttattgcgtttattcaaaggcaaaacctgtaagagatgcctaaaaatgataatggctacctttcttaaaaaaactttattgagatttaattttcccacaataaaattcaccaatttcggctgggcgcagtggctcacgcctgtaatcccagcactttgggaggccgaggggagtggatcacttgaggtcaggagttcgagaccagcctggccaacatggtgaagccccatctctaccaaaaacacaaaaaattagccggcatggtggcaggcacctgtaatcccagctattcgggagggtgaggcaggagaatcgcttgaaccctgaaggtagaggttgcagtgagccaagattgtgccactgcactccagcctgggtgacagagcgagactccgtctcaaaaaaaaatcaccaattttaagcatacagtaagttgacaaatgtatcccaccactgcaatcatgatatagaatagttccatctccccacaaattctc

SEQ ID NO: 128072 - DNA, 1031 bp, Homo sapiens
ttgtaagggtgccccgccgcttacccacttaaagtcatgtgtttatttgctttttgtgtatctttttggtgaagtgtctattcagatcttatatagggcctgtaattttttttttttttgagatagggtcttgctctgtcacccaggctggagtgcaatggcacaatcttggctcattgcaacctccacctcccatgttcaagtgattctcctgtctcagcctcccaagtagctgggattacaggtatgcaccaccatacccggctaatttgtgtattttttagtagagacagggtttcaccatgttggccaggctggtctcgaactcctgacctcgagtgatctgcccacctcaggctcccaaagtggtgggattacaagcatgagccattgtgcctggccgggtctgtactcttaacccgcacactctacctgcgcatttttttcctcgagtctcatctattaaatggaaataaaaacgcaagcatggaagaagactgctgctgttccgtctgcccttcccccactgtctagggaaccccccccttcacacctctgcagtcacacgaatgttttagtcaatgtggacgtttccacactggtaacagtgacagcttagtggtccagaggcgggtgcctgagcctgtttaaaacaatcccagtccttccttgggactagtttctagcttggactggctgttctcttgaactgaggatgtcacggaagttgacagctgttagtggccatgtgccgccatgataaagctggccaccgcagaagcaagtgacccaggcacaggaagaggggtcgaggcaggacatgaggagcccggctccagccagtcccaagcccagttgtatccctactcttggcctctctaaggccctcctgagtcttctaatcatttctctttcttgcgtaggcagcttggaattgggtttttgttactaaaagccaaactaacccactaatgtactgggtcattgtggaaattccatgcgctctatatgtaaactgttcacacacacta

SEQ ID NO: 128073 - DNA, 1040 bp, Homo sapiens
cctgggtgggggcctggcgaggcccccagggctggcactggatcgacgaggccccactcccgccccagctgtgagtgaccacgggcttttctccctcctctgctgttctggatcctccatttctccccagactccacctccttgctgctcccctagcctggaatgccacttggaaagcagcccacgcccatgctcgcggcctggtgcctgattagaccctgtcgcttcactctttatttgggttcccagcacgttcacccaagcagggttgtcacccccattttacagatgcggggtcagctgcccagggaggtttggggattcatccagtgccacgtggctgaccagtgcagtgactcactcagtgcccaggccggtagaggtgacaggcacacacgctggagggtctggctgggaagcaaggccccggcaccctaaacacctctcctctttcccctcccatcctttcccagactccctgaggacggcgaggacaatctggatatcaactgtggggccctggaggaaggcacgctggtggctgcaaactgcagcactccaagaccctgggtctgtgccaaggggacccagtgatctgggctctgcctggtcctcagcctgccaggcagatgcagcaccccctacaggggaggccagttgagagcttgggcagcctcttcctggacccagttatccaggtcttcatgctctgctcaagggggccacatgagcgagcctaggagctggacttcaacccaggaagatgcatccgagggaaaggagattttctatggcctcaggcctgagtgccaatattagtctccagcttctgtggatgatcggtttgatgacattgggatggttgtttagcatttctgtgccttggtttcattaaaatgacaatttccccctagaggaaaaagacagggttaacaaccacagcggattccaatctgggttctcattccggctcatggaaatgagtctgccgttgttcagtggcagtgggacttggcagggataacgtcattgctgtgaat

SEQ ID NO: 128074 - DNA, 1144 bp, Homo sapiens
cctttgtaaaatacaatacaaatgaataactagcagcaggcacttggatgtcgggtaattgctacagattcttcctctcaattttggcacttatatcatgatggacaagtaacagtttacagacaaacattgagctgcagaggcactgttttcatctatgatttatgtataacattgactaaaaaaacactttcaaagtgggggcacaacaatgtaactgtacttaactgtgcactcaatggttaagatggtaaaaaaaaatccaaacaaaattgtaaagggaattcacacctgctaggagggctgtaatcaaaacaatgcaaaccaacaagtattggtgagaggatgtggagaaactggaacccttgtctgttgctggtgagaatgtaaaattatgcaaccaatgatggagttagtctttcctcagaaagaactaccggtagcagcggtggtgtcggcagcggctgtagcaaagagtttggcgcgatgtctcacaccattttgctgatacagactaccaagaggccagaaggcagaacttatgctgactacgaatctgtgaatgaatgcatggaaggcgtttgtaaaatgtatgaagacatgtgaaaagaatgaatcccaacagtccctctatcaaatatgacatcagtcagttgtttgatttcatcaatgatctggcagacctcagctgcctggtttaccgagctgatacccagacataccagccttataaaaaaagactggattaaagagaagatctacatgcttcttcatcggcaggctcaacaggctgataaataattgtattggaagcattaggggggttgggggtgggcttggaacacaggtgagtacggtgtgctgtagcggaagttttgtatcatagtaatcctgtttccactttgttatactctagccaagattggctgtattagatgaaatgtgaagttctttttccatttggaaacccccgttgccccctctttttttcttttcttcctttttttttacttaaacatttttatgatgatttagatggaagttgttcttcctcaattaatgttggttccagtccttccactgtttatatctgctttataacgttcactgtagtaacccttcttcaagatggggtgggggatgg

SEQ ID NO: 128075 - DNA, 1064 bp, Homo sapiens
tttggctattgtgaataacgcagctatgaacatggtgtatgagtatctgttcaagtccttgctttcaattcttttgggtatatgcttaggagtggagttgctggatcacatggtaggtttttttgttgttgttcttttgttttttttttttttactaaagaacacttatttatttttaccaaaattttatcttgaggacatggctaaactgcgtttccatcccccaccccatcttgaagaagggttactacagtgaacgttataaagcagatataaacagtggaaggactggaaccaacattaattgaggaagaacaacttccatctaaatcatcataaaaatgtttaagtaaaaaaaaaggaagaaaagaaaaaaagagggggcaacgggggtttccaaatggaaaaagaacttcacatttcatctaatacagccaatcttggctagagtataacaaagtggaaacaggattactatgatacaaaacttccgctacagcacaccgtactcacctgtgttccaagcccacccccaacccccctaatgcttccaatacaattatttatcagcctgttgagcctgccgatgaagaagcatgtagatcttctctttaatccagtctttttttataaggctggtatgtctgggtatcagctcggtaaaccaggcagctgaggtctgccagatcattgatgaaatcaaacaactgactgatgtcatatttgatagagggactgttgggattcattcttttcacatgtcttcatacattttacaaacgccttccatgcattcattcacagattcgtagtcagcataagttctgccttctggcctcttggtagtctgtatcagcaaaatggtgtgagacatcgcgccaaactctttgctacagccgctgccgacaccaccgctgctaccggtagttctttctgaggaaagactaactccatcattggttgcataattttacattctcaccagcaacagacaagggttccagtttctccacatcctctcaccaatacttgttggtttgcattgttttgattacagccctcct

SEQ ID NO: 128076 - DNA, 1179 bp, Homo sapiens
aatctcaataaccctatgaaagccctggtctgttgtgttccttcaccgtacggtttctgtaataaaaagtgttaatccatgttaatctgtgtgaaaattattgcgtgcaacagtattttctcgtgtacctctttttcctatgtgaattgtccctcttttttatttataaatgtctacttttgtttttttaaagacaaaccaatgtgttgtagacctatatgtaacctattccttagtctcatattataggtatgttataagaatggatattttacttggctttagaatgttttacaagaaaactaattcttaactgatcaagtccttgctactaaaatgcttgtgtttttcatcatgacgtcgtgtgcttctaaattaatcattttcgttgtagaaaaatggagtgaatttatattagtcttggaaactaataatagcattgtaaatttatgagatgattttaacagaaaaaatatagaagaatatagttattttaattgtaatattactaactgtagggtgagaaaaaggggggggggtcccattgtggtgaactatgttatagcttgttactcatagtttctttttgatcattttttcggtctccgaggtgaaatgacttattaattaaaatttgtaaactcacatatgcatattgtatatgtgtagaaatgtaatcacactttgtcttggaattacattaaactgtttgaaatcactgtacacctgcctggcatgcttatttatcctggaaccagacctgtcataaaagcgaagaggttattgttacaagtaacatatttggggtttgtttgtttatttagatggagttttgctcttgttgcccaggctggagggcaatggcacgatcctggctcactgcaaactccgcctcccaggttcaagtgattctcttgcctcagcctcccgagtagctgggattacaggcatgcaccaccacgcccggctaattttgtatttttagtagagatggggtttctccattttttggtcaggctggtctcgaactcctgacctcagatgatccacctgcctcggcctcccaaagtgctgggattacaggcatgagccactgcgccgggccgagattatttaatggctctggaaatgtgtagaagccaccactgcattgaacatttgcagagagaggtggggggc

SEQ ID NO: 128077 - DNA, 3015 bp, Homo sapiens
atattagtccccctacagccaaggaaactgcccagagccacacaactcttgaggggcgaggagggcttgaacctgagtctgcccagctccagaactgagcttgcagccattagccacagctgtctcctgcatgtctgagcaaagaaaggcctttacacagcatcaccctgtgccatcccatgcaccgtgggactcagctaaaggactgtgcaaagagggggctcctgagttggatttaggcaaaaggggcagaattcgtttgatttttagagaaaatctctggagagtttcttttgattcatagaattccttttagatttctttccagcataccaactagctttagtagtgctgctacaaccagctcttataagtaagagtgaaaaagtattcttttcttctttaaaaaataagtttttcttgcttatagttaattctagaaaggcaatactaaaggtatatatttttttcaaaatgctattttttactgcacttgataattatcctgacagctctgatctctgtaatagattcactcttcagctctgggcagaaccagaggcagggttcacaccaaatttgtaaataccatatgtgggtctggtgtccaggaacttttttctttctgttaaaaaaaagaaaaaaaaaagaaaaaaaaaaagaagtagaggtggaagaaagacaagacttagaggaacaaaagaatgttttcttttgagatactcttctcaaagaaatagcaacaattgtataaacaggaaaaccagccagctttcatgataaaaggaaggcgtgtctcttgccctggtatgagattaacagaaatacagatgcatttttattttgattgaaagatggtgagaatgtagaaatgcttaggactagatttttaattttttaaaataactattatcatttattatgaaatatttgttcagttgttttgagtgggtttcttgttccttttttcatttaaaaccttctttgttgactggctccaggcttgtttgcctaaattcttaggtagtttacacaagttctagaatcttttagaactttaactccattggaagcaaacctaactaatcggagtttgagatcctggttggtttcaataggtattctggaattctggcagaacacctaaagattttttttttttttagaaggttttagatacattatcttacacaaactgtgacctaatggcaataattacctcaaatgtgggcattcatcctggttttagccttttttgaaatcatgtagccagcttgatcttggaatttaaagactatgaattctctgtgggctgaaaataatgattacttcatacccccggtcatcgttgcttaagtgaattctgaaaatagctcatctttacaacaaaaattaaaccaaggaagagattattctttgtgtgttgtactcaaatgcgatgttcaaatgcacatgttaagtatatatgtttttagctactgtaaaatgctgttagccttctaagctatcaaaacagtcacattttaaatgagtaaactaaacaattgactgtggatacttaagcatatttctggctacgttttatagttaaagtgttttatagtttacatttagactggtactttttaaagaaaagttctgtttataactgacatccgcaaaccccagtgaatgcctcttagttggaggttgtgtctcccccaaggcaagtgtgttgtcccagactcttctgtagtccagcatgcgcacttccctctggattattactttccacgtgaactcaagagaacatgaaaggcaatccagatggagggaaaaggtgtgagtccgcagcccgggccagatgcgaaggtctcatgcgtgtcgtctaaacacttgtcttcaaggccttctctctgacatcttggaagagtcattgagaacagataacctggttcattgatttttgtcttgatttgaatatttaacttattaatagatccactgatttccaggcaccaggcagtagaagagactgggattcaggtgaccatgaaggcacagctgctacttctgggccgggggtgatattttgatcagcgttttgtaggggaggaccatatacccctattcccatggtcgctggctgggttttccatatatctgctgtcatttattcgttttccccttaaaagcaaaatcaatgtaaaaggctatgtttacgttttactcattgtccagcttagactcaaagtctagttcggtgggagggggaccttagcatcctctcagagatggtcagggctgagcaggaggaggcagagacagaggggcagctcagcctggtccattgagacccactctaaacagacatcatatttggaacaagaagatgcttcgagacaggaatgggccccactgtcatgcagaaacagactgggggaatggcagtttccctgagtcttggtttcttttatgttttctcttgtgccaccaccaaactgcagaggacctgctgtgacctaaagggcattcctttagcagataagaccttgaaaactgcaaaacacctgggaccagggagcttttaaaaaatacaaaaaaataccacatttgctttttccctgtgaactgtattgacagcgtgttcttaggacagtcttttggtggaaatgttactgtaaaatagttttcatctcacccctcctaatcatactcccactttcctgtttgtgtggtggtgttgctgttttttcctttacatgaattaaccaaatgaattttgtgtcattgtttttggggcttatatttttaaaacatagaaattgccttttgttcatttgaaaagtaagtatgttgtatctgaaaaagggctctgcctctgctctccctcgcttccttgtaaccaatctccaaacgaatctctcctggcaccgcccccttccttatatagggtcactgtccccggggccacctctgcctccaccctgctgtcaccactgccctgggccaaggcacccaggactcccagaaagc

SEQ ID NO: 128078 - DNA, 1397 bp, Homo sapiens
atattggaacaagcttggggtggaagatttaggccgtgtgagcatgtgtgagtgagtggaacaaactttcttggaaactggagggaggagatgaggaggcttcgggaagtattactgatggctcatggttgagagagcgacgtggggacccagctcgccccagcttttgtcccaggttctctttgtctgatgctgagggcagggtggggtgtgggaccaccactcttgttggcctgtcaagtagaccctaggacagaaaatggaaagaaggaaatggctcggtgctctcaactagcagagagaattgaggagaggtaagggttccttctgcaggccagcctgggactccacagcgccagcaggagtgacttggccacaagacattccagccccagggactttgcaggcttcattccctgtctgtgtcttttccttctggtgtgttttacagacttctgatggggaagcttcaaacttgagcaggccagagatgtccttaccaaattggaaaggaaggtgaaactgttcctttctttagccaaagaacccttctcaaagacgcctccagaaatggacaaaatggccttcccttcgttcctttccaggcaataatgacatcattagtgatgcaattctatttgtctttctctttcctctctgtccttttttttaaaaaaaaaaaatgcatttatttcaaaactgtgctattcttttaagaggagtggaggtgaccccttcgatgctgctgctatcgggagacaaggtgccataccaatacgtgggcttgactaatcccaggccaccatgggagagagcaaagcagggctgccaggagttcagttgcatcaagggcgtagagcacgcgggggctgggctcggaatagcagtacttttccactttgatgccttagaactctcacttctcatctccacagaccagactcagtaaaatctcaggccactagagaatggaaggcggtgaaacaggatttaaatgcaaaaaaaacctattggaggcttttggcaccgtggctcactagagggacccagcatagtagaggtttctcttgttgcagcttctgaaaagttcaaaaaagaactccaggccgttcttccctcaaacccagtgagagtttgcagagaagtgccccctgcagggctcccgtcccagaacaccagcaccagagagggtcttcccgatgccccccgctggacttgcccaagcctctgggagcccctcatctcagatccctgtgttgaacatgacactgactgtcccttatttgttaaaatttgcaatatctctcaagtaaataatagccaacatttgttgaatgctttcatgactcccgggctaaggcctttatgagcgttgtctcaaggggccccaacagcca

SEQ ID NO: 128079 - DNA, 1504 bp, Homo sapiens
aaaacccagctcaagaacccattctacgccaaactggaaaggagaagagagcaacaggaagattccagaaacggggggccccagtttttgaagaactttatgaacttttcaaagattattttcatatggcagcaagtgatacggaagactgctgtcagggacacctgatatggaaatcaaatagatttttaattaattgaacataagatttagggatttttccagaactcgaaagggtcaacagccctccagaatgtcgggctgcagcctgaggaggctgatgtttggagctggtgtgggattggcgaagcccagtccgggctccctagtcaggaaagacgggggacggccaggctgctggaaggcccccgggggcgcggggcgagttttctttttctgagcactctggataaatccctaagcaacgttgtttctcaaatgtcattaataatgtgtgttgcaaactttaggtttttttcttttctgaaaatgtattttctctttgaatccacccctagtcgcgtagcgtagggctagcggtcgtcacagacaccctagtagaatgtagcactcagcacccttgtctcctaccttgtgttcaactccaatgataccaatagaatattcctcaatgtaattgcacaaaaaaaagcgatataacataggcatgtaaccaatgtggcggtgcaggtgtgcgggtgagcgagcacgtgtgggtgtgcacgcgccgccctccccgcgtggccctcggcgccgccaccctagctggcgcagtcttgacactgcatccttccctcctagtgccttaccgagcgacagacgcggcgtgagggtttacttccactggtactccaagaaactgaggctagtcagacacaatctcagctcttctgttgtgctgttgtaacagtttacgctggccttttttttttctttttctttttctttttaaaatgttaatgcccgttgtctttcctgggctgtttgctagcggaaggatgccagggaagccagcaggagctaggagagagtccgtggatctcgaaagaaatatgggagacagatgcccggcgggtgcgtctggagatggggacggcgggagttgagttgtggcagtagttgagttgtaatttgtgggcggaggcccagagagactccccacccttcacccctgccccactctgtccccagttccgccatttgtgaggccagaggtttccggactgttggcctcgccaggcagccgtctcccgccccaggcggcatcccccagtccctcccgcctccacgagagcctggagctctcagcctcgcccggggctccactctctcctccggctccctgggctgttttgctctaacgatcttgccagatccctccctctgtagacaaccaccaacctctgtttgctgttgaattctctcctcacattacccaggtctgctcaagacatgattttggttttggtttctgagggttctagtgggcagaaggttggaggga

SEQ ID NO: 128080 - DNA, 1018 bp, Homo sapiens
tccttttaaaaatgttctcttctctgctctacgtcctcccacttcccggttcaagtttcactggtgtcccgacccgtccccctgccctctgcccccccccccccccccgcccctgccccgtttgcattgtttgtgtgcggcatcttcagtataaaaggccagcgcccacggtcccaggagcgcctccctccttctctccctcctccctcgggccattctctccctccctccctccctccctcccctccagtgtttatatgtaagggtactggttgaccttggcggggctcagtgggtatccagtgtagacggtggaggctggcgaggcgctgatgtaggtctggtgggcaaattgggctggatactgactcgggtggatggtgggcgagggcaggacccgggggcccatgctcacggggacctggtggacgatgctggctgggtaggcagtgtgctgcacggtgtggcgcgcagagccttgcgaggccaccaggtgggccacggtgccggtggagcccagggccgccggcgcagtgtaggtgtagaggtggggctgggtggggaggtgggcagcggcagcggctgcagccagatgcgggtgcacagtgccgtggctggggctgttgtgcgggaaggagtacggagcctgggccatggtgggagtgatgtaggcctgctgccttcggtggctcccagtgcggtccgtggtgatgtgctgctgagcctggggaggagaggcaccaagagagacgtcaggggccgacacatggggaggaaggaatgggaggaggggcaggagggcagggaggaggaagagaagggaaagactccagaagtaatagaaggggcttccctctgtgtgttgagaaagtaaaaatttacttgggacctggcgcagtggctcacgcctgtaatctcagcactttgggaggcagaggtgggcggatcacctgaggtctagagttcgagaccagcctggccaatatggtgaaaccccgtctctactaaaatacaaaaa

SEQ ID NO: 128081 - DNA, 1031 bp, Homo sapiens
aatcccagcagtttgggaggccaaggcaggtggatcacaaggtcaggaattcgagaccagcctggccaatatggtgaaaccccgtctctactaaaaatacaaaaattagctgggtgtggcagtgggcgcctgtagtcccagctactcgggaggctgaggcaggagaatcacttgaacccgggaggcggaggctgcagtgagctgagatcacgccaccgtactccagcctgggcgacagagcgagactctgtctcaaaaaaaaaattagctgggcgtggtggtgcatgcctgtaatcccagctacttgggaggttgaggcacgagaatcacttaaacctgggaggcagaggttgcagtgagccaagatcacaccactgcgctccagcctgggagacagagcaagactccatctcaaaaaaaaaaatcagtattgtttctgtgcacatctcaccccagcaggactggttgcccaaggaggcaggacagcccccagccccagcgccaggctcttgttcattccctggtctgccctgcccttcttggtgggggaccatctgcctgtctttccacctggaagatgttttcttctccattaactctactgttctttagcgtttaaggaacagaagcaatgcttgttgtaactatggtttctaactatacaacacaaaccacacagtcttcaggctgctttgtcgtagccttcacttactaaacccctctttttctgcttccgttgtcattgaagttagagaaaggtatctggaattttctgcctcccacactttcctaggccattatgcagtttgctcctaaagaagcccagtgttggcccagcgcggtggctcacgcctgtaatcccagcactttgggaggccaagggcaggtggatcacctgaggtcaggagtttgagaccagcctggccaacatggtgaaaccctgtctctactaaaaatacaaaaaagttagccaggcgtggtgccgggtgcctgtaatcccagctacttgggaggctgaggcaggagaatca

SEQ ID NO: 128082 - DNA, 1127 bp, Homo sapiens
cctaagcttatgacattcttctcccagcgaggtttactcctaacccaggtccccaggttgctgggttcttgctggttctctccttgctcagatgtcccattctggcaggcccacgggggttgtacccagctctgggctgcaggtgcctcccctgcagctctgctgagctctgctgcacaggaagagcccaggccagcccggaagcatctcactccctagtttccagaagcccctgtgggtccagcaccagccccttctccatgtcttcacatgtccccctgctgccggctacacaggggacttttgcatgcccagtctccctatgggggttagggagggcaaaagccctgttcctgccctctcccctctgcctccctcccctgccccagggcatgaagtgctagttgggtgtctcacctcacggccttctcccacctctgacttctccctttgcattttcagcactgtctccaagcaaagaaaaaacgtcatcagctgtgtcacagtccacgactccccctactccgactcctccagcaacaccagcccctactccgtgcagcagcgtgctgggcacaacaatgccaatgcctttgacaccaaggggagcctggagaatcactgcacggggaacccccgaaccatcatcgtgccacccctgaaaacccaggccagcgaagtattggtggagtgtgatagcctggtgccaggtaatttggggccaggacagggcaggaacctctccctggagagtggttttcctgcttttctgctgctagaaatgttgctgtatgggagctagtacaatagaaagtgcccagtgactgcaggcgacccttaccgaggattttattcaagtatccaggggaggcttctgctgaacagcacattgtataagcagcgttttccttctttaatcctgtaatcaatacctctctgcctttacaatggctctgcttccaactaggttgattaatagaaaataaaagcctcctggttctttatgcctgagcctggaagaatacctggtctggggagttcctggctgacatctagcaccactctctgccaggaagccctggtggtcagatgggcttcttgtgtaggaagaacctcctccgagtctt

SEQ ID NO: 128083 - DNA, 1045 bp, Homo sapiens
taaaagaagaccagttctactacttaatcctgggggacccagaacaatatctgtttgtcttatcttttggccaattctctagccatgaccagagtcccctagtccaacagtaattcactgaaaaggagttccctggctcttccctgcccttcttactttaaaaagagctgactccgcccttctcagtgccatggctccagcactctgacaaacgcccagcaccaagagggggctcagtggacaatactctagactccctatggccctggcatggtgacctgcacacagtggcatagtggtagtcacaggagggagcaggatagaatctgtattcattgaatgaatgactgaaatcagttatttttgccagttattaagtttgacatttcttcaagagcatggcacctgagtcccaattctgctatttagaacctgtatcaatttgggtgagtcacctacctttcctgagcctcagtttcttcatctatcaaatgggaatagaaatatcagccttgcatgccccatcaaatgatggaggagctagtgcgggtggaacacccagtgcatgtttgctatgattctcctgtctttagctcagtgtctcccagcatctgcctccaacatgccctggagttcttacgagtggagctgctggccagccatctgctgtgcaaccaacagtgccacatacgtggggtcaggaataatgattttgcattggctttcttttaaaaattctaggctatatcatctagtcctagaggtttagtgacaccctcaatcaggtctaaaagcccctttggtggtggaggcactgccatccctctgaaggtcatcggctgcctgactctggctgccaagctgaggctgagccatgttaggggaattaaccagcattttaggcaaagttacaggactggcactggggtaagtagcaaatagaaaacgaggctgggaacacagaaggtgggaatcaacatgcccacagcatggagaaatcaggctcgagaacaaggatgatcaatgtgtaggagggaaggtctcc

SEQ ID NO: 128084 - DNA, 1077 bp, Homo sapiens
ccattataatcccatcatgcagcagcctgcactattgaccggtcatgtgacccttccagcagcacagcccttaaatgtgggtgtggcccacgtgatgcggcagcagccaaccagcaccacctcctcccggaagagtaagcagcaccagtcatctgtgaggtaggtggtgagagccaccctagggaagagaaatcccaggggatgtgagtgctaaagaaatgtagtttagggagtatcagcacccactctgaacatgggacagttgcatgggatgggggcactcctcttcctgcagtgactagcaaaacatcctgtaccacctggtttggcctagggtttgcaggaagcacttggtttaagaccgtggtaatagtgtagggatggatgcaatggaatcttgcagtgggcaagagagattgggctcaactccatacagcgtgggcgagtgaaaatttatagccaaggcagggttggggggtgtcggtggatgggaagttactaagaggaagcatcaggggtaagggagattctgcctaaactgacctaacaggattcttgctaatgacaggcccgggtgatcagatatcacacctggaggatgaggaacctcatcagatatcgagggtgatcagatatcagggatggtgggttcttgctaaactgacttagcaaggttttttgccaaaagtagattgtacagcagagtgcacagttagacctaggagaaggttcacaagcctgactaaagtttggtgaagcaaattatcttttgtcactttctacttgtctggagaacactcagcttcacctgaagtttcattttggaaacaatttaccataataattgttttaaaatattttaaaatgttgaagttgtttaaaaatgttttaaaaaatactaaagaaatgtgctttctttgtatctaagatcagaagtttaactgatttagcaccttgcttaaatagaagcaatagcttgtttaatcccagacactaaccagcagaacacaaatctttcccattccctttaaatccattctcatctcaatgaacactttgaaaaaatcaaggtcaaca

SEQ ID NO: 128085 - DNA, 1033 bp, Homo sapiens
gatttgtcctcccacatgtggactgcacccaccaggcccgaggggagtgtgagcagagcttggacgtgcaggctggcaggtccaggcacccagagctcatcatgttgtgggatggaatggggcttgggcagagagaaggagggcaaggtccagctctctccctgtcaccatgtgtcagcacagaacccaaggaatcccatagtcctcaactcacgcctggtcttcccggttattgggaaggtgtatttgtcaaaatgaaaaggcagaacattttattaaacagttttctagcctaatttttagccttttcagcatttagacatggtagcaggcatccgtgtgtcctcttgtctgggcctcacaaatgccaggagcaagtctgaatgtgaacaccaaggtgactgtctcccatgttttcagggacctgcttttccctgcgactttcaatcgtgtttccactcctctctgcttttgcctttctgctcttagtttttgtttgtttgttcttctttgagttcatttatttgatttagattcgtgtctcccaacatgccacctccctcattttttatttttgtttatttttgtttaatccccatcactcctttaggctccctcctctaccagtgccactatttccttagccaatcccgaagtctccatactaaactacccatctacactctaccagccctcagcggcatccatggctgcagtggcccagcggagcatgcccctgcagacaggaacagcccagatttgtgcccggcctgacccgttccagcaagctctcatcgtgtgtccccccggcttccaaggtaagattgagcagccacagcctctcacctgcttcttacagaacggcctctggggctccggcacctgcagttttctgtcacgctcattttcatggagaaaggccctcctcatttcttccagtgagagcgctggtatcactgaactagagggctcctctcctactgtggccaacctagaaacaatagggcttatgcctcagcaccaagtcaatcct

SEQ ID NO: 128086 - DNA, 1037 bp, Homo sapiens
tggttgtcaaaactattaaatgaataaatgtgctttagaacaatgtctggcacgtagcaagagctatgtgcataagggtttattaaataaaattggaaaatgcatgggaaagccctttgcttttccacaatggaatcttgccttattccttagactcagagaaggctgtaagctgatcgaggatgtggcataccttgatcagcctgtggtatggagcaagactgctccatacctgacccggagccagcccctgacacgtgtgcataggaaggaggagggatgggttggtgtggatgaagagagaagggaattgcaggtgtgcaggtcattgaagaatcaaaatctcttccgaaatgtgggaaagagaccctctgtgagacacaggagttccaaggcttgagtcccagtgatgaggagctaagtcacgctaccaattggcttttgcctctcttgacagacaccagatgaccatgaagcagagacagggattaagtcaaaagaagcaagaaagtacattttcaactgtttagatgatatggcccaggtaagcttcatgggtgagtatgcaacgtaagccctttaaaaccaagggcagcaagacttctgcaatagtaatagaagataatgggttgaaatccacattattcaactgcagtggttgaccttgaccttaaatagttacagccagtcttagtaagaataccatttggtgtgtgaaacatttttaaaacttcataccagctcctttaaaatcgttccagttggccaggcatggtggctcatgcctgtaatcctagcactttgggaggccaaggcgagtggatgaccttaggtcaggagttcaagaccagcctggccaacatggcgaaaccccgtctctactaaaaatacaaaaattagctgggcatgatggtgagcacctgtaatctcagctactcgggaggctgaggcaggagaatcacttgaacccaggaggcagtgagccgagatcacaccactgcactccagcctggacaacaagatcaaaactccatctc

SEQ ID NO: 128087 - DNA, 1073 bp, Homo sapiens
cagggttgctcctgttcctgcagcagtatccatttctgggacccactttccaaaccacccccccgaattctaacagcaggagacacacacacacacataccctcaggctctacatcacctctgcctccttcaagaccacccttaatattcattttaaccagattttgcctgaataaaaacgtgaaggggaagaaaaggtgccccagtgtgttttcccctaggaaaatccctactggtaactagtcttatttgctcaataaacaaaatcttaggctgggaactgaaggtcagcacaagcagcatctgcgggtgtgcaccggggctctggggccctgtaacatttgcgcgtgtacctgggggaaggggtgctgcatcggcccgccccccgcagccacccgccgcagcagtggtcaccgagtcagggtgtggggaggtggaaatgaaatgcataattcataggccgctgtggtgtccagtctgtgggaggggtggtaattacagaactgagaaatgaggctgcagcgggcaagtcacctctaggttagaggctgctatgatagatggcctgcattgttctctttctgacctttttctgaacttccccttagaagaacagaggaaatatggtgctgccttttcccatattgtttttgaataataccttcagacgccagcttttagagtttctgttcttccgtttggggttttgcttccccctccacccgcccaatgccttgcttctttccatagaaaaatcgaatcactaatgactttatcctagtattaatggtaaatacagactacacaaatatttgtccacactgaacacaatacatacggggaaaggaaaaaaaaaacccgcagcaccctctccctccttctgctccgccctccactgccaagcaagacaatcccaagagccgtcctccgtcctccgtaatgatgcagacggggctgatgagaagggtggggggcgttgctcggtaggaagtgatggaacctaagctctggcttgcagaatagaatcgttttaaccggacgtgaaggtgcaagcaggaatgatgctcactccc

SEQ ID NO: 128088 - DNA, 1068 bp, Homo sapiens
gccgagatcatgccactgcactccagcctgggcgacagagcgagactccatctcaaaaaaaaaacaacaacagtctcgaggaggccagaggagcatgttttgttccccccacctttggaaagaaaaaaacattgtacaagtggaaaatcttcactaatgcaacataaaacttggcgattttcatcacaccaggtcaggtaatcccaggctgtgcttcttgaggcagtggaagctgatttcctttgctcacttatcacctgtgcctctcaatggcatgtctgtaacaggaggcagaggcctccttcccgaggtccatgggtcagagttttaccatacgagatggcggtgtgggaggtgtgatttgtcccataagatctctaaatcccaccacccattctgtaacagttgatagtcctcagcactgcattttccagttactcatgtttacagacaaatgtctctttgtctgtagttgctctctgaagaaatcaaagagcagctgttgtcctgcctcagcaccatggcataggaggtccagagttagcatcgaggatgacagtgacgctgtttctgctctggtatcacttgccccttgctcctactgccctagcccttgtgtcacttccttgttctcctgaacagtttttttttttttttttttttttgagacagagtcttgctctgtcacccaggctggagtagcagtggcgtgatctcggctcactgcaacctcagcctcccaggtgcaagccattcttgtgcctcagcctcctgagtagctgggattacaggcccccaccaccacacccatctaatttttgtatttttagtagaggtggggttttaccatgttggccaggtctcaaactcctgacctcaaatgatccacccaccccggcctcccaaagtgctgggattacaggcgtgagccaccgtgccggccctgaacagtcttctttgtgttttcctgcctctgtaccttcgttaatgatgttttcttacctgcagtgccctctcccttctctcaactctgaagtcggtggtacctaacgattctatttaaattct

SEQ ID NO: 128089 - DNA, 1052 bp, Homo sapiens
cagcagaagcctgggtgagctgtcgggggactgctaatagaagtggacgtagaactggcaagccaggcatgggggctcatgcctgtaatcccagcattttgggaggccaaggctggaggatcatttgaggtcaggagttcgagaccagcctggccaatgtggtgaaaccccgtctctattaaaaatacaaaagttagccaggcgtgatggtgcaagcctgtaaccccagctactcgagaggctgaggcaggagaatcacttgaatccgggaggtggaggttgcagtgagccgagattgtgccattgcactccagcctgggtgacagagcaagactccatctcaggaaaaaaaaaaaatggaggtagaactgaactctgaggatgtttaggatttgaataagagaaggagagagcatcgcagatgaagaaagcaacatgcacagaagtgtcgagtaaggagagtattgcggtgtgcacaaatgacagggaagggtcagacctaaaagaagaggatgttatgaactgaacacagaaaaacatgatggggtaagggagggcagctgtggggccttgggagcaattagaatttggattccgtgtgataggcaagttggttcttgaggaaagctgtgggatgatgaaagtgagtcaggcagcaggctgtaaattggattggacggagggaaagattagaggcagagaaactagccaagagactgtttcagttatcgggcccaggccaagggagtagtggcattgagaataaagaagaaaaagtgactgtgaggtaaatcccaaaaagaaggcagaaactcaagaaataaaggtaaacgtgataagcaaagatgactcttgagcatcctaattttggagatgaaaaaatcatggttctgctggaataagtggggtgagctggagaggagccccgttttgtgggggtggagggacatgatgacttcactttgaggcatccaattagagatacttaagtcaatgagaatatggtactagaacccagggagagattggggctgggaatgcatctgcctggt

SEQ ID NO: 128090 - DNA, 1222 bp, Homo sapiens
tgactgcttttctgagagtcttttacctactcccagaaagttatttactctgtgggacagttcattctgttgcatcttatctgagtacttaaagccccaaggaagaagatgatatttgccagtacataaactgacattttggcacctaatctttgactttaagaagaaccagaggacccttgatggttccagtgagccctgggtcttctgtgctttcgtggcgaaggcctctttcagaggacacaccacggcagcccctgctcctcaagtctcagaaggcctgaacccatggtagctggaaataatagcttgacattcctccctcattttaaactgtgattttttttttaaacactcttcttgaccttttctttgaaggaggaacaaaacagggaaaacattgctcttcagtacactagtgaattattttgacaatggcagtctcccgaaacaggctaccatgtcatccctacgcttttctcttgtgtgtctttgattgggtgtcattgccagtccttacagaaattggcttctggcccccaatagtcactgtctatcggcaggacctatcacataattgctatcttgaaagcaccatctgggcagctcagtgtttaaaaaaaaaaaaaaaaaaggcagacctccttattgacttgaaagagcttacagtctgcttgtaaacagaagacatgaaatgactgaagaatgttctcaaagctcaacatgaacaagtcacattacagacatttgaactgaactgaatgctgaaggaccttgaacaaatgagcatctgggtcagattagctaggcagatggcactgggtgcccaaatggagtgagcatgcatggaagaaaaagtgaaggcccaggcactcatttagaggggaggagtttggtaatataatgaggataaagaatgcttgtagatttctggttagtgagtagtagaataaaaattgtgactaagcaccatgggtggatggatggatggatggatggatggatggatggatggatggatggatgtggccaggaggctgaaggcagtgctctatccaggagagccaggtcagcgcatgcatagctagggcataagctaagaaaatggggaagacacagcaaattcctgatactttacataaaaggagtttgttgggttttattttaaaagtgttgaatgtgagataaaaaagaagaagggttgggatccctaatgtagatg

SEQ ID NO: 128091 - DNA, 1115 bp, Homo sapiens
ccaacccgcccggaaaaacaaacagccttgtaggacaacagccttttaggacttgaaccttctcaggcccgcctctcaaaacaatatgacttgaaaatgtttagtttttcttgtattgtctcacttgccaaacctccgaaagcaatttgagagtaatttcaaccacatcttttagcaggccttgtgaaaaataaatttaacaggttaattgtgtgccgttttgatttgtcttggcatctcaataagtaaaaggttaaaatcatggccacaaaaagtaaataaagcttgattattccagttgaaaattcatccatgggtactctagtgcctggctttcgtgttgacctcattgccatatgaccaccatcaatagctctttatatttaattaatttcctaaaaaaaccacactcacacatttgtaatgtttgtaatctttttattccatgataattgatgtagcctagcgtaattgtagtttttgtgtgtgtgtgaagtatctgacattctgtgctttagtacgttttatttcatcacttaatgtgtcccccccacccgcccactggctgtgacagtgtttttgcgaatgaaacagttcagtgagacctgggaatttcctgtggcatttatgtggtctcatgctcatctctatttgccagataccatccgtgtaagaaccatgctcaacagatacattttggagaaccagatgtctcattttgtcattcaccaatgagtcttgaaaggctgaattcaagaagacaactttttaagatctttctctctcagtctacaaaagaaaaaacgggcttattactgtcaccgctgcctttaattatgtacagtcacaatacaattatctccctatttgggtgttatctcccctgccagatcaccaatgcctcaaattgggagagcacggcttctgtttattgttcatcctttgaaatgacttaaaaggaagctgagtacacagttgaccccctagccaaggggattgatagtggtctcgggctggggagaggactctgtgattcttcccaaaaggtcactccctatccagaatgataagtcctcagtttttagaatgtagttgttaggtaaagggattaatcc

SEQ ID NO: 128092 - DNA, 1535 bp, Homo sapiens
agacacccgcaggagggcaaccagaagttcagcatgggtgagcccagggattcccttgccagggttagcaaactagggtccacaggccaaccacatccattcatgtacctgtggtctctggcaactcttgtgccacgtcagcagagatgagtagatgcagcagagaggagttgcggtgtatagatagcctggtaagccgaaaagacttagtatttgtttctttatggaaagtgtttgctgaactctgccatagaggcacagaacaaaaatgagcgcagttaccttagggggccccattgcaaagtgacgatgcatacttggttctcttttgatcaggagacgactgacctgattggagatatgtaaggtttaggaaagttgacatgagaatgattcagtggactggagcttttgggaaagggaccaagtatgagaaaaccaattaggagtatattacagccatctgttcaggcatcattgaagaaagagcatcattttgagtcttatctaagcgttggggttggcaagtattacctcctaggccagaaagccttgtccttctcccagtcccagttcatgtcactagattgggggtccacctcacagctccagaaacctcaggtcaaccccacccaatcggtcacatgctaacttcctctctggtgatctttgcacaaacatataactcacagcatggtgtctggttcttgctgacatcaactttgtaactgttttcagattattttttcttttctccacagtaactctcaggcttcttgaggtcagaaccatgcattcttgttttgctgccacctccccacctgcctgcccctcatgctgtgtcgagtccgcatgtgagaaataagatgagagtcactggcagcaaagtgagtgccgacatttaaatatggaagcaagtctggggccccagactccaagcgcctagtacctgtggccttgctcactgtttttcatatgctgtcctctggtcttgtttgtaaagtgacctgttgcacaacctgtcagtaccctgaaggtcagtgactgtgtccacacctctttgtgttctcggtggttagcataatatttttaacataacggactctttttaaatgtttggtgatgacacagtcactgagcaggatgtgctgtaagaagaaaacatactctccctcattctgtgaattagtcagaatatatcaggttaataacggtaagagcaagcttctgttggtctgatgcaccagcatctattggatcaagcaattaaacccatgtcagtcattttggtacaatagaactaaaattagacacagcataaatacaatcaagacgtgagcacgtttcccagcattagccttacgatgacaaaggcaaatgcagaagtgtgcgaacttccaggacaggtccggagatggctgttccagagaagagccagggtggatggcaggaagcggcagctgggatggaacctccagtccatatgtggcacctcttttacatcttcatcgtaagcgctaccaggagtttgaaat

SEQ ID NO: 128093 - DNA, 1683 bp, Homo sapiens
gcggtaccttgttacacattaacaggcagctaatgcagtctctgttcgcatttttatcctcgtgtgtggcacgcgtgttatatagttaagcatgaagcaggtcacgtccaggctccgaggtgagagccaggcccttccaggtaatgctaaatattgtacaaacagcaaggttttgttcatcaacccaggagtgaccttactgagtggcgtgttggtggtaaaaatgccttatatttaagagagaacacacattctcctttctctcccaccagaaagtctggttcttgctgctctgtcatttcccagaaaggaccagcctctcttgctccaccccacttcctgtctgtggccctgtgatgccagggggccctccactgtcctacagaggaggggacaaggggcaagaggggccagaagcatctctggaatgcacacagctcatgagcagctaggcttgctccagcagtcacatgtcctgactggagtcttccagcgccttctgtcccctctgttagaagaaaggggaacgcgggtccttaacacagtgcttttgggagattgccattgactcagagtctgagatttaccattaggcgcatttgaaacaataaacatgcatggagcacttactgtgtggcaggacatggtgcagggtgctgtggggaggagatgagtaaaacagtgttcctgctcttgaggagcagtcaagcacagtcattacggccccacccaccacagggacccagaggagggcacaggcacgcagcgggagggatgagggaaagcttcccgtaagaggtggtgtccacactgcacctgaagaaggtggaactgacatctctgtcctaggtgcctcaacagagcccttcattccaacccctcattgcacatgtatagttacaggtctggctacccctgctcatggatgagtttcttgaggctagagatgggttttacccagtgttcctggtgccaagcccaggtcttgactcactatgggctctcagtggatgtttgatgagtgagtgagtgagggcatgtggtggatgatgaggctggagaggtaacaggactgaatcataaggaccttgcctgtcgtgaatattgaacagcttggcaatagagggggttttccttctgaggagtggaagcaacgtggtctatggtatgtgccaagtgagggcagaagctggggcagtagccacattggcatctcaccatgagtcctctacatggcccagggtctgtaccagcatgacataagccgtgcacgagtaacaggagtgtcagccagatccgagggctccactgtgatgcctgccctggaaaagatagagcccactcaggccaggccatggtggtttgagcacctccagcaccaggggagatgctgtcctagaaccagggcccccagtcagtggacaaagaaatgtaggaagattccagctcagagaacatcagaccttctgctccctggagcagtggtggctgcatggacccagggcttggtgcatggaaagtccaggctccgcacgctgtgactctccttaaagtgagaatatttttcccaggagtgcaagggcctttcatgtgaggagttttaaatgtgctctctggtggtagccacagcatccttaattttcttgtacagcaaaagtcaatttggaattgcaggaaaggagg

SEQ ID NO: 128094 - DNA, 1145 bp, Homo sapiens
caggaatgggtctgagggctttctgggtgcagctcatttcccaagcgctttcccctggcatccctttaaacctgctgtgtcagctgtccctccccgcactcccccacccccgcccccaccgcttctcatggacctgcatagattgggccccaccttgaggctcccccagccccctgtgcacaccgaggtgcccggcaccctgcgtgagctctcactgtggatggtgagcaaggacatccacccagcgtctttccccctcacaggctgcctgaggcctttgtccctgtcctgtcagggaagctctgccgctctcctgttgattgactcaccacctgactccttcccagtcctctttttctcattttggagttagaagtctccagaccccagttagtcctggctcctcttcaagcaaagcgcaagccatagcttgggatttctgagccacacgattacatgtagggccagatatgacccttggaccaatgggaagctgtgtgtggcagagatgggcaggtttgtaataggaaagttccaggctgggctcatcaggtgagaaacatttctgcacacctcccccatagcagacccagtattcttcaccatcaacagacataaggtaactgagacaggaagatgttacctgtgaggaacttgcaatttagctaatacatataaatgatgttgtgtgaaagtaattctgggctgtttcacaagaaatatttattttcattccaaattggatagcaagccaattctttcttataagacagcatataacatacataacttcaaaatgacacacttggactgcctaaatcttaatcctgagaacttcaaggttccatttggtatgtgggcttcattgtgatgattgaattaggcagccctgttaacgccaacaaaatatgaccgcttttctctgattgcatttcctgacttctaagttttcccgatagcagttttccctaccagcagttcatttccccagctcttggggagcactctgtggggtccgtggctgcatttacaccccagccaaacgtggcactcatcgggcgtctccaggctgcacgaagattcaactttagctttggctcttggtccaccacttggcagttaggaaagttttcattttgagagtt

SEQ ID NO: 128095 - DNA, 1227 bp, Homo sapiens
tgctattgtgattaataaattggaaaatgtgacttgcctactgtgactttttggtattttgtattttctcaattgggagatagtaacaatgcaattactatcatgtgggatctaaccattcccccaccccaaattctacagatgacaatagaaacctacttcatgtcagggagccacggtcacccctctctgtacacaggaaaagaacctgtcctgctcccttagtaggattgctgtgaaagtctaggatgtgggaacatagtgcagggtatacagagctagctctatacctttgaccttggcattaagcaggctctcggggagggcctgacaccctctctgtagccagtgtgcatgagcttaatgcacagattttacatctatttttggtgctcaaaggcctttttgagttcacttccaggttctgggttatgttctaggtagttgttggtgccaaatgaaaatgagcttcaaatgttattaaatgtatgtatttctttaaaaaagaaaatactgtttcagatacttcagaattagaaactgcaccaggttggtcatttctttgagcactggcctatttaaaatttttagaaaaccaaaaagctgtccatctactgtctactgatatgcctgtaatgttatatcaaaaacctgttaccttaagttttattttttaatatatgaatgcgtagaaatcatctttttataaatatcctggttttggtggatttaataccttccctgaaaggagaaataagtataccacgtatatttctattccccaaaaactctggatttttttcataggccacggtttttaatgtattatttatttttgaggtattaatacaattttgtacttgacagagcaccatgatgtatacagtttcatttaatcatcagagcagctccgtttcatccccacttgcacaggtggaaactgagaatctgccctgtccctggacgcagagccaggaaggagtcaagccagctggtccccagccagctctctccacaccaggctcacctccttatcccagctggttttgctgctgtggggcagctcactgtgccagacttttcccacatggtttatgagggctcatgaggtgaagggtcaggctttcattttggtccagtgtttcacatagaaattgtgctccatgcagcagtgccaggtcagagtgtaagtgattccaagccacatattactcttgggtaggcagg

SEQ ID NO: 128096 - DNA, 1030 bp, Homo sapiens
aacgtacacatctcaccaaaaacacttattcccatctcgtctttccacctgtgtgaagtttatatttaaggcctgcagacagctgattcagcttcgaacagatcagttccctgaaatcagccaacatctgtcttgtcccattataccttcgcagaaaatgagaagcgacttccccagcataaagaaggggccaaatgcagcaagacctggctgagtcaccttgaggatagaaagacagcatcatccccggggcctcgtaacctccaacctgcttttctgtttttgaggctctgtggacatgctgctcacgttccttgtaactttgtcttcgtacgtaagagctgcatgaacaaagccttcctggagagagtaaggccaatcgtcagctgctcaacccgtgcctggcacatagtgagcactcaggaaatgttagctgctcttttttttttttttttttactaatcttttcatccttgttattatttgtattatcattactatcatctggcagacagagctggatttgaattccagatctgctactttacagctgtgtgactccaggcaggttcccaaacctttctgaggcttattgttcttttttcttaaaagagaaaacttcctcacacctgtaatcccagcactttgggaggccgaggcgggcggatcacgaggtcaggagatccagaccatcctggctaacatggtgaaacaccgtctctactaaaaataccaaaaaatcagctgggcgtgttggtgggtgcctgtagtcccagctactcaggaggctgaggcaggagaatggcatgaacccaggaggcggagcttgcagtgagccgagattgcgccactgcactccagcctgggcgacatagcgagactccgtctcaaaaaaaaaaaagggggaaactactagcagttggtagtagttttcccttttaagagaagatgaggttggtagggactgaatgagatagccgcatgcgtgtaactcgccctctgccatgcctggcacacagcagctctgtca

SEQ ID NO: 128097 - DNA, 1040 bp, Homo sapiens
accagaatgtgcttctgggtggaagagattcactttttcaaccttgttttcaagtgggaggaatatattctgtatggcccaagccacagatgagaactgaaggggatctgttgagtttacttgtaccaaggtgactccgatacttacttttcgttttcctttccttgtaggtatggcctcacatgtgcaagttttctcccctcacacccttcaatcaagtgccttctgtagtgtgaagaaactgaaaatagagccgagttccaactgggacatgactgggtacggctcccacagcaaagtgtatagccagagcaagaacatccccctgtcgcagccagccaccacaaccgtcagcacctccttgccggtcccaaacccaagcctaccttacgagcagaccatcgtcttcccaggaagcaccgggcacatcgtggtcacctcagcaagcagcacttctgtcaccgggcaagtcctcggcggaccacacaacctaatgcgtcgaagcactgtgagcctccttgatacctaccaaaaatgtggactcaagcgtaagagcgaggagatcgagaacacaagcagcgtgcagatcatcgaggagcatccacccatgattcagaataatgcaagcggggccactgtcgccactgccaccacgtctactgccacctccaaaaacagcggctccaacagcgagggcgactatcagctggtgcagcatgaggtgctgtgctccatgaccaacacctacgaggtcttagagttcttgggccgagggacgtttgggcaagtggtcaagtgctggaaacggggcaccaatgagatcgtagccatcaagatcctgaagaaccacccatcctatgcccgacaaggtcagattgaagtgagcatcctggcccggttgagcacggagagtgccgatgactataacttcgtccgggcctacgaatgcttccagcacaagaaccacacgtgcttggtcttcgagatgttggagcagaacctctatgactttctgaagcaaaacaagtttagccccttgc

SEQ ID NO: 128098 - DNA, 1053 bp, Homo sapiens
ggactatgggtgtgcaccaccacacctggctaattttttttgttttttgtagagacaggatttcaccatgttgcccaggttggtcttgaacttctgggctcaagcagtccacccatcgcggcctcccaaagcattggaattacaggtgtgagccactgaacctggctccaattctcttttataccaaagtgactacagttgctcctcagtagattgagagatacattcctatatggcctttttcagaagcgttgtaacatcaactcatgcagagcttaatttaaagtagatagtatgcttttacttgtttccagctatgatattagactaattgaaatgaacttataggtcctttaaggtaagatatagagaaagcacaaagtgaaatgtcttatctccaagaagggaaaaccgaagagacttcttttggaatatggtaattatttaacctgagaaaattatactttagtaaaatgcttttggtttccttaaaactattgttatgggttgaattgtgtttcccccctgccaaattcatatcttaaattcctaaccttccatatctcagaatgtgactttatttggaggtagggactttatagaaggaatcaggttaaagtgaggtcatcagggtgggccctaacccaatacaactgatgtccttattaaaagggaaatttggacacagatacacacagagggaagatgatgtgaagagacacacagagaagacagtcatcagtgagccaaggagggaggcctagaacagacccttcccttccagccctcagaaggaaccagccctgctgacaccttggtcttggactccagcttcttgaactgtgagacagcgtctgctgtttaggctgcccagtcagtggtgctttggtaccccaaccctggcagattcatatgctatgtttagaaagtggtgttttgtgtttttctaaataaggttcttaacccagccaggcacagtggctcacacctgtaatcccagcaccttgagagtgtgaggcaggaggatcgcttgagcccaggagttcgagacca

SEQ ID NO: 128099 - DNA, 1060 bp, Homo sapiens
caggctgtacaagaagcatgatgctagcatctgctcagtttctggggaggcctcaggaaacttacagtcatggtggaaggtgaaggaggagccagcctttcacatggccagagcaggagcaagagagagtgaggggggaggtgccacacacttttaagccaccagatctcacaagaaaactcactcccgttgcaaggacagtaccaagatgaatggtgctaaaccattcttgagaaaccacccgcatgatccagtcacctcccaccaggccccacctccaacactggggattacaatttaagatttgggtggggacactgatccaaaccatatcagggactcactattttatacacacacacacacacacacacacatatatatataatatgttatatatattatatgttatataatgtcatatataatatatgttatatatagttatatatatatatgttcatttactcctcacaaggaccctatgaaatatgattactgtctccactttagagatgaggggattgaggcagaaaggggttaagtaacttgctgagatcacagagctagaaagggcagcactggcatctgacctagttgttgagaatgcagaaacaatctgaaaattagctcttggaatacagacccctatgaagatagggatggcctacatcaccaaatgccatcctgtctgttttaaagcaagacataggagagctatcagacatcttagatgtacgtggggaaggcgccccgctacaagaaccagtattatctgagtgggcacctcctcccagcactgggtgtaagtggctccgtgccatggagttgttgggtaataacgccaggactggcttgatgacagtgactcacagtagaaaaatgtccttgcaacagaccaaagaacccactttaatttgcacagcttagaatgggccactggttgccctgccaagggatccctgtaccagctgattttcatatccacaaacacacacacaaaagcacctatttaaatattgcaaataataccacattgcatttttattatgctttatag

SEQ ID NO: 128100 - DNA, 1053 bp, Homo sapiens
cagtggtcacctgccactcttggggtggtgcttggacatcgtaggtgctcagcagatattcctggatgctgctcactctgtcctctacagtcctcagcctagcagatttggaaatttgactccataaatttaaggattattgggttctaaaagactggttcatactaactaattctataaaaggctgatggatcaatctgaatcatttaaagagagataatcctagcatccagagaagctaggcctacatatcaaggtattttctccttggtcagaaggtcctctctggaatcccagtaagagatgagaaagttgcttatttagcacagaatttaagcaaaaggcttaagtcgtcatgtacttctaaatgtatttataaatcatgaaaacattctctgctcatgggatacttctcttaaagaacctgcatgggatatctagaatcaaatattcccttcccccctcgacagtgaaaaacctatgacttacttctagacttcactaagattagtgtcaattatctttgtaacatcatctctctttatttaggtatgacatatcatagttataccaagttggtagatattctcattaattacattttacgtcattttggagtcacaaatcatacggcttgtcaaatcctggttttgtaatttttgagggttccttcatttaggatctgcagatctctatttataaattagtacagcataacactcctatgagggaaatgataaatgtgtgtgccttgattctagaaatcacaatctaaaacaccatacaagttaggagtccacagtagtgtgtatttggccattaatgaatcagtggtcccctgggtgtgtgagccatgctatttttaaaaccattgctgacttcagtgataaagagagtacagaatgtgccttcccaggcttgtgagcttaccatgaataatacccatggttatcatgatgtcagaacttaaatattctttaccaagagcacaaccgtggcgtcatggagcatgggaatgcatttagggggcagggtgtggaaagtccatttttc

SEQ ID NO: 128101 - DNA, 1032 bp, Homo sapiens
tgaactttatggtatgtgagttgttatgtccataaagctgttactttaaaaattgccctgctggggatggtggcatatacctgtggtcccagcaaatagagaggctaaggcaaggaggatcatttgatcccaggagtttgagcctggacaacatagtgaaaccctgtttcaaaaacaaaacttgcccgaaacttacctttgtagccaagtccttcatggacaggctagaggtcagatggaaagaagtcagaaaatttatcttgggcgagggcatttattctgccactgtgggagaagcactgtgccatgggtgtggaggagcagtgttcagagaggagtgtcctgtggcctccacaatattcattcaaaatttgccaatgtcttggacatcctgggttccattccctgcccggaaatgagttcctctttttgcctggtagatttcagtgattaataaataaatgttcatccttatacatttaaaaacattttatttggaaatagtttccaagttactaaaaaattgcaaaaataaaaatagtacaaagactacccctatacccagattcccctcccctataccccatatccagattttcctgttatcacttcaccccatttgttttgtcatgcccttgaatgtgctgtctctcactgttgctcttttggttgttgtgtgtgtgcctgtggtgtgtttgtatatacagacacacgaatgatcgttatatgactcgagggtaagttacaaatatcatggtgctttattccggcaccatccagaatggtagctactagccacaagtagctatttaaattaaaactaaacaaaactttacattcagttcctcagtcacaccagccacattttcaagggctgcatagacacatgtgtggctgcatcagacaatagagactacagaacctcttcagcagcacacagagctcctctggacagctccgcgttacccccgatgcttcagcgtgtgtttcccaagaatagggcgctctcatacatggtacagagatcaactg

SEQ ID NO: 128102 - DNA, 1065 bp, Homo sapiens
cgctttatttgatttaacccagcatttcttaaactgttttgacctcatttttttcttcttttttcataataaatattagcacctcacaggacactcagcccagtttggtaagcatggcctccttcatggaagaagaaatctgtgttcagaaatattaagtgacttgctcaaaatcaacacaaagccagacttgaagccaaattttctaactcccactccattgttctttctacaatttataaccatgtcgtggctgagtaagggtttatgacttttaaagatgttgtcatttacattcctaatggaaaatgtaaaggcattagggtcatactgacatgtgtttgaattcaggtcctctgattttacgagctcatgaccttgggggagcgaatcctgccagtctctctggatctctttcttctgtaaggtgaggatgataataatgacctcccagggttgccgtgaggcttagatgagagagtgtatgtaaagatcaagttcacgttcttatctttgttttctctgacatttttcatcataccaggttctgtgccacttatctatgatttcaaaagacgaaccatattacaaacaacaaaacgtgaatggtggtgatcatactgagtatttattgaatagtgactgagaaaatgaatgcacaggagacaggaggagttacctgtgaaaattcagagctatactgaactgatcaacgttcacggaattggagaaataacaaaggtgggacaggctagagtgtggagattaatgggggctgagggaacaggctgtgcactggtaggacatattcaggatctcaagctacctgcctgccacttctgcatccccaccgcgtcaaactgtggttgagctttctttattaaatatgtagcagtttgcttttgaaatacaatatcttcaaaaacaaaaataatgccaggcctgccaacaaagtttgtcccgagggggcaaaggtgaaggacaagtgaaatgttgcaagaggacaggacgatacgaaggatggggtccagagtgaaagaagaggcctatgaggctcagcacagt

SEQ ID NO: 128103 - DNA, 1180 bp, Homo sapiens
gctgtcttttccaagcactcttaaactcattgcaggcaagattaaaccaagcaacaaaagacatcaagcgatgcagggtaatacgtgatgagcactgttaggcccaaagagaaaaccctgaggtccccagtgacaagggatgcatcatttgatctggggtttgaaggatggtcttgatttggaaaggtggctagggagcaagctcgaggttgccccacacaggggtgcacaaggcccggctgggggacagtgggtgtctcacttgggctgactggaacaagttccaggtcacaggtttttttatttgaatgtaattatttgactgtagtagccatcagcagatggagagttcagagggactgcactgaaataatgaataatttgcagatgcagttggtagccctggtgtcttggtgtgcctttctgttccagcaggatgcgtgcaaagagtggctcacagccccatctgctctgctcctcctggctcgagctttgctttaataacctctctgtcacctatttacacgaggtcatccagctcctctttttctccttttctgtgttgaaataatcgtggctgctacttgctgtgaaagacttaactagtagtgggtaggattgacctctcaattcagtaaacatttactgagtccccaggacaatgcttgcagtgagcatgcagaggaggaggtgattccagccggcaagtggaggcagagctcgagccagcaggcctggccactgcctggaagttggggggtgaggggggtgtggaaggtgagccagggtgcttagcctcagccactggggaatgcgaatgatagtcctgggggaaagagaaaacaagaggaggaacagatttgtgggatggagaacagtggggtaatgagctccatttgggacattttaagtttgagacaggacattccctggagacattaagcaggcaataaaaagacccccaacttagagtcctcgaggccctgcggttgcagtgtgaaataatccggcttcagcttccttccctttccttctcaagtggttccccatggagtcactttagactcggggggaggatagttgcttcctcagtctccctagcctttatcctcacacttgaatgctaaatccagaactcctcattcctgctaagtagttcaaaagctccaagggatccttg

SEQ ID NO: 128104 - DNA, 1056 bp, Homo sapiens
gctcatttctgcctcgtttgtcacctagattctctttacgatgacatctaatgtgcagaagtccagcccgtagcagcagcatttgactaatgtgggaagttcaggaattttgagcctggaaagtcctgggaaggaaaatccctcatgcttcagcagggctgtgtggccggttctccatgtgcttcagcagagttttctttctctttttcttttttttttttttttcagctgtgaaaaaagcagtgccagctgtttggtaaaatatgggtcagtgagaaataggatttgctttatagaagttaactttggagaatcgtgtcctcaaaaagaaaagaagtctaaagataggaggactgagggaatcctgggtgtggtgatcctaaccccataagttagcttggggtgctttcaggaagattttggtttccagcagttcagaagggaggtgggcatgatttggtgcagaagggggagaggtgagggagaaaatcacatgcagacacgttgagtagtgataaaccacgagacagactctgcacggccggacagagggcatcttattagagtggaaaagaatagtattttattttgctgtgaacaagatagtttggggagtggagaagagctcccagggtgggcgatgacaggtgtctgggggacactggagccagtggatgcagcaaacagcttggacttcagtcccttttctagcaaaggagctgcccctgtggggtggggggctgaggaggttggagaccatttgaaatagcttctgagcatgtgtgtgcacacaggcacatgcatggctggtgtctcttagagaaaaggtatttagagaaaagcaaggttgtgagtggcctgagagcagttacaattgattttgaatatggaagcaattctacctaatccagagaatatacaaagtatactttggaaaggggcagtaaacttttctggttggcctgccttcctccctccttttcttcttccctttctctcttcttcccttcctcccatccttccttccttctgtgatctttgtgggagagcaagagc

SEQ ID NO: 128105 - DNA, 1007 bp, Homo sapiens
ttgcttcaaaaactgaagcaacaaaggcaacttgaaatgtttcctgtttatatggctggtggttgcatttctgcatcctctgctctccttttcctcctcaaccttggtctcatacatatgattgcttcctaaagcaaagctgatgaaactgacccatttcctgttgcttgccaaagtagttcagtaaccagtatgttccttctgctggtgaaacctgacagagaacctggtaattctgacagctgttatgttttgtgggtttcagccactgacttccatggcctctcctaccatccttctttgatggcgtctctgctctctgcttccacctatttattttttcccacttgtctacccacagagccaggctcccttacctacctgtttattctttgactgtgtgttccttgagcgtgtatttgccttgttttacttgtaggtgtgaaggtctaagtggatgtacacacagaaccttctttggggtgtatttgtgtaagggactgtctggaagaagtggttcttcaacctttttgcccttcagttctctggagggcttgttacaacagattgctgggtttcacccccagagtctctaattcagtaggtctgtggtaggcttgagcatttgcatttccagttgaggaccattgttttggaagagtacattcagaacaaaaagtcagaaatatttagaatcagatggtggttgttttggtgaaagcttttcttggatgtgagagagtcagggacctggccttagcattcttcgcaattctactgccttttgtggctgtgacttccagaagccataggcacatgcagatccagcctccgacttcctctcctctcacctgccttcacatcttctcagggaaggtcacaaagtgcaggagccactttctcttgttcattcagagccagctggtctgtgtagttcatccagtttggtcttggggccccagaataaaatgggccaaatatcatcctcacaatagtaatacactatt

SEQ ID NO: 128106 - DNA, 1041 bp, Homo sapiens
aaatggttaagtttctggtagagagggaaattaatttatgtagatcaattttgtggatagcttctttccaaggatgtcggataaatgaggtattcctatagaaagagacaacagcaataggcaaagctctggtgttggcttaacaaggtgaataagcagagtgcataatggaattcatttgcaaagtaatttttgcttggctggagtggtaagcacaaaatagactagcagatgagaatggtaagtgtttgggatcagttgttaaaaggtttaaaaggggttctaattcaagtgacattttgtggtgtggagaaggggaccgatattatcagaatgatacttgaacaaggtaatttttactggcctgggtataatagaaggaaccagacagccaggggtgggccatgctggtaggccttgtggtgcggtggaaggcactgcggccgtggagatggaggtgggccatgctgggaggccttgtggtgcggtggaaggcactgcggccgtggagttggggcagggctgctgttggggtggtgcaggagaacacgcatcgagcacttgtcggcttgcctggtccagaggttcaataaatgttggtttctttttgctttcctccccacaccttatggcagtgatctaggatcaggaaaacttgctgggattggcaataccatgatgttctgtttttctaaagaatctctttttgtaggctcactcgcatttcacagaatctgactgggtcatagtataaccctggtggggtcttcatgcgttattattcagtctttgacacatgagaatctgaggccagagcaatgaagaggctgttccaatgttatgtgtgctgggggagcagagctagggctcttcctctcccttcccctgtagcagtgtgcacagaagccccagaacactccagaatgccgagtggagctttgctaggctgcactgccaggtggggctccaggtatagtggttcctaccaggctgtcagagccacttcctttttccccagaggcatacggaagctcctgagtt

SEQ ID NO: 128107 - DNA, 1042 bp, Homo sapiens
acttgaaagaagagcaagcacacagaagaatcttgatgattcagagcagtgtcaggtcatcctcatttagaagggaccgtttgtcaaattcgttatagattctgagtcagctaaagccatacctgttttactaggttctccaaggtgagtgagctaggtgtttatgagagtggttacaagtcagactttcagagggtagtcctccctctctttggtttaaagccaatggaaaaggcaaaagatgtaatgaacgacatcactgcaggttgtgttttttctgacagatatctttgcccttagaaagcaagctagtaaaatcattgccaaaaaagaaaaggcagaaaacctttgaaactccaaaatatctttgtggttttatagctacttatttctgaatacagcattgaacaaatttgtaatgtttttgacagtagtctgttttaacaattcttgcctaagtacttttgccttagtaggttctgatcaattaaatgccactgtgtttaagcagaattaagattgatcaattcttctgcatgtgttaatgctgtcgactctataaaaacctttgtcacaaaaagaatgcagcctaatatgtgagtggacaagggtatttttcctccaggtggttctgtccatccgcagtgagagatcaccatagaaccttccatgacattgactacgaaagcacttctggcttcacacagtcacagatttgcatcttgaagaacaaagggtttgtttgtgtatttttaccattttccttcacactaatatttccctgttgattcaacctatggaatcgttattcccaagtaaaatcattcgtccaagggcttatgataagaagccagctctatacaatatagaacttatagtttcatagcattaaggaagcaaattttaatggtgtttgtgcctggatttctgttaaaagtcacagggttataatgccgaggttgtgagtattaaattaaaaaattttaaaaagtcacagggcagggagatttggaaaactccagcttattgccgattgtggaaa

SEQ ID NO: 128108 - DNA, 2429 bp, Homo sapiens
attaatggagcgttctgaaccgccagagatttagacagaaatgctgtttttgaaacaaggggtatttgataataccaattaatgggtggcaaagagaatcagtcttccagggcttgcttgaaggataggtttataaatagcatgttagtttttggtggtttggaactgaacttcttataaaaaggtttattttctttagaaggttaaacatttgccttgtgattgtatttcctccatcaacttgctttgcgaggctttttcaatatctagtgcaaaggccaaccaccaaggtctctattatgggttctgaatgagaggagcctaaattccaagttatttatgttttcctctccctgagatatgctgtgttgattactattggcttatgtaaaggaacacttcacagacttccaaaaactgtctgctgcaattcatcatcagatggacctgaagatgcctatctaccaagctgtctaccaagaaatgagattctgaatcatcttgggttagcagagtttgatgacacatgccctaaaatatctgttcctgtgtttaggttttatattttaaaaatgagtaagtataaatgttgcttttcttctcgccacatttgagtagtgagtaaggtgccttaattttatccttgatttcagacaatgtgctatgatacttgaatcagagaaacctgagtttgaatctagtgatacgactttgggctttattggactgtgcaggaactccattagaaactagtgcacgtaaagtccctggctgtagtaggcatcttctcagagtgtgttaaatccctctatcttctgagatgcttacagacatgatgactccagggaaagaataacccacaaatagtttcgaaaaccaataatagcaacatttcaattattaatctcctgcgattccctttccagtttgggcaccagcaacaataaaccccctatagccatagaagaaagaaccttctttttactccctctgtgacctttccagattctttatttgcattgagcttctgctggtttcaggtagagaatttctcttctatagtggcactttctgtgctacttgaaaaatgtggaaataaactgctggggcagagtttcaggggctgcagctgtgcctcttggaaagtatccccaagtatgaaagataacctttgccgttaaccaagatccattcctaaacaaggcagcaggctgggcaagggagcacccagaggtggttcaccaagagcctcctccaaggggaggctcctcgcccaccacaagccagggtctgcctcaccatgcattaaacatcattttcctacaaaagacaatttggtgctttctgtaagttacaggggctcagattctttgtattttatgttttatatttcttcatctctctctctctcccttcctcccatagagaccagtcttggggaaccacctttgaggtttgtgtggagcaaagtagtgatgatcaagagggtgtgatatgtgagcatttcttattgttctctgaacgtgtaattcgcctgtgctttctggtagtcttattgatgacaattcaaggactttgggttggtgtcaaagacgggcttcagaataatggcagtagactttatataaccaccgatgggatgtgaacttgaaaggcccaaactcgcaagagttccatttcatatagctattctcttttgggggaaaaaagaaaagaaaaacctacagtataggcagatctttatttttcctataaaagaaacccagatgcttgagggtcacggtgatcactgtgacttaggccatattgactttgtgctgtgcaccgccctgcgcccttcacccacatgaactcaaatgttccacctcttgacagacgagggcccatctttaacgcattcattcagcaaacatttatgcaggacctgctgtgtgtcaggccctgtggcaggttctgggtttgtcgaaatgacaaaatcttaatccctgtccctgactttacagggtgggggaagtgaaagaagcatagactcactagaccatgggtctgattcaagatggaattttttcttctcctttttttttttagtggcagttcatacttctaacatgcctatgctttcttcagctagaatgggaagacttgggtaggcacagtggctcacacctgtaatcccagcactttggaaggctgaggcgggtggatcaggagttcgagaccaacctggctaacatggcgaaaccccatctctactaaaaatacaaaaaaaaaaaaaaatagctgggcgtggtggtggtgcctgtaatcccagctacttgggaggctgaggcaggagaattgcttgaacccaggaggcggaggttgcagtcagctgagattgtgccattgcactccagcctgggcaatggagcgagagtctttctcaataa

SEQ ID NO: 128109 - DNA, 1048 bp, Homo sapiens
tccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaagtggatgaagactgaagctcatttttctgcgtctattgattgagcacctactgagtgccaggcgtttttctgagagtcagggattgcctttgttca

SEQ ID NO: 128110 - DNA, 1049 bp, Homo sapiens
ggagtcctggatctggcaagcagccatgtggcgtcaggctgccagcctgtcactaaaaagtagaggatccacctgtgtaggagcactttcaccccaaacacgatagggctttgtgagcttgcgttgcccacttttgtgcagagaactgaatgaatcctctttaactctcttttataccccatatcagaagctgacatatctttgtggtgtttctttgcagaaagaaaagacagttcaggttctgtgtccccaaacactcttagccaggaggagggtgatcagatctgtttgtaccatatccggaaaagttgtagctttcaaggtaagttggaagaggctccttcattccacttgtgggaggggtaactgcttgtcattcccagagctgtgctctgaagtcaccccctaccaaacctctaccccatccggagaggatcagggcttggcactttggccaaaccaattctgaaggtattttgttggggagttgaagatggtagcaattctttgagttttcagaaattaaatgtggatcatttttgggaacataactggttcatgcaccaaatgagtgtcaagtattgagccttggtcagcttagcatgaggtcacagacctgcacaggacagggaactgctcagcctggtgggaacaaagataagggtgatgataggctgagagctcccttagaaactggaaaggacctcactgcgaaggaaacacttgtgttagctcttggaggatgagtagttgtttaaattggggttttttttctgtattgatccagtgaacaatccagtgatctcttttttatcagaagcagcaattctggtgtgcatgtgcctgtctgtattttcactaaacctttgttttcttcttaaatgctgtcctgggctttgactgaagaaaggtttgttctcaaatttggtgactccccttgacaaccaccaaacttcttgtttcattttcagtttttaaaaattacccaagcaattaatgaatactttcactctgtaaaacagttcagtaatacagagtgaagcatgaag

SEQ ID NO: 128111 - DNA, 1611 bp, Homo sapiens
ttccttacctagaactatttcttccttttaagattcataagtaaccttttatttttacagagctacgtataacttccacattacagtcagggacctgaggtgtaacttactaagtgaaccccaaggttattttatcttgcaaaagaaacctaaaccaaactaagggccttacagtttatggttagactgaatcaaaagctataacctcaatttttccaaaaacagcttctgactgcaaaagcaagtcatacagttgttaggtatgaaatagcactgatcaggaaatgcatcttcgcagatggtatttccttcagaaaagacttttctacttttaatataaattaagccataacagtttcatgctgtggaaagagggtgaaaaggttcattttaagagattatataatatgaactttcacatttactgtgaaatgtctaactttgccagtgcttcagcaagtttttttggggggtgatggggaggggtagtattggttttagaggtttcaaatctgtgaactttggagaggggacagttgttggctctggtatttactagttttgtagtaacgttttgctagcctgactgacttttcttactggtttttatgcccacggtccgaggggactgttcttcttgttgggggtgtctgcggaatagcgtctcgtcttgtttgtataggcagtcaatgtgtgtgacatgtgtgtcctttcagtccggaagcccactgtgtgacaatggcgtggggtgtggctgggaggtggggtgctgaagcttgaagagcatttctttgctgattcataacagtatttcccatcttttgcctgcaggcagggaaagtgtacagtatttattttgtttctgttttactttaaatttgtaagtctttaagtagcttacattgattattataggggaggacaagtgacttgtttaaagttgtatttagtattctttccaatttctgtattttaaaatattgaaattaaaattgtattacttctgttttgatttttttagcacttagtgtattttttgctcattttgtttgaaagtataaatgttgaaaattgtataaaatgcgtccttgaaagaaaaagaatctgaattctatatccaattctgactttgttccctttttctgctgattgaatcatgggaaattatttaaaagtatgaaaaactgggttcagcgtctgctccttactacttctgaagacttcaatgtgaaaagtaattgtcttattttattagcagtattgctggggatgagtgattgctcaaagagagggaagaatacaaaagtgtaattggcaacatgaggctgaaacgtagaaacggatgtgggtacttggctaatgaacatttcagcacactcacagcccctgcccaggcatcccacaaatatttcctaacacctgcagtacagtaggcactgttttagcactagtgctgcaggagtgagcaaaaccaagtcccaggcctcaaggagcttgtgtgagacacaaaaggcaagtgagagccaggggtgtggtggcctggctggctggtgaaggtgagagtgttaagtgcacactccgtgaggaagatgagctcagttttggactcag

SEQ ID NO: 128112 - DNA, 1619 bp, Homo sapiens
gcagttgtggtctctgcccttgaaggtatcttctccaggaaattagcagtattattttcacttctaagcaaacatgagcaaaagaggacctgttcattaaaaaacatgctgacttttttagtttcaactgagatatgccactgtagaagtgaaagtaatttcacaattaaagaaatgcttcaacttggtaattaatatggtcatacagggacttggtgtagcatgcaaggaagcagaagacctgggcttttgtcgaagttctgccatttaggtatcagctgtgtaaccttgaataagtcacttaactctttctcttagttttctcatttgtaaatttggattaaagtgtttattatgataatcaattaagaaaatctcttaacacttcatacatacagagaacttatcattaagttaaaactggcaattaatgcacctttatatatatttttaaatgaaaactaatactattcatgatgtttattttatatcaaatatatgcccagggcatgctactttaaaaatccgaggaatctccaacaaggtgctggattaaaatcagatttcgtgcttgaagtggaagaaaaatgaagttgtttatggataagagagtgagaatgtgtatcctcaagtacgttaagatgatttaactgaaagatggctttaggtttttcttgaagaattaggaaagtaccatccccacagattcagcatactcttcaggtactagataaaggtgaaggaagtcatggaattaaaatgacttagcaactccccagggaacttgtggggagaatgaggtggttagaaaggtgagaatgcacaaagacagctctgggttgggtaccaacagtttgcttggtagaaagaaaccagtgtaggaaaggagacgccaccagacatcttcaacagacaagattctttctgcctttttcaaaagatgctctctgcagcagtaagactatagatagagttgattggaatatcatgtgacccagtatgctactgctaggcataattatcaaaaattcatttttctcattaaatattgttaattgctcgccacataaagagaagctagagctcaccagtcttggtggtgtcctagaccttcctctaaagcagtcttgggaagctggatcatcagatctttagcctagacagagtgtcgctggtaaataaaggagacacaggtaacccagagtggacagtgatttgcgtggggagacacagtggatctggggcctctgatactttgcttcctaaaacagcccccagttttcggcttgccctatgagatgatgttcatgtgcttccttgaaaccaggtggaaagaaaggggaagaattaattttctcattctgttgctgttgaacgtaatgtaatcttaatactgtagccttcctagaagcccttccctctttttcatgctgtaaagtcaaatatttgatatccttaacataaattttaaaaattaaggtcattaggaagcaaatgtctatttccaaagcaatgagcttgttgtgactgtgattttattcttctatagtatttttttcctcattttaactgagaggagaaaataatactcttttgcaatatccttaggttctcccctt

SEQ ID NO: 128113 - DNA, 1932 bp, Homo sapiens
caacgtcttgggaagatccttaagttgaacagaaatggccatgcacgtttctttgtgtgacagagctgctgttgcagccattcttccctttggagaccagtctaggggtgcaggagcctggagcttccgctgtccccctgcctggagcagtttgtgtgtatagtaagaacactgcccgaagaacagaatgaacctgatgctgcattttcactgtgccacacccactcagcaataaccattttggacctggtgggggagaggaagaaggagggtagaaccttaaaaagagaccttgaactggaaagggtctcttgtcagggcttgaattttattttgttgttggtagtgtcttgatgtattttcagtggtagggtaaagaattatcaataatttatttaacagatttttttttaaagttaacagcttttaaattctttttttaaagctatttatttggaagatttctggagaaatatctcactaatttagatgtaagaatgtgaaggtttttaaattatttttgatagtgtgtgtgttacatgtggggaagggccacagtaacagtaactagtctggactcttaaatttgatattcaggttaaagtcttaaacagggatttgatgcattaattattttaaattaagatgtatatgaaaatcattttattttatatatttcatgtgttttttataagctattagcttcgcttttgctaacatccaaggtgcatactgttatccaggttgattaccttatatcccaccttccctctgcactccccatcattttgtgatgacccagtaagactcttctctttgcagggaaacactttcgtagccaatgtgtaagaactccatgaaagatccctcatttctcatttcgtttgacattgtgattttcttctcaacattaaaaaaaataggcttttgcattttcatttctgctgatgatatctgggtcccaaagagagcagctttaatatatttttcctacttgtgggaaaagtattataagtttggttaaattgtcatgtttatagtttttccaagtacatttgtaactacagcaggccttcttcgtactgctgctgttggacaacaggactggcacctgctgcagaggttataccttatgatacttttatgctccatacctgatttgttgggaaatgttatttaggatattcaaatctgcatcataagccgtaatataataggattaatactacattaagttgtatagaagcaagcatgttggaatagatcttttgtgtgtatttactttttttatttcttaattttctaaagaattacttaagatatggatttggagtaaaatgggtgcttttggcagtttcttccatctatcctaacctgaccagtacatattgaggttaagtatctggttaaactttaaggtattcatttatctcctttatgtatgatttttactaaatgccagttttcatttgcttatagtagcttctattttcccttttttccatccatggcataaaaataagtgatttctgggggtggggcagaaatgttcccaagtctgacaatagagcattttacaaattcctacaaagaaaatataggcaaatagataaaatttatttttatggagaagaaatatggccatattatggatttgtcttttttttactcagcaagatagcaggacttacccttctctattaagtatcacttgaattgctaagaagaaaaaagtctgtaccatcatctttcatggttgcattcaaatgtatattttcaaagagaaatacttcttgtgtccccattccaaaatgtcatgggataaatatgaaatagtttatgaagtagcctttctggttcagagtgactggaccaaagtctgaatcttatctgggtatcaggaaaaagaatttttatggaaatccttagtgt

SEQ ID NO: 128114 - DNA, 1050 bp, Homo sapiens
atctaaggatttcctagcaaaaaaatacagtggagatgaacctgatagaagatagactctagaaaagaacatgacacatgagaggtccaagggagctgtgacttgccagggaagtgggagatcgatccattcccccagctcagggtccctgcgttggcatgtgctcactgagctgagtagcaagtagggcgtggtgcctgtttacgttgttttctctcactctctctttcgccttcttaacttaacgatgcaacttaaagacccgagtccttcagagctactgagacgacatcatgcaggagtggtcatccgtggctaatagatgttaagaaaatcagaattcagtagtttgtttcttctctcacttgactttgccaatgcatagagagcttaaatacctcatttaaaccctaaaaattcagcctcatgtccttcctcctccttcaggatctaagtagaagccagaaatgcatcagaaaggaaggttcatcagaaattagtcagagggtacaaagtaggaattatgtggacagcagcggctcaagccttcagaatggaaagtatatgcagaattcaaacctgacttcgggggcgtgccagataagtaatggcagtctaagcccagaaaggccagttggtgaaacttccttctcggtgccccttcaccccaccaagagaccggcatcaaatccaccacctatcagcaaccaggcaacaaaaggtaactttcacacatgtatagagaaagtatatttctgactgtatgtgatggtcatcatggcagttgaggtgtagtctctgcactcaagttgttcaacatctcatgcatagtagacagcatagtgatggcagtatacacaggctactacaggaacaaagaaaaaggatacccaagtcagctctgaggagcgagagacagatcctaaaatcagatgttcaggggttagccaggctgaattggggaaagtgacagaatagacagctttgaaggcagaggattgagcctgaggcagggcacaaaggggagaagcaggatatggggtatttgtg

SEQ ID NO: 128115 - DNA, 1027 bp, Homo sapiens
ccagcctgaccaacatggagaaaccccatctctagtaaaaatacaaaaattagccgggcgtggtggcgcatgcctgtaatcctagctacttgggaggctgaggcaggagaatcgcttgaacctgggaggcggaggttgcggtgagctgagattgcgacattgcactccagcctgggcaacaagagggaaattccatctcaaaagaaaaagaatttgattgtagatcttccagcatctagcccaaaacccatcatataaagacagtctttgaggctggtctgagtatggtgtttataactatttgatcacaaacaattacagatttctttgtttcttctccatctcactgcttcacttgactagagaatgaatgaataaatgaagacagtctttgagagaatcaaaagaattagcataataggttatgaattggtgactttttgtttttgagggaaaggcatatagtgaaggtaaaggtatgcaaatgagtatctaaagagttaatgtgtttttaaatacaatgtcaacataaatttgcttgcttttttttttttcccccaagatggagtctcactctgttgcctaggctggaatgcagtggcatgatctcaactcactgcaacctccacctctcgggttcaagtgattctcgtgcctcggcctcccaagtagctgagattacaggcgtccgccaccatacccaactaatttttgtatttttaatagagacggggtttcaccatgttggccaggctggtctcgaactcctgacttcaagtgattgacctgccttggcctcccaaagtgttgggattacaggcgtgagccatcacgcccaacctgctttcatttttaagcattaggctaattttgtcatttcaaatcaagtttgtgcaaagttaattaaactaaaacttctctttaggataccatgtcaagactgaagatccagacttgaggacttcctcctggattaaacagtttgatacttccagatttcatcctcaggtatattcaaagtttgaaa

SEQ ID NO: 128116 - DNA, 1061 bp, Homo sapiens
gacgagcacagaggaagaagctattcagggcatgctgtctatggcagggttgcactattccacgtgtttacaaaggcaaatacaaagcacagactgcagtggtgaaagaaactctctccaggatcccagcagctgccatggcagtaaccatgaggttaggcagttgtatcgctatgataaaccagtggaatgtggtaagaaacataaattatcagtctctaaaaagtaacatatgttgcccaacttaatggctcaataatcctcatttaggttagagattatgaataagcatctttaattggaaatgtgttaagaaggttgaccaaaaaaagcacaatgctgacatatcacgtaagatggaagcagaagaactcaaaatgtaaattacctgggattgacaattgtgttcactagcatcattctaccattgttattgcaagccagttagtattatttcccttttacagacaggttgatcagagtggaaggagtgttttggtgccttaaatggccaactaagcttgaacaatcagccctttttccttttatgagaggaaaaataagttttaaactgtttctttctgattgaggctattccttctcctacttgaaaagaaagtattaggaaaagagggtagactcagtggcagtgttaggcatgccacatagtgttttcttccttgtgcctttagagaaaatgtttgtatcccaaaaagcctgaggaggaccggggagaagatagtactatattaaaattgaatgcctatataataaatatgtttgatcctacataattatcaattgtataccaggagcttgacatccatttcactgaaataattttttttattatttatttatttatttattttgagactgtctcactctgctgcccaggctggaatgtagtggcacaaatatggctcactgtaacctcaacctccaggcctcaagcaatcttcctgtctcagcctcccaagtagctggaactatagatgcatgtcaccacacctggctaatttttttattttttgtagagacgaggtctcacctatgttgcc

SEQ ID NO: 128117 - DNA, 1104 bp, Homo sapiens
gtggctcacacctgtaatcccaagttgatttgggagtctgaggtgggaggatctcttgagaccaggagtttaaaactagcttgggcaacttagcaagactccatctctacaaaaaaataaaaataaattagctgggtgtggtggccatgcctgtagtcctggctacttgagaaactgaggtgagaggatcgcttgagcccaggagttcaaacttacagtgagctatgattgtgccactgcactccagccagggcaacagagcaagaccctgtctcaaaaaacaaaaacaaaaaacgaacctcagatccctagcgcatactattgcacagttgaatgaaatatggggacagtgtctcaattctctactctttgtaaattaagggagaggggaataaatactgtttggctacagagtcttgcactatattctgattacttttccttcttaatacagagatgaaaggcagccctttgcagatcaaagtctttatacagcagatagtgaaaatgaagaggataaaagaaggacaaaaaaggcaaaaatgaagatagaagagagttcaggagtagagggagtggaacatgaagaatctcaaaaaccactgaatggtatgtttttttaatggttattttaaagatcttttgattactaatgtgataatatgtaaagtaacttgctaattttgaagttcttaagtttaaaatagcagaaaacttttgtgtccctaaaactgtcttgaaaaatctgaagtatgagagaagtgctgaacgtgaatgcccagtgaggtatacgcccagtggccaggggcggtgttctcagtgaggggatgtttgtgggttagagctgcactcatctagtcagtttttaaagagtcacttgaaagctcatgcatgttataggcctctactccccaaaataaaagtttcaagtttcgtttaattttatatgtaagttcagctaccatgtgtatggttttcagaattaggaagtatatatgattagctaatctgaagctgttagtaatccatgcattgtggttttaattgattacctgttgacaagaaggcctctactgggttattaattggttatcatcagtatgg

SEQ ID NO: 128118 - DNA, 1053 bp, Homo sapiens
attagctgggtgcagtggcgtgcgcctgtagtcccagctacttgggaggctaaggtaggaggatcgcttgagctcaggaggtggagattgcggtgaggcaagattgcaccactgcactccacacactgcagcctgggtgacaagagcgagaccctgtgtcaaaaaaaaaaaaaaaatcaaggaagtatgttcacagtatattatgttggagagagaagggatataaagttctcagcaaagctgtttgaagcttaggatttagtcttttttgtgtttatatggttaaactgaatggtttttgttttctgaaatatttttatggatgattatttagtcacgtatgtgtgtaacagccttcttataaaaatactctgattttaattcttaaaggaggaaaacggcaaaccagttaaatctcagggaattcctattgtgtgtccagtttcacgatcctcaaatgaagcaacttccccataccattcccgaagaaagatgaggaaacttcgagatcataatgtccgaactccttctaacctagacatcctagagctccacacaagggaggtcctcaaaagattagagatgtgtccatgggaagaggcaagtattatgtttcatgacaacaaaaagaaacttggctgttccttaaagtctttatagggataataagagaatagtcttgactattgttgatatctaatcttggctgcagcattgtagggatcaaccagtagttatgcctgtgacagggagtggtgcttaatctttctaagttttagtgtagaatttgaatgaatagacctcattcgattgctgatatgtttattgagtctttagcaagtaccatttcctcttctaggctctggagaagattgtgagcaaaacttaagtccctgcccctcatgaagcttccatcctagttcaagctggaaggatggggagacagagacatatactaaaataatacaatttcagatgataagcgttatttaaaaaaaacccaaaacaatagaacaacagaataaagggggatggggtaaagctggctgcttt

SEQ ID NO: 128119 - DNA, 1015 bp, Homo sapiens
gaaattatcctggtcaacttgcatgctaattccccaatgagtgatgtgtttttttttgaaatgatagccttagaatattttaggtgttacaaaagtgaaagggaaaagtcagtctcctcattttatgcctgagaaaactgaaatccagacagtgttgcacaatttctacatgccaatataatgtatttttttgtcattatgagctgtacaccaagatatcattagtatacagaaagctttgtaagccatatacacttttatattcagtgtaaattgtgcagctctgtcttactgctttccttttcctctgaaaaatgtcccttttttcctgaaaggtccagttgaacttgagaaattaagagtatagggaaaatatttgtctagactacatagttttatagttggtttaattatcataccaagttaaaatattttttgattagagcatctgctgatgtaactcttaagtccaataataagactgtaatttttctctgcaggtggtgacaaagtgatagatgtcattgatgtggcgaggcaggcagacagcaaaatgacacttcacaattatgttaaatacttcatgaatcctaacagaccaaaagtgttaaatgtgatcagccttgaattttcagatacaaagtgagtagttctgggtattttggtttagcattctgagtgttagctaaatgtagtgtaatgatgtatttattttaggaagaaacatagttgtgacttctaaagttgtccagtggtagcaatgttataaattttgcattgggacactcagagatacttagaaataagatgtattttaaacttttggctgggcacagtggcttatgccttaatcccagcattttgggaggccaaggcgagtggatcgcttgaggccaggagttcaaaaccagcctggccaacatggcgtaaccccctctctactaaaaatacaaaaatcagctgggcatggtggcacatgcctgtaatcccagctactcagagaggctgaggcacg

SEQ ID NO: 128120 - DNA, 1821 bp, Homo sapiens
tatcaagtggcttctggtgtttctacttaacttaaatctaaccgttcattacaactagttgtaagcatcctattattttatgatgtcttctagtgtagtttacatactaaaatacaggttgagtatcccttatccaaaatgctaaggaacagaagtgtttcagaaatgatttcagattttttttttcttttggaatatttgcattatacttagcagctgagcatccctaatcggaaaatctgaaatgctccagtgagctcttcaattctcaaaacattttggattttggagcattttagagtttgtatttttggattagggatactcaacttgtacatattttactataaactggttggttttttctttttgcatttagaccagtttatatatatttctaattatatgtattgaattgtgtatattacattatctataaattttagtttaggatagcaaaaggagatttacaaaacatttgtcattaaaagaatgagaagtgataggttaagaaccactgatatagataatccagtatatgaattaacccatcactaccgtattttttttaaactgaccttaccaataaaaatgacatttttattcttatgtttttccttagtgccgatgaaataattataaagatgcatggcagccagctgacacaaagatatctggagaaacatggatttgatgtccctattatggtcccaaaattagatgatctaggactcaggctcccttcacctacattttctgtgatggatgtggaacgttatgtaggtacgaactttatttctttaagtacctgggaaaacatggtaaaagtaaaaatgatagtcctggtaatattaatggttaaatgaagaaatgtcaatttagttttctgctcagaaaagtgaggctcagtatcatctatattgaaaactagtttttctcagcagacctacaactgtcagaaaaacagaatgacaatttacttgattttatttactcagcttcatcctgctgctttcttttgtgccattaagttctctgatacttgcttagggaaaatcattactgagggatagatatagataccaggaagaagatattggaaagttggattggttgtaggcatctgtagaatacaggtgcaaaattcccagatcccagtacaccagctgcacagttagtcctctggagtctgctttgtgacctgctgctgcttagaggaaaggtggtaaaaagagcagatcattttcaaatctgtttttataataatgacttggtgaatattgccatttaatgatgtctggacttaatttttgattttgaaaattccccaaagaaacagaaagacatgagaaataagggggatcccctataccccttgccatgttgttgacattttcagtcatttcattaattctcgtgatatttacagataaagctgactatatgtagatgtcatttcttgtcagcagtagatagagaatatttgagattagattccaaatctattttgactcaaaattgtatatttactatattatctcctcagcatggaatatctgagaacttgtccctttatcgagccattggttgacaattctcattgattattgtttcactgaggaaatctaactaagtattgtaacttcacattcagctaaatttgaatatttgacaagtgagaggatggggctaaggattaacctgaacctatttgcgtagatagcatctgcaaaacaaatagctagtgtaatacatgtgcaggaaaaaaatgctcaaactgcttgatagctaactttttggtactgcagagcacttcagtta

SEQ ID NO: 128121 - DNA, 1028 bp, Homo sapiens
gactactcaaggtcatagccttccagagctgtagaattacagggtcttagcattggaataaatgatgaagttatgtattttgtcatgctacccgtctttctttaattatgactcagtcacctgctcttctttatgtcagtgtaactgtgcttatttagggagtaagtcttcacatgaaagaggaaggaatgatgctattagaatagatttctaatgtgagataaaaggccctgtcctgagaagacgatttggattatctggataatcatattaggacctaatgttctgatgaaaatcataattgtatataatttggaaattgtatagtatctataagtgtggacattataaaaggctccatctgctgatttgaatttgttgctttaattttatatgttttgaaataaaaagagtaggttttaaaaatccacagttaattgtctgtaattgcagcattacattaagcaaaattctcaggcctggaaatgcattaaaaacttgagtgtttttaatgtacttacaattgttatttctgattatgtcggatataatgattagaaatcacatagtatcaccagttaccaaaatcatttttttttaatcttttaaaaatccagtgaaaaaaaggaggaactggcacagacatgactacacagaaattgatgatggttccaaaccagtgcaagctggaactagaactttcattaaggaattacgctctcgagtcttcccaaggtatggaaacttactctgataaaagaaaatgtaagaatgtaagaatgtcgtctcatagagtgacattatataaaggcaatgttttcaaacttaggctgcaacccattattgtcctcagccagcttttcaccttttttcttccttaacgaaatagaaaagtatcagtacattccaagaaatagcagtaagtaagcatattttcatggaacttttgttacatctatgtgcacactgggtcaccctgtaaaaacatttaagtgtgggccacagtccaaaaagtttgaaatacacta

SEQ ID NO: 128122 - DNA, 1039 bp, Homo sapiens
tgaggtagatacatagctcattaatttcagcctctttttttctagcagatgcatttaaagctatatgtttctgtttacaagtgcttcatcccacaaattttgtcatattgtattatcattgttcacattttaatatgatttatcttttgattcattttattgacatttaataacagtgacatttacataatggttgaggattttatggcttataattgcagtatttctgatgtctctactgctgctaagagaggattactttgagtatagtatattctccctcacactcacttagcaagtttgtagagaacagaataaaatttatctttatatgtgtttctgtgctctacaaaaatgtgttggtgaggtggttgtacatttctcagctaaattccaaccactgtattatagttaagcgaagattttcaacttacttacatactgattttggtttcctttgtcttagctgtgttggagtagaagaacatcatgctgttgacattgacctgtatcactgtcccaactgtgcagttttacatggttcctccttgagtaagtactagatgcttaaataaaaatggacatttcagaaaaactgacatttcaaacttacatgtacatggtaatactttaatgatactctgaggagttatattacacccttcaagaactgtagggaaagattttgctcaaggtatttaggatgtagtttttgtttcattaagtcagaagattaaggggggaaatgtactgtcagtcttaattgccagtgcagagtccccaaactcaactacatagtttgatatctttcaatttgagaagtgtggtaaagtaaaatttttctgtttctggaaactgatttcacttgttttgctctcttcacaaatagaagatctttagtagtattttgggagagtatacagaataagactttaatgcactcatatgccttatattttaaggagaaaatgagagcattgataagctaaaatattacttatattttctgaatttggttgctgtattgagtatggcctgg

SEQ ID NO: 128123 - DNA, 1048 bp, Homo sapiens
ctgtcagcagttgtatcccaaagaagaacctgggcagaggctgcagagtcggccacagcatcaaagcccagctctgcttactacctgcgtgacctagacccaattcctcatccttgtttagcatgcagttcagtttccccatctgtaaaacagggaggctgtgaagatcaaatgagaccatgttcccgtaggggacaagaagcccgcccctggctggcttccctctagggagctgctgccaatccctttggccaggatccaggactctgcttcagccacctgtataagggggcggggaccctgtgtgatgaggtctgtgccaaggtgtggccttccctcccacatcctactctcagggggtggatggatcttgctcttctcactggctcctccagctctggggacagaacaaggacggcgaaccaaggtcctcttggagcctgtccttctggcctccctcatcctccccacatgagcactggcaggttgggcccaagcatggccagggaagggagaacctctggatcctggagttccgagcctcagctgtgccatgcagcccagagccctgccccgagtggagtgtcaggctctgtgccatttgcctttatcctctgtgtgtgccaatccccaggaaccccacaggaaggaaggggtggaagagctagggcagaattctggcattcctgggtcccctaaatcccacctgcactctgaatggtagaaaagatgggaagatataaatagaaagcagtgggggtgtgggggaaggtcagcagcaccccagactgcttcagggcccctggggacacaaggaaacctgatgtgagttggaaaaggtccctcctccgggtggacgcacacccatgatgtgcagcttagctcacagatggcgcctttgtgcaaactagaaaaagccctcagccctccctgtgtggttggggtgcagcgcccaacctgaatgaagtctccacgggatgtcacaggtcccttgcactgccagttttctcagcacacacgaaattgaaggtatagccttgggttctgc

SEQ ID NO: 128124 - DNA, 1057 bp, Homo sapiens
gcctcttcccttttccctttttttttttctttttttgagacagggtcttgctctgttgcccaggctggagcgcagtggcacaatcatagctcactgcagcctcaacctcctgggctcaagcagttctcccacttaagccccaccctgagtagcgagggctacaggtgcacaccaccacattcagctaattttttaaaatttttttgtagaaaaggggtttcgctgtgtttcccacgctggtcttgaactcctgggctcaagtgatctgcccaccttggcctcccaaagtgctgggattactggcatgagccactgcacccagcccccttcttcagaacctccagaagtcctcctgtctcccaaatcaatacacggtaaagccttttcttttccctactggcttttctgactaatgtcctagttttctttttgcagctaaaccctttgagctaatagacagtatctgctgccttcccatctatactactcatttcctcctcaactaggtagctacctgtctatctgttggcccaggacagtcctgacttatacctgtcattcaccgtaattatcaatggcacttccttttgctctccaagtgtcctgatttggaccccttatctctagcctctggcctctcatcaccctacagaagccatgcattgagggtcattgaattttgagactttttcccccctcatcccatatttgtgcttgacacctgtaaccacttcgtctttcccaggactttttcttctttggcttctctggcattttaatttatcgaatcttcttactgactatcccttttcctgggttctctcctctgctctgcctgcactggtctcctttctactttccctgatgagctatttttgtaatctaccaataaccctgtcaagtacttaatgaacaagaagccactaaagagaggaatggcatctgtttgttaatgactatctggtgtatagttaagaacagctggtctcaggggaggggaatgggctcgacttatataatcccaaccccttctcccctccccacacagaccattctg

SEQ ID NO: 128125 - DNA, 5238 bp, Homo sapiens
actatttttgaggcatcaattatagtacctttcattggaagaaagaatgattaaatgggagtggcttgcggatgttcatcttcctctctaaatagcaaagtgaataaaaataaaccttctgaactgacaacttctattatacggtttttccatttggactctgcatgcttaaatgggccattaatcacagcaggcacatgtatgtggaagagctttgtaaactgcaaaacatacaaatcctgttcccttcttattttctaaaatagccatgtttaatctactttttagctgcttccttttatgaattataaagaattatattgtaatttttttttcctccctttcagtatttagtgtctctgatccgggacaagctaggatggatgtgggttttctactttttcattctcatggtaagtgtgtgcccctttaaaaaaaaaaaagtcatttttctgttaattaagttcaaagcacttacttaagtcacttcagcaaaactgttgattgcttttaaaggctcctttgtgaaaagtaacattttattagtctaaaagacatcttcttcttcttcttcttctttttttttttttttttttttgaggcagagtctcgctctgttgcccaggctgaagtgtggtggcgtgatcttggctcactgcagcctctgcctcccgggttcaagcgattctcccacctcagcctcccgagtagctgggattacaggcgcctgccaccacacccggctaatttttgtatttttagtagagatggggtttcaccatattggccaggctggtcttgaacttctgacctcaggtgatccacccgactcggcctcccaaagtgctgggattacaggcaggagccactgcgcctgacttcacattcttctttgtgaggaagaaaaaggctctcagtttgctcttgacctgagtctaatgaatattgccatttatgatttcagaaaaacaagaagagacttatttaaagtatcaccagcccctaatcagtatactcttctaggctaccctctatctgctgaatataatataggaattctgaagtaaattacaatgtataccaagcaacacttgagttaaaagagaagcattgctgtaatcaacactgtcatgtttcccggttctaaaatgttgatagtttcttgaggaaatatttatgatgccctagacattcttggctgggattctctactttcttggaaatagccaatacagagtaaggccttgtttatttttatttatttatttttttgagacaggtctcattctgtcacccaggctggagtgcagtggcacgatcacagctcactacagccttgacctcctgggctcaggtgatcttgggctcagggggtcctcccacctcagcctcctgattacctgggactataggtgtgtgccaccatgcctggtaactttttgaatttttcctagaggtggtttcaccatgttgcccaggctggtctcaaactcctgaggctttgtgcttttaaaatattgctctctgttatgagctgtgacatactcaggcacgttattgtgggacagtgctcaagacaggtctacctgagagagtctggaaggcaccagggacgcattcagtatcctgtccccaaatccagggcactgtaattgaaggcagcttccaccacccgtactccaggcagctgtcctcttgctgtggtcaaggagccccaggatagtccagctccaggaataccttggagctttcatctaattcccatctagcttctaaagactgggcccatgtaacttgtgttccatttctgacatccatgctaagtagagggaagtatcttgtgatgaactttctgatgtgatcatactaggaactgtagtagaaagaaaacttttatctattataaggatcactgttgttcatctgagcctctggtctcagttctctgctccgcctatggcaaattatttgtatgtattgttctttttttgggaactgaaatgtgatgttgagtgttttgtaatattagccataattttcaaaatcattttctaattcattgaagattaaacattatctttgtatgaagtcaaaatgaatgtaattgtccaaatccattattatgttcaaaacatgacactctaacagaagtaaactgttgctgcatatttaatactattttctctttacagacaagttgtacaattgtgtttatctcgccattaatagtgagggaaatattctctctcgtgctaaggagacaggctcacatattgagggagtgaccggtgcccgcgagacagaaagaacaatgtcagccacatcaggaccgctggggcttcgagtctgccctaatttgggtttgtctaggagctccagcctgatcttggattgtcaggcgtctctcaacactgccagccacctgagatgctgaccagcagtgaaggctgcactagttttctacactacaggaattactgttgatgatttttgctgttgtttcatgaatgtgccgagtgacttctgactctgccagcatctttgacctctgactctgcccgcgtctttgtttggcctattgaggtttagcgttttaaccttaactgttgttttggacttgaactttctctagccttgaaaatggagtgaacaggaggcaaagccacgcgtggtttgtgttggtggtatgttccacaaatggaagagatcattgcattttgctttggtaatgagtttacagagagtgggtcatctttgaagcatcaaatcctgatcaaatgctcaagctggaccgagctgcaagcctgccttggacaaagaatccctctgttcactgtggtgggaaagatcacactacatgcctgttgattggctcagtcactctgtgtctgatctaaacgtcattcagccctagaagcatgaattgcttcaaattattgtcaacttgttctcttccattttcattcaaattaactttgactcctggaagtattgagtcttcctttcaaggaccataaggtacatcagttatcttgaacattctgacgtgtaaaggaccataaggtacatcatttatcttgaacattccgacgtgtaactcacagccgaagcactccatcccagatttgttgtctgggaacttaggatcctctaggaagctaatctgcttagtctatttttagaggattgatctctggcacaagcagcttcctggagttacctcagcagaagactagaattagagaaaagggaaagaccttttcttctagtaagtgtcaagtacagatgctctttgacttatgatggggttatgtcccagtaaacccattggaagtcaaatgcatttaatacccctgactggacaccacagcttagcctcgtccaccctaaatgtactcagaacacttagaattgcccacagttgggcagaatcatctaacacaaactctattttataatcgagtgttgaatatatcatgtaatttattgaatattgtacattatgttgaaattgcaaccatttcacaccattgtaaagtccaaaaatcagaagctgaggactgtctgtacatgacattgaatcacatgaatggattactagggcctgaggggtgtccgttctttagaaaaatgtagagtatatatatcttcagggctgtgaattccatactagttatcaatattttaagatcattctgtatatacatattttaaattatgcaagcaaactaggaggagaatgtgcaattttgagggatacctaatttgcattcggttaggggatatttttcaacctcttgctttatactctgatatggggtgtgtttatgaacttgttaatgttatttaatcatgcagatttccaatcagtgtattgctcatttactgacaaaaagggaaaatacgaaacacagaaagggaaaataaactgacttttataatgaatctccatttcgttacttaaatctatataccatgagcactgagatttagaatgtgatcggtgccctcatgtttcctgatactgagcgctcccgggtgagcccacgctgacccacagcattgctgggtcacgtgctccctcacctgaggtgctggggtggcttcatttccatctgttctgtgaaaacttgccctttcccactgtggaagactgtgctcggtttggatgaattgcccggttgtaagttaagggccgtctgttttctcattgaacctcttggctggcgtttggctcagagtttcctttccggctgcactgtgggtgtggtctcatctttgtgtccccacgccagccaatgttttcttacccagttgaaccttagatcggtgactgttcccctgacctttctatggcccccgagctgtactgaaatgaaaccatttaaaaaaatttttttgagacaaaagtctcgctctgtcacccacactggagtacagtggcacgatcatggctcactgcacccttgacctcctgaagtcaaaagcgatcctcccgcctcagctcccaaggagctgggactagcctcccaagtagatggaccgtgcgccaccatgcctggctaattatttttagtctttttattttctgtagagacgaagtctcactgttacccaggctggtctcaaactcctgggctgaagcgatcctcccaccttggcctccccaagtactgggataacaggcatgagccactgggcctgcgtaaaatgaaattacaaatcaatgctcagcactggacaacatgaaataaggatatattcccttattctagttctgccagtctgcacaggatttaactttttttttttttttttttttgagatggagtctcactcttgcccaggctggagtgcactggtgcaatcttggctcactgcaacctccacctcccgggttcaagcgattctcctgcctcagcctcccaagtagctgggactactacgggcacacgccaccacgcccagctaatttttgtatttttagtagagatggggcttcgccatgttgaccagtctggtctgtaactcctcaagtgatccacctgccttggtctcccaaattgctgggattacagatgtgagccaccgtgcccagccaggatttaactttgatgaacatctaagagttcactttattttcttcttaatatcttctcccttgagaagggaagagaaaaccatagtgaaagctaatttgaaaatgcatcctttcctcacagccagatcgtcgatgct

SEQ ID NO: 128126 - DNA, 1095 bp, Homo sapiens
cactccagtccagcctgggtgacagagccagaccctggctctctctctctattttttttttttgagacagcatctggctcttatgcccaggctggagtgcagtggcaggatcttggctcactgcaacctctgccttctgggactcaagcaattttcccactgcagcctcccaagtagcttggactgcaggtacccaccaccatgcccagctaatttttgtattttttttgtagagacagggtttcaccacattgcccagactggtctcaaactcctgggctcaagtgatcctcctgcctcagcctcccaaagtgctaggattacaggcatgagccacttgcctggacaagaccctgtctaaaaaaaaaaaaaaagacaaagttgcagtcagtttggagccccccatgcttcctgtagtggatgatgagacctctgcttttttgctacacatgatgtgatctaatataaatcacatagtcgttctgcattaatttttttcacttgtacatttcagtaataatgtgattgaagaatgctacccttttgtgtctgcggccaaattgatttttgacaagggtgccaggaccattcaatggggaaaggatggtctctcaataaatagtattgggaaaactggatatccacgtgaaaagaatgaagttggagctgaggagtgggagaggaaagaaaaaaaaaaaaaagaatgaggttggaccctaaccttacctcatatgcaaaaattacctcaaaatggattaaaggcctaacttgaagaacttaaaattatgaaactcatagaagaaaacagggacaaatcttcatgacaaatatgtacaaatgaccaataagcacatgaagagtctcagcatccttagtcattgggaaaatgcaaatcaaaaacacagtgagctgtgacttcatgcttactacgatggctgtaattaaaaaacaggaaagggccgggcgcggtggcttaagcctgtaatcccagcactctgggaggccgaggcgggcggatcacgaggtcaggagatggagaccctcctggctaacacggtgaaaccccgtctctactaaaaatacaagaaaaattgg

SEQ ID NO: 128127 - DNA, 1056 bp, Homo sapiens
aatgcccagtggtcaaagaaagaggaaggcagcagagtaacctgtagtcaagggaactgcgtttgagaaggcgttagtaaggtcatggatgtagagaggtcaggagaaagagaactgaaggatttgtcttttaggctcttagttttgacatctaggaggtcattaataaccttgaagattattgttacttgcttgatgggggtgaattgctgatgtctgattgctagtggttaatgagagataagtattgaggtaaagtaagccatgttaatactttgactacctagccgtattttaatagtctatatgcacttgttaatgtctgtctctcccactgtaacataagcttcctgagcgcagcattttgttgtatgttcttctgtcaccttagtacctagaacagtgcctggcacacagtagacattacttgtggaatgaatgactgatatgcttggcatatttgattataagactaaagggcaaaaaaccccaaagaaacaaaaaccttagcaaagccttgaaaaatacgcttacctgatcatgccctggagcgggaatcgaaaaatgctcccagccatcagttcagacgtcttcacctatggggtagagagtggctgcattgggcatccttttctgacattatattattttaagttatccttccttacgaatgttttcttcactaactaaatgggtgcattataatgagtatttcagagaatttgcttttattcagattgcctcacctgccagtatccagatccctcactgtgaacttgggtcctagactgaccttcatggttggggaagcacgtctggagtaaatcactgttagctttactcattcctcttccatgttgagttttgaatgatttcccattgcctaaggggtgaaatcccaaactctgtgacttagcgttaacctctatcagctctgtccttagccagtgtactaatttaccctgaataactttgttaccccgtctttccctgacttcccaagtaaagaattgtttcttcttcaggttgccatagcagttgatgcggttctgtagt

SEQ ID NO: 128128 - DNA, 1019 bp, Homo sapiens
cagcagtgggaccagattcacctgggccatcgcatgcctgattcatgggcagcctcactgagagcagtggcagatagagtcacctgctccattgcagtggctttttcctctttgctcttttttttcaatattcctggttgaatttgtgtagtggaatgatcatatgatgcaactaccgtaatagaatttatttgacaagctagtgcaattagttattaatgaatgtaaacttcacaggattagaagggctatgtgtttcactatttttgtatctttgggttctacaaaatatactagagtgtcacataattcgagaagggatttcaggaacgtggatgttaactactaatagtttgaaaatgatactatctgggggtttccttttttttccacttctctccaacatattaagaaaactattcggatattattttgccttatgcagtagattgctagtggttgtgaattgtgttttaataagaacctgtttatgacttcaggattttttattggtggaccttctaatatgattagttctgctatttctgcggacttgggtcgccaggagctcatccaaaggagcagtgaagctttggccactgtcacaggaattgtggatggttcggggagcattggagctgcagtgggccaggtgagagaacaggagaggggctgggattctagtgtcttccctcaaaggcggctgaatgtgaacctgccctctgggcctcagtaggtggcactcttgtgctgtagaacgctgttcccagagcccaaggacttccgtctcccctcaggaccagctgatgcgtcctaatgtagaaggactctccattgtttttagttccttttttctacttatacttctagattcttcctgtctgcaaataagctaagacctcgtaagacagacagatccttctgccccagcccaccatccccttctttctttccaggctgaacttggtattccgtggtggggggtgcttcttgttatccccacctggcatgtggacccc

SEQ ID NO: 128129 - DNA, 1049 bp, Homo sapiens
agcttcaaggcccgatatgccacctttgcattgtcctgtgaatgcctgggaaacctgtcatcacatagttttatttgtcttgggaggaaactggcatctcttttgctttgttaatttgcttaaaagcttgcttgggagtgtatatgctttgtttgggggaggctccagaggcacagcattatagccaataaaacaataaaaagggaacaggtttcaaaagcggaaagatggtaattagtaggtttggtatattcccttaagatgctgctgagacaggagtagagcttttctttagcttttagaagtcttgttagcttgagcattagcaagaggcagacgttacaaatcagagttgaaagaggcagagagagttgtgtctctttgttgtctctgggagtgatttgtgaggtcacggagattcagatcttcgcgtacggttggcagaggcacgtggagtctgcttttcaagccaccatggtttgtctgtgtcttccctcacaggttctccaaatgataagtccatcaatgcccttctgatgactgttacaggtacggcacatggctctgctccaccatgcttctgttgctctgtaaattcagaggaaaagggaaactgttttctccctcaatttgagtagtaccgaaaccttaattacagagaattcaaattttaaaaggaaaaacgcctccttttccagattctttttctctgctgtttcttacatgacctcctcagtcctattgtgacagaagcggtccctattgacagagattttctacgatttttgattgctgccccagcttctgctcttacctctaaaagtgacttagaaaaatgccacatgggagaccaattcaccagctttcaaaaaaatccacaatagctcgtgtctcctcctgtgttggaattggtcagcattttgtcacttgagcactagataaaatagttgggtgcatttagggactatgttatagaaaaattacttactttatttattatttatttattgagacagaatcttgctctgttgcccaggctggagtgtagt

SEQ ID NO: 128130 - DNA, 1049 bp, Homo sapiens
ttgttcacagtgttgccttggcaaggagtagaataaccaaccccgtttggctgctcccagtaaaggccgtgatgcttcctggacttctttgcctatggttaacgctggttagtggcatgaataccattcctctttgtgtgaataaagaaatatgggtatgtgctctgccttataggttcaaaacactggcttgcttctaccagagaactgataggaggagaaactggacacagctaagaagtagccataggtgttttttattccaaaggcctgctgtacatgcctgtctagaagttaacagggatgaagagcagagggagactagctgaagtcaggcatgtgggagtttgtagagatgtttaactgtaaaatcaggttctgttcatcctaacttcctttattttgttttgcttttaaatgacattaaaaatggtagtcgtgctgtgctatttgtccctcgctgatagttgaatgcttttcttgtagtactcactggcctacgcctgcttgaagttagtgaattactccttcttcttctggctccccttttatctgagtaacaacttcggctggaaggaggcggaagccgacaagctgtccatttggtacgacgttggagggatcataggtatgccggtgatacatcttttccataataaagagttagtcactagtgatcttttactgggttgtgaaatctggcctcatttaaagttttattacttattctacagccattttccctaaactgtcctactagtaaacagccaaactcaaaaaaaaaaaaaaaagaaaagaaaagaaaagaaaaaacaagaggtccatagaaaggaagacctagcctaaggcagcgctgtgatttattggactcttttttcttagtcctttgttgatggatcagttcttttgtctcgggaagcacatgggaatctctttaaatgcaatcctttcatacggctttctcagtgatatcttagctctaaagctaattgtatgtcagagatccaagttagaatatgaacgtgttcattgtatctacctcccacctt

SEQ ID NO: 128131 - DNA, 1049 bp, Homo sapiens
aggagaagccgccccttctattccgaatgtcttactattatggccgaaaggaaatctgaggccaagaaatcgaatctcttttttcctaggaaaactctgagctccttttagtgagtgaaaggagaacagtactgccgtttgagtcctgtcgacattgtagccagcccctggcacagctggacgtgtttgaggggagtgatgcacgtcttttatagatacaggaaaatcttcgcatttgcaaattatttttataattgagacactggcaaggaatgaacatagatgtatttctgatttcacttcttgaaacatttcttttcatccataaaaatgatgcacaaaaaagatacttaacctgtagttaaatacagattacatacaaatgaaaccacagaagcaaacagatgtacaattcttctatcttttgagtatttttagatagactgtgtgactttaattgaccttagttgacctcggtctctggaccttcgttgctgcttctgtaaaatggaaataaaaataacatcacctcataagtagggatgtatgcagagcccttcacacgtggtaggcactccataaacagtggctgtcgctgttattttaggtctctcgggtattgaggcagaagaaaactttgaagaagactcacacaggccattaattaatggtggtgaaaatgaagacgaatatgagccgaattattcaatccaagatgatagttctgttgcccaagtcaaggcgataagcttctaccaggcatgttgccttcctggagtcataccggtaaggaccgcttacatcttaccacagccagggaggtatgagagcccgtgacatctcctctgcctgagataaagcttccttaagtattgagcctctgttggatactttattttaggaatatacgtgctgaggaatgttgtctagtgcccctcagcttatctgatctctaatgcaggggttgacaaaccttttccatgaagaggcagagaataaatatttttgacttcggggaaccatccagtctctcccccaactactcagct

SEQ ID NO: 128132 - DNA, 4817 bp, Homo sapiens
taatcatgttttttataagttaaaatatgatgtccacacaaaaattggtacatgaatgttcttggcagcattatttataatagccccaaagtgggctaatctaacctaacctaagtgtgcatcagtctatcaagctgagtagttgaaaaatctcgatgaagttgtttttctttaaaggcataagagagtttacgtgcctgtcacccttattttccgacaggttttaactagggtcttaacctcatgtagaaaccagaaataacaaacagtatggaaaaccgtctttaatgtagttgagctccaggtttggggtagagaaaattgggtaatttttcagttcccgaagttgagtcctcatagtttgattttctagtattgttaagtaccaccgcaaaaacaaacaaacaaaaaaaaaacaccacacctgtgtttacttgtcagcaaagctaattttcgtgtcagcttgggaacattgttttttcagttgactatttgattctttgactgtgaatcattaactgttgctcaagtttttcagggttcaatgactggattccacttgttctctctccaccttctctagtcgtgcattgaggcccatgagaaggacatggagctctcatttgccgtgcagcgcagcaaggacatggtgtgtgggatctgcatggaggtggtctatgagaaagccaaccccagtgagcgccgcttcgggatcctctccaactgcaaccacacctactgtctcaagtgcattcgcaagtggaggagtgctaagcaatttgagagcaagatcataaagtgagactcctccccagtcttcatttgtgctttctcttttggggaagaatttagtaacttgtgccaactttcaaccagatggaccgcatttaaatgcatgcattttatcttgaaactgggatattctaatggggatttcttctttgtatttcagctagcttctaggttagttggtctatctacttttatttgaatgaggaaaccctgtgtatcagttagaatcttcgtgctttttctgaggagattgtgtttaatggattattagccagtttaggctcagtgaacaaactgatctagctctgaatgtatgtttcctgacgttttacatttccactttcctattccattcattaagctagccaacaatccaccatcctttaaagattgttctcataactgaacaaaaaccacataatctaaacagagcaaagctacaagaaataaatttatttaaacgaaagaaaaaggagtctgtgtgaaatgtcttcttttgtttttgttttttacctaagttatatttttcaaaaaaaaaaaaaaagaactggctagcccttgagttggatttataaaggaggttgccttgcttgaaagaaatggtcagttgtgtgacagtatgtggaaccctttcaggaaatgcccacgtgcctttcagttaagtctttaagtctggaggcgacacaccagggtgtgtccttgaagagtgggcctgtaaaaggggaatttgcattgcagcctgttcattgtttcccaggtcctgcccagaatgccggatcacatctaactttgtcattccaagtgagtactgggtggaggagaaagaagagaagcagaaactcattctgaaatacaaggaggcaatgaggtatgagcactgcagccttttctcaagcgaagagcccaacagagcttgggttcactttgaaaagaatggtgctgcattatacactcctacctccttcctacccttctttgacttcccaggacagtttattttgtcaccctgataacatccagtatatatcttgctataacacagtccttggggtccatgccaagggactgtgttataaagaggtctctactgttgacaagtaaggccccatgagtggggttctaccttattctgaatccgtgtcatagctgtcctatgttctcatgtgttggctttctagaagattttctctctatggcatctgcttgtactagagctattaaccagcatagacttgaacagagttaccggtttctagttagtgtttcttgcattggcacacacatgtttataagaacacatcttggggagggctgtaagctgacatactggttctatccctacctgtttaaagaaaccccggatgatagtcaaatacagacctgaaatccactgtgaataagggttgcgatattttcctttccagcaacaaggcgtgcaggtattttgatgaaggacgtgggagctgcccatttggagggaactgtttttacaagcatgcgtaccctgatggccgtagagaggagccacagagacagaaagtgggaacatcaagcagataccgggtaactctcactgtttttttaaaggaggggaaattccaaggtatcagttgagtcctgcacatattggggtaggggaaggagaaggttaacgctcaggtctgggagcgaaagtgtagagtattaaaggaggaaacaaacctcagaaaactgggagggataggaaaggaagaaaaaatgtgtgttaaagctctagcctaaacgatttccatgaagtaaccagaggggaggaagtggtaaatggaaaccctaactaagaagtctggttcgtcatgccctctggtgtgctggacgttttgccttataaacaacaggatagaagatactgctcgacagtgccatccctatcatggccttgttttttacaggcccaacgaaggaaccacttctgggaactcattgaggaaagagagaacagcaacccctttgacaacgatgaagaagaggttgtcacctttgagctgggcgagatgttgcttatgcttttggctgcaggtggggacgacgaactaacagactctgaagatgagtgggacttgtttcatgatgagctggaagatttttatgacttggatctatagcaaccttgcgtggcgtgtgaactggtctgctgacctcagacagcagctgtcccctgtggtggtgtggcagtgcctgtgttctctcctaggcaggcctctcaactccaggtgctgtcctaagaatttttacccagggcctgtcttctcaacccctcacctttccctgaggagtgtgttgttttccctgttgaaaaaagttacaaaaataaatcttaaagttagttttttgtaacacgaatttaactgtcagacagttagtgtaggtgtgttgcgtcatctgttttcaaccagattgcatttatggacttttcacacactcattttgaggaccccaggttcaaaagtaaaagcagtggccctgctttggggtccaagaataggagtgatgggtgaagggacctaagctggccaatagccctctgccccagacatgggatgtggatccttgaggtttctggtgaaatctgcacatctgtgtttttatatctgttccctaccctgtaatccctaccacgtgcacttgttctgtggttttggtctcttgtttaattgcacacaagtaatactactgggtaaccagaatcaggtgtgaatgtgttgagattttttactgttttgcatgataggaaaattgagaaagaatacgtataaaagatagagaggcataacatcaatgcagagttggaagttggctcccaagggctgacatggtgtgagtgtgtgggtgtgtgataagcttctcatccctgcatagatgcagtattcttagccttagtagaaaaacctggtttagtggtttaagccttgtgtggcagatagatcttaaagggcaaagcagtatattggtagttgtcaatatagcagtgctagctctgtctatataaatagagaaatggggttagccatagaggttaaaactacctggttatcccatataataacacaaactgggtcttggatacacagttgtatttaatgttttacgatctagcctttccagtacaggcactttctgagaaacctttgtcctcacttgaggcattttgttgtcgggtttttgtgtttgtttttgtgggtatttgcctcattccacccctgagctttcaggtagacagacgtgattcaaaactctgttctaaggtgtttattgtagtggagtaatgggtttgcagtgataagtcatacttttccaccgaaagggagggcttgggaatccctgagattagctaaagttaagttgttggaagaattccttgattggaaattgtacctttgtgttttgttgctctgtttcctgaaaataactcggggatgctcctggtttgtccatctactgctttgattccttggatcccacccattctttcactttaagaaaaaacaaataattgttgcagaggtctctgtattttgcagctgcccttttgtaagaagcacttttcccaaataaaacaattaaaaaaaaagttggctgttctgtgtaatgagctgtttttgaaatgtgccgatgtcaaagaataatgatgtttttctttcactgactcttcgatcggtcccttgtcggatattcgggaggataggtactttgagaaatgtgtgtgagagagaaagggaaaccttaactagccggggtcatcaaacaatcctatacttgaaaatgttcaagactaacgctgggccacctgttgagcaaaaggcactggcagttttctgctaccatgcacttgcggttgaacttgcttcatgcccttagataacgggggaaggtcataatataattgtattttgaaagcttattgttctgcataattatttcgtgaatttttaaggagttttcattattgtgaattttttgtgagtaagaaccattctgctactcccatg

SEQ ID NO: 128133 - DNA, 2177 bp, Homo sapiens
aaaaaaaaaaaaaaaagaaaagaaaaaggtatatatgaagttaggcagtgagtgcttactttttttttttttttttttttgagacggagtctcactctgtcgcccaggctggagtacagtggcatgatctcggctcaccacaacctctgtctcctgggttcaagtgattctcctacctcagcctcccgagtagttgggattacaggtgcgccaccatgcccagctaatttttgcgtttttggtagtgacgggttttcaccacattggccaggctggtctcgaactcccaacctctctggtgatccacccacctcagcttcccaaactgttgggattacaggcttgagccaccacgactggccgactgcttacttttgaattttttcttagatatgaacatagcaaaccattgaaacaggaagaagcaactgctacagagctaactacaaagtcatcccttgctgcttcctcaagtctctcatcgatagttggaccacttgttgaaatgaatacaggcgaagctgagtcaagaaattcaaactttgcaactgtaggagcaggttcagaggactgggtgaatgctattgagtttgttcctgggcaaccctactgtggccgtagtaagtattctgaagaagaaaataagagttagagggctggatagcagttcatccatttgcttagttttgacaactttcccctttctgcttctattccttttttagtttaatcttagtacagtactttaatttggattacctaagatttacagatagagtgaaggaaatttttaatcccagtgaaatgaattcagaatgttttgaaaaactgaatcctttcgagtactttttgaaattaaatttcagttacccaagacatagataaagaagcaattttttttttttacaagtctaatcttggaaataacagcggtagaaaaaattcctttctttcaagtgaagaagttagttcagtagactgttttggtatttcattgcagttttattttcattttttgcggttagattctcagttctcttatagttcatgccttatctatttggacctttaccaccctcttacacattttcagctgcgccttcctgcactgaagcacccctgcagggctcagtgaccaaggaagaatcagagaaagagcaaaccgccgtggagacaaagaagcagctgtgcccctatgctgcagtgggagagtgccgatacggggagaactgtgtgtatctccacggagattcttgtgacatgtgtgggctgcaggtcctgcatccaatggatgctgcccagagatcgcagcatatcaaagtaagtctttagggagatgtgtgtgttattagatgtgagaatcattatttgccctttcacagcattgtgggtttatttcagagaaacatttgatgaattgaatggttatcagtgagtagggaagttttcctttcttgggcttcttggatgctttatcaagaagtcatatttccagtgaacaaaattaactgggcatggaggcatgtgtctatagtcccagctacttgttaggctgaggcaagaggatcgctcaagcccaggaggttgaggcaaaagaaaaaaagaagtcctacttccagaaactcagactatagacttctaacatttttttcctcttttaaaaaataatgtttctgagattcacattgaatatgtttaatcttttgaaaatgcacatttcattggtttttagtatatttacagagatgtgcaaccattaccattttactaattttaggataatttgatcatcctacacccattagcagtcactctttattccagccttcctccagctcctggcaataacgaatctgctttgtctctggattggcctattgtggacatttcatgtaaatggaatcctgtaatgtggtcctttgtgattgacttcacttctttcacttaacatagtgttttcaaggttctttgtgtggttgcgtgtagccgttcttagttttgatggctgaattattgtctttgtatggctagaccacatttgtttttccattcatgagttgatggacacttagatcatttccagtttttggctattatgaataaggctgctaggaacatttgtatataggtttttctgtgaagatatgttttccgttacctaggagtggaattgctgg

SEQ ID NO: 128134 - DNA, 1056 bp, Homo sapiens
tacacttgctttactcctgttttcttatcaccttctttttattttttttttttgaaatggagtcttgctctgtctcccaggctggagtgcaatggcgcgatctcggctcattgaaacctcagcctcccacgtgtaagcagttctcctgcctcagcctcctgagtagctgggattaacatgtgtgccaccacaccagccaatttttgtatttttagtagagacggggtttcaccatgttgcccaggctggtctcgaaccgctggtcttagacccctgacctcaggtgagccactcacctcagcctcccaaaggtactgggattacaggcatgagccaccatgcctggccctttctttgtgtttatttcgtatgtttgtgtatttactggttgaatatattagtcatgaatactaattagttttaatattttcaaggattggttttaatccagttttgtggtctttcgtctcacaggtattttatgcatggggtttgtaaggaaggagacaactgtcgctactcgcatgacctctctgacagtccgtatagtgtagtgtgcaagtattttcagcgagggtactgtatttatggagaccgctgcaggtaagaatttgtttataaatttgttcaggggtgggttggaggaaaaaggtaaaagacatacttctgatagctttatatgtcactgattaaaaataatgctttgaaaatgactcttggctgggcagtggctcatgcctataatcccagcactttgggatgcttaggtaggaggattgcttgatcttggaagtttgagaccagcctgggtaacctagtgagacctcatgtctacaaaatatagaaaaattagctgggcatggtggtgtgcgtctgtaatcccagctacttcggaggctgaagcaggagaattgcatgaacccgggaggtggatgttgcactgagccaagagcccgccactgcgctccagcctgggcaacagagcgagactccaccttaaaaaaaaattgggtagggcttttctatcctcctagttcagaaatgactaggtgtatt

SEQ ID NO: 128135 - DNA, 1814 bp, Homo sapiens
tttaccatgtaccaggcactaagctcagtgatttctaaggacatcatataatcctcacagcaaccatatgtgggtctgctgtcatccttattcgagagaggctgaaacggaggctcagatagaacaagtacctagctcaaatattactagagaaatgggaaagtgcagattcaaacccaggtcttccgactgcaagtccctagtccccagccccagctccactatatcagcctctgctaggaagaaagccgctaactatggactttcgtcgccggggtttcgagcctaggacacacctgtacagacccccgtttgccccgcccctttccggaggagacgtcccctccaccaatgagcggcgccgtgggcgggccgcgggcgcgcatgctctgggcccgcagttgaagtggcgagagcgctcagatacgcgacgcgtagcaggcggggaccgaacgggtgcctcagtgtccttcccctcccctcgcctggcctcgccgtcctctccccgcagccggaccggaactatgtgatcccggaagttccggggcctttgctgtgtgggataaacagtaatggcggaggctgcaactcccggaacaacagccacaacatcaggagcaggagcggcagcggcgacggcggcagcagcctcccccaccccgatccccacagtcaccgccccgtccctgggggcgggcggagggggcggcggcagcgacggcagcggcggcggctggactaaacaggtcacctgcaggtaggacgttgcgcggcggagcgccgggcgcggggagggggccgcgggccaagcctgcggcgcgggagggaggagggcggccggcctgcggctagaggcgcgggagggcggggaccggcgttgtctcgatctctgcagccctcgcggcccccgctgccgccgcgttcccccagtcactgcgtcaacccccgctgggccgcggagccctcagcgctgtccgcggaggcctggcggtgcgcgattactgcggagccgcggggctgcaccgccgcttacacttccctgagcgctgcctgagctggctgcgagcgcatcggggagaggtgggctggctcctcccctgccgctggaaggatgcccccgccgctgcctccggctcccggggctcgggaggtggtcacttgaggccggtctcccagcgatcctctccgggcctagacaccccgccgagggccccagcgagcttgcctggctcccggccctctcctctctccgtgccatccgtttgtaacgtcttttcacgtccctccgtccctccgccccccatcctccgcccaactgtgagaagaagcttttgtatttcttctttgtatgtttgtcgaggttggcggtgctgagctttgtcttagaagcaggcgttcgggggccggggtcgtcttctccacccgcggtttttttgagctgcagattattaccctcccccagcgctatgttcctcttttgaaatttacgcatcttccgaagggagtgaaagggctcttcgctcccggaagagagagaggtttggttttggtttgatatgcgagacgaaaatattagaaaaattaagggatggcggttgtatggatgtgtatggttgtaaaaaactacctagctctacgcagaagagggcatttaattgtacgttttttattttccggtttttaaatagtgatcagtagcgactgtaagcttttctttttctatcagttgaataaatcaactgaaatgccggttttcacctgggtggtataatttatatgcaagtatgtaaaaatgattcctaattagaacttgt

SEQ ID NO: 128136 - DNA, 1431 bp, Homo sapiens
ctttaaaaggactgaaaggaaaacccactaaaacattaacgcttgttgtcttggggagggaaactgaaaggagacagattatgagtgattttaaattgttttagtacattcatatatttttataatgatcatcagttactttcactagcagagaaggtaacacacatgtattttctttttatcatttgctagagaggcctaacttctatcagattttgcaagaagtaattatagtaattacagaaaatttctctgggcattctgatggattacttccaagtgttgccacattgctgaaaagttcagtagcattaatgctgttttttatcattactttcacttcctcaaggcccacagggtaggcccttcccaagaccctcctgctctgaggccctgatcccaaagccagccttagatcacacaggccatctgccctggccagaatcccctggttaccagaatccactagctaccctacaggatggagcagtggaaatcatctattgagtatcctctcagtgccaagccctttcacagggtaattgtagtccattgtagcttcacaacaaggtacagattgattggtagtccattttacaagtggggaaaacgaggctcccgttgcttgtaaaaagtaggctcggccaggtgcagtggctcacgcctgtaatcccagcactttgggagaccaaggtgggcggatcacctgaggtcaggagttcgagaccagcctggctaacatggtgaaactaaactactaaaaatacaaaacattagccaggagcggtggcacgcgcctgtagttccagctacttgggaggctgaggcagaattgcttgaatccgggaggcagaggttgcagtgagccaagatcatggcattgcactccagactatgcgacaagagtgaaactctgtctcaaaaaaaaaagtaggctcaagattgaaacctcagacctctggctttcagttgtattccttccatgaaactggagactgagccaggcctgccctgcagtggctccagtgtgtcctatggccaagacgcagccaccgtgcccataagcccacctgctacctctgctttccagatggacgatgaggactccatcctgccccggaagcttcaggtggccctggaacacattctggaacagaggaacgagctggcttgtgagcaggacgaagggcccctagacggcaggcacggtaagtgttcagccacctcccagtgggtctctcccttccactctgagggtcagggaacaaatgggcagtggccaagggccaagtaggaatatgggcaagggagacataaggagagaaaccagggcctcattctgtttatctggatttcattcccacagtgaattgtgggaaagattttcccacctcccccattttggccttaaagtacctgtttaaaaggggg

SEQ ID NO: 128137 - DNA, 1061 bp, Homo sapiens
atccagacccatcactgacatatcctggggctggaagcttattccagttcttctcttggagtcgaatccctcccagactacactggctttgaaacactgtcatcttcaccttttggatgcactgcagccactggaaacctctcagacacgtttctctgagattctttttttttttttcctgagatggaggcttgctctgttgcccaggctggagtgcagtggcatgatctcggctcactgcaacctccacctcccagtttcaagtgattctcctgcctcagcctcccaagcagctgggactataggcatgtgccaccacggctggctaatttttctgcatttttagtagagacggggtttcactatgttggccaggctggtctcaaactcctgacctcaagtgatctgctcgcctcagcctcccacaatgttgggattataggcgtgaaccaccatgcccggccttctctatgaatttcttagtgagtgtcaccatcattcttttgttctgtcttggctaaggagcgctagaattaccttcctgtgacacccttcgttcttttgatggcctcaacaaaagctcctgtttccagctcctggcctttgctctctcttctgggttcatcgtttgtagatgttaaagttggaaggacggccaggtgcagtggctcaagcctgtaatcccagcactttgggaggccgaggcaggtggatcatctgaagtcaggagtttgagaccagcctgaccaacatggtgaaaccacatctgtactaaaaatacaaaaattagctgggcatggtggcacatgcctgtaatcccagctcctcaggaggctgagataggagaatcgcttgaacctgtgaggcagaggttgccgtgagctgagacgacgccattgcactccagcctgggcaacaagagcgaaactccatctcaaaaagtaaaaaattaaaaaaaaaaaaaagaagctggaaggacatcagcaacgatctagcgatgatctagtctactttagttatttcacaggtgagaatctgaggcctggagcagttcagggctt

SEQ ID NO: 128138 - DNA, 1023 bp, Homo sapiens
aagacacagctggcatggtggctcacgcctgtaatcaccgcactttaggaggctgacgtggaaggactgcttgagggaagtagtttgagaccagcctgggcaacacagtaagacccccatctctacaaaaaacgtaaaaaaaaaaaaaaaaaaaattagccaggtatggtggctcgagcctacagtccctgctactagggaagctgaggtaggaagatcacttgagcccagaagttcaaggttgcagtgagctatgatcatgccactgcactccacctgggcaacagaacaagaccttgtctcaaaaaaaaaaaaaaaagaaaagaaaagaaaaacacagacttgtctcagtgcagtggggtaacagagacataagccgactctccaggaccacattagaggcaggtagaggcagtgagttctggagaccgagggagggcactcactcccagggaggcgagttctgagggccaacactcagaacaagtagtcagcacattgcaggcaaaaggagccatcctacatagatatggggacaggtgaggcctagctgtcaccttcaggactgtaaagtaggccaggcgcggtggctcatgactgtaatcccagcactttgggaggccgaggcaggtggatcacttgaggtcagaaggtcaagaccagcctgaacaacatggtgaaaccccgtctctactaaaaatacaaaagaatttagttgggcgtggtggtccacgcctgtaatcccagctacctgggaggcttgaagaagaatcgtttgaacccgggaggcggaggttacagtgagctgagattgcgccattgcactccagcctgggcaacaagagtgaaactcaaaaaaaaaaaaaaaaaaaaaagagagagaaaaagaactgcaaagtagttcactagggctggcccagagagaggaagatgggggagggagagatgagccggcagtggtggacagaggccagctcacagaaggctgcagggccatgctcaagaggacagaccatcgtgagg

SEQ ID NO: 128139 - DNA, 1006 bp, Homo sapiens
atgcccaactaatttttgtatttttagtagagatggggtttcaccataatggtcagactggtctcaaactcttgacctcaaatgatccgcccacttcagcctcccaaagtcctgtgattacaggcatgagccactatgccctgcctgtgtgtgtatttttgagacaggatctctgtcttgctgttgtcatccaggatggcatggagtggcacgatcacagctcactgcagcctcaacctcctgggctcaagtgagccttcccgcctcatcttcccaagtaactgggactacaggcgcatgcaaccatgcccagcttatttatttatttatttttcgtagagacgaggtcttcctctgttgcccaggctggcctcgaattcctgagctcaagcgatctccctacctcggccttccaaagtgctgggatccactgtgcctggcttttttttttttttttttttttttttttaatgcaatggtgatcatccttgtacaggcatttttacatgtcaggcattttatctccttgtctttgctcccttgctccctctgtagaaaggcccttttcctccttctctctcttctctttttaaactttttttgtgggttttatccctcacttctgtcaagtcacctgaatcaaggcacagcccctatttgcatgctaatgttccattaaaatgtttcctatcccatatttatctttgacagttcagggagactgggctgttttccagccatctgtgattagttgtatttgtgggaaatttccgtgtgcagcttcctgtaactgtgctcctgtgcatatatgagcctgtgtatgtatgcgctgataactcgtaggttgatgacgtgtgggtaggcacaagtgtgcctgtatttgtgtgtgtcctatgtgtgatctggggtgggtgcatgcaagtagtgactgggctgttgaaaagggctggaacttgtttccccacgaggtctgctcttcagtcctgaatgctgtttcctttgtgga

SEQ ID NO: 128140 - DNA, 1348 bp, Homo sapiens
gaagcctgacttagaagaagaaagcaagctgtcacacctggtctgtcccctctgggtcctacctggctccccacttcatgcggggagtgaactgcctcacccctgaggaacaatgaaaaacatctgcccaggccaagcgcggtggctcctgcctgtaatcctagcactttgggaggccaaggcgggtggatcacctgaggtcaggagtttgagaccagcctggccaacatggtgaaaccccatctctactaaaaatacaaaaattagccaggtgtggtggcgggtgcctgtaatcccagctactcgggaggcagaggcaggagaatcacttgaacctggggggcagaggttgcagtaagccaagatcatgccacttcactccagcctgggtaaaagagtgaaactctgtctcaaaaaaaaaaaaacatctgcccaaggcagctctgcattcagggcagaacgctcctccctgataccaggaaataaaggcttaccaacccttttcttcttgtcactgctgggctggagaaaacctagagcctctgccaccaaagcagctaagcccagtaggtgagaatgtcaacaagaacttaacgtccagctgtatctgtatctgtagctgtcctgaacaaagagaatccagttgtccagagcacgtgtctgattgccacggatccttgcaagccctcagcgggacacggtgtccgtgctcattattctgctcatccacatctgggtgtctgctgtgtgccctgttctaggggacagctggagacttcaccacttcctccattagctcatcaaatattcatggagtatctaccgcatctgggctgcatctgggaccctaaagcttgcaggagcagtccctccatgtgacctcccccaccagctgcggagagatcctcagccatctttgggatgttcatttcattaggccacagctagttattcgggtcactagaatttccattcgagagggaagggcctgttggataggctctcctcagaaaggaccaatgtgtagctgcgggcagatgctgctgctgctgaacgcaaactgcaagctcctgaaagggactgttttcttttcttgctacgcatcacccaccgtttcttttcttttcttttgagacagaatcttgctctgtcagccaggctggagtgcagtggctcgatcttggctcactgcaacctccacctcctgggttcaagtgattctcatgccccaccctctgactagctgagattacaggcacaggccactgtgccggctaattttttgggtatttttagtaaagacagggtttcaccatgttggccaggctggtttcgaactcctgacctc

SEQ ID NO: 128141 - DNA, 1041 bp, Homo sapiens
catggattttcacaccttttacaataacagaagttgatttcaggccgggcacagtgtataatcccagcacttttggaggccaagacaggcagatcacctgaggtcaggagttcgagaccagcctggccaacacagtgaaactttgtctctactaaaaatacaaaaactagccaggcatggtggtgcatgcctatagtcccagcttctctggaggctgaggcagaagaattgcttgaacccaggaagcgcaggttgcagtgagccaagatggcgccgctgccctccagcctgggcaacggagcaagactttgtctcaaaaaatgaaataaaataaaagttgatttcggtaacaatttttctaagaaaaagaaaatttggccgaggggatatattaatatattctctgaaacagcctaatttgattcaaattctttgttttttcctcccatctggcacattccagaaagtcctatgagtttgaagatttactgcagtcttcctctgagagcagcagggtggactggtacgcgcagactaagctggggctgacacgcactttatcggaggagaacgtctatgaagacattctaggtaagaagccacagcgtctgtgtgcggatctgagtctgtctgggagaaaggggagggagaatggggctggctgctggaaacacacgtgcacacacatgtacacacacacacacttgaagacacctgtgcactcggatgaaaaagcaggcaggtggggtgggagagtgagccttgtgggatatatgacagaccctagggctggagggggaagactagctggtaatgagtggccaaggaggcagtgtggcagcgtggcatagcgagaagcgtggggcctggagtctgaagatccagaaccacatcttggttctgctgcctgttggccgcaggacattgagccagtgacttcacgtctctgaactgagttctcccatctgcataatgaggatgaagctagctcccttgcaaggttaaggactggagagaatgttgtgtcaactacctcacata

SEQ ID NO: 128142 - DNA, 1031 bp, Homo sapiens
cagcctaagcgacagagcaagactccgtctcagaaaaagaaaaaaaaaaaggaaatatataatcatacaaccgtaaaaaaacagatccaaacacaccaaaaaactttctcccatcacacttaattaacaaatgtttctgaagtgtggtatggtgtagaagtataaaacagttgctgatcttgaagaggtgagcaagacagacattcgtaatgatgagctagagtctagttctagtctatattagatatgagaccacgggaatattgtcgaaggagcactagacttggattcaaaacatagacccattacttgtgagttattgtatgagcttaaacatgtgacctaactccctgaggctcaatttcttcatcacaaaaaaatgataggaacactaacattgatttctgtagagctgagaaacaaaaagggtttcttagctgggtttccggcctacctgagaacagagagaaggaagaccaagtttacatatttgaaagttgaaataagttggaacctgactcttccctgtttggcgatctgtaatacacaaaagaaacaaaaggaagtgtacttttttattcaaaaaatacatttatctgaattcagactattaaaccatattttacctgtattagcatatttcataacttttataactcatgctttaatgatttatggcaaactcatactagccttgatcagagaggtgaccctggcagttattgagcattaactctggaggactgacgccactgagtctttctacacactgtaatttagtgttcctatccaagatggccactaaattgcacttcttctattttcaccctctggagaatggtaaaaagcatgatttgcaaatattgtcaagtccaaagtgtgtttctaaactactaagctagccaaatgcatctctatatgttacaatgttctgcagatgtgaaaaaatccttcccgggtttatgaaagtgagaatgatatgcatctttagctgcctctggcatccggcacgtcacacagtgtggtcagtc

SEQ ID NO: 128143 - DNA, 1186 bp, Homo sapiens
acatagacaaccttccaggatatcagaaggggaccagtgccctctgtttaccctccagctgactgatgcatctaatagggtggaaaaatgtcagagaagagagagcttcttaatccctctcaaaacaatcagacttgaagattccagcaccacagagagccaagagagcctcttattccaggctcttctttcccttgaatataggacagccaagattcctggtctggtacagaactgagagagatgggtaaaggggctaagaggctgcttctgggtacacacacaaccccgaggttcaggctgccaatttgtcagagaaaacgagaaagagaatgctccttttgggaccaagaaagaagcagaacaaatgcaagagtcccacgaggcagatccacatgttccttccccacacccccgaaatctggcttctattcctatccatctgctgaaaccatatcttaggttactaatggttcgtctgtggccagttccctgttctcatgcttcttgatctcactaatgcacttgacacacccctgacccttccttcttgaaacacaagtcaaggtggatgtaaaatgggtgcagtgatgaatctgcgccacttgtcaaaatactgaaatacttctattctggttggtaaatagggtgtcccacactcccaggaccactaactctccccctgccaagatctggccattaaagtgttaacaataaggccattctgcttgttgggctcctgcacacctttgttataattttgttgtgtgtttttgtttttgttttttgagacggagtctcactctgttgcccaggctggagcgcagtggcatgatcctggctaactgcaacctccgcctcccaggtttaagtgtttctccttcctcagcctcccgagtagctgaaattacaggtgtgtgccaccatgcctggctaattttttgtattttattttattttatttttagtagaaacaggctttcaccgtgttggtcagtttggtctcgaactcctgacctcaaatgatccgcccgccttggcttcccaaagtgctaggattacaggtgtgagcccagcctgttatgtattttgaatactgcctcctcagtgtagacgccatactgttttggttgttttaattgtctttcaaagaagagttcttcactgcttcctcctattcttattc

SEQ ID NO: 128144 - DNA, 1086 bp, Homo sapiens
ccttcttctgccacctgaatcagacagcctccacttgtaccccagactctcttgaaattccctgtgctggttactcagggaagagtgccaggccccgctggcccctttaatgataggaggcaaacactgcctggaactagggcaagtgatgagctaagttctctacttttcatatgcaaaagacagcgacatgctgggaagccagagtcagactcttctttaccctggccttaaaatcaatgtctgacgtgggcaacagtttactccgtcagccctcagtttgcctagaagttaagttctttgccagctgggcctagaattgcgactctaccttcagcttctctttggcacgtttgtccctggcttgcagttcagaggggctaaagaacagataagcctgagacccactcttccaactggctgaactatgggaaaccaagtgatcgttttttcccctggccttggggaaggaaggggtgggtcacccttgcagcaagcttagggaagaggttagcttccctcagtggtagggaaccaggaggtcataggcatcccttcagaaggaaatgaaagcagggatcattggctggagagtggggccagtacagggagccgcaaccttggctgtgacccctcctcccgggatccccaggccttccgtacactgcggatcttatctgaagggcttatcagaccacttcaagcagaatgccaaatgcatttccttttgttgttttgtcttctaaaaaagtacacttaaaaattgtaggtttacttataaactttatatgtaatctatgaaagttatatttgtcataaaacatttacttatttatttatttttattattatttatttttagacagcgtcttgctcttttgcccaggctggagtgcagtggtgtaatgatggctcactgcagcttctacctcctgggctcaagggatcctgctgcctcagcctcttgagtagcggggactataggtgcgcaccaccacacctagctaatttttgtatttttggtagagacagagtttccccatgttgcccaggctggtctcaaactcctggactcaagcaatccac

SEQ ID NO: 128145 - DNA, 1030 bp, Homo sapiens
gcgcgtgcaagcgcggggcatcgaggcggctgagcagccgggcccccctcacagcggtcagcatttgcagtcttgggaaagcaagaaggtaaagatgattgaatggtcttacttcttccactttgtccccaagggtggagttgggagcagatggagcccaggggaagtctggacacaatcgtattaggagggtcacagagagctgggtgagaccacggagtagagccagacctcagccgtggaatcttgtcatggggggcctgggacaggaagcaggaaactggtcagggctctccaggggcgtaaattgggcaagggaagtgcagtgaccctgccttaaccagctggtgctgacttccagctgctgttcagatgcgattcaggaatgtgacttccccaaggttccaaatgacatcggacagtaatgggctgggggtaacagagttgtaataggcgtgctacagtaatcttgttagtaaactcttaaaccctctgtggttaccacataaaagaagagaaagaaatcccttctccttacatcatcaaatatcagataccaaaagagtggagtagaaagtctgggtgggcagcgtgggacggagcagaactccgagaggaagtatgtgtgagtgtgcgagtgtgtgtgtgtgtgtgtgtcagagacggtttctgaggcctggtaatgaaaaggctggcgggaggctggcctccagtcctttcgtttgttttttatttttatttttttgagacagagtcttgctctgtcaccctggctggagtgcggtagtgcaatctcgacccactgcaacctcagcccccggagttcaagcaattctcctgtctcagcttcccgagtagctgggattacaggcgcccaccaccacacccagctaatttttgtatttttagtagagacggggtttcaccatgttggccaggctggtcttgaactgctgaccccaggtgatctgcccgcctcggcctcgcaaagtgctgggattacaggcttgagccactgtgcctggcctcc

SEQ ID NO: 128146 - DNA, 1050 bp, Homo sapiens
ggtgcaatcacagctcactgcagccttgacctcccaggctcaagcagtctcccccgacctcagctgggatcacaggtgcgtgacaccatgcccagctaattaaattttttttttggccaggctggtctggaactcctggcttcaagtgatcctcccactttagcctcccaaagtgctgggatttaggcgtgagccattgagcccaactcagtgttaagaacactttttgccctaacattttgagtctaggagaactatataactcaaaagacagtaggtccaagtgtcacagcccctgataaaatttcagaagagctagtgtggtagagttctttataatacaactttataataaccaaagtgtccatagttctgggctaaattttaaggaaaacctcacatatatggtatagtatgttcttaaagccacatctactctgttgtaatcacacatgaaggtttagaaaatgaatttctatgatgtttatattatagaattaccattttcagaagagaaaaactgcagttcataggaaattaagtcttgacatttatttttatttttagcgtgggtgtcttgctatattgccctggcttgcctcaaactcctgggctcaagcaatcctcctgccttagccttttaagtcttgataacattttattgtttgggaggaggggtgaaaccagattcctcaggcacaagccctttttaggcttttctgttccttcatattattctcagacataaggataaacaggtgaagtgttttttttgagacagagtctcgctctgttgcccaggctagagtgcaatggcgtgatctcagctcactgcaacctccgcctcccaggttcaagcgattctcctgcctcagcctcccgagtagctgggattacaggtgctggccaccatgcccagcttttttttatttctttctgagatggagttttgctcttgttgcccaggctggagtgcaatggcacaatctcggtcggctcactcccgggttcaagcgattctcctgcctcagcctcctgagtagctggaat

SEQ ID NO: 128147 - DNA, 4835 bp, Homo sapiens
caatattcagggtgatacactttttcttcccttgcattttagaataggctggtatctcatttgaacgggggagcagacttgatctcaaatgaagctgtgcccaggagccaggcttagcatattgagatttttatagataccttaaaaaataaaatatttaaacctctcttttcttcctttttctatgaaataggttttttctctagtttacaaatgacatgaaaataggttttatttgtgttttatctgctttattttttgatgcttagacaacagttagacttactgagctcctaaaaaaacgaggaagaagtccttatttgtgaaaagcactttatgagtaattgtatagacagtatgtggctgcgtcactgatcatcttgtaagggtgtaacagtcttgtctgtaaagtggctgcagtgccttctgtagtgtgttttatttttggtagggagaggtgaagccttctgaaaaatttgagagcaactacagaggattgtttgtaactgtgtagtattcctgatggacttttttcatcgttagagtcaaggacctagacttttgccactgaaataatattgaccaaaaaaatagtttataaaagggatttgtgaatagaaaattcagtgtgatcatttgttgttaatgtgcaccttaaaagaagattctgtctagctgtcaaattctggttcccgaatatctcacccctgattgtatttgagatctagtagggcatactggggcattttagaagataaaatcccatacaaatgatatatgctatatttatgttggtgttggagaagaaagagcagtatataaagaaataattcaagactgcagcactgtcaacctgaaactttgtaaatatttcctagcttctggtttggtgcggtgacagcactttcatcacaggatgttaccttgtattcaccaggcggagtgcgagctgctgcacatcctcctcagatctcacctgtccccactgtacatccacccgccagctgcttgcaaacctcatctctagctttagttcgaaaccacattgcagggttcaggtgacctctacaaaaaactacctcttcagaatgaggtaatgaatagttatttattttaaaatatgaaaagtcaggagctctagaacatgacgatgatttaagattttaacttttttgtgtacttgtatttgagcactctcattttgtcctaaagggcattatacatttaagcagtaatactgtaaaaaaatgtgttgctcggaatatctgaatgttgttgaaagtggtgccagaaccggtttaggggtacgtttcagaatcttaaccttgagtcaattgcatgaaattaaatagctgtggtatcacttcactaacagtgatgtaattttaattttcagtaggcttggcatgacagtacatcctcataatgagtttgctgcagctttgtcacatgcacaggcattcatagaaagaccacccagctaagagggtagaatgattactctttttgcaagattctcttctttgtccaagttggcattgttagtgctaggaataccagcaccttgagacgagcagattccaaccattaggctataaacaccatagccagagatggaaggtttactgtgagtatgaacagcaaatagcttacaggtcatgagttgaaatggtgtaggtgaggctctagaaaaataccttgacaatttgccaaatgatcttactgtgccttcatgatgcaataaaaaagctaacattttagcagaaatcagtgatttgtgaagagagcagccactctggtttaactcagctgtgttaataatttttagagtgcaatttagactgcataggtaaatgcactaaagagtttatagccaaaatcacatttaacaatgagaaaacacacaggtaaattttcagtgaacaaaattatttttttaaagcacataatccctagtatagtcagatatatttatcacatagagcaactaggttgcaaatatagttcagtgacatttctagagaaactttttctactcccataggctcttcaaagcatggaacttttatacaacagaaatgttgacagaaattgctgtagtttagggttgaagtactgtatgatgggcagcaatcatgtattaacttagaaggggaaattgaaatataggaccgaatttggttttatcagtttccagagtactgctgccaacctagacactgatttttcagagtttgaaatgtaaatttcttcccgggacttgattgcacatgaagctggactgcgttagtcatcctgtcccaaagcgctgtgggggccagggtggaggtctcaaggcatcctttatgacctggccattggatgtaaaagaaaacatattccatgctgtggttcttgtatcttgtttcattcctcaccattgaaagagaaagtccatgtattgtctccagcacatccttgaaatgttatactgggatggattactgatgcccatcggtagttgagccccagaagagggtagtagcatctctgcctcaggtgatgatttgtagcttggccagaggagagcggagtcaccagtatatctgtggtccatgttgctagctctggtaaaattaaaaatactggtaagatgtttgttttattagtacactagacagtaagctctgttttgttgttttcaaataacctattttcacttttgtttgggcaaagacatttaaattgaaattcaattctaatttttgttaattgtggaaagggtaattaacagttcctatcaggtatttttaatgtggaaaaggacagaaacccaactcctaaaatcttaaattaaggtaacagtgctttaaaaaaaaaaaatgcatggggcaattagtcggcaactcaatgagtgactaaagtacttttatttaacatccacaacttcaactgttaagttttattaattactaaatcagctttattaaaatgttgacatttatttagctattttgaataattatagtgacttgacgagtgtgtatgaggacacagccaatgtaagccagtgtatccattttttagaggtgcatttttttttaaagaattctgtagatagaagtgctctgaaaacaactaaaatatgtttattcatggtagtatcaaaaaatgtttgtacaaaccatctgcttctcccggccagccgagttcattctccagcaccgtgaccgctggttctcatgtacagcacatatgcgggagagttggcagaaaatttgtgaagagatgccgcaaaggaagggtctgttgacgggtgggattgggggttttgatgaagttgcttagtcctggttttgttttgaaaattactgcgttgcatttttgtgttaagtttttgaacccacgtgtgttttggtggagtatgagttggaagtcactgcaaactagcataaacaacaaagctcacagagtaggcacagatgtagagaacagagaccaaaatggggtgaggtggcagtaaatctaggatagggaaaaattaatgtgagggtgggaaataaactgtaattacctgaaatcaaatgtaagagtgcaataagtatgctttttattctaagctgtgaacggtttttttaagaatcattccttcctaatacatttgtgtatgttccatagctgattaaaaccagctatatcaacatataatgcctttttattcatgttaatgaccaacgtaagtggctagcctttatgtcttatttatcttcatgttatgttagtttacatacaggggtgtatgtctctgtgctgtccccttctcctgccttcattttaaaatgcatccatgggtcctccgtgtttcctttggccatgccacatatatagactcagtttggccttcatgatatcgcctgatttttgaggactgtatcacagtgatatgtatttgtggtaatctcatttgttggttgtacatctgatcctttcctcaacatggcaattgctgcctttcctaagataggatcatacaactgatcaggggattgaatttgatcattcatcaacatgtgtctctgaattttattcagtagttgtcattgctctttggtttagaccaagaaaaaggaaatccccccttttcatgtattccttggtttgaggacatgactcctgtaagggagaggaaagggagatgcttcctgtttgaactgcagtgaattcacggttcctgtttcaccactccaaaccttatggcgactcacacacacattcctcttttctgttactgccaaaggttcgggtttagtacacttcagttccactcaagcattgaaaaggttctcgtggagtctggggcgtgcccagtgaaaagatggggactttttaattgtccacagacctctctatacctgctttgcaaaaattacaatggagtaactatttttaaagcttatttttcaattcataaaaaagacatttattttcagtcaaatggatgatgtctccctcttttcccctattctcaatgtttgcttgaatcttttattattttttttaattctcccccatacccacttcctgatactttggttctctttcctgctcaggtcccttcatttgtactttggagtttttctcatgtaaatttgtataacagaaaatattgttcagtttggatagaaagcatggagaataaaaaaagatagctgaaattcagattgaagaaatttatttctgtgtaaagttatttaaaaactgtattatataaaaggcaaaaaaagttctatgtacttgatgtgaatatgcgaatactgctataataaagattgactgcatggagaagtcttcatcaa

SEQ ID NO: 128148 - DNA, 2333 bp, Homo sapiens
cttgctatttaattgatagagctgaaccatattctgtatactatatatgttgtgttcttccatgggtttcagccgtttttgcttttaaattagcaatgctgttgctagacttgaaatatataactagttacttttcagtgaagctcaaatgaggcttttctgtgtctctaggttatttgagatgacttttttaaaattagctcttgtcctccctctacaggagaatttgcagccttcaagtagccaccatcatggcagcatctgctcttatttcttaagtcttgtgttcgtacaatttgttaacatcaaaacacagttctgttcctcaaatctttttttaaagatacaaaatttccaatgcataagctgatgtggaacagaatggaatttcccatccaacaaaagaggaaagaatgttttaggaaccagaattctctgctgccagtgtttcttcaacaaaaataccacgagcatacaagtctgcccagtcccaggaagaaagaggagagaccctgaattctgaccttttgatggtcaggcatgatggaaagaaactgctgctacagcttgggagatttgctatggaaagtctgccagtcaactttgcccttctaaccaccagatcaatttgtggctgatcatctgatggggcagtttcaatcaccaagcatcgttctctttcctgttctggaattttgttttggagctctttcccctagtgaccaccagttagtttctgagggatggaacaaaaatgcagcttgccctttctatgtggtgcgtgttcaggccttgacagattttatcaaaaggaaactattttatttaaatggaggctgagtggtgagtagatgtgtcttggtatggaggaaaagggcatgctgcatcttcttcctgacctccggggtctctggccttttgtttccttgctcactgaggggtctgtctaaccaagcaggctagatagtgctggcacacattgccttctttctcattgggtccagcaatgaagataagtgtttgggttttttttttttcctccacaatgtagcaaattctcaggaaatacagtttatatcttcctcctatgctcttccagtcaccaactacttatgcggctactttgtccagggcacaaaatgccgtggcagtatctaactaaacccccacaaaactgcttaataacagttttgaatgtgagaaatttagataatttaaatataaggtacaggttttaatttctgagtttcttcttttctatttttattaaaaagaaaataattttcagatttaattgaattggaaaaaaacaatacttcccaccagaattatatatcctgaaaattgtatttttgttatataaacaacttttaagaaagatcattatccttttctctacctaaatatgaggagtcttagcataatgacaaatatttataatttttcaattaatggtacttgctggatccacactaacatctttgctaataatctcattgtttcttccaactgattcctaacactatatcccacatcttctttctagtcttttatctagaatatgcaacctaaaataaaaatggtggcgtctccattcattctccttcttccttttttcccaagcctggtcttcaaaaggttgggcaatttggcagctgaattcccagacagagaatagagcaattttagggatattaggactgagggagggtgtgggaaagctgtcatcagttgtttttatagaaagaactggcattcattaagaacctaaatcttatctttgcacaaatggaaaatataacctagttatagcttcctttggcctttattaaagggtaatatcaatcacagtcatagcaaagaaagcggatgtattaatggcaaattaatggaaaacctcccttatcaggaatctagactcagaatttaggaacacaaatcaaatcagaccaaccaagctatagccaaggacttgaaagaaattaaacaagacccagaataaatcaaggaattagaaattgttatttaaaaatttcagattgtaactccaggccctgctgtctatattgcagccactaaaagctcactaccattagatttttgctaacatacatgtattcagaagaaagcctattgaaattttcattgtcttgtaaaaggttgtcctagtaaaatggaaaagatccttaagttattaatcagtttgaaaagcaaatttgtttttaagttttacatcagcagggcagtgtcttacaaaattcagaaattgcaaaggtggaaataattcacgctgatttgaagaacatcttctgtgcaataatactgcctctctt

SEQ ID NO: 128149 - DNA, 1025 bp, Homo sapiens
ttagtcagccataccactatttttcttttttttttgagacggagtcttgctctgttacccaggctggagtgcagtggtgcgatctcggctcactgcaagccctgcctcctgggctcatgccattctcctgcctcatcctccccagcagctgggactacaggcacatgaagccacgcccggctaatttttttgtatttttagtagagacagggtttcactgtgttagttaggatggtctctatctcctgacctcatgatccgcccgccttggcctcccaaagtgctgggattacacgcatgagccaccatgcccggccagccatatcactatttttcaatagcagcttctgatgaggatccaagcaatcacttatatgaatatactgtttaatccaggaataacctatctaatttctgattgctatcagattccaactggttgctagataacactggcacatcccaacaacagattgctaatgactggatgattgaatcctcagctttgtaagctgatagtattagtgactgactgagtgcctgatgcctcacggaacagtttgtacacatctgcatccaattctcatgataaccctatgaggcagatgctatcatctatattatatagatgaggaagccagggtttagagtggtcaagtaacttgcctgagatcatatacagaaaattgcagagaaggaatgcaaacccaggtgctgactccaagacccagcagtccctaaacaactttcaacaattaacactttgttttcccaatctgaatacaactactaatgaactgcagatagtctattatctctttctatgcatgaattccttttaacaagcaattaactaaggtattgtgagtccaaagatcaagaaagggtaaaagaattattgcctcatatttaaagttaagaggattggggaatctagcactgatttaaaaaaaaaaaaaggctaaattaaattactaagaccttagagtaaaacatttggagtataatcataggaggctattatg

SEQ ID NO: 128150 - DNA, 1385 bp, Homo sapiens
tgtcttttatttccttgaagcaataaactaagtttctttttataaattttgagtgcaggtgaccaaaaatattgctgaggagtggcacgtttgacatgagtaaaatgtcttaacttcggatttttagcgggaaaatgttataaattggagtttcttttaaatagctttttttaaaatacattaaggatgtctcgctcatgtagaagtcaaattttgttgcaaacgcattgctcccttcacacccaatctctcccctgcaaaaaatcttcacagaattctgtgagaacttttaggtgtgtttttctttgagatacctctggttgccaaacaccaggtaatagattttttaaagttgttattagattattcttacctctcatgatgcatattttagcaatcaccttatcattgtgtctcatgttctgtcctccttatattctttgcccagcaagattctacttatgatgaatgaatgctcttctccttttttcattcaatggtatgaagtatttgttagggttctttagtacttacactttgttgtgtagaaaatgactgtaatgtggtggtcagtgtattcttactgtgattcagagggaatcaaaagtagaaagcaacagcacgtggtcctatcaaagatttggccatctctgcttcactgtcagcctcttaactatatcttcacttactcaatttggttttgtcatgatttttaaatgtagccaatagatcaaggttcttccagtaaacacatatctgcataaatgcctccttgaagtcaataaagaaggaaattgagaagactttaaattaatgataatttagtttttaagtacccacaaataaatttttgaaacattttctttatttgaatacttagatgtcatccaggaaaatcactcaataataattacggcaaatctttaacccctcatttgggtagcttaagataagtaatgccattatgaatcagaattgattcatgactttagttaagaaaatgaaaaggaacatttcacgtatttttaaaaatgatactaaggaataaagaagtacaactattggaaaatatctaagtatatgatttttaaatcctccagtggcattaaatatatgattattagtaattgttagatagggttttattcattcacaaatagaagactagcaagcatgtaactaacaaagtttttacaaaattgactttgtggaatgctccaaatgtttggccattttgaggcacaaggtcaggggtctctttattgatagagctccttctataatttcccagcatacctgcctcacagttatcttcctttcattgttcactctctttttcttctcaatgccatcctgcctaggctcccatcatctgcatctgacac

SEQ ID NO: 128151 - DNA, 1110 bp, Homo sapiens
gttaccctgtgagtgggaaaatggactggataaagagagaccaaaagcaggggagcaattagagaacctttgccacagtccaaggatcatgaagatttgagcttgcactccttttgtgggtttcccaccatctatgatgtggcattggttttttaaaactttttattgaggtgtaatacatacatcgtaagctgtaaatgtacagcttattgtgttttcaatgagtgtgaagtatatttttcaacttatctacaaggttgaattatttcccttttttttctctctccagataatttttatggtgggacgaggatacctgtctccagatctcagtaaggtacggagtaactgtccaaaagccatgaagagattaatggcagagtgcctcaaaaagaaaagagatgagagaccactctttccccaagtaagtaaaagcttcatgctatccaaaagaacagactaacattcatagacagatttctgagcacttttttgggcacacagtgtgtatttcatgagtttggattctatgtgcagactccagacaagaaaacacattaagatggcttcatgagggttgagcagtggcacacctagaaattttgggtcctaatacaaaatattcagaaagactttgcatttgtccatcagttctcagacttctcagtctttgaactcttttacacatttaaaaattatcgaagacccccccccccacaaagagcttttgtttatataagttttaattccttattagaaattaaaactattttttaaaatattaatgaattaaacatagtaaaccaatatgttaaataatatttagaaaaaaacagttctattatctaagagaaaaaaattagtgaggagttgtattgttttactttttttgcaaatccctttgcaaaaagaagacagctggattctccgcttttgcactcacattgcaatatctcacatcatgtcacccctaaaaactctacttaacgcttgtaaaataatgacagtaaaaaaggcaaatgatatcttattgttattacaaaaatagttttgacctcgtggatcccctggtggtccacggaccacattttgtgaaccactgctttattt

SEQ ID NO: 128152 - DNA, 1097 bp, Homo sapiens
ttagaatctctgaatctgttcgaatctaaaggcttttaaagaattaaaatcttggccaggcacagtggctcacacttgtaatcccagaactatgggaggccgaggcaggcggatcacctgaggtcgggagttcaagactagcctgaccaacatggagaaaccccgtctctactaaaaatacaaaatgagccaggcacaagcctgtaatcccagctacttgggaggctaaggcagaagaatcacttgaacccgggaggcagaggttgcagtgggccaagatcacaccattgcactccagcctgggcaacaagagcaaaattccgtctcaaaaaaaaaaaaaaagaattaaaatcttgtgaagagtaaaccatggcaaagattgtgaacattcagtgagaaacaaaggcttattctcttcccacaccactggtctctttgcaatttcttcagcaggccaagcgtgttccttctttaggacctttatgtttgttatattctctttaggatacacatgccacaaatatccttgtgtctcggttcatatgtccccttttaatagaaatccttgctcaccttatataactaacatgtccccacgtcactctgtcactctctatacccataggcttgattttctttataacgcatagctccatctgacttgtttcttgtcttttatccccactagaatgcaggctgtatgagagcaggggctttttttcattattttatgcctaatgcctagaatgggacctggcatactcagtacataactgttaaatgaaaatgattacacacaactgcatattattgatagatttacctttcagaagaaagagatgccaaatccttctcacatcacagctgagaaatgtggctgggcatgttggctcacacctgtaatcccagcactttggaaggccaaggtgggaggattgcttgagcctaagagttcaagaccagccaggaaacatagggagaccctcgtctctgtaaaaaataaaaaatttagcaaggtgtggtggcacttgcctgtagtcctagctactcactaggctgagttgggaggatcacttgagcccaggagtgtgaggatg

SEQ ID NO: 128153 - DNA, 1022 bp, Homo sapiens
ctttttagtatgatggataatgttgcactaaacatctttgtgcatatcactttttcttctgaattatttccttaagaaaagttcccagaagtagaattacagaatcaaaggatatgaacatttttatctctcttaatgtgcaccagtataattttttttaaggattgatgaagccattttttaaaaatttatttatttccaaagttcaggggtacatgtgcaggatgtgcagggttgttacgtaggtcaacatgtgccacagcggtttgccacacagattatcccattacctcggtatgaagcacagcatccattagttattctttctgttgctcttcctccttttaccatccaccctccaacaggccccagtatgtgttgtttcccccatgtgtccacttgttcttatcattcagctcccacttataagtgagaaaacacagtatttggttttctgctcctgcattagattgttgaggataatggaagccattggttttgaatggcctgaaatggacatcaacatttgattaggactaataattgtttcattataggtttacattggcaagtgcttcaaaatttagattgtattatgttcactagataattccaaattgttttgtgtaatagttataagatgtattgttttaattaataaaataattcttttaacgttagtggaaaattcagtgttatcgctactctctgattatatgcttgcttggaataaatatacattactatttatttgtaggacttgattagagaccaaggatttcgtggtgatggaggtaagtagtgatttcaggtttttttaaaaactcaaggaaactgcaattgctttgctgcttatttcctttatacttgcctctttcaagtaacagacacagagaaaaatgtgtagagaaacccaaaatttttttgtttttctgtagtgtttgtcatttacctctaataaaatgttaactagtttataacatgagtagaaaagatgactggacataaaaggaagtcttttt

SEQ ID NO: 128154 - DNA, 1114 bp, Homo sapiens
gactgctttatcagtgaccaagtcctatagttatcatacacagcactaaaaatcttatcggctgggtgcagtggctcacacctgtaatcccagcactttgggaggccaaggcaggcggatcgcctgaggtcaggagttcaagaccagcctggccaacatgatgaaaccccatctctaccaaaaataaaaaattagccgggcatggtggcaggcgcctgtaatcctagctactcgggaggccgaggcaggagaatcgctggaacccaggaggcgaaggttgcagtgagctaagatcgtgccattgcactccagcctgggtgacaagagcaagacttcatctcaaaatcttatcacctgtatcacttagttggcaatcaattgagcagcaaactttggcatctcttttattatattcttatgcaattattcttaaattatttgattttcacttacttccaatgtgtgcatcttacttcccatgagattgtaagctctcaagaatggaaagttaatgacatcactaggatttttatatttgttagtagccatataactcctgtcaccttcttttcaggtacgtatttgatttttctgtagaaaatgttgaagactttatatgatacattaaacatgatagaaatacatctttaaagaatttactttgttttagcctgtaaacaaaaagttgtctatttgcagagactattcagagatatttggggccattcaatccctcatatttaagttaaactaaataaacagactaatgcaagttctacccatcaaggcccaaattgcattaccagtagcgactgtccccactaccatcgttgttataaagagctaaatatatatatagttttttttttgttttttttctgtgatggagtctcactctgtcacccaggctggagtgcagtggtgcaatctcagctcactgcaacctccgcctcacaggttcaagcaattctcctgcctcagcctcctgagtatctaggattacagtcgcgtgccaccatgcctgtctaatttttgtatttttagtagagatggtgtttcaccatgttgaccaggctggtctcaaactcctaacctcgtgatccaccagcctcag

SEQ ID NO: 128155 - DNA, 1107 bp, Homo sapiens
gggtggaacgcttgacccagaagttagagaccagcctaggcaacatagtgagaccccatctctaccaaaagtaaaacaaattagccatgcatggtgaggcatgcctgtagtcccagctactctggagggtgaggtgggaggattgcttgagcccaggaggtcaaggctgcagtgagctatgtttgcaccactgcactccagcctgagcaacagagtgagaccctgtctcaaaagaaaagaatttcaatttgtgctatcataagcttggcattatgaccaacaaaaacttgattttttctgtgtttattttaaaattagcatataattgaaactataaattttattaaatattaatataaaagaaaaacttataaattttaattttgtaattttaggtaaatttgcaaatcagactttcttcccactttttactaagaaattttctctatttttattgggttcattttaagtgacttttttctagtactagttttccttaactagcaaggttcacctctatctagcaagacctaaaaacaaaggaagaaaggggaaaaggagaatgtgatataagaaatcaaaccatatgtccaggttagggttgttctcagtctgtccaaaattgcaaccttcatctttactttgaaaactatcatccttttagactattccctttttctctgattgttaccactgttccctggtatgttgggcttcatttagagtgtcatctttgtatcttgccttttcatcctctctcgtaaccagtcacagggtatcaccttttcatgtgcatctcaaactggtttttacttattaccgctgccatttgggcccatattttttcacttgaattatatactacattaatctcctaaatagattttctgccattgatttctctctatctatttccattccttctgcaactgtcagaatttttttacacttctagcatcatctgttctcttgttccaaaacttttagtgacttactgttgattacaaggtaaagtgcaaactctttagcatttttattcatgttcaagcacttatgattccattaaaaagatttactaataactgtgggctatgcattgtgttaggc

SEQ ID NO: 128156 - DNA, 1013 bp, Homo sapiens
cctaaagcaaaaataaagacagctctgtcagaaaccaaaagtttctcaataatcagaaaaaataaaaaggacctagatggaacatgctaattttcctaaaggcttgtttcttacctataattctcattgagccgataccaatttttttttagtacataatattttattatttgcatatcaattctaagtggattcatttcattaatataaacacatgaagtcaaaacttctttccttatctttaataatatgcttcaaagaagtaaaattgtgaactggtgtggttcagattctgacatgttttattcagagactgactttcactgttaggcttccttggctcttcaaacctttattcattcctttcctactatatttttttcccattcctcacgtctcacaaaagtgtctttttattccctcaacattgtctttctagctgtgtcttagtaaccactaataattagtttgcataaaatagggtggaatgataaccaatatgtgaagagagcttattggcacttagccattcattggtcctgatggagttaagtgagacagcttacctcatctatcaagtgacactcatttccccactcctaggataccctttctgaggggctacatccttccaagtgtttacaatctagtctcaaaactttagtgttctctgtgagtgccaggttcattttagggtgagatatcatagactatgttatttagctaccataccgaaataggtatgtaacatattttggtgattttccaaatagcatacaaatgtaacattttggtggttttccaaatagcagttttcaaaaatatttgctttagtggttaatatatgattctcttgtgtctctgttatcaataatgggcatgataaaaaatccagaatatgagagatattggcactctgaggatcatcttctgaatttgaaaaggatttttcaatattgttctggattttcattcaactcctgtaaaggaacaagtacatcattcaggtcctg

SEQ ID NO: 128157 - DNA, 2175 bp, Homo sapiens
atatgacttccacttatgaagaagcattgatatgtgagacaatggcaaacaatgtaaaaatagtatataattataatctacaatttatgatggagtatattgaagtatgtgatgaggacataaatgtattcatgtttacagaaggaagaatagtgaggaaaaagagagtgctcaggaaaacttaatgaagaaggtggtatttgaactagactttaaagaattactacaatctgaacgggcctagggaatagaagcatggtgaaaggggaatggagaaacaacagatataaagggaataaacagatataaagggaatgaagatgttaggtttagaagctagtgaagaaaggtttatctaacttaagaactaccatgtgtaaaaccagattatggagagtcttggaattgaggccagaatttagacttaaaggtctttaagcagattactaacttgatgaaaatggctttaaagaaaaaatcaattagcagtgaaatacagatggattgacagaaaatttagggtgaagaaggccaacctaggatgttgttggtagtgaaaactgagagaggcagtgaagacaagttcaagtgctagaagtatggaaaagggatagatattcataaagcgtaaaagaaaaaaatgaacagtattattaatcagttgaggataaagctgagaagtgactttaaaaataatgcaaaggcagccgggtgcggtggttcacgcatgtaatcccagcactttgggaggctgaggcgggcagatcacgaggtcaggagttcgagaccagcctggccaacatggtgaaaccctgtctctactaaagatacaaaaaaaaaaaaattagctgggcatgatggcacacacctgtaatcccagctactcaggaggctgaggcaggagaatcacttgaacctgggaggtggaggttgcagtgagctgagatcgcaccattgcactccagcctgggtgacaggtgagattctgtctcaaaaaaataaaaataatgcaaaggcgtcatttaagcttcatagtaggaaataaaaaggaagacacaataaagatgagttaagtgggtatcagtttactttggaacatttctcgaactcctggcctcaggtgatcttcctgcctcagcctcccaaactgctagaattacaggcgtgagacactgcacctaattagctttggaacatttctgacacaggtctgtgtactctttcacattgaatttggggcagcgttatttaggctgcgtctggaagcacatgctttaaaaaaaaaaaaaaaaaaaaaggccgggcgcggtggctcactcctgtaatcccagcactttgggaggccgaggcaggcggatcacgaggtcgggagatcatgaccatcctggctaacacagtgaaaccccgtctctactaaaaatacaaaaacaaaattagccgggcgtggtggcgggtgcctgtagtcccagctactcaggagtcaggaggatggcgtgaacccaggaggtggagcttgtagcgggccgagatcacgtcactgcattccagcctgggtgacagagcaagactccgtctcaaaaaaaagaaaaaaaaagtccccatacagcattctgtcctagaatattcctgagatgttaagattagaaatatttattgtcagttttaaccctacttcctcccactcttcacagtgtaatgccatttcttcagatttctacctagagaaatcttttcaaaatcagttgacattttcagtacaactttgtaatttttacaaagccaacctttctggtgatctcatgggttagaaaattttgcaaaagaattttgtcttaagcagtgagtatacttacctatttggaacactggaaaatgcagccgttgtgttctcttgtcaggttgtagcagttatctcttctagtggagtcattttattcccgttggctctatcactacttgtgtgcagctgtgttttttttagatggtcaaatcaaaatgttattatttggttggtttttaattaatcttttggttataatattttctcctgacagattctgtagaccatgatgcctttctaatggcaggtcccagttctgtgagcagttataaaacaccctaatgaaattagcttggcctctctgaaggtttataatggtaatgatccaggacatt

SEQ ID NO: 128158 - DNA, 1828 bp, Homo sapiens
ctattgggtgcctttgtaactttaatatatgcctttcttgttccgtcaacaccagtcggcatttcttaacctcccttctttgtatgataattaaagtataggcttcttcctttcacctctgtttcctcctccttttcatgtctacttttacttttatgttgtcaagcttgaaatcagttgccagccttttactcatttctcattttttaacttctgggtttttaagttagatagtggggtgggaaataaatatgtgtagtccatctattatcttgaacccccggttttcattttataatagtactttagtatgtgagtttcatgatataaatatattacaactttgttattttaaacaagagagtagatacgtcagtttctagaaagttttcttgtgagtttttgaaatctctgtgattttttactttgcaggtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgagtaagtaatccaaaaatatctcttttctacctaccattttacacttaaattttcttaatgtgaagctacgatgtctaaaagtctgtgagggtttttcttccatacgattgttatagagaattttttttaagtgtagttagagaataatatgtggaatggacagtatttctctcccaaattgtaatgctggttcagctatacagttaatttatattttatattatcgtttaattaatcaagacccctaacccatagaaaccatttttggatagtttctaggaggagagggagagttgtttcaattaaattaagcattatgattttgtaccacagatcaggtagtctgattctgttagctattttgtaaattacgtttatattcttcctctctctccttcatccccattcagctcccttcccccaatttatttgagtaagatgtaaaatttttgtatccagtatatatctctttctaaaatttctctttgctgtatgccagtttttctaatagattagactgagtctattatctctttttgtgtcattggtgctgctgctgttaaagtcttacttttcttgatcacctgagcaaataaaacttaactctgtactttaagtaaattataatgtcacctaatttacagtagatactttttattctcattctttaaccataaagcatgattttcatcttgtagtatgtagaaatttgctgaactgaatgattagttttaagttataagcatgcctttgaaagtgcaatacaattttttttaaaataagcctttagacaaaaatacaactaattgaattttaacagttgtttctgagaatggaatttgatctcagtttttttggttaactatgtattttggtatatgaagcttctgggttttgcacaagttaggtttgttttgttttgcctcacagtttgctgtttgtctccaagttctttgaacaccacccaataccacaggaagaggcgtccttagcagagactgccctaacatctggatcatccccttccgcacccgcctcggactctattgggtatggtttgacttctgctcttgggcgacatgctacttgaaccgctttcttttggatctcctggttaattagaaacctttccaatgtttaaattgttaaattaaggactttttccccaaataacttatcataccactcagatatttacatgcatttgatacaaataaatgggattaaagctgacatagactatttca

SEQ ID NO: 128159 - DNA, 2121 bp, Homo sapiens
ctttgaagttttcttaggatctttaccaaaacctagggaattgaaagtgtactttaggaaaaagtattaaaataatactaagttagcctgaagaaatactgtaggccatatgaggagttaaataattgtatatgactgtagggtttgttactttgatcaaatgattttatttggaatttgagattcttacaatttttgaaccattcagagtgtgatttatttggataatagactcttacccccctcccatttttaatacaaactcatagtttcacaaaaggtatatcaaaattaacattttatattgacctacttttctttcagaaagtgtctaacattgttccaagaccctcacattttgaatcctctttaaaaaaaaaaaaattattttgggggcatgttgtccctgtcccttgagtactctttttccttgaatggatagataagtccgtacctgtgattttttttttttttttttttttttttggaccccaggaacaatccattttctgctgttgtaggtcttttctggagctgacttgaagaaaagagtacatctctttaccctgctgtttgtccaagagtgatacatttatttggggtaaacttaaaattaatttattgccatttaaatttctaacgatggaatattagggagccaaacctccctcactgttactagcccctcgataaccaattttcatatcttcagcatgaggtatatgaatatttttaggtgtaataaccaagaaaggcttgtgtctacatttttcagagagaagaaaccaattggttgggacactgatatttcctggcttactggagaagaattgcatgtggaagtgttggagaatgttccacttacaacacacaactttgtatgtatctttacatttttttttgaaatgtcaaaaatgtttagattttaatgaatgaatttttatttagggaatgtgaaatatggatgagtaattttggaactgacattttacctgagttgaaatcagttgttttctttaaaaacttgtatttaaacaagagtttaattttaatctttatactttctttttaatttaaaaaagtaaaatgtatgcattgttaaaagataattttgaatagtgcagaagtatgtcaagtaaaaaaagtgaaaataccctcctagaggccaacatttgtttagattaacagattattgttctgtcttccaaacttttttctgtgtacacaaacgtgtgcttgtacctgtaagcctaaagttttttcctttctttttttctctctttccttcattactttcttttcttttccctttcttaaatcaaagtagagccatgctatgtgatattctttgccttatttttttttaattcaacaggatgtcacggacatcttttcatgtcagtatacctggctttattttagtatgactatgtaataattcgtaagaataggaattcattatatttaaccatttctctattgatagacatttaagtttttgtattataaaaaatctgttacatacagggctaaacaaggtctttctgcatatatcttgacacacttgtacacacccttgtgtttctgaaggataggttaatggaaatagaatggctggatattaaactctccatgaggcttttttctttgtctggtttttgcatttgctagaacctagcataagcctaagggtcaccagcataaggcccggaatgtgggacctttccaccttagagatgaggatctacatagaacttgagaacttatcccctaaaatggcaggcagaagccaaaagttgtctctgaatcaggaatacatttcttacttttctctatgtatggaattttggccagagttttttctaggtggataattactgctaccctttaggcgtcaagtgttttcccatgtgtcttggtgattaatccagctgggctcttaaagcagatgattgattagattatttcctttggggtttatgctttcaagcctccattagtagtgaataatgaaatcatgtttgtgtttctgtaaggcattttttgggagaagtgtaagatacacctaatgtcaatcaaattttactgtgcagcaaataattttttaacatgttgaatttt

SEQ ID NO: 128160 - DNA, 1050 bp, Homo sapiens
gatcacttgtgcccaggagttaaaagctacattgtgctatgtgcaccattgcactccagcctgggtgaaagagcaagaccctgtccacccccacaaaaagtcagatgtacacttagcatatcacacagcccttctactcctcggtatttacccaagagaaaagggagcatatgttcgtagaaagatttgtatacgaatgttcttagttgctttgtcatagccccaaactggaaataacccaaatgtccataaacaggtgaatggttggattgtggtgtatctataaaagggaatactactcagtagaaaggaatgaactgctaatgcacacaacatagatgaatctcaaagtaattatgctgagtgaaagaagtcagacaaaaaatgattacacgttttaaaattcagtttacataaaattctagaaaatgcaaactcttctatagtgacaacagatttgtatttgcctgggcacaggactatggcaggatggaagatttacataggagcacaaggaacctttcagaaagtgatgggtatgttcattatcttgaatgtgatgatggttgcatgggtatatacgtaatctcaaaatgtatcaaattgtgtactctaaatcattgcagtttattgtatgtcagttgtacctagataaatctgtttgtttgttttttaatagcctttaagaaagctgatagtactgtggaaatattatatgaaatagactttgggagaaagaattattattaaaatttttttttcaacttttattttagattcaggaggtacatgcacagctttgttatctgggtatattgcatgatgctgaggtttgatgtacaaatgatcccatcatccaagtactgagcatagtagccaatagtttttcaacctttgccctccccgctctagtagcctccggtttctgttattgctgtctttatgtccatgagtacccaaagtttagctcctacttagaaatgagaacatttgatatttggttttctcttcctgtgttaatttgcttaggataatggcttccagctgcat

SEQ ID NO: 128161 - DNA, 1092 bp, Homo sapiens
acatgatttggaaggtaaatataagtggaccagaaaattggaaatactgtgcttttttattattcatggaccatctagatatcacatatgtataggtcaaatttatcaggtgtaatatagtgtagtgtctaataacaaagaatttatcaatttaaaggtgaaagtattcatttatagtatttctggcacttattttgtaatttgaaacttaaaaccctatcaactggtgaaaagattataatcaaaggctaaaattttatattctcttttgttaatgtcaggacaaagtccggattgaatataagtctgctttattttataggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtgagtcagttttaatatcaccattttgctgtttctttgtatttttcagacagatcagttgttgaaaattaatatattattacttcatactcagaggtcatgcaaatagaggcatccatgtcatacaggaatgaaaaatatgtaattatttggtggcaaagtctatattccttaactgaaataaatggtattgtctctagtgttggatttgacatttaaacctgtctgccaaacttgaaccacagtcatgtctaagcactagtttaaaataaatcaggattttaagacttgagcttgttcattatctaatgtgtgtcaggtaagactcattcttcacccttgagaaatctcctttctgagttatattatcagatgttgaacgttcagtgtgattgatatgtttcccctcatctacttcatttttggttgttgaatattagtattaaccattggaacagcgtaccctgtaagtaacatttgaagcatttaaagagaaatctgtggaa

SEQ ID NO: 128162 - DNA, 1027 bp, Homo sapiens
ccaaaatttgtatctggcaagctagttgataaaataacaagaattagcctgaaaatcttaagatatcaccaatggcattgttgtagttgtgagccgcaaagtatgtgaaggaagacaacaatggccaaatcttagcaactgtttgagagattaatgttgaccttgaacagattaatgtaatgagatagacatttaagaagttgggataagtatgtgtgccccaggggtgcgtgaggttctaaatcgagatcatttcatcatttttattgcttttgtaaagactgtgatgcttctccgggtcttaaaggtagaatggaaataaatgcttttagaggtgagaggtttagagaaatctatggcagtgttaaaagagtaattgaagttcatattgaatgcagcaagggcagtaggtaaaatgagccaggggccttggtagattgcagctttgaggatagggacagatggaataagtagatgttttgtacttaacaaaaggaaaagctattgatagatgtggtgaagtgatagtttataatctgtcatggagggatcagtatactttcaaaaattaaagctaacattttggtaaggaaatatgtttggaaaattgttcttttcattacttttcctaaggtttattttgtctagtaactgtacttgctcaggtgacagtaaataagaatattttatccatgcaggaggaacctttgtgttccagactgcatttatgtgatcttcaaagagtaggaattgtgtttgtcttatgtgtggttgtagtctgagccctaacagtgccaagcacatgtatcagtatatatttactgagtgattgaaggctcaataaataaattttattgagagaagtatgcttaagtaattaggccttggtactgaaagctaaaccaaattgtagctcagaaaatttggaatctatctgtttataatgccctcatctactatgaaacagggtctgggtagggcaactagcaggctgtaaacaaagaagaccttttgatgaagtttaaat

SEQ ID NO: 128163 - DNA, 1185 bp, Homo sapiens
gaagactgagtatgttaaaaatgttagtatttctcaaattgatagtggatttattgaaatccaaatgcaaattcctgtaggtttttctatggaacctaacaacctgattcaacaatttctgtggaagctttaaagaggcaagaatagccaaaatatactttaaaaacaataaggtaggaagacttctttaattcctttttccactcggcaaatttttaatgctctatggtaggcactgctcatcctggttattacctttgtgaatgtgagatctggctcccacccaaagctcacattcagatccacttgtagtggtatctagggttttgaatagaacacttcctgaaatacaggttaagtactgggactaccaacaaacaaacttacaacactaattttattatctcatatttgtatttacaatttttcttgatcatattttttcatacaaactttaattagtttctattaatttcttttaacataggaagcttagaaatagacacactttgcttataatagatctttaatattatgtcagttggactatggctttgttagaaaaggagaggagaatctactgctgagtgctgtccaaagagcagttacccaactgagcagagagggaggatgaccttgagggtctcacaggcatgggtttttaggcccagcctgtggagcgtctgagggacttataaaaggaaaagggacccaggtgcagtggctcatggctgtaatctcagcactttgggaggccaaggcggttggatcacttgaggccaggagttcgagaccagcctggccaacatggtgaaaccccgtctctactaaaaataccaaaattagctggctgtgatggtgcacgcctgtaatcccaggtactcgggaggttgaggcccaagaatcacttgaatccgggaggtgaaggttgtggtgagctgagattgtgccattgcattctagcctgggcaacagagcaagactcagtcttaaaaacaaacaaacaagcaaacagaaaacaacagaaagaggagatgaataacaaaatggcaggtaatactaaataatatggatgaattttatattcttacatatgggtaggtggagggacacctgctcttgtggcagattagttgggaaaggatacacttgctggaacaatgcctaccatattaaataaatgaa

SEQ ID NO: 128164 - DNA, 1195 bp, Homo sapiens
ctgcttttcttttaaaaaaattttcttcatcttttctgtatcaaatacttactggtttttctatgtagaataacataatctcatcattactttctttcaaacactctccaaatttgacttgtctttgctcatgtttttcctaccacctgaaatacagatttcctcccccatcccaccctccaaaccttccagacttacctcacctaccgtttattgtaggaagcttttcttaacctctttccaagtcctagtttgatgcctctgctttgtgcttttgtagaatcccagagtttaccttgttttactcactatatcgtattgtggggtttttttgttaataggtatttctttttcctctagacctgcactgttcagtcatactttctgtgatgatggaaatgttcagtgtcgtcttaatatggtagacagtagccgtatctatgtggctactgtgcacttcaaatttgcatagcaggactgaggaactaaattttatttcattttaattaatttaaaaataactagcctgatggctagtggctgctttaatcagtgcagttctagaccccttcaaagtcaagagtgtgtgggattcatacttattctctcgttgcttaacaataatactgtctaatacttaaatgactgaattctttttcggtactcttagtctgcatagttataactcacctagaatatggcagttttgttctctagatttctgtctttaaccatggcttttcagtttgttttcaagattatgttgatttacacagcactgagttcttcagtcctgcgaagttagcgttttggttggatgtggtggctggcatctgtaatcccagcaatatgggaggctgaggcgggacgactgcttgaagccaggactttgagatcagcctgggcaacatagcgagcccctgtctctacaaaaaattagctgagtgtggtggcatccacatgtagtcccagctacttgggaggctgagggcgggaggattgcttgaacccagttcacggctgcagtgagctatgatcacaccactgcactcctgcctgggtgacagagcaggagtcaccctctcaaaaaaaaagtgtattttttcccctttaggactgaaaaaattgggtgttacaagattacctcaaggactggtctgagaactggggatggtaaggaagaaactcaagtggc

SEQ ID NO: 128165 - DNA, 1276 bp, Homo sapiens
ctgtggttggccgggcgcagtggctcacgcctgtaatcccagcactttgaaaggccctggcgggtggatcatgaggtcaggagattgagaccatcctggccaacatggtgaaaccccgtctctactaaatatacaaaaaattagctgggcctggtggcatgtgcctgtaatcccagctactctggaggctgaggcaagagaatcgcttcaatcagggagtcggaggttgcagtgagccaagatcgcgccactgcactccagcctggctacagagcgagactctgtctcacaaaaaaaaaaaaaaaaaaaaaaaaaaaaaagctgtgattaacatttgctttgtcattcatccaaaactacattggtgacttttgtattgagtcatttcttagggcaacaggtattcatgtattcagtaaatatttgagtgcctactatatgccaggtagtgatctaggtgcttagtagtacacttgaaaacaaaacaaaggtctctacccttatgtagctgctgtccagtggaggggtgtgtgtgtattgggggatggggctgagaaaccttagacatacagaaaggaaattatgtagtatgttcaaaggtaataagtgctgtggagcaatgaaagttaaacagtttagggctgggatgggggtaggtagcaatttaaatagggaggtcagggtaggcctcacttgagaagggggtatttgaacaaaaatttgagaaaggaggaggaggcatttcagataaaccaattagttcaaagattctgtgtcgggaatgtgccttgcctatttaagaaacagcaggaggccaaagttgctggggcaaggtagagactaggggattagggaaggatctctttcagttatctaggccatattggtgatagcagaaatactgagaagtagtcagattttggatgttttgaaagtagattcatcggggcttggtggctcacgcctgtaatcccagcactttgggaggccgaggcgggcagatcacccgaggtgaggagttcgagaccagcctgaccaacatggtgaaaccctgtctctactaaaaatacaaaaattaggtgaaatattgaaggagatgttttgattgaagtgattttaagagagaagaggaggggaagtaaagatggtgaggaattatcctgtaaaggggaacagagaaatggggccagagctagtgaggaaagtggggtcaataaatttttaatgataagaaaaagaagagcgtatgatgataggaatgagccattagagagta

SEQ ID NO: 128166 - DNA, 1033 bp, Homo sapiens
tataggtcaaaattcagtaataaccattgggtaggcatttctgttaaatttgtggtttgaagagctggctttaatttaaaaaaaattgtaaatattattaatgagttatacagtaattcaggtttcataaaatggtgggtaaccctttcactggaaaactgtctcttgttatatatatatttatttaaaaacctgtaggaacccagtggtctatttcaaactgaaggtggcatttcttctccttgggtcagcagagttgttaacatttcaaagaaggacatttgtgctcctctgccagcagcatgcctgtatcagcttttattacacatatctttagtggtgtggtggctggctgggtgcttgtagatcaataagctgctaaaaagggagctgcatcagagaccataatggcttcttcataggagatagattgtctccaggtagtgaagtgcatttaggaataacaacaagaatatccctgcattgagatccttattatttagaagaaagaaatagatcctttcaaggtgatgagtcctagaatgtactttgttaatttttagagacggagtcttgctctgtctcccaggctggagtgcagcagcgtgatctcggctcactgaaacctctgcctcccaggctcaagtgattctcctgcctcaacctcctgagtagctgagactacgggcatgtgccaccatgcctggctaatttttgtatttttagtagagacaaggtttcaccatgttggccagactggcctcgaactcctgacctcaagtgatccacccacctcagcctcccaaagtgctgggattataagtgtgagctaccacaccccacctaatgtactttaacatgctaaagatacattccaggaggtcttgtgtccactgttatagctgaattccatacaaattcagcttctgttaatggaagaattcccagaccgagaaagacaggattagttcccttggcctcaaatatttcttgattatagtaattcttggttaccctaccaatttaaaaaaat

SEQ ID NO: 128167 - DNA, 1038 bp, Homo sapiens
aagcctggctaatttttgtatttttagtagaggtggggtttcaccatgtggccaggctggctttgaacttctgacctcaagtggtgtgcctgcctcaacctcccaaagtgctgagattacagggtgagccaccatgcctggccagcaaacagcatattttaagcagatttagtgaagaatgcaaaggtatagatatttgaaataatcatttatacatagatagtgaacactgaatgatttttttagtgttgtgaaattactgattattagaattacaaggaaaccatgggaaatcaaatcccagctaatcctttaattttacagactaagacatttgtaactcagattggggaagtgactttccctgggtttttaggttattagtgaccgtaactactgaaaccttatttttttctgaatataatactctttgatagatacaatagtacacattttcctttgtacaacacccttttaatgaaaaccaagtaaatataacaaatgcatcatttttaatatgtgagtctttggttcctgaaactcaaaatgtgaaattcacaaaattataatttgcagacgtattgctgtggtcagtaatctattccgaaatgtaaaatttcagaatgttatcattagagtgagataggcgagtcagtgtgacaatcagaaaaaacctgcattgcagtattttaccctgacttttatgggtgcaattatattaatgctgcaatgctggtttttggaattctcaccaaccagtgagacccagtggaggaagctggactgggacaggacttgggtttctgtgtttgctttgttgccggtgatgggacctgggcacatgtttcagctctttggttctgttactcatgtgaaaaatgacaatttggactagatggaatttaagaccaagtccaaggctaagattctaatttttatatcagtgatagaaattgcacaggttttcattctattgctgttattaacaaggattaggtttggctgcatttgacaggaaacccccaaataagtggctta

SEQ ID NO: 128168 - DNA, 1032 bp, Homo sapiens
gtttcaagaagtatattgtggctgcgtgtccagatgattgtcactaaatactcctggcctgaaatgatagagcaggtgccaatggatgagatagcattcaccgggctgtttcccctacaagatttatccattactagagacactaagcagcacatggggatggagagctaatgttcaaagaggattcccatgtgctggcattgagctaagcataccacatatttaatttcaatgttatatttgccttagagacactagtcatcagggttattaatttccttttcaaggtagacatgtgaggactaaaatgtagaaatatacaatagctgcttatttcccacaatgtattggtctaatatagtcccttcttaggagcctaaaagggatgttcaagattgataagtcctgtggattaaccattgaaatctaacttaagttatgggggtcgtaataggattcagaatctaagaaggaagaaattattgacatagcagcttgaattcaaattaactccatttaaccaaagttgctgtgtttctttttgtgccagtgaataccgaggccacagagggctctttagggagctctagttcaggggtggaggagggtgggggatggggagagacattcataatacaagtaattacaaggcaatgtgataattacaatatagtagaattgctttaagcaagtaagataatttggaaattttttagcaagaaggaaaattattttagtgtaaattgcacagatactcttcagggaaacctggtagaactcttttgactgcacacactgtagatacctggaattcaaagagattacctagggaggcatcgctggaaacatgtcacgaggcattggcaaagacagagaggagaggataatgccaagctttgtggggtcttctttgagccctgcgtgtctccaggttcttattcccaaactgtagtgctgtagggttctgcaaaatctagtgtgcagcctatgctgtgaactggggtgacagatctatttttaactgataaaagc

SEQ ID NO: 128169 - DNA, 1053 bp, Homo sapiens
ttctcttctgagaatcctctcctgcaaactctctcatttctgcaaatagtgctcatacgctttcacttgtccttaagctcaaatgcagccacatcgtatacataagccagctcccctgatggaactccacaggaattgggaatgcctatagatttttcagcggaaatagaggcaagagaattggcatgctgtgagtcgatcttcatccaaaccttttccaaatccatattcttttcgttgtgtaagtttgtccagtgaatttcattatggtccgtgatagaaatgttattgtgtggagacagatgtaaatccacttctgttatataaacaagtacttttggacctcactctggaaccaccgtcagactggaaaagggtttggaagtagggatgggagtagtagagtttgggaaatgatgcgatttttttttttcctgaattccaaccaaacctgtaaatttttaagatttctacaaacttaggaaaagcctgtttagcttaggcctatcacaactttttatttttgttcaaatttgtttctgaggggatgagtctgaataagaatcaggttgcttccagatcccagacagctactgaggaccagcagcaaatgtgtccattttttgttgatagttcatctctatggagccatgcttattttagttcacataaaaatgtattaccaaatatctattacttcttgagtaaaatgaaattgaaaaatacttacagagtaatgacccatttccccatgtggatgcaagtggcaaatcttttcattcatgatttcagcatgtatttatcaggttcagtacgatgtttctgagactacgaaagggtatttggagtaacgtccatcctctagggggttgtaacataggtagagagacaagaagatcttcaataaaatgatttaaaagtaatttggctaaatatgtaagacactttgtagcctatatgctaagaattcaaaataagtatttttttaaggggtagagaaaccagagatggcttcctggaggaggcggatcaagaactggatcatgtagagtt

SEQ ID NO: 128170 - DNA, 1107 bp, Homo sapiens
tgcagattaccctgtgagtcacccttcacctccttcaggtctttactcaaatgttaccttctcagtgggactgccttccatgcagcagttacattataaaatgcatatatctgcttacattctaggttcccaaagcccattgcctctctgatcagagtccatttcttctgcaaccccaggggacaatcacatagaacctccctcctcatctatatgggttttataagggacacaagagaagttgctggaagtgtctatgttcccatatagaatgtcagtttaattattttaaaattatgagcaaaacctcagagaactgctttgaaaatgcagagaactgctttgaaaactatgtgtagttctgaggatgtcttccgtaaatataagaacttggtgattagagttactattagagccagacttggaacccaaatgattagatgacttccacacatctgagccgtccaggcttgtgagaagactggaggcagcggtgatgaggaatggggtggggtgatgaaaactaaaagggatggaaaaaaggagagggaaatggcttagtgattaagagtattggttttagtgtcaagacagcctggagtccaccgctggctcagacacttagtagctgtgtgactttgggcaaattatttaatctctctgaaccttggtcactttatataaaaatagagttaattgggccttcccctcaggacttcaatgatgaaatgagatcttgcatatgaaatacctcttgcagttcacagcatattggaagtgctctggaaacaggaactctggtattcttgttgctgtggtgcaagctctgagaataggcagaggccagagcaaatggtgagagaaaggttacagatgagatgaagtctatgagatgtgatcctcggacccaaataaacaacaacaacagcaaacaacaacaacaacaaatcctgaggaccagtatggagccacagttggaagtgtacttgcagaaggttgggtttccctgggaaatacactacgagactgagatttgaatgcagggggcttctcaggggatgctcttgggaacgatgcctggaaggagtgaaggaagcaggactgctc

SEQ ID NO: 128171 - DNA, 1050 bp, Homo sapiens
ttgtcctgcaggcccagtacatagaagatacttgacacacattttatttatgaaagatggaacaaacaagagaatgaaaggatgagtgtgcagagggcaaatatcaaccttattgtctgaccattaggaattcacaaacctaggctgttgagtccttctgaaggaaattataccctaaattcataggttactctttcaatttctacaacatttattttgaaatactcatgaatttccttacccgctctatgttctctatacttattcttagacaacctaactcctagttcaaagagaatataaaaaacatgggcagttaccccagagtgcatattgatgttctgtctctctgtctcagtggctgaagctgccatcctcctgttcagcccctctgactctcatcccattgtttcacctcccattggttgtccatttcctcacttgtatctttagtctcagactttcagtttctctctcccctatttgtcagaatcttgctcatacatcttcactcaagtctgcattcccatgtgtttggtgacctgttctcatcttccattgacaccgtcctcagaagtgtacctcacacttgcagtcctacctccattttagaataagcttagtaaaatggcttgtatcccatcatctgattgaacctgctcttgatgaggtcattaatggcctcttagttgttaaattaaagggatacttttcatgccacatttgattttcttggcccatatccttttaggtatctttagatatcttcctgctttgtttgtgccttgaatgttggtgtccctcatgttccattctcattctacacactctgtaagggatcacaaccacacagttgttttcaggtatgatatatggattttggagtcatcatatttttgtagcccaggtactgcttctcttgacattttgtatgaatagaaaacaaatattttttggtaacagatttgtgaaaaattgcatattttaatttctttttatctgaccccttttgattactgctcttagtttgtcttttggtatcagatatta

SEQ ID NO: 128172 - DNA, 1029 bp, Homo sapiens
tttttactgtatttataattttttttctccattgagaattccacccccttctttttctcccttcccccaagtttcaaagaaaaaaaagtctgtgatatttttcccctctgcataatttcccctcagcaggttgcagcagttgacaagagcagcagggactgctctcaactggagaagagcaattgcagaggagaaaatgaccctgtttgctgaaagtaaagacagtttaaggattgctcattcctcttcaactgcttttaccaagctttccagcttccctggggaagattatgttccaggttgttcggtttatcatgtcagcagtttacctgcaatagtctgtcactcatttctggtccttttagtagcaaagagtctgctaataaaaagtagcataagaaaggaggcagtggagtataaaagttgtctctggagttggactgaactgacgcttcctagcagtgtgaccctgtgctctctaagccttaggttcttcatctgtaaaatggggataataataatatctcaatgggtcactgaaggattgattaagtgatataactggaaagctgttagcatcctgtctgctagatttaagggttgaataaatgctagtaattgtgagtaaacttgatataatacatactcagccctgtggaagttaaaaccaagtgctgctggtgactgggttgtgagtgacttgagagactgccagtgggaagggagatgtggatctgccaggtggtctaaggtctgagccttttatttatttcgcctttcatatgtaacaagacagcttggaaaagtatagtttcaagactgacccaacataactacaaaagaggcctgccatacatggttaaaagcagcaagccgtgtcggaagccttttccatctgatttgggctcagattattcctgcatcactggggaccttgtcctcgctcttcccagctctggtctgtctccgcatgattttggctggtgagctttggcacaactccccaactaactcccttggctgagcagt

SEQ ID NO: 128173 - DNA, 1075 bp, Homo sapiens
taatacatgagcatgggtgccaaaggcagggggtgtctctgctttgagttttgctgcttactagctatgtggcctttatcaagttacttaaccacctgaacctctgagcctcagtttccttataagtgtaatgggaataattacacctgtttggcaggttagttgcaaggattaaataggtgtgtcaagtgcctggtactgtgctcagcttatagttatccctcaataaatgctagttattattattactaggtagttgactgggcatatgattgaaggagaggaaggtagtagaaatgattttttggcttcaagactaggataattggtgatatagaaataagaaagttgccagggagaattggtttaaggaggagattttatattctgttttagatacgttgagtttgaaaccccgacaggctatgggggggggaaatgtgttggatgccggggtaaattatgcataagccacacttgactagactcatagatttacttttggtgcagattatggtttcaataatggtttgtgctccgtttttcagtatctttggggtttctgacaaagcagatgtcttaccttgacatcagttcagattagactctgactttgcagtcaatggtctggggcctggcggcttcatccacagctgaaggtagggaggtttttttccccctcatggcttttcctcattcagattctgctgacatttgaagaaagcagtttgttttgctttttagccatttcaaagtttatctttttctctctgtgcacaggctgatgctgaaattggggtattaatgggtgctatttaaagaagctcatttatgggcaattaaataacatgcctgtcagcccagatttgatagggaataggggaacatttttaaatttttattttaagtacaatgaagtttaattatatttcctttctttcaactcttttgttagattatccagaaagcagatttcttcttttaaaaaaaaaatctatatatttattttgcttcctcccctctctcttgggagtggtgggctgagatgggcagccagtatatttaatttatattc

SEQ ID NO: 128174 - DNA, 1032 bp, Homo sapiens
atagtgataaatcataaattgaggtgacgtaagtgtggcatttgccagtacatatggtggaacagtggacagcactttcttgattgcgtttttgtcatttgagaatgtctgtagagaacagaagagaagcagagtattgagggggaaaatgccatgttgagaagcaggagacttcagttctaggcctaagccttttagtaacttctgtccaagtgggcaaatcaccaggccagatgcttttacagactaggtcaattagttattttctgggagctctaaggagatgacagcatcctgcttaagtgaacataccagaatcacttggcacttagagacctgagcttatagaattacatgtgctctgtgtgtgtgcccaaatgagaattattgctgtattgaactttgttactaatgggatattgtcatatatttgtttcaggggtttcagggtgtgtagagaggttgacaagcattggactagataatttctaaggactcttccaatctgaaaaactaagatttccaggaaatggaaattgggcttagatgccttttacaaaggcctttttttttttttttttttttttttttttgggcctggctgcttctagggctttcaaactttcacagaaaataaaaataattatagtaaaaacagggattttagacctgaaaattgctgtaaatatttggaagccatggttaaacagtgggtaaattcatatctctggggtgaatcacaatctcatgtaatgaggtaaaacatattttggcaaaaggctgctgggaggattgactttattgagacacaagatgctgcagccctgtttgtgttggttcattcctcattccttggaatagctattttgtcaatttaaatgctgaattaaacaatgaacttgctaactatgaacttgacttcctcccttctttccttaatgcttccccacttcttggaacaaaaatgctcttggcttgctttctattaatattaaatatgttgatcgttgccttgttaaatataccactaac

SEQ ID NO: 128175 - DNA, 1118 bp, Homo sapiens
gcatgcccggctaatttttatatttttagtagagacggggtctcaccatgttggccaggctggtcacgaactcctgacctcaagtgatctgcccaccttgtcctcccaaagtgctaagattacaggtgtgagccactgtgccctgcggttcttaggtttcagatttcagattcacagcgtccatacttccctgtggatggtgttctcttagtgaagccgcctgctttgtgaacttcaggggttgttttgcagcctggctatggaatcactgagcagcagcctttgacagcaactctggcaaaaagcaaagcttgcttattgtttttcattcactgtaaatgtcaaatcacccagaagagcctgttgccttttgaattcctgtgaaaatgcaaaatttaaagttttcaatgttataaaaaaagtctagaaagagaatataagcaaaataaccttttttcaagtttttctataaattggttattgttcatcttttctgggtatttgatttcttaacttttgttaaccacattgaagttactatcttagcagtgccagcaatgtgcattagcacaagctcttagatgaagattctggagccccggaggtgactggagccatttaaaatgcttttatggtagaaacctattttagagaccttgacgttaaataggtgatcacattctgacagaatgctttcatttttggaagccaaaattttgcctcatgacaaaattctccatttatgatttattgtctgacagtgatataaaaaacaagtgatttagataagacagtagcagaagaaacttaatatcaaatttacttgtggcaaatgacctaatttccactgggtaagaaaaatgcaggatatgtatattagttttctgttgttaccttaacaaattaccacaaatttagtggttcaacacaccacaaatttcttgtcttgcattctgtgaattagaggcccaaagcagctctcactgggctaagacaaagtgtggcaagggctatgttccttctggaggctctaggggagaatccttttgcttttccagcttctagaggccaccacattccttgactctcttcagagccttcttccatcttcgcagctg

SEQ ID NO: 128176 - DNA, 1034 bp, Homo sapiens
tgtttgtttctggattggtcccaagaacacagaactggactggtagaagctctgggaatttgtttgtgtctgcagttgtctttgtagatttgtctaacccctgaatcatccctgatctgaataacccccaaggatatcagttcagagcaagtgttacctctaaaagtcaaatcttcttaaaattgttgattcatatttttaaagctcatctccaagttcaactgatccatatcatgtacactgttatattccatgagattttacttaaatattcatttatatggctaattatagctggattataatatttgtcctttcaaatataagacagcatttttgcccccccactgcaaaaatgtgcattataccttgcagatgaaattctgagactgagttgcctttttgttttatatcatttgagcttatgatgtcagaaataccaaaatagaaacatgaaaatcaaaagtggcaaatgtgtgaagcatttagtaataaaaataggtggcagacctcatgtttgtttctgaaatgttttaatggatgacagtgagaatagatactataaattaattcctctctttagcgattgttacaatagatactataaattaattcctctctttagcagttgttacagtatatactataattcctctttttagcgattgttatctagctgttctaaacctgtgttttacgaatttgattacttctttgtttaaatgtattatctttcatatggctctaagttgttttggaaatcaattcaaataaactttaatattaaattaaaggtgatccccgtcccaagccaatcattagcgactggaaaatcttcctggagtacagtggtgtgatgttggctcactgcaacctctgcctcctgggttcaagcgattctcctgcctcagcctcttgagtagctgggactacaggcacacaccaccatgtccagctaatttttgtatttttagtagagataggggttctccatgttggccaggatggtctccatctcaacctcgtgttccacc

SEQ ID NO: 128177 - DNA, 1051 bp, Homo sapiens
tagagtgagactctgtctcaaaaaaaaaaaaaaaaaaaaaaaaaaaaagaaagaagaaagaaaattagtaaatatgtattaaattggattctataagatctaagtcaagtgacattaaggtaataagaacaacaacaagaaagatagtttgggctgaattgtaagtggtaggcataatgttgtctggagtaaaacacagggtctctgaagtcagtttttctagtcatttcttgagaggcagtgagtgtgacttcacagacaggaggacacatcctgctttatttctttgtaattcagtggtttaattcagattgtctaaacagactattctgcctaactgaatcatatctgctgggctttgttagagccgcttccctcccccataaacgcaccagtcataatgcctattgatcatttttgtttaatatcaatactaaatcatgccaacaaatcaacaagccctaatataacacagtcaaaatacctaagataagtaaattgtcagtggtggcccgtggctgaagataacagagaactcagcctgggtctgggagtttgaggaatctggtctgtttactgttttgccacttactagctctatgatattgtgggagttaattcacttcttaaatccccagtttactcatctgtaaaatcagaaaggcaatagtacatactttaaaaattattatgtggaatagggacctttggtattaaatgagataatgcttattaggcactatttccatttcataataagcacacaatgtaagaaatataaactgctgaaattgttactcttgactatgggttaggttcagaacagtcttcacttcgctatcccatccttcccagaagctcttgtacctctccttcgacctacttcagtgtaactcttctattcctttagagacctaataaattaacaacctgctaatttctgatgaaacttatggcaatttgtttaagcaataaccagttattttgagttcctgcttctaagaggtatctacatttttaaaattaataagcaaatttttcagagcaattt

SEQ ID NO: 128178 - DNA, 1930 bp, Homo sapiens
caatttctaatattgtacacttccaggaaatcatagaagttaaaaaggatcatttagtctagtttaccatgcaatgttgaaccctcttttccaacttttctgtcatgattttccagttgtttgcccccgggggtaggagaaaggggaagaaaactaacatatttgagtacctgtaatgtggcaggtatgagagacccaagtatggttatgtgagactgatgtttgtttcttcaatgattggtgaaactcacagctaaaaccatctggatctggagctttccttgaggggagattttcttgtgtgtgtgtgtgtgtgtgtgtgtgtgtgtgtgtgtgtatgtagagacaggagctcactatgttgccaaggctggtcttgaactcctggactcaagtgatcccccccaccttggcttcccaaagtactgggattataggtgtaagctaccatgcccagccttttttaccttttttaaatttttaatgtacattaaatttctttaacagttctagaagtactcaggtttcattcttcacttaatttttgtaaggtaaattcttcaaggaatttgtttcatctaaattttcaaattaattgacatcaggttgttcataatatcttctatttaacttttaaatttctatagcatatgtaatgtctcattttcattctcaatattgtttatttgtaccctctctttttcccctcagtaatcttgtgagaggtttgtcaatttagcccttgccaagaaccgttttttggcttattgatcctctcatttatatgtttcattcatttctgatctttttttattgtttcattcattctactttttaaaaaaatttttctgctgtgctttttctgacattttaacttcattgcttatttcatttttaccttcctttcttattgtatgtatttaagctacagatccactctactgcttcagctgcatcctatactttttgatgcataatatttttattatttatttttaaatattttcaaattttccttgtgatttttcttgatctatgtgtttttgaatttccaaatctaaagtttttctgattgtctttgttaatgatttcagacttaattgcattttggccaaaaaatgtagtctataaaattctagtattttaaagtttgttgaaatttgttttatggtctaacatgtgctctgttttcataaatgttgtatctatgcctaaaaatagtatatatcagttattgggcactatattctatatatgttcattaagtcaagtctgttaattgtgtgggttcaaatcttctatgtccttactgattttttcttctgttttaactatataaattctcaagagggggtattagaaatctcccactgtaattgtggatttgtctatttcactacatagatttgtccatttttgcattttgtattttgagacttaggtcattagatgcactaaagtttcagattatttcatttttcttacatttcgaccctgtcatagaataactatttttagcacaaatactgccttttgtgatagtctatcttatctagtactattggtaatttatactagcttgcttatttttagtttttgcctggtatcatttttatatccctttatttttatcttttttctctcctgagattttagatgtattgttgataaaagcatgaaagcaggatattgtaaagcccattttctcatcttttgacttgactgtttaattcattccaacattctataccagttatctattgctacagaacaaaaggcctcactgtttttctgcttatgattccattggtcagtagtctcgcctgggctcatagtggcatggctgaggaagggtggtcttcgatggctttactcacgtctccaagttgatgctggctgtcccctggctcatgttgtctccactatgtat

SEQ ID NO: 128179 - DNA, 2458 bp, Homo sapiens
agttagtgcagactccaaggggttaagggctgagtttcacaagactgtccacacttcaggcgccagtctcacatcttggggaaatggtcacctgttcttctgacctgccaactacaaatccagggttctcccaacctcccctcaggttcggtaactcaaactcaggaaagcactttacttagtttaccagtatattataaaggatactactcgggaacaacaaatggaaagatacataggtcaaggtatgggggcagagggattggcatagagcttctatgccctctgtaggtgtgcctcctctcaacacttcagtgttgaggtatttgcttccagcctggaagctcctcacactccattgcttaggaaggttcccttaagcaggcatgatcaattaaatcattggccattggtgagttaactcaatctcaggcccctcgctcctccctggaggttaggggtggggctaaaagttccaaccctctaatcaccttgctgatctttctggtgaccagctcccatcttgaagctattcaggggcccaccaatcacctcattagcacaaactggcaagattgagagggccttgccatgaataacaaaagacatttttatcgctcaggaaattccaggggttttaggaactctttgccaggaaccaaggacagagaccagacatacatatgtatatatatgtacgtatgtatgggtttttttttgttttttttttttcctgagacagagtcttgctctgtcgcccaggctggagtgcagtggtgcaatctcagttcactgcaacctccacctcccaggttcaagcgattctcctgcctcagcttcctgagtagctaggattacaggcgtgcatcaccatgcctggataatttttgtatttttagtagagacggggtttcaccatgttggccaggctggtcttgatctcctgacctcgtgatccacctgccttggcctcccaaagtgctgggattacaggcgtgagccaccgcacctggcccagatatatatatatttttattatgccataggtgcttaagcccatctgaaatccagacatttaatttttgtctattagtatgtatagtgtgatatcagttggagggagtgtttcctattttaatattagttgcattatgtctattgaaatttagtgtttggttttagaagtatacatattattggtggcttaaatggttcattgaagtctatgtatgtatctgaaatcaaatggtatcaataaaaatggtaagtcttaggcattgttttgtgactactttgaatcctacctgtatttctttatgtatggtcataacaaaacaataataacctccttttatttagtgcaataccagttatgaacagttaccttaccagttgctttacatactgctttacaactggtttactgagaagttatcattattccctccctcaacacacataatttcagtgatgaggaaattaagatccatagaatttaaggtcactcagctaaaaagtagcagagttgagatttaatccaggtctcttgggctctgacatctgtgctcttgtcattacatctgcttcttcctatttgcatgtacacttgacttcctataaaggatgtaatagaatctgcacttgactggaaatgatgcccttgactagctagctgtgtaagagacaaattattgggtttgaattttattttcaaagtatggagctgactagatggtttctgaggtccctctggctctaaaagtgtaaaactgtaacgactatacataattgctttgatagctatttttttcatgtctatcagttatgtaaaatttacgaagacagtcaatgtaaaactttaaagaagatatcccacatttttaaacctttaaccttgtggctctaggttgataaactcaccaaaggcttccttggtatttcagacagattatgagggacaagccaagaaactcctggaactgatggaaaacacggatgtgatcattgttgcaggaggagatgggacactgcaggaggtatgactgtttttctctttgaagctattttgaaggtgagaaaaatggaaattaaatcctagagcaatggtatgttgtaatttaaagaaattttttattttaattcattattttaggattgttgctctctaaagctagtatagctttaaatttttctcctgcacttccatttcattgctttttgtaaaccctctacccagcacatagaaggatttttgtattatcatatttaagtttgataatattgaatataacagaagaaaaaatgatggtggatgggataatcttgttatattttgaagactcttatgaagtagccctgtttgtaatggaatcatagtttccatcaacaggtatgtttcttataaaataaacagatattcagctatccattctcatgtcatttccattacatataatat

SEQ ID NO: 128180 - DNA, 1003 bp, Homo sapiens
ctcagaaaccatctagtcagctccatactttgaaaataaaattcaaacccaataatttgtctcttacacagctagctagtcaagggcatcatttccagtcaagtgcagattctattacatcctttataggaagtcaagtgtacatgcaaataggaagaagcagatgtaatgacaagagcacagatgtcagagcccaagagacctggattaaatctcaactctgctactttttagctgagtgaccttaaattctatggatcttaatttcctcatcactgaaattatgtgtgttgagggagggaataatgataacttctcagtaaaccagttgtaaagcagtatgtaaagcaactggtaaggtaactgttcataactggtattgcactaaataaaaggaggttattattgttttgttatgaccatacataaagaaatacaggtaggattcaaagtagtcacaaaacaatgcctaagacttaccatttttattgataccatttgatttcagatacatacatagacttcaatgaaccatttaagccaccaataatatgtatacttctaaaaccaaacactaaatttcaatagacataatgcaactaatattaaaataggaaacactccctccaactgatatcacactatacatactaatagacaaaaattaaatgtctggatttcagatgggcttaagcacctatggcataataaaaatatatatatatctgggccaggtgcggtggctcacgcctgtaatcccagcactttgggaggccaaggcaggtggatcacgaggtcaggagatcaagaccagcctggccaacatggtgaaaccccgtctctactaaaaatacaaaaattatccaggcatggtgatgcacgcctgtaatcctagctactcaggaagctgaggcaggagaatcgcttgaacctgggaggtggaggttgcagtgaactgagattgcaccactgcactccagcctgggcgacagagcaagactct

SEQ ID NO: 128181 - DNA, 2295 bp, Homo sapiens
catggtggaattatgagaatttttttttgtatttaggtatttttcagtttttacagaatactatccttcttcatatttgtcaataagaacgatttgttaagtgcacactctctgagtgtagcaaagtgcttttttcctgtatatgtacttcatagtggtaaactagggttttctgtataattgatgtgtacatcatatttatacccattttatagaacttaaaacatatttttagtaatacaacttggagtttttataattattttatcttagcctttattgtattattgatcataggtcaaaaataaaatctaatttagctctgattctattggagaatactatatgttttaagatccagtgcatcttttaacagagcttctaagaagaaaacaggagtaagtttatggtctatgaaaattgaatccaattcttttattgtaaaggaaatacatattatttataacaatgttttattattacatttgtaggttgttactggtgttcttcgacgaacagatgaggtgagcattaaagagtaattgcattttaacttttatttttctgttcttttttattgcttttctttcttttactttttttttccattgtatattttaaaacgggtacaaattgtgctttcttgaattttagaaaagaaaatactgctacccatgtcatagaacacgtatattaacacatggggacttttctggtttggtaattgatggtatccaataactttgacaatggttatttaaaattttgttatggaatctttttttcaaagaactttttcataaaagaaattgtggcatattcatatagtgggaatcatctaacagttaaaatgaatgaactaaatgtataaatatctacatggctaaatctcaaaagttttgaataaaaaaaaaagcaggttgcccaggtatgttatgcatttctacagtgttttaaaattcagaaaacaatactatgtatggttaatggatgcttaaatatgtagcaaaagaataataatgtggatgaaaaggaatcacaccaacctcaggataatggtctcctctgggaagggagagaggagaatagttttagaagggactttcattgtatctctatcgttttatttcttgaaacatatgaagcaaaaaggtaaatgttaacatttgttaaatataggttgtgggcacatgggtgtttttgtaacattattttatgcacttttctacaatagctagaagatccttctcagtccctttggtaatagtacattgtgctcagaattgttttgaaccttacagtatctattgtatgtgtggcatttaattaactgctatgccagtaccatctattatttgaacttgtttattctctttgccttatttgtacttaagatagtttataaagcaccttcacctgtcattggtcactgtataaatggtagacatttttagttgaattttatctgcaactttatcaaatagtgtgacaatgttatacagtctctgttgcactagtgcattgatatattatcttcaaaaccctcattatcttaaccaaatttctttcaaacagttgtcattaatgagtactaaaatatttcttccaaattctgagtcattttgttttcattgactgccttgttttagaaattacccacctagctttatttgattactggtctaaggatgtggaaaggagatggggaggcagatacagggtcagttatttgtcatagtggacacacctgtgcttctccattaagcctgattttctgatcataacaataaaactttcctcttctttccccccccaggctaccttcagtaagattcccattggatttatcccactgggagagaccagtagtttgagtcataccctctttgccgaaagtggaaacaaagtccagtaggttgtcaatgtggggaattagcatttgtgggtgagcgagactgggaatgaaaaatttatgtgtatgctataactttcttgagttttgatagcctgaaacttcaaataattaagaggaggacctagatcagagttcagcctttcagttcattgggaagtctcccaacttggttgtgggactcttataataagtctccaggtcaggtagggaggtgaatacttgatgtccttttgtcagttatgaagataatatccctgacctaaaccgtttttgtgcttgtacattgtaagattctttagtgaagacatatttgtgctgctcatttgtttgctttaagtatatgcaatgacaaataacaagtcccttgtgaagactgaact

SEQ ID NO: 128182 - DNA, 1059 bp, Homo sapiens
atcttggctcactgcaacctccacctcccaggttcaagccattctcctgcctcagcctcctgagtaactgggactacaggcgcatgccaccacacccagctaatttttgtatttttagtagagacggagtttcaccatattggtcaggcttgtgttgaactcttggcctcctgatacacccacctcggcctctcaaagtgctgggattacaggcgtgagccaccgcacctggcctgtgcttatatttaaatgtctcttgtctcttttatgtttttctttgaaatatgctgattttgtgaattgatgaaaccagtatcaaatttaccacaggctctgtgtattgatgacacaacccaggaagaaaattctgaaaatcagttcctagaaaacgtggtacaacagtctctgctctggtttctgaggaacccaactaagttggatacattttctcttttttccttatttctgaaaattaatttcagaatatggggaaaaagattatagacaaagccttgtactataagcattatagataaagcctgataccacatttttcttcttttaaagaacaatccaaccctattaaacatatatctgacgattctccatagataaaagaaatagttcttggaaacaataatgccttatatttagctttttagattgttcaatctgtgttcacatttcacttgaatctcccactcagtgaggaagtcgaggtgagattcgtatcctcatttgacaggttagggaaaaaaagaatcctttgattatgacgagttgtgctggagatgtaactagaatttagattttctttctcatagtctgttggtttttccacttaagtgctttgtccaggtggcatcatagttggcaccattccatgatttttgaagggcagtttttcccatatagacatctatgatgcctgataacttgactttaaagtaattactgggaaggtttatagaattctttgtagctttttctttttgttttttcaactagattcttaagaccctgccaacccagaaccaaataaggcatagaggggagttc

SEQ ID NO: 128183 - DNA, 1082 bp, Homo sapiens
tatgagaaaatggaacaacaatagaagaaagagactagaaacatttacatgtatatagacatgatgtatggcagaggtttattgaagatcaatgggggaaaatggagatttcaataaatggcgcttggacaactggctttctatttggaaagaacataaaattggagctttacctccatcattcacaaaactcacttataagtgggggtatttcctttttaaagaaaaatggaactatgttgcaaatcttttcacctatttttcccatgtcaatagatagaaaataatacatatataaaatagatatgacttttaataaatgtaccaaaatttattcagtctgattagttcattgcaaatattttactattatacagtgagcatagttgtataagagatcctaattttcacacattctatactcctacagcttctttcatacactgaatgtgctgcttttaataagtgaacattttgagctattacacggcagctacactgcctttattgtattgcatttgcttttatttttataaagaactgtgcaaaaacgaaacaaatgaatttgctgctactagtgataagcggcacagtatcgtatacttttaaataggcacaaagataaaaagcacttggcattgtgagtgtggctaatcttgagcgcactcacatactcactgaactcaatccattcagtggtactcagtcatcagagaaaagaacaatggtaaagaacatgaataaaatactcggaatacatattattaaagacttggtataaaggagatgtataattagacattttatctttctcttttaaattcctctggaacagaatctatttttttttttttagcattcacatatccactttcaccagtgtttttcagatttccattatgtaaaaaaggactgcctacattatatattcatcaggttattccagtaggataaattcctagaaatacagttaatagggcagaaggtatgcatatattttagacactttatgtatactatgccaaattgctgagacaggatgttccaatctatattcccatcagaaacacacaccaccacta

SEQ ID NO: 128184 - DNA, 1115 bp, Homo sapiens
tcttagatatttaattttatcaagtactcttccagcatctattgagataataaagtttcctcatttaatctgtcaaagcaataaaatgaattgatttttgaatgttaatgtgagacttttggccaagatgtagcaaaaagcaccagctttataccttaaacaccttaaaaattggacaaaatctttgaaacaactatatgagacattggtatgagacaagcagcataggacagtgagtccagagagcaagaagttgaacacagtgagcctgatgcttgcccgaggtgactgctggagagaggccacagcctgcggagagggagcccacacagagcccatgccctacctcagttgaggggtctttgagaatttgagaaatcaaggcagctagaattgcaaggcaggatacaagagagccccatggagaggagagccgcacccagaaccaagctagaggtttacggaggtgtcctctggaatcttcagctgagtactgacaggtgcatgcatgtgagaaaccaccacccgagatagaggttgagttacctaccagtgagcaggcgggacagtctcaggagagtcagtcctctcacaaagccaggaatagttcgtgttcaaaccaattagagtagaaaatcctcttcagacatggggcattgggtagtgtcctcagaaaggtattgcctcagtagtgagtcaaaattaattctagactaaaggctgccctcttccctgttaacaaagctaaaggctcacctccaaagaaccacagtttctttctaggtaacttaattgtgcctccagaacaaagctttagaacaggggtcagcaaaggacagcccacaggcccgactatcctgctgcctgtatttgtacagccttgaagctaacaatattttttacatttttaaatcattgaaaaaaatcaaaagaagagtatttttccccgttacgtgtggaaattgtcttcaaatttcagtgtctttaagtcaaattttactggaacacaggcaggctaattcatttgagtatattctctggttgctttcagctactatggctgagttgaatagctgtgagagagacctcatggtctgcaagcctacagtgttcac

SEQ ID NO: 128185 - DNA, 1036 bp, Homo sapiens
ttattgatattactatgtgatgaactgagtatgcatatactgaaatggaaggaaattttaaaactattattctagaagaaatgggcagttttgtaatttggtggtggctgagaccccatagaagttttactatgtaaataatttggagagtgaataaggagattgtgctatgaaatcctgacagcgctctttaggaggcagacttgacagtcctaggaaggttgacataaaaataccaaccttcagtaaagctctagtacaaaaaagggtaaatgtcatcattcttatttttaggcctctttcttgagagaggtgggagtgggaggtagtgttataactggcactttaatttgtttttggaactagaatttaggggcagttggatgaaattgcaaatttagaaggggaataagaattttctagtgctatataaagaaatgatgatggagacaaaagccttgctttcctctttttagaatttattttcgatttttagcatactgtggggcttttagagctaatatgatctaaattcagaaaatttaattttcatagtaggccaggtgtgaattacttatgtttgctatagaatgcttatttagactaacaataaatttactttgctttctaaggccagtcagcgaatgtggggatgaggcaggatgttttaaatgagccagagatgatccacaaagtgaacagtcgacacagaggtctttgagttggatggttgcaaatatattgacattagagtgaaaactccttcctttgggtaaactaaagaaagataaagtatactaaaaaattttaagatggtgttatacaaaaaaaagtttgggtctaacgtgtccacaaagactgtcaagtgaagaatggtggagattcttggtgtttgagcagccaacctggatgagtgacttcagggacagagcagaggaaagcaaaatgaatttcctttatttacccaaaacttgttgactgaatttttgtataggtccgggaaaataagcctaaacaaatagttgtagccttagaa

SEQ ID NO: 128186 - DNA, 1029 bp, Homo sapiens
gtagtattaaaatatgataaaatgattctcagtgttctttttagggaaattccatcctaataaaaacacctttgaacataattgcctttgtatgattttctgtgaatcagactttcgtcagtttgacaaacttccctaaaaagtatctgaaatctgccatcttctcagaatagtcagacacagcttagaccatgggtttcctgtctagctcatgaacatttgtaaaagtgaactaagtgactacaagcaacctcctcccaactagttatttgttataggaggactatatttgttatagtaggactacctccttgtcaaaacttaaaatgcataggagccctgaaattggcgctatcatccatcttacattagtaatcattatatgaatatagtgatgatttttttcctttttaaaatataaatttgtctgaaggtctcttgtcatcactttgacataagagctgtaaatcactctggagtagagatggttggagaatagaaggctatagttggttgatgaaaatcttgactcaacagtttgtgtcatagtttggggtaagccaccgtggcagtttgcagaggcggtgtggcagcggggagtgcctatttttaatcactgctgttccagggccaaccataattagggatgtttcccttgctcagtgaagctatattttgctttttgttcattgattgatggaaattgtaggacactgagaaaataaagatgggctaagagggttttgtcgctttttattcctccctcaattagggcttttccggggctgcataacaaagtgccaaaactgagtggcttaaaacagcagaaacatactgtctcactgttctagaggctggaagcccaaagtcaaggtctcagcagtgtgagttccctctggggctatgcaggagaatccgttccaggactctccctgagctgctggtggatgctggcaatctttggggttccttggcttgtagatgcatcatcccagtctctgtcgtcacgttcacctgctgtttgctgta

SEQ ID NO: 128187 - DNA, 1023 bp, Homo sapiens
aataactttctatttggtaatatttctgataaatgaaacagacaccagaggacaattccacaaatctattcattttttaaaaagtcagaaagaccagcagtagaaagtaaaagccacaaaaaaacaaaacaaaacaaaacaccacatcatgattggccaggtgcagtggctcacgcctgtaatcccagcactttgggaggccacggcaggcagatcacaaggtcaagagatcaagaccatcctggccaacatggtgaaaccctgtctctactaaaaatacaaaaattagccaggtgtagtggtgcgcgcctgtagtcccagctactcaggaggctgaagcaggagaatcacttgaacccaggaggtggagattgcagtgagccaagatcacaccactgcactctagcctggtgacagaaaacaaacaaacaaacaaaaacacatcatgatctaaaatgatcgtgttgtattttaggaagtaacatctctgagctggaaaactcagaaaggttatgaatatgagataacatataatgtggggtgattttaaaacacaaatgatttttaatgacatcggtgctttaatttaaaataatttgacaagaaacaactctccaaatctaagtttatatttttagtgcatttcaaaggtactcactcatttgataattctgtaaaagttttcatagagcgctttattgcataaacacatccatccagcctcttaatgcacttgtagactgtaccaaattcgccaaccccaattttttcaacctccaagaattctttttcatagcgggaagccatgttggtttctcgtaaaacacatctctaaagtattttaataaaaaggaaattagagtaattctaccatgttgtaagcaataaaattaaacagtattacagtcctaagttgctccaagttttcaaaaagacttttgaggtgactgcaatgaattctacttgggtcaatattcatggtagcaagaatctccccaattgctgactatcttctttgttttc

SEQ ID NO: 128188 - DNA, 1318 bp, Homo sapiens
tccgcccgcgcacaaagagaagatcgcggaacttcagagttaaggggagccgtttcccgcagcgctagccggcagtatttccaaggcgcaagttgcggagtttctgtttcctttttcctctggcgagctttgcgttccctgtgcgccggaagtgatcccctgcgtggctgggctgctcgggttagatcgtcaggtgagggaggaagggatagccagcgcgaaggaagtgctggagtcgtgtgttttggctgcgcgtgatcctgcgtgggtcgggaggtgtttctgtgtaggtgtctggccctttcatcagtcgtgcggaggaccgcgtgatttccttccagttctcctcggttttcaggtggtggcgccatcttcggtaaagggtgtccacctctccctatggtgtggctggctagcccgggggtctctacgctgcttggtctttgttaacggagatgaaggcagtaatttttcagtaacaggtttcagatataagtcccttggtgatgctaatatttatggaggccttactatgcattaagaacttttttagaagtttagaaaatggcagtgaataaagcagatacaaatctctgctctaagggagcttgcatagtaatgaaatttgagaagacagtggattggaagtgggattaactcagaatcaaaattttgtcgatgggttggaggaagaggaagttatttgggaccaaaaagacatacaggtgtgagtttatttgggagggaggaaggaatcctcatcagatgtgcaggaatgttggtacgttgtggtcacaaaattggagtgcataaaaattatgaatatagttaggaatttaggactggtgagttgtacttttgccataagaggtaatgtttttttcttattttgtttttttccttcaggaaaagcctaaagattagactgtaagaaaagaaaatagaagccatgtttcgaagacctgtattacaggtagtcacttgtctgtattaatactgagatgtattactatcagccacagtgatcagaagacttctttaggcttttaactacaggggcaaaagacctttgagctcacccacccacctctatactcatttgatatggaggattggggacgattttgccagtgtaaattatgttcactaaaacaaaaaaaaagttcaggtttattcacacgtaataggaatcattaatttttaaaatgtgtgtgtgttgcttgaatttaaccagtgagaggacattaaaggtctttagtgacctaaagactgtaggaatcattgttccaacttttttcttaaggcatgtagttgcttt

SEQ ID NO: 128189 - DNA, 1822 bp, Homo sapiens
gagcatctcaagtctcagtggtcaccagagatttcactatgtagaaaatgccttctcattccacttagtatgggtcctcacttttccagacactagcccaccttgagccagcttagactaccatttttcctcacttaccacattcgggcaccagctcctgtagattcttctttggctctcctactccccatcctcctgtgaagaccaatgaagaaccagttcctccatgactctgtcattttccccaccttaatcctatattcttggatccccactttaacctgtatgtatctttaatctatttttttctgtattgaaatgtgaaacatgaaaaagttattgcttcttaacactaacgttacagtattaaaatgtctttaaataagagttaaaagtttaatttaaaaaattatccaagttaaataatcctttcctaatcttctccagtagatttttgtgtgccccaaatgagacattgttattataaatctctgtgtaagatttatgaggtctagcttgtctgagcactcaaatgacatttccagaatcatgacacaggttctcattagcagtttgattctatagtatgttgtactcatatctttattttcttatctgccctctgctcctaagtttagtgataggattagatagccaacagcaccctggggattggtgtttatttgattggtggacttctgctttttatattaacagtactgccacttcaaaaatgtttctctgatagaatggctagctctctgagctctgaattcagtgatgtgtactcccatctttacaggagctcttgaaattaaggaggcagcagagggcttcgggaaagcagtagcattggtgtcaagggccctgggtccttgagatcacttgccacatacttcctgcaggagcttgggcaggtgatgcagtctctctgaggtgttttctcagccctaaatgggaataattttacataacttgtagatttagttttagaattgataatagataaatcccttagctgatattcagtaatgattgctgctattatgtggtagtgactacctttgctgacagtgatgtgactttgacttggacagtcgagtctttgtgtttaatcaaagaaccaaatttattagaccttttttgatgcactaaaaacaggaaatttcctatgaaatatttataaaaactgtattaggctaagctcactactgaagctgtttaatttttgcaatagccttgtgaagtaggtattatgtatcataatttttgcttattttaaaatgaaacactttagattagtcatattaggtatcctaattccttttaaggtctgaaggagcaaccaggggaaggcagtttcatagacacagggaatctgactttggaatatgttcctgttgctgtgtcagaaagtcattcatgtgattagttttagaatgtattgttttgttggaatgtaacctatctctcgttctctaaaccagcagaccccaacctttttggcactgataactggtttcatggaagacaatttttccatggaggaggggggtgccgtggggatggtttcaagatgaaactgttccacctcagatcatcaggcattagttagattctcataaggagtgcacaccctagatccctcgcatgagcggtttataatggggttctgctcctgtgagaatctaatgccactgctgatctgacaggaggcggatcttggtcagtaatgcttgctcgctgcttgctgctcacctcctgctgtgcagccaggttcctaacaggccacagaactctactagtcctcagccctggaggt

SEQ ID NO: 128190 - DNA, 1022 bp, Homo sapiens
atggattaaatcagtacccatgttggatctaaatttcttaatttctaaagtctactgtaaccaaaatacagtagtaatataccagttgtttatactaaaaaaaaaaattagaggatgtatatattgaatatatgtagtactttttgtctctttttgtctttccagctaatgaaagctggattttgaaaatacttggcagcaactcttaggtacaggttggatttacaaatattatcatactctgtaatgttaaagtgatactattttgatttttccttttgtgtgcaaacacagaagtgccataatcaaggagatgtcgcaaaataaatgggagtactataacttaactttgagcatgccttctagtaccttccttctacctttgggcttctgcattaggctgctcttgaagtgtttgccggggccttctggcactctgttgggagaacatgagaagagcttctcttctcttctggaattttcaggaactactgactatatggtgaatgaacgtgagtaattcttctgtttgcatttgcctttcctaaaaaattaaagccatgttattcatttgttcttctttaggtacttcgtcagtttgtaagacatgagtccgaaacaactaccagtttggttcttgaaagatgtaagtagctaatttccaagtttaaaatgttatttttagtaatttgccaatctcaaatgtgttgtagaagaggtatgctgcttgggttaaccatgttgccattgtgcttttagctcatgtttgctcttcagatcttagccttgacacatcaggctgtggagacatagtataaactgagcccctgttctccttatcagccagttactactcattcttgtcaacactgtcctgcataagaatttccttgagtcatatttggttatctgagtcttcccgggttatgttgtattaggctgagattgtaaaagatattgtttcttcacagaaatattcccttgtgtttataaagattttcagatctcagatttgttctttt

SEQ ID NO: 128191 - DNA, 3386 bp, Homo sapiens
tctctcctgaccttgtgatccgcccgccttggcctcccaaagtgctgggattacaggcgtgagccaccgcgcccagccaggtgtggatttctttaatggtcagcttagaggctgctataaaaaaataccatagaccaggtggcttcaccaacagcatttatttctcacagttctagaggctaaaaatccaagattcgtgtgccagtatgattgagctcttggcgagggctgtcttcctggcttgcagatggttgccttctcaccgtgtcttcatatggtagagacagaaagttctgaactcttcctgttcctatagggacacctcaccctcatgacgtcatctaagcctaattaccttttaaggatcccacttccaaataccattacattgagggttagagcttcaacatacaaattttgggggaaggggcacaactattcagtctatagcaggttgtctcatttggtcttgatgttgtgtttcagccctgaatcgtgtgcacttacttgggcgagtgggtcaggaccctgtcttgagacaggtggaaggaaaaaatccagtcacaatattttctctagcaactaatgagatgtggcgatcaggggatagtgaagtttaccaactgggtgagtacaaaagactggggttttaattttatcagcaataaatagatattatttattgccagttatctaatttagagataaaccactttaaacaagatctgtctttcattctgtttgttctcttagaaatcgtgacattggttttcctgggcatgttgtctgttggcatttgtaaccaatttcctatttttatgatttaggtgatgtcagtcaaaagacaacatggcacagaatatcagtattccggccaggcctcagagacgtggcatatcaatatgtgaaaaaggggtaagttgaagagggaaggatcttatgaattgaatgatttaaagaaccgataagaagtgttctcatggcaaggagtgtgtagtctcttaaatccctgagtactactaatgactgtattaatttaagaggtatttactaagtccttgatactatatgcatggcatgttgccatgtgtgactaatttgaagatatataaaacatagttttagctttctaagaacttacagtttagggcaaacagggtgtgtacataaatagaaatagatgaggcaggagagaaggcaaagtgtatcaagtggcatttgagcaagtcaaacatctgctttgaggaattcctgtgcctctgtggccggggatgctgagggtggcttcttgcctgttggctgccacatggtatttccagcagaggatctggaatgtctgaagcctgacatgccaacttcatcttcgtggcagttattttatatttgatgattttctgtaggcttaatagttcccttttggaaggcttggattgagtatgtataaaaagtatgttttccaaactcatagaaggacaaaacggtgtgtgtaacagcagttgtattgatagttaatatgtttagaaatgtacttgttttgtagaaagaaaacatattttatgaaaaataatttagcaatcactaaaatttttcttttcaataactgtatagcttttcttcctatgtatcttcattgccctttatgtatgtttatgaatatgtgcacatacacacacaaacacatataaggtatttcaagggaagtgtctgcactcccacttactgattgatgggtgtgtgtgtggggtggggagcacctgatgtttcactaatctttctgtgttgtacttttttggtggtggtagactctcaaaactggtactattgtcatctttccactcttgaaaatcacgattaggtttgttatctagtttagcctctagatagtgtagaaatagtcttagtaattacctctaagtggtatactaagctgatacagtgtagaaatagtcttagtaattaactcagggtaatattatactaaactaactacaaatccatattttgaattttaatcatctaagtttctaaggtcatagaaaataattgataaataagtgaaaatcaagtctgttagggactccaaaatcaaaggtcaaggaaaatgatacattggaaattattcctagagatttaaatgttgccactaaatttccctttgaactgttttgttttattttttaacttccgtaagagaaatagctgacagatgaaaacattgtctgttttacctagatgttaccaagtctgtttggacactctgtttcagtactcctaatcctgaaccttgagaagtggtagcaaaaattagcttatatatgattatatatttcatccttgtcatatactcagtaccaccctgacctgactcttataaagcatattaagatctcaactaaaaactgtacattttatttatatcaggtctcgaatttatttggaagggaaaatagactatggtgaatacatggataaaaataatgtgaggcgacaagcaacaacaatcatagctggtaagaagcttgtgaaaatagctgtttttttctttttctccttttcttttttaaaagcttggctacactgtaactaactagggttaagagtaccagtacttatgagttaaggcaactcactagaagatgtccataactcttatttctctacttgctaagagtttgtacatttatcccttcctttaaaaaattatttttatacttacagttttagtcacaagtaacttttgaataaagcctaaaactgaattatccatcccagtacttattgttgagaattacaaaaactctgaatgtattgtcttttggaaggatctagccctaaccaggaagaagcgtatgccaagataagaattacactaatgtgagtgtgcagatttattcggaacctctttggtacttagtatgtgaaatttctatttgaaattaagatttttttaattttattttttttgagccagaatctcactctgtcacccaggctggagtgcaatggcacaatctcggctcattgcaacctctgtctcctggattcaagtgattctcctgcctcagcctcctgagtagctaggattataggtgcgtgccacaccacctggctaatttttgtaattttcgtagaggcggggtttcaccatgttggtcaggctggtcttgaactcctgacctcaggtgatccatccacctcggcctcccaaagttgtgagattacaggcatgagccactgtgcccagccaagaagtttttaattttctctttttttgtttttgttttgagacagggtctccctctgtcaaccaggctggagtgcaatggtgtgatcacagcttactgcagcctctacctccccaggctcaggtgatcttcccacctcag

SEQ ID NO: 128192 - DNA, 1499 bp, Homo sapiens
tcctgacctcgtgatctgcccacttcagcctcccaaagtgctgggattacaggcgtgagccaccgtgcccggctagataatattttttaaaaattgatttttgggctggatgcagtggctcacgcctgtaatcccaggcctttgggaggctgaggtgggtggatcatttgaagtcaagagttcaagaccagcctgggaacatggtgaaaccctgtctctacacaaaatgcaaaaagtagccgggtctagtaatgcgtgtctgtagtcccagctactcaggaggctgagtcatgagaattgcttgaacccaggaggcagtgtttgtagcgaattgagatcacaccactgcactccagcctgggcaatagaggaagactctctcaaaaaaaaaaaaaaaaaaaaaatttttttttttttactatggaaaatgtcaaacatgtataagagcagaaaaaatggtaaaatgaactcctaccatttcgcttcagtgtcagctgatggacagtgttatatccatgcctccagcgacttgacctacacctggattattttgaaacagattctagacataagtttattcataaatttccatagggatctctaaaagataaggtgtctttttgaaaatgtaactaccgtgctattatcacacctaatattaataaattactgttaatttttttactaaatatcgtagtgttcaaatttccttgataacttcataaacattcatacattatattacatgatttctaccttaagtctcttagatttgccttttatctttcttctttcctttgctccagagttcatgtcttaaccaccataccttattaataatttataatttgtatagaatgctcacatggtttcttactgctaagtttctttgaaagtgtattaaccttgaaaagcagtgtaggtattttcctaccctcctgtgggtcccaatataaaccacaagtgtgggcaaactttagattgttcggattattgagttgttactaataagccaaacggaagcatttcagatgatatgctgttttgttttttttccttgtcactaggttccactagcacagtcagtttactttaggtttatgtctaatggtaaaattgaagagctcttcagtgacatttgaattgaagaaaatagagtttattggttgatctgttttattggtgatttttttttctcctagggatcctatctgtaactaaaaaaccaccaccagtggatggcactcttggctttttccacagtgatattaattcgagtagtttgttctgaagtaaccgttctggaccaaaacattctagtttttggaagactatggtcatgaacaaatattcagtccttggtggataattttatagttacaagaatcttttggaattataaaggaaatgcagtcattcctccatgtcccttgtttctgcatctgtggattcaaccaagcacagattgaatatatgtgaaaaaaagaaaccaataaaaa

SEQ ID NO: 128193 - DNA, 1807 bp, Homo sapiens
aaaagttagccaggcatggtggtgcacacctataatcccagctactggagaggctgaggcaggagaatcgcttgaacccaggaggcagaggttgcagtaagctgagattgcaccacttcactccagcctgggtgacagagactccatctccaaaggaaaaacaaaaagttattctgtattgtaatttaaaaataaaatttcttctatttgaatttttaaagttaaaaacgtaagtaaatcctgtcattgctaacagggccacatatggactcttactctttcctctagacccccagagtgtagaatgtgatacacttttgtccttttctctgaggatgtgctgcctagtgtcgtggaatctgcctgaccattgcaagcatccaattttgtgaccagttcttttgcaggaaattgtttctgagaagactggaagacaagaaatatcccacctcttctaacaagatctgaattgttcgaaaagcagccagtgcctaacttgtagctccacttatgccaactgtatatatacctctcgtgagcatagcaagtgatttaatattttgaaaagatggctaaaatccttttaatgaacagcactaaagttatatgtattagaggagaattattgaatgagatggagaaagagttctgaaattaatatttacattttggcttttttacagataatattatatttctgagtgaccagacgaaagagaaggagtagaaaggatgattcttctttggccatcatttggtacagtctcatttccaagtcatgtataatctttatggcttccaaggacaagaattaaaatactcttttacgtaaaatgagtaataatcttttttctgactgtcgttctcgctctcctttttgtggtataatcttggtagctactatctgttatggcatttactagttgtttattcttctaagggtggtttctatgtacaggtatacaaaatagtaaactttcaggctcatttgtgttatggcaaagggataaatatgctttgggaaggtctcctggtttttgtatacacttttattacaatattgatttgtccaatcagtgaatttactgagcatcactgtatgtgagacatttatcccatatttgtaaatattgattttcttaacgttttgctctgtagacatgaaggcaaggactgaatcttctgtttgcctgcactttaaaccatgctttacatagaatagccactcagtaagcattgatagatgaatcatcccaatgggattctaagcttcagctcaaattgaagggagttgctgagcagtggttagtgtctaacctaaacatctttaagactaacctaccttcttcatatcttttgtttttggacagtttcattagtagcattgatgaaacatagtttaccagcaataaggacctgaataattagagatgaaatcgttcatctccaggtgatgccacaggagctgtagttctgttctttctctgcccctgttatctgtggggaaaagaaagagagatcagactgttacagtgtctatgtagaaagaagtagacatgagagactccattttgttctgtactaagaaaaattcttttgccttgagatgctgttaatctgtaaccctacccccaaccctgtgctcgtagaaacaagtgctgtgtgctgtgtcgactcaaggtttaatggatttagggctatgtaggatgtgctttgttaaacaaatgcttgaaggcagaatgcttgttaaaagtcatcaccactccttaatctcaagtaccaagagacacaaaacactgcagaaggc

SEQ ID NO: 128194 - DNA, 2059 bp, Homo sapiens
cttttgtttttggacagtttcattactagcattgatgaaacatagtttaccagcaataaggacctgaaatataactagagatgaaatcgttcatctccaggtgatgccacaggagctgtggttctattctatctttctctgcccctcttatctatccttttagagtcttcttcagaactcttggggaaggtagaagaggatcctcttaacaacctctgtcagtgcctcccttagagccttaggtcctacattttccttttatttttccacatgaatcattatgtacatcatgtaatcttactttttattacaagattcaggaaattttagaatactaataatttgccaataaagatgaaatagtaactcagtttttcagtgcatcttttgctctttaaagtttacatcagccctcccgaggtctgcctgccagtttgctgctgtatcccagaggttggctgccactgtgcaggttgttttgttcaaatggtagaagtctctcgtactgtctaggccactctgtctccagtttggcctctgacccagcctatatatttgcttcccagcctacatgttctgtcctctctgcctgagagtacgagtacagtgctaactgtagcttaggtcatattggactttattaggttcagaattcccaagctatgttataggtctgtgacttttttgttttaaggtattttctgcacacttgagtagctttttttatacctacaatgcattttggttgaggaaagatggaattttttagctttatcctctccttgctcaggaacagtagaaaattcattgctgttttctcctgccagccatctttctttttcctgcagctgggacagttaatcagcatattaactctgctctcttaagttcacacattaaaactgcctggtgatgtagtctttattccttcatgccacattccttaagcaaaattgggcagtatataaaatttatctttttagcaactctttcttctatcagcacagcagcttttatactccttaagtgttgtgagaaattatgcagattaacagtcctgtttaagcagggtaataaatctctgctttgggaaaatgacatggtgaacagaagagcttaattaccaacctggagcagtttctcagccctgaatgcaggggtggaagaggatgctgtgctggatcattgtgagccgaggggctctgctttaaactctcccctggaggttgcctcttctctccatgcctctgaaaggctgtggagctgaagcagtggtgctttatcagacttaggtgtgtagcatgcagtcttcagcatgcgtatgattctagcagaatgattctcgcctcaagtcagtcagacttgctagggaaactttgcctacccctgggaagccctatctgctgagaaactttctcctgctccctagctggtctaggaagagcgcatttggaaatatgatagcagtaaatagcagtaaaagactaggggtcttctaacccaagttttgggtcttgcatttccctttttgatgtgatagtgtcagggaataaacctcagaaaactgcactgtgacctcgatttggagtttcctgttaaatggtaagatgaatagtatacctagaagaatgggagaaaaagtttcaaacagtatgtctggggtatcccatttttgaaaaagaagttgtaatgaagataggcttaatgtctggagggagaaacatgaggatgttattatctctagagagggtgattatgcgtgattttccttgtttctttacagttttttaaatatatattttagcattgaacatatattacttttataataaaaaaataaaactttttatctggggaaaaaaacctttccattatttctgagccagactaatttactcattcacttttagtgagtaccactttactggatatgaatgagaaaatcttttatatattttcccccactatctgtattttagcatctcatgcttttataattcattcatctgttaatacgtgtacacagcccaaaatgatttactttgaataccaacctagc

SEQ ID NO: 128195 - DNA, 1084 bp, Homo sapiens
gtactccagcctgggcggcagagccagactccatctcaaaaacaaaacgaacaaacaaacaaaaaaaccaacctatatgagatctactgtttgctgcctttacagttctcaaagaatcaatcatttcttaaaacacactggacattttattcaaagatgatccaaaaacaccaaagatatatttctgtggcagttttggcaatagagtatacatttctttaggaattacttgtcattgcaatgtggattacagcctaacttttgcagccaagttaggagaaattagtgctgttttccctttgttccctaatgagatcatggcaattcttgaaggcagggttttcttttactaaaaccaccctttttccccaatctaactcagcctcacacagtgacatggagattgataaatgtttgtcattcggttaggtgggacttgaaaagaaaatgagggcaggatcaccttgctatttttctgttagagtttgcataatattctgtgaagatttgtgggagtaacagcaagaaaatcgttgtggaaaatgagaggcaagtccaaggttaatgaattacagggaaatctcttaaagatgtaacaataatcatattaatgactgtcatttctcttctggttactatgtaccgagctaagctaagtactttttatcattgtctcatttagccattatcctaagaagaaggtacaataatcccattttacaggtgaggaaacccaaaactgggagaggttaaataacttgtcaaagtcatgcatcttccaggatgcacacctggaggttgaactcaggtatgtgaagtttgcattttgctttctgcccaatgcctgcctccacttgcattcattctccactggccctccgtatccacagattcccgcaaccaactgtatttgtctgttttcacactgctatgaagatactacgtgagactgggtaatttataaacgagaggtttaattaactcacagttccgcatggctggggaggcttcaggaaatttatggtcgtggcaaaaggtgaaggggaagcaggcaccttcttcacaaggcagcaggagagagagg

SEQ ID NO: 128196 - DNA, 1029 bp, Homo sapiens
tttgacatgccctagagacattttccccattgtcttgactattaacattcggctccttgttacttatgcaaatttcttcagccagcttgaattcctcctcagaaagttggtttttcttttctaccacatggtcaggctgcacattttccaaaccattatgctctccttctcttaaatataaggttcagttgggcatcttctatatatcatgcacccatataggacctgaatgtagggatgtatataacaggattcctgcactgaaggaattcacaattaagcttatgaggggttagggaggataagcagaaacttttatagctaactgtgatagggtgtgaggagtagcttagaagagaatggataggtgagctttcagcagaggaaacagcatgagcaaagatccagaaacaaaagtttatgaaacaaaggtgaggcatggaaagtgggttggggctagatagtaaagggccttgaaagctttcagagaactttggcaatggggagcaatagaaggtttgaaaacaaggacatcttatcagaattgtgcgttaggagaacaacaaagacagagtgaagggctagaaggagaaagcctagaggcagttaggaagctctaataagcctagaaaggttagcaagaatggggatgagaggtgacttgaggggcgtttgggattcaagttgatttgacaaatagtaattgtgtaccaattttgtgctggaccctgtgctaggctctgtgttagagatactgcagagaatcacttatagcttctgcccaagatctagtggtgacacaaccactattgctaagaggaaatgcaattcagaggtggttctgaggttcctgcatggagatgtgtggatagtagcacttcatttctgagtttatggaacatggatgtgggagcagagttgagagggggaaagataatgagcttagttttgaatatggtttatctgtagactttctaatggctccttggcagggtattaattatattagtctggagctccgaggagaag

SEQ ID NO: 128197 - DNA, 1146 bp, Homo sapiens
ttctacctaagcaaaggaggtagatgggaggggcagtgtggattcaggattggctggtttgcttatcaaaggagttttctcaggcaagttggctaactccaggaattagctaaccttgggagggcatgccctctctgggtctgcaaggcccaaaagtgtcaaagcataaaatacagaaaataaacatgattaatgcactacccagtatctattgtcccttctgtatttatagaacccagatgtgacagggtgcacagcacatgtactgcattcctgttcttttcagttaggggttgccaaggggctataggcagaagtcacttggtgatgctctcagggaactttctatatgagttactcttgggaggcgtatcctgtgtgcttccccagactctcgtcctacagcattttcttttttgtctgaaatgtggacatttcatggctggatttccagttgccatcttggaccatgaggcagtcttcagaatggaaggtagaagaagctgggatctgcaatcactatgcaaccaccataccagcctggacagtttgcctctggactgctttgggagacaaaaatatacctctcctctaagccatttacttgtgttgtgtacttaaacctaattctttcttattcatatattgttgactttatctccgtatacatgagcaactctttactcttatctttctcttacatgacctttcacggcaagtagaagtaaaatcttttctttattcccacaatcctttaggttttaaactaatgtctcattaaatttagggaagggagtaggacataaaaagtatacaaaccttagcaattagctttaaaaagagtcaacataagcatactttaatacaaactacgtactgcttaattctgcatatagtcctgaatgaagatccttaattaatagccgcttgttaaatagaggagctcttaggttaagaacagaagtattgttcttatgcctccctggacagtattatagcagactagcaatccagagtgggtctgagacttcccactgcaagtccaagttcgggatgtaagcttggccactttctggtgaggcttctcttgctagcttatagcttacagccatctctctgcatgtaagccaggctccaaggggcatg

SEQ ID NO: 128198 - DNA, 1087 bp, Homo sapiens
tatttccatctacctcactggtgctccaacctcttaacatcagtagttcccaagttttagtcttggacatctcttttctatctatacccacttccttagtaatttttatcagtcttatagtttcatttatttggggaggcgcagagagagcaagtttatttggtaaaagctgaccaaacattatccaagaaagacaagatgggaaaggtgctgtgacaaaagagcctagaaagccttcaggctagatacgaagtctcacacagggaaaggcacgggctctggggagactgggaaggtccttagccatttggcaccccatggacaagctcttcacagttgatgcaaccattgctgtccttatgccctgcactagcatctttacttcttcttctatcatcttctcacccagtgtgacaaggacttgctagatttcagtgcccatgatggtgccattccccttcttgtcaaatacccaaagtccttcaacataatcctcataggctctggtccctgttcttggccacagcctgcaacatgggcaggaagtgcccaaagtccagcaccgtcacattcatctcatcacttttggggatctccaggacttgcatcacctcagcatcggtggggttctgacccaggaccctcatcacatccccacactgactatacaggatcttaccatcacctgttcagtcaaacagctagaaaacctccttgaattctgtggtctggtcctcagtgaagtcacacaccttgactgctcagctctgcagcaccttttcctacattaatggcccagtcttacagttttaaatatcatatttagtctaaatactcccaaatatttacctccagtttagatttttcccttcacttccagtctcacatatataactgatctaatctaatctatatatggttagttaactattagttaaacctaatatattaaaaattaataataaaatataaaaatatattaataaaaattaatattttaactattttaaaattagttaaatctaatatattagattttatatatatatatatctcaaacttagcatgttcaaaaatgaactctaaa

SEQ ID NO: 128199 - DNA, 1075 bp, Homo sapiens
tgcagtggattccatttttatccccatttagcacatgaattaatgggggcacataggagtaattcactcagggtgatatagtaagtagtggagcccttcactacattttaatgttgtgttctttaatgtagtggagaggaagaggatgcatgtcaaggaaatgtaattttctcgcctatctaactgaacaatgtccattttggtggagaccagagaataaataacctagttctgggtgtctcctgtttggttccctagctgatgcactaacagtcctattccattctgctctgcacctttggaaggggacatatatggatttaatcagtgggctctcttgtcctctggcttccttctattggccaataggaagcaccagaaagtaactggaggaagaagagtgagattggagtacttatcctcccaggtccctccctgcagttttgtcacagagtggctgtgctccttgactaggggttacaatccttatcaggctgtctcctcacacaggtctcgctttttctctatctctccttgcctcctttgaaattatcttctcctcttgcctttttaggcctagaggtggtaactgcattttcttaatacaaaccctggtggtatggaactattcttaatattgtccctttaatgtctccatacctttgcaattggttccttcttaaaactcacctcaattgacccaatttgagtgcatcatcagttacctgctagatctttaagtgataaaatgcattcatactgccagtaaaaaaaaaaaaagaaaaaaacttatgagagtctgaggaggcataacatgtaacacagggttcctcaacagtggcactattgctgttctgggctggacaaatctttattgtggggactgtgctgtgaattgtaggatgttaaacagcatctttgctctagcctctccccattagatgccaatagcactgccccctggttgtgacaaccaaaaatatcttcagacattgccaagtgtaccctgtagagaagttacccttatatgagaaccactgatctagaatgaacagtagctgttttggggatgggg

SEQ ID NO: 128200 - DNA, 1001 bp, Homo sapiens
tcttgaggatggtggagatgatgtaggtgtaggagacaatcgtagggatcaaaagaaccaatgataatgaaaacagccattagaaaaagaataaactctgtgaaaagagtgtcctcacaggataccttgagcaattgtcctcagtcacagtaaaaatgatctaacacatttgatttgcagaaagtaagctgaaaagtggcataaactggccagatttgaaaaaggaacccaaacacccatgatacaatgaccatccagacacatgtgctgctgttcataatgatgttgtacctcaaagggttacacacagccacataatggtccacagccatcactcccattaatgccaactccgaggtacccaaagaaaggtatatagctgtgcagcacaggctgtcaaagacatgatctgggtgcttggaagcagcaaccccccagcataaaaggggcagcggtggatgtgatcaggatctccaggacacagaggtggcccaggaaaaaatacatgggggactgcagatgtttatcaacacagacagtgacgatgatgaccgtgtttcccatcactgtcactgcgtacaagaagaagaagttcacaaaaaggatacggcgtacttcttgggagccagggaagcctaagagaaaaaattcagtggcgctagagtaattccccaacatttacttctgagtgcttttaactcatgaaatctagaaaacaaaagagagttaatacggcttctcatcttaacagaattagaaactgttctgcaatccccctcctgttcacaggccacacaccatgactagaatggtaggcatttgtcttctactattcctgtatatggtcagtggcaatttttctaaatatgtacaatgtgtgaggaaaattgagttggtcatgaagatgatcccagtccccagtgccataccttagacatgagagcctataccctgcccagcatgcaccattgcacccccaatgctcacttcacctgcctccc

SEQ ID NO: 128201 - DNA, 1070 bp, Homo sapiens
gatcttgctagggaaggccaccttgtatgccgtgctggtcagtgccctcgtgctgatggccatggtaaggaggagggtgggatagggcagatgatgggggcaggggatggaacatcacacatgggcataaaggaatctcagagccagagcacagcctaatatatcctatcacctcaatgaaaccataatgaagccagactggggagaaaatgcagggaatatcacagaatgcatcatgggaggatggagacaaccagcgagccctactcaaattaggcctcagagcccgcctcccctgccctactcctgctgtgccatagcccctgaaaccctgaaaatgttctctcttccacaggtcaagagaaaggattccagaggctagctccaaaaccatcccaggtcattcttcatcctcacccaggattctcctgtacctgctcccaatctgtgttcctaaaagtgattctcactctgcttctcatctcctacttacatgaatacttctctcttttttctgtttccctgaagattgagctcccaacccccaagtacgaaataggctaaaccaataaaaaattgtgtgttgggcctggttgcatttcaggagtgtctgtggagttctgctcatcactgacctatcttctgatttagggaaagcagcattcccttggacatctgaagtgacagccctctttctctccacccaatgctgctttctcctgttcatcctgatggaagtcctcaaacaccatttccatacccaggcattctgggtccccactggagggttagtctgaagggcaatggctgggctttggaaaaccagcaagatgaggacagagaggaaggcacacagcaaaccataagcccttacccagtgcaggacagaggatgcgggcagacctatgggttacaatgtctggtcatttcccaattccagattaaactgtcacctgttttacctttagttttattagtttgtagtcttaacacctccagcttctcttgtttcaggatttgggcttaaaattgagtgctactctgcatgtctagtttgaaatactagagaa

SEQ ID NO: 128202 - DNA, 1546 bp, Homo sapiens
ttcattttatctgcaaaaggtcaggaataagccatcttaggaaaggaccctgattttccctaattttatttcttaaagcactcaaacttactatcacccactcatctgaaatttctggaatcttctggagcctttcacagcaattgccttttcctaagtcttcaggcctgagaagcgatggagaccaaaaggagtttagctccagctccagggttactatggaatagagtcctttggttcccattcgcccttctgttgggagggtccctgcctcgctgggccaggtgacagggacgcaggtagaggaaggcagtggatggcagctagggagaatgactgcagcagcaggcctccgcagagggagcttatgcaataagctgggaacacccacatctggcactgggcctgtctgtaacccccactgcacctcactttctccatccatggaaatgcaattctgtcccagcaattggcagaagaaatctctgcctgagggaagagagggtggggttcagtcttggaagaaaaggagaaccagctctggggaagagaaggctgcgaggatacctgcctgctgtgtgttgggagctcagggtgggtggacagagcgagtgtgacgcccccactctcctctgcctcctcagcctgcccacgggggctctataagtcttctgctgggaatgctccctgctcaccatgccctgcccgcagtcacgctcccaacccagcagcccccgtttgcccctgcctggagggcttctaccgggccagttccgacccaccagaggccccctgcactggtgagttcctcacccagccctgcaatgggaaagagacttggagaggggccagaagtgggggtagcaggcaacactgggggctctttgcatttggagtgacttgtttttcccctattttcttggcttcctcccctccctgtccccacccccttctctccctgacccatccttccctgggcccacatcctgcctctctgggctacccccaccccacgctcttctgtctccttccctctcggccacccaccctcccctggctccttccttcctcaatcacccccactgctgccctcttggcccttggactgccatatcctccggccccccaggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaaggtgagctcttttccttggccttcaggatcccctgcctccgctcctttgagcccccttccc

SEQ ID NO: 128203 - DNA, 2228 bp, Homo sapiens
gcccgctcttgggttctcttgaagattcttcatcctttcctctggctcccttatgagggaaactataaaaagaccatactctgtctccttaaaaatcgacgagaccttctgcagacctcggtgctctgcctgatgtgcatttgatttgtatcgattgtatcatgatctgcatggctttgcatagaatgaccagattttcaaagaagtcaatacagggtttggaaattgagtacttttggcagaacaagggggttcctgtggctccgagtgtccatgcctctgccccggtcattccatttcatggcagtcatcacccaggagaacattgtaatgcctcctgctcgagactgaagattaaggtcttcgcaaagggaacctgcagaaggacacagaattaagacgtaggaactccgtggtgcccttcgcccctcctccccttccagttgtgtcctgaaattctaaatgattggaaacttttataatgttcacgtttaagactctcatactacagagtagaggaaggagcgggtgtgcagagggggtgatgcttcagattaaaactaaagagttgattgaaaattcaagtctggaactcgagagagttaagaactataagtcagtaagttgcaagtatgggtgagattgtctagggaaaggctctttgaaggggcgtccctaatggaatatcaatattaagggcaggccaaaggccctctaaagaaaacaggaactgggtaggcagagagaagactcccaaagaatgctgtcatggaaaccagaggaagagaacgatttaaggagcgaatactactggtaaactaatggaagaaatctgctgcaccactggttagtatcccagctgcagtgttatatgtgatcgttattactgctttgacgtattcgaaagtgattcattcttaaataggtttttttatttgtatagctctttttcttgtagccagtttttcctgaaagtcttgggtaatggaaatattacagtaaaaagaagaaaaaatggagtttcagactcatttttccaaacctcagattcattggctgcttccaacccacttcatctgttttaggatcccacctgctatcttagttctcccagttcttccaggacccagctcttccctcttctaactataaatctctcacccaatagcatctgcaagccaagtgcatccattccatagatgtgtggtatttcactgactctaagatacacattttttccctccctttttttttttttttttttttttggacggagtctttgctgtgtcacccaggctggagtgcagtggaatgatctcagctcactgcaacctccatctccaaggttcaagcgattctcctgtctcagcctcccgagtagctaggactacaggcatgcagcaccacactcggctaattttttgtatttttagtagagacagggtttcaccatgttggccaggctggtcttgaactcctgacctcaggtgatctgcccaccttagcctcccaaagtgcagggattacaggcatgagccaccgtgcccggcctcccctcatgttttaacaccttagaaatcagaatgcattttagagtaggtttttaagttataaatggaagttattgtattttcactgctatcaggtgccacccttcctgctgttacatatgtggaaaatgtgacggggcaggctagagaactctggatttatgtaaactaggcatgtagatgacatattggcaataggattattttagtttataagcagaagctgatctctttgcaagcctgtagcaaaattagctggaggtgacagcacatgcctgtagtcccaactacttgggaggctgaggcaggtggatcgcttgagtccaggagttctgggctatagtgtgctatgccagtcacgtgtccacattaagttcagcatcagtgtggtgatgtcctgggagtcagggtccaccaggttgcctaaggaagggtgaacccgcccaggtcaaaaatggagcaagtcaaaactcctgtgctgctctgtaatgggatcatacctgtgaatagccactgcactccagcctgggtggcacagtgagactcttttaaagtaaatagataaatacctatccactgtgactttctgtcatactttctgcttatccacatcttaacaggattcgccattttgtcactggaacttaaaagttttaaaaaacatgtaattatatgttt

SEQ ID NO: 128204 - DNA, 1193 bp, Homo sapiens
gtgtgtgtgttttcttagaggttttggtctagccatgtcttttactagaaatctattatgtcatggtttttcaagttgtatgcagctgataaaggatcttacatgtctaatagttaaagataaaatactgagtcactaagtcaactatatatactgctgttttctcagagactgtcagatttggtgagtttatgagctcacttcataaatagcatttccatttatggtaagcctgatgcatattcagtgacctattggattctaattctttggttgaattgctctgtaactggaattgcagtagagttgaacttcaagcaccttataatgggggactatgtgagctgccacagattttaaagatcagatgagggagttttgacatcagcataaaaggaagtgtgtcctcttatattcctaacgaccaaacaagattagagaaaaaatcttctgtcatagctaagaagaagaagcgcctaggtagatatgatcagaaggataagtggaggaggcagaacttaagctggccttgaaggatagaagttactgaagcagagaggagtggtgaagccaccctaggcagggagaacagtatgtggacaagaaatgtgtgtgttataaaccaggtagttgcaatgggtgtcataatttggtacactgggcatctgcacagaatgctctcttcctggtgggatctccctagagagtcaactcgtttatcatatagctatttggcaagcaaagaaacagaaccaaaaaaaaaaaaaagatccttttttctttccctatcaaatctttcttacttaagagaggaattccatttaaaaacaggaaatagtataattagtcttagagactcctcttcccctgatagtgctgcagtgaacatgggtattctcactgcccagatgttttcacttttctctttgttattaagtttttattgcatctacttcatgaggttactagttctagaattatgatttaccctatgttaggaaacgtactcttcaaagtggaaatttccttttaccatgtggtattgtttttttagcttgcatttgggtcacaaactgctttgaaaatgtaaggacaagctatgggttatccctggaaaatgcagctgcccatataatttagcatataatttcagagggttcacaagttactctcttcacatgtcccccaacccc

SEQ ID NO: 128205 - DNA, 1022 bp, Homo sapiens
gtcaagtgatggctactgttgcatgtgtaggacttaggaggccccgctgaatgcttaacctctcttcttccttctttctttctggcagctccaagaggtttttcagctctttgacaacgccaactgcccaagcctacagaacaaaccaaaaatgttcttcatccaggcctgccgtggaggtgagtgccctagcagaccagcacctgggtggtggctcctgggcagcctcccaccagctctcactttcctgtttgctcctctcaggtgctattggatcccttgggcacctccttctgttcactgctgccaccgcctctcttgctctgtaagtgtctcccaatgcatggggtgtgctgggacttgggcagcccatggctctcaggctggtcagctctccgtgcaccaccatatcctgttttcaggtctcttatcccgtgtctttgccttcctttctgagaactcttactcttttctgtgcttcattaactctggtgccctttttttggttactcattccagttacggatttttgatctgtctttttcctgtccttcttattttatctcctttctttcactctttgttcttttcacttgttccatatacttccctgtttacctacacttccatgcttgcctcctttcttctttcttcttaccattcttgggtcatgcaggatagcagaacagaatccgtgttggcctttgactcttccttttccgtgagctgctgctgcccctctttctctcatgcagtctgttttactcctttaagagccaggactgcaggacgaggattaaaagacacataggtgtgcttctcatcctggaggaaaataatagtaattaagagccctaactttggagtcaaattctgacttcaccatttactagtaacgtgaagttaaagaagttaaatggcatccctccatctcagtttcctcaatataaaatgaaaatagtccttgtacctacttcataaggtgcttgtgatggttaaatgagattatgcatttaagggct

SEQ ID NO: 128206 - DNA, 1062 bp, Homo sapiens
cttgctataatttatcttatgaaattaataaacatagtgcttcgaagatatcaaaaccaccttggaaacaactgatcatacttagttttattattttttgatacatagttcgaggttgtgatttttatatagcatacatatggtaaccgtatttgttatttattaccttgttttttcttgtttatgtaattaaatatatcaatattttattatgtattgcaataaaaagcactgtgactcccaggcatattgttaattgaacaagtgagttgtggacttagatgattttcagttccatttacaaggagtatttgatttggcattttccctgtcttacacagaatgggaactgctccaaccgcatagatgtgcatgtgcttgagcgtggtgcccggtgtgtatgaggcatcccctgagtaacagatgcatgctgagagagtaataattttttttttttttttttagtttatcagccataggttggaggcaacagctggaaatggctcttccccttcaaggttgtagggaacgtgggcttgcctgtgacaggcccaagagagataggaagaagtaacatcattgtccattctgtctgcctttgttacagatgagactgatcgtggggttgaccaacaagatggaaagaaccacgcaggatcccctgggtgcgaggagagtgatgccggtaaagaaaagttgccgaagatgagactgcccacgcgctcagacatgatatgcggctatgcctgcctcaaaggtactttgagttccaaaagagttgagtcatacctcattttgttgcactttgctttattgtgctttgcaggtacaggttgagtatcccttatctgaagtgttggaaccagaagtgtttcagattttggatttttttgtttttttggattttggaatatttgcgttatacttactagttgagtatcccgtatccaaatattctaaatttaaaacactcccatgagcaccttctttgagcatcatattggcacttggaaagtttcagattttgaagcatttcagattttttggatttgggatgctcag

SEQ ID NO: 128207 - DNA, 4104 bp, Homo sapiens
tcctagacttagattcttcatgctgggttctctgactagggagggtgcaggtgtcatggccgagtctagtttgggaagtgcagctgtgtgatggcattcacactgtgattaatgcccttttggttgcagggactgccgccatgcggaacaccaaacgaggttcctggtacatcgaggctcttgctcaagtgttttctgagcgggcttgtgatatgcacgtggccgacatgctggttaaggtgagccagcgggctccgtgacccctgtgtgtctccacagtgctctactttcctcctctcttgaatgctctttcatagtccgtctccccttcccgtttgctgctctcctgaagcccgagattctcagacttgggcctattggttctgcccctccaggtgaacgcacttatcaaggatcgggaaggttatgctcctggcacagaattccaccggtgcaaggagatgtctgaatactgcagcactctgtgccgccacctctacctgttcccaggacaccctcccacatgatgtcacctccccatcatccacgccaagtggaagccactggaccacaggaggtgtgatagagcctttgatcttcaggatgcacggtttctgttctgccccctcagggatgtgggaatctcccagacttgtttcctgtgcccatcatctctgcctttgagtgtgggactccaggccagctccttttctgtgaagccctttgcctgtagagccagccttggttggacctattgccaggaatgtttcagctgcagttgaagagcctgacaagtgaagttgtaaacacagtgtggttatggggagagggcatataaattccccatatttgtgttcagttccagcttttgtagatggcactttagtgattgcttttattacattagttaagatgtctgagagaccatctcctatcttttatttcattcatatcctccgccctttttgtcctagagtgagagtttggaaggtgtccaaatttaatgtagacattatcttttggctctgaagaagcaaacatgactagagacgcaccttgctgcagtgtccagaagcggcctgtgcgttcccttcagtactgcagcgccacccagtggaaggacactcttggctcgtttgggctcaaggcaccgcagcctgtcagccaacattgccttgcatttgtaccttattgatctttgcccatggaagtctcaaagatctttcgttggttgtttctctgagctttgttactgaaatgagcctcgtggggagcatcagagaaggccaggaagaatggtgtgtttccctagactctgtaaccacctctctgtctttttccttcctgagaaacgtccatctctctcccttactattcccactttcattcaatcaacctgcacttcatatctagatttctagaaaagcttcctagcttatctccctgcttcatatctctcccttctttaccttcatttcatcctgttggctgctgccaccaaatctgtctagaatcctgctttacaggatcatgtaaatgctcaaagatgtaatgtagttctttgttcctgctttctctttcagtattaaactctcctttgatattatgtggcttttatttcagtgccatacatgttattgttttcaacctagaaacctttatccctgcttatctgaaacttcccaacttccctgttctttaagactttttttttttttttttttttttttgagacagagtctcgctctgtcgcccaggctggagggcagtggcacgatctcagctcactgcaagctccaactcccgggttcacgccattctcctgcctcagccttccaagtagctgggactacaggtgcccgccaccgtgcccggctaatttttttgtatttttagtagagacagggtttcaccatgttagccgggatggtcttgatctcctgacctcatgatccacccacctcagcctcccaaagtgttgggattacaggcgtgagccactgcgcccgggcaagacctttttttaaaaaaaaaaaaaaaaaaacttccattctttcttcctccagtctgttctcacataacagagtagttttggtttttaattttttttggttgtttgctgttttttgttttttaaggtgagttctcactatgtttctcagactggtctcgaactcctggcctcaagccatcttcccgcctcagcctctcaaatagctgggcttacaggcatgagccaccacacctggccaggatttggttgtttaaatataaatctgatcacccccctgcttagaacccttctgctttctattacccctcatttaaaatgtaaactcttcaccttggtttatgagaactggttcttgccttccccttgaacctcattaaatggtgatttcttgctaagctccagcccgagtggtctcctctcagcttctaattttgtgctctttcctgcccttttcctgggccttctcagctctccacccccaccactcttgactcaggtggtgtccttcttcctcaagtcttgacaattcccgggcccttcagtccctgagcagtctacttctgtgtctgtcaccacatcttgtcttttcccctcattgcatttattgcagtttatatatatgctacttttacttgttcatttctgtctcccctaccaggctgtaaatgagggcagaaaccttgtttgttttattcaccatcatgtaccaagtgcttggcacatagtgggccttcattaaatgtttgttgaataaaagagggaagaaggcaagccaaccttagctacaatcctaccttttgataaaatgttccttttgacaatatacacggattattatttgtactttgtttttccatgtgttttgcttttatccactggcatttttagctccttgaagacatatcatgtgtgagataacttccttcacatctcccatggtccctagcaaaatgctaggcctgtagtagtcaaggtgctcaataaatatttgtttgggtggtttgtgagccttgctgccaagtcctgcctttgggtcgacatagtatggaagtatttgagagagagaacctttccactcccactgccaggattttgtattgccatcgggtgccaaataaatgctcatatttattactgatgtgtgctcaatatctgtttctgtagatactcagtcctctgaagcccacagatttcgtttccttagccccttacactgcagcattccttaccacctcacaaggcatacccagacctgaaaacccttcttattttgctgctgtgatcctgtaaatatatgcaggtgtgggcccatctcagtttgcgtagtcctgggatttctcacagatgaaatggaagttattagcaaacagtgctggttcttgattatttagactatgagatgtaggctgccataacagattgggctggaatagaaggatgggagagtgaagatagtaaaattccatttcttacctggttgcatttaaggtcttctagagtgggcatagattgtaagagaattctagtgcagcatagaagagatcaaagcaatgaatttgtgtaagttgggatattttgggggtgcattgtatctaaaggatatgcctgagaggtaagtgcaggtgcagatgggccatggaatttggcaagagatggaatgttctgtaggaactttgtacagaagttttggtaggaaacaaaacttttttttttaaatacgggatttcaccatgttggccaggctggtctctaactcctggcctcaagtgatcagcccgcttcggcctcccaaagtgctaggattataggtatgagccacctataacaaaccagaaacaaaacttttttgtttggtaggaaacagctgtgggagctggaaatattgttgagtcatacagagaagggtatggcagtctaggaagagcagaaggggattgaggtgagctgaagcacctcggcagatagagcagaatttggtacagaacactggagacaaaagggcatgaaaaatggactgaaactggttggttgtactgcaagaaaaacaaccatgggatagcctcaagggaaggatacaaaatctaggacag

SEQ ID NO: 128208 - DNA, 1207 bp, Homo sapiens
taatcccaacactttgggaggccaaagcgggcagattacctgaggtcaggagttcaagaccagcctggccaacatggtgagaaacccatctctacaaaaatacaaaaattagccgggcatgaccgtaagtgcctgtaatcccagctactcgggaggctgaggtgacagaatcgctcaaacccgggagacggaggttgcagtgagcagagatcgcgccattgcactccagcctgggtgacagtgagacaccatctcaaaaaataaataaataaaataaataaaacccgaaagaatatatatcatttatgcatgcttatgaatttgcttccacattcaggagccttacaggaatccctagaagcccatctttgtgcctccaaataagaacctaagctactaagcccagcgggatgatggagtgaggagtgggcatggtttacattttcttttcttgttctcttgcagggatttaaacccatgggatttaaactattcctaatttcaaacacaggatatttactctcaaacccttgcccaccagcactggcagtctgtacatgtctttgaccctcctaatttcagaatctggttttaagaatcgcagttggtgctttccttctagaccacacgcttccactcagcttggctggatgtgagcacttccctactccactggtctctgccttcaaatctcagagtccatgactaggctgctctgttttagggccctgtctttctcagaaatagtaagaaagtcataattgtatctcatatcttgctgcttatatttatcaagtttctacagcaactgatcactttcaggaaagctatactcctcaaatgggagaatcttgtttctgaagtcctccaaggaatgcagtgttaccttggcactctatttttttgtgtgtgcaacaatgtcttttattatgtatgcggttttaaaattatttcttgaatctctccatacacaggcaaaaaataagtgtgctacttaacatactggaacttgcctaacttaatcattgcccagagaagggaaaattatcaccaaaatgtgcttaaccaggaggccaatgcatctgccaacctccaagaacatggagatgaacttgacagacagactgtccaccatctgaacctttattcaccaccatttgataacccttattcaggcccaaatcagcagcacatttcttgccaacaa

SEQ ID NO: 128209 - DNA, 1040 bp, Homo sapiens
ttcatattgttactgacaagcttcaattgtacctaatcataagaaacatttgtgcggcctccaacaatgtacaacttgatgtgttgatatatgtgtacattgtgaatgatcatcacaatcaagccggttaacatatccatcacctcacatagttgctttgggggtgcagggaggtgagaacattcaagatctaccctcttagcaaatttcaagtatgtggtattactacctatagttaccatgcacattagatctccaggactttctcatcttgtataagtgaaccttgtatcctttgaccaaatttccccattctcccaccccctactccagcccagcccctggcaactaccctctactttctgcttctatgagtttgactattttagattccacatacaagtgcaatcatgcagtatttttctttctgtgtctgcaatgtttgacttagcgtaatgtcctccaagttcatccatgttgtcacaagtggcaggattttcttctttgtcagggttgaatagtattccattatatatatttatatacacatgacattattcatctgttagtggacacttaggttgtttccatttctaggctattgtgaataatgctgtaatgaacatgggagtgcagatacctctttgagatactgatttcctttcccttggatgtatgggagttgctgagtcatatggcagttctgtttttaccttttgaggaacttttatactgtttttcataatgactataccagtttacattcccaccaacagtgcacaagggttcccttttctctgcattctcactaacatttatctcatctttttatttaatttttttttgagacataatctcactctgtagaccaggatggattgcagtggtgccttcccagctcactgcagcctccacctcccgggcttcagtgatcctcctgtctcagcctcccaagtagctgggactacaggcgtgcaccaccacacatggctgatttttataatttttatagagacagggtctccccatgttgccaggtt

SEQ ID NO: 128210 - DNA, 1050 bp, Homo sapiens
gatggagccagtgtgggcactccacagtccaaatggaagctcagtccctccgggttggcagtgtggctgacacctaacagtctgggaagtgggagaaattctagaacccaaggctattaccgaccctcgacttcccacttcccataagtgttccacacccagtgagtgataaggatgggatcaggggatgcccccaagctgttattagcagcctctggcagacagaagggcaaagagctagagaagaacgctggacatgggatgggctggcagagctggccagacagaaccctgggtggacacagagttgggaacaagctggccaggagatgtggcagagaggcaccagttactttcccaggtgagttaatgtgccagtgtttccagaacttcgagtcgcttcatctttatccagcacccacccctcaccttccgcatcctgaagaagagagatgggcaactggagggcttccatgcagatccggctctacacataggtttgagagcatactcagcagtttctcatcctggtccaggcgatatttatagagggaccagtgacatggagctggaagcctactactggtgactaagaagggggacaatgccactggctcagcagagggaattccctgtggggctgtccctcaggttctcatcccaacccccacccccacactgcactcacacctgcttcgaccccaagcagatcagatgtggcagtggggggtcatgtgacggagaggggtctataaatagctggaggtgggcatgctgccccagacgccttggggacagcaagagcagaggcttaaggagctacactgggggaaggacaggggcaagcaggccaaggcctggccggggctcggggggagggaatatggagcaatcccggtcacagcagcgtgggggtgaacaaagctggtggggtagtgacccccagtaccagtatatgccctttgaacactgcaccagctacggactgccctctgagaatgggggcctccagcacaggctccggaaggatgcaggcccccgccacaacgt

SEQ ID NO: 128211 - DNA, 2255 bp, Homo sapiens
tgaagccccaagtacccaccagttgtcaatattttgtcactattgttccatctattcttcccttccccaccctcaccactctacacaccatggaatactttttttttgttttttgttttttgttttttgtttttgagatggagtttcgctcttgttgcccaggctggaatgcaatggcgcgatctcagctcaccgcaatctccgcctccctggttcaagcaattctcctgcctccgcctcccaggtagctgagattacaggcatgcgccaccatgcctggctaatttttgtatttttagtagagacgaggtttctccatgttggtcaggctggtcttgatctcctgacctcaggtaacctgcccatctcaggctcctaaagtgctggggttacaggggtgagccactgagccttgcttccaccttggaatactttttaacaaatcccagacattgtatcacttgtagacttgagttttgacttctcccttgccctcccctcaccctgccctgcatgggaccagccagaacagatctggccctttaagtgttttcccagcccaggtatgatgatatgaagcaacccccttccttgtctccactggcctggggccttgaggagctgagacagcctcagctgtctgacttccactgggaagtatgttctctctctgggtcccacgcagggtttggaaggaaacactgcctccctcggtcactgacccagaagacaaacagccatgagcagggcaattcatgtgcgtgcttgttcaggactgcggtgtaaaatgctgctcatattgtgaaatcagatctcttctactcaggctctcccagaatccagcaacatggcctggcctgaccctggccccagaggacagttagtgtagtgggagtggggcaggctaaaagtggttggagctcttgtataccccacacagacacacgtgctctgcctcaggatggaagcggagggccaccagacctgggggagctgctctgtcctcttcacatgtggggcaggtaggggtctaattatctagctgtgggaagaagtagatggacctgccttttcgggctagttcttgtgtgtgcatacaagcactgggagatgaagtggatggtcttgaagcttgatagaggacctgaggtgcctcaggtaaggctagacacaccaaggcaaagtgcaaccaagactgccctgctagttagcccagtctgtcctcaccctgttcatgttaggagaaaagtcaatgcaagtggtctggggaaattgtgggacatacagaaagcgcagtgacacaaaacacctgattgatatggccacctgggttcagcacagttctgtacctctgcttcaaagcaaaaactggcctccttgataaaggctaccctggatcaaggtgagtacaggttggagaatgggtgtagagaaggtaggatgaatgaacaagggaaagggtgggaagtgtgggaatggagggtggagagtagagggcagggatgaccacaaagtcaccctgcatgcagtcaacacccagaattcaaaaagctgttgttcttttcttctgtgagtctgtctgctggcctctgtctattatttttttagtcttccacaaggcagacactgatcattctctctctgtccagatttatggccatcacaaagaacaattctcagacagggagcaggacatagggatgcccaagaagacaggctccagttctaccgtggacagcaaggatgaggatcactattctaaatgtcaaggtgatggggactgaggaataaagaaatctggagtagaaacaggtacagggattaggagaataacttgggcatcccattgcacgtacgtactccctgccctgctacaaaaactctcctctaattgtttttaagagacagggtctcactctgtcattcagactgaagtgcagtggagtgatcatagctcactgcagcctagaactcctgggctcaagtgatcctcctgcctcagcctctccagtagctgagactataggcacatgccaccatgcccagctaattttaaaactttttttgtaaggatgctgaggctggtcttgaactcctggcatcaagcaatcctcccgccttagcctcccaaattcctgggattagaggcgtgagccaccatgcttggcccctctaagtattaaggaaaaggcacctctcttcacctccttcgcactttgcctattccctgttattcctcccacaactccaagaaa

SEQ ID NO: 128212 - DNA, 1140 bp, Homo sapiens
gttcctggtctgggtcaccttcccactagtcctcatcctcttcagcgccctcttctgccacctcatctctccccaggctgttggtgagaacttgccaccagactcggcctgagctgggtggcctgagaggggccctgtctgtctcccccatcatccagccccacccacagccctgtgctgccttgccccatcctccccaccactgcctcttcagccctctccaattcccattcccatattctggacattcatctcccttttcaccttcaccttgaccctgcacataatctttcaacgcttttaggctctggaatccccgaaatgaagacaatacttcgtggggttgtcctgaaggaatacctcacaatgaaagcctttgtggccaaggttgtcgccctgactgcgggcctgggcagtggcatccccgtggggaaagaggtaggcctggcatgactgaagccagagctgggaggggccctcaggagccagggtggcaccaactctagagggagctctgggagtggaagtggatcaggggacaggaccaaggccagggccaggggacactaggaaggggaaatgctttggaagttcctccaactgaggtccaatgacaaaaaccacacagcttggggagcttggagcaggctcttagcctggacacccctgacatttggggctggaaaactctgtgctgtggggaggctgttctgtgcagtggaggggacttagcagcattgctggcctctgacccttcctagatgcccagctgcatcgcccagttgtgacaccagcatgtcctcagacattgccatatggaccctggaggacaaaatctcccctggttgagaacactgtcttagagatcatccagaccaattctcttgcttgaatctgagaaaactaggactgagaaagaggctgtgctattttcaaggttgctcggtgggttgcagcctccttccgttctctgctggtgttcatctttgccccctactgccatattccacccagcagccagaggcatcttttaaaaatgggatcagtctcatctgacccctggtcaaaaacttcttaaggctttccatgcctcttaaaacaaaattgaaagttttgttgttgttgttgttgagacagtgt

SEQ ID NO: 128213 - DNA, 1079 bp, Homo sapiens
tctgtgtaactcccgtatttccagcccctggcacagtgcctggagtaaggaatattattagtccagtgagtgctgcagagcctccatctggcctctgacccccgccccctcgctccccctctcccagggccccttcgtccacattgccagcatctgtgctgctgtcctcagcaaattcatgtctgtgttctgcggggtatatgaggtaaggttgagacagtgaaatgagctggggccaggtggtagaaggagtccggctgtgtgtccagggtgttgggagggctgcctctgctctgggctggctgtggtgctgaagcagcatcgcactaatccacgctcccttcctcgtctccctgtctgcctaccctggccacgtgatgcctctgtttagcctgtgcctgtcctccaaatgtccacccctctttcacctgtggccccacatggaggtctggtctgtcgtctgctcccatgctctccctgctagtccataccaccccctctgtgttagtttccctccacgtttccctcgtgtgctcccccatccctttgtagctcccaatccctcaccctacctcttacatacgtcccgcctgccccacccctccacccccttgtcccgcgtgcttctctgttgcagaccgtgcctgggcagcttgacctcctggtgtcggcctgtgcagtgggcgtgggatgctgctttgcagcccctgtcggaggcaagttgcacttcctccctatcccggttgcctaagcaagacttagaagggggttttgggtggctgccacaagctttggagtgggcatccagggaatgactgtggatcacagcccctgcggtccagatacctatattttttcagcaaagggctgtgtattattttgagactgcttgctgtttggtgcaggatttattagtactgctttctggagttcttgctgtctcttttctgcttatcatttattgatttacgtgcctggcatatatttgcctaacttttatttcattttctaccttctatttcattttgacactgtgctatgaggttaattcctttttgccaaactcactgagtttctct

SEQ ID NO: 128214 - DNA, 1054 bp, Homo sapiens
gtgctggggttacaggcatgggccacctgcctagcatcccggtgattaattttgtgtggggtaaaagagaggagggatctaggctaacacccagatttcctacaagggcaattgggtcgatagtggtgttagtaaccaagactgggtatatgggaagtgaaacagatctggtggggggagctagctgatacatttcactttgagtgtattgaatttgatgttcctgtgacatatctaggtgagaccatttttgcagcggggttgacgagtctgaagctcaggaacatggctttgctaatcagcagcatataggtgtagttgtggcatgagcatacatgaaattgagagagaaagtgtgtctatgagtaggaggagcaggagaccaaggacaaaggctggggttgggcagagggacaggagcagcagagaaggtagagagggaatccagggtgggagaagagagcaatgttccagaacctgagcagagagcttccgaaagctgtttttgtttttaatgctttgtttcctcttagctgcacattttatgtctggctcaggctaatattaaaattagctctcattccggagcatacagtgacagactgctagggaaagtgtcccagaaccacgtcgtaggaaagaaaacctagcccaggatttcaaaaaattgttgtaaaatattcatcagttggatagtttacacccaggcaaatcaaagctgactgcttttgttactggtatagaaaaggagagagactcactctacctggttcctgctgtgtcaaatcctccttttaggccccagaggcagctgcttacctgatgtgatgtgaagagcagggcagaaggggtgattggccaagcaagctctgtctgccccacattgcccattgcctttctctgtttcctgaaattctgttctcttctgttctcttctttcctcatcctgtcctttcctctcctcccctgctcatccagagaatagacattcagccctgattattcaccaggcactgtactaggtgctggttttcaaggaattttctttctttct

SEQ ID NO: 128215 - DNA, 1726 bp, Homo sapiens
ttacaggcgtgagccaccgcctggcccaggttttttaaatgatgaaatgtcagatacaaaagaaagagttcccttgtttccctttttccagggagagatataatgtttgtattgcttatagacttctttcaaagcgtgttcacgtctcagcttatttgaatggcttctcatgtttctttttatttggacagcattgattagcctccttaattatcagctcacctatctgaagtctatataaggcctcatcaaaataagtacaaattagcccaattagtgctctaccaattggccccgtacctgctaaatggatgaaataaaagggattgagtgaggttaatcttggaggattcttaaaatgagtttccaggaagctgagaaagatgtggggacgccgggcagggtggcgcctctcctgttccttctcaggagtgcggagcgcggtggtgcgagagggcttggagggggcgctcaggcagggcgtgggtttccctcagattcaatgatcctgctgggctcggtggagcggtcggaactgcaggccctcctgcagcgccacctgtgtcctgagcgcaggctgcgcgcagcccaagagatggcgcggaagttgtcggagctgccttacgacgggaaggcgcggctggctggggaggggctccccggcgcgcctccaggccggcccgagtccttcgcctttgtggatgaggatgaggacgaagacctctctggcaagagcgaggtgaccgcgccgggaagggctagggagtgggatagatcaggagcaaagggaaaagcgtcgtctgggctgggctgggctgggctgggacaggcgtagtttccctgaaagtagtgggaagagggaggggagagtctggtaactgagaaagccagaaattctggatcaggtaccatagagaccagtgcctctgggtccagggactaaagaagataaggttgcagatgatggtatcctcgacaattcaaagggatataggaatttctgaactggggggaagaatagagttcgctttcccagaacatccaccaactggtaaaggcagtgaaggcccaggcagtctctgctcccaggctgagacttcttactcttccttacagcttcctccttcccttgctctccacccctctactactgcccctctgtccccagaagagcccaatgggcctctgcctggccacaaacagcagccggaagcaccagagcctgcaggtgacgctcttccctcatgcaccccaactcaccccttgtgggttctctctggtcactaggacctgaccttgacctgcatgcaattcctatgcggggtggggtggggggtgaggctgggggattgagggaggacagggttcttattcatcaattctccttgttactgtcccagggagtgggagcagagggtgatttaggagggtagaagagagggtgaggtacctgggaagtgcagctctttggaggcaaatgttaggcactgggtggggcccctggccgtttcctgttgctttgtgtccatttccatccactcacctgtcctctcaggtcaaagaccctccatcttccagtccctgcttcactgcttgctgggcagagctcgccccacaaagaagaaaacaacccaggtgagaggagatgtgtttggggatacaggggaaagggagcctgcccttgaagagtgagaaacccacggttcttaaatcaggaaggcagaga

SEQ ID NO: 128216 - DNA, 1752 bp, Homo sapiens
ccaggggataggagagttggagcctagaagagggaggggtgttctgggtacctgggggttgcagggtaggttgggggcctgatgaggaagggcagagaggctctgtcccctgggaagaaggaggaggtcctctgatctgggggatctatgatcagttcttgcatgttcccagattctgggcagcggctaggagggccgtttggggtcaaaatcaggtatctggggtgaaaggaggctctgtgattttcgtgactttcctcctctggctgacagattgaggcctgggagcaggagcagctgagccagcctgtctgttttgattcctgctgtattgaccagtctcccttccagctggtggagcagacaaccctgcacaaggtgagtcttttgctgactgctcagggctgtggggaaggcaggagagctgtggggcaaggaacatgcactgacctgtgctcttcatcctcagactcataccctgttttcactccttggcctccacctcgcttacgtgaccagcatggggaagctcaggggcgtcctggccctggaggaggtaatcacgatgtgtcccatttgagcagcaggagggaggctgggcataggataaggggatgcagtggggacagaaggaatattagcatctcagaagtcccctcagattcccttctctatttctttcttttttttttttttgagacagagtttcactcttgtcgcccaggctggagtgcagtggcgtgatctcagctcactgcaacctccgcctcccgggttcaagtgattctcctgcctcagcctcccaagtagctgggattacaggcgcccgctaccacacccgctaattttttgtatttttagtagagacggggttttgccatgttgggcaggctagtctcaaactcctgacctcaggtgatccgcccgcctcggcttcccaaaatgctgcgattctaggcatgagccaccatgcctggcacccctctgtatttcttatgcagagattggagggggtagagcaagcagccagctgaggtagaggagactacgaagcctgttatggccacagccctgaagggaatggaattctccaccccagatggggcccacgtgatcttctgtagatagtgtgggtttgagatgggggttccaggcatgagtcacagtttctcggggatgcgctttgaggaaagctgcggaaaaaaggcagtggggggatgtggctgcaggtggtcactaggaaggaagaggtcacccaagggtctgagtctgggcaggtggatcttttgtcatgccccttttcttgtcctttttctgttttctttctctgattgttccttgttttctgtttctctttctccccgttttgccactctatatctttcctgttcttttttcctttcattgtacctgttcttttctgtgtctctcactgcccccgtcttttttctttttccaactttttaccctcttttcctttcccactgctcttcagctacagaaggccattgaggggcacaccaagtctggggtgcagctccgccctccccttgccagcttccggaacacgacttcaactcgaaagagtaccggggcacctccatcttctgcagagaactggaacctgcctgaggacaggcctggggccactggaacaggggatgtgattgctgcctccccagagacccctgtgccatctccttccccagagccccctctctccctggccccaggcaaggtagagggcgagtt

SEQ ID NO: 128217 - DNA, 1110 bp, Homo sapiens
gagagtcacatcttcaccctccccaaatcagcagcaggaagcctggctatgcactccattagcgtgctttctctacaaagagaggccaggtgctgtgagcatccccaaacccttgctccgtacccaaggtttttctccccagcctgccatcccgtatgccgttcttaattctaccattgtgcccccgctccgacattctcctcctttgcctcccctgttcccagtctcctccatcccccaaataagacactcacagtcagaggatgccaccacattctgtttagtgtcattgaacacagcctgtagccttctccagcatcacatccctcccacttccccaggccaagagagatgctgaagcctgggtgggggactggcagtgggcatttgagcccatgcccttgtgtacataatctctaatatttatatatattgatatagaattctctctataatatatgtcatagaatctctcttgggcctggcgtgggaatgtgacattaagaaaacatgctaagactggccagaaaaatggatatttcccagacctggaggatggtgtgtgggatgtataggtgaggtcgtggagaagataataaactcattccccaagataccctcttcaacacaaggacaagaaggaaggtgtgtggtgggggaggggacaatggagggggaggagtggaagatttggattttcatttaataaagtcaattgaaaatgaaagtgcaccccccctccaaaaaaagaaaatcatttagcaagagcagtttcattcacaagaatataaaaacagccctgttccaggactgctgtaaaacgtgctgcacagccttaaccccaaaggaaaagcaaccctttcccaccccgaaacagcctcttcctgcacatgcccctccccaccccctgaaatagacgataagcaacccccatgcaccctgcccccagcaccagaagagtcctaagatggtcccaggccagctcctcagtctccctcttcagagcgagtaggagctccttgcagaagacagacccccacctgacttccatctgcagcaatatgccagcaccctggggaaagcaggttcatgtatgaaccctgctagagt

SEQ ID NO: 128218 - DNA, 1027 bp, Homo sapiens
gcgcccggcctttcctgacctggtactcccagggcgccctgcgcccctcctttgcttccccacacgctctgggacccctgagagagttcttgggttaggggttagagcggttaactgaggggagcttgggtgaggggtagagggaccccggccgacgtctttctccttcctaccccagactttcccctgcctccacctccccttgctggggatggcgacgatgcagagggtgctctgggaggtgccttcccgccgccccctcccccgatcgaggaatcatttccccctgcgcctctggaggaggagatcttcccttccccgccgcctcctccggaggaggagggagggcctgaggcccccataccgcccccaccacaggtacggaggcctgggaggggcggctgcactggacacccccaaggagaggagaagagggccctttcttcttacctcccctgcacctctgccttgggggtggggggatagaggcatggaataggtgctctgacctctgaccctctagcccagggagaaggtgagcagtattgatttggagatcgactctctgtcctcactgctggatgacatgaccaagaatgatcctttcaaagcccgggtaagggaccggagagtaggaaaagcagggctcagggccagagagactgggcatagaactaaggaggatggtgtcctcctgactgcatctctcttccctctcccaccccttgcaggtgtcatctggatatgtgcccccaccagtggccactccattcagttccaagtccagtaccaagcctgcagccgggggcacagcacccctgcctccttggaagtccccttccagctcccagcctctgccccaggttccggctccggctcagagccagacacagttccatgttcagccccagccccagcccaagcctcaggtccaactccatgtccagtcccagacccagcctgtgtctttggctaacacccagccccgagggcccccagcctcatctccggctccagcccctaagtt

SEQ ID NO: 128219 - DNA, 1015 bp, Homo sapiens
cttttccagacatagaaaagacccacccagtgcacttgctcctgtgggcgtgtctcccggcagtgctgatgcaggtcagacagcccttcccggagttctcagggttacctctcagggttactggcagcgctgtccttaacatccaccccccactccagtccccgggatcccctaaatgggaaggttgggctggcctagggggtggcctttggaccttctctgaggctgctggggagggacctgagtgaggtagttcagaggcccctcactcgagggacagggtctctgtgtgggggtggggctgggttcttgcagacagctcagtgggtttaacctgcaattcctgcctgtgttgtatcctcacgctgacaggggctgctcagcagcaggcaggccgggtaggtgtgtgtgcgcgtgtgtgcacgccattgcgtgcccctgtcccatgggggcgatgtccgagcatgctctgtggagttgatgcgtggccctggagtgtccggtgcttcagtgacccgagctgctgtgtgcgtggcctccgtccgcccagtcattctggcctgtctgtgactgctcagggggtttgggcagagtgggtggaaatgtcttgctgtacgagatccaggcttaggtcccttcccctgttatttgtgtggtgctggggatggcgggggtagggggacgagggagaagctttaagggtcaagcctgagcatctgggacacgagctgggagctaagcctcatcggaagaagccgggtaggctggcctgggaaggttcttggaggcagcagccctctagagtgtgaggaaaatgttgggattgcaggtgcgctcccctggggccccagggcccctgactctgaaggaggtggaggagctggagcagctgacccagcagctaatgcaggacatggagcatcctcagaggcagaatgtggctgtcaacggtgagcccaccccaccgggacacccccaccctgcccccacatcacggtgggggccagggctgtgg

SEQ ID NO: 128220 - DNA, 1223 bp, Homo sapiens
tctcagacaggagacttccatgtcttaaccagccctcagtcaggtgcccagaaccggccactccagcaggagaccggctggtgatccccttctgttggggcttcccaggacagtcccttcctataggcctgtcgacatagcaggactgtcagccagtccactgttgtgagcacaccaggaaacaggccaggaagtgggctcagagataatggtggggtcaatccacagtctagatgatctctgtgcccagacaccgaacttcagtgctggctgctgatgctcagaggccaaggccaaccagatcagcccatgtacccgctgtgactgacatgcccatgtcccacaggatgactcttcgcctgcccagcctgagtggctcagatgggatcccatatcgaaccgtctctgagtggctcgagtccatacgcatgaaacgctacatcctgcacttccactcggctgggctggacaccatggagtgtgtgctggagctgaccgctgagtaaggagctggagctgtctgggcaggggagggctgcgggggtggagcctccggactcatgcccccacccttccttgcccacagggacctgacgcagatgggaatcacactgcccgggcaccagaagcgcattctttgcagtattcagggattcaaggactgatccctcctctcaccccatgcccaatcagggtgcaaggagcaaggacggggccaaggtcgctcatggtcactccctgcgccccttcccacaacctgccagactaggctatcggtgctgcttctgcccactttcaggagaaccctgctctgcaccccagaaaacctctttgttttaaaagggaggtgggggtagaagtaaaaggatgatcatgggagggagctgaggggttaatatatatacatacatacacatatatatatttttgtaaataaacaggaactgattttctgcctccatcccacccatgagggctgcaggcactacaaaagagctgactactgagaattctggaaaacaaggtttttttttatttgtagctatagctacaacttggcagcatgggggagggtgggaatgtcctggagggtctcccagccctccgcaagcagagtacaaaggctgctcggggggccggccgagggcgcgggtgcagcagtgaaagcagcagcactaaacctggtgcccccctcaggtggggtgtctggaagacggtgggca

SEQ ID NO: 128221 - DNA, 1056 bp, Homo sapiens
gtagcgtttcatgcgtatggactcgagccactcagagacggttcgatatgggatcccatctgagccactcaggctgggcaggcgaagagtcatcctgtgggacatgggcatgtcagtcacagcgggtacatgggctgatctggttggccttggcctctgagcatcagcagccagcactgaagttcggtgtctgggcacagagatcatctagactgtggattgaccccaccattatctctgagcccacttcctggcctgtttcctggtgtgctcacaacagtggactggctgacagtcctgctatgtcgacaggcctataggaagggactgtcctgggaagccccaacagaaggggatcaccagccggtctcctgctggagtggccggttctgggcacctgactgagggctggttaagacatggaagtctcctgtctgagaggaagctgaaagtaggagaacagaggcctggcacctgggcgtggtcctgcctttttccatagtggctgcttgagttccgggagcagtccttcctcaccaccttcagcttcggctgttattcttgcactctgacacccacaatacaatgagtgttcctgtactaaagctcgccagagccaaaaaccattagcaaagtaaatctgctgggggaaaaaatatccagcattccagaaagattagcacacgcagtctccagtgtatgagggagttgcgctccaaaagatagtttcaaaagttggaacttagagcatgttttctcccagaaacaaggttatatatggtggttggatacagaggccagttggccaggctggctacccaataaagcacttgaagaacagccttgcctgcttccccaacctgagcgctcccccacccccccatcagttcattctctacactcaggccatatttttggtaaaatgcagctctgaccatgtccccccatcctgtggacagcttttaagaattggttctccaggccaggcgaggtggcccacgcctgtaatcccagcactttgggaggccgaggtgggcggatcatgaggtcaggagt

SEQ ID NO: 128222 - DNA, 1552 bp, Homo sapiens
gcgtcgtcacaaagcgtacgatgagtggtctccctcagctgggggcgggaaatgcaggaaagaggggtgaaaccactggaagtggagggaggatgtgtggccaagggcaggaagcccggttctgagtgtgatatgtgtgtctgtgtctcaggaaagccgatcatgatcatcacagaatttatggagaatggagccctggatgccttcctgagggtgaggagggcagaggactagctggggagggggatgcaccatggtaccctgggcactgggaggagacctggcccatcccctgactcacccactcaccctgctgcaggagcgggaggaccagctggtccctgggcagctagtggccatgctgcagggcatagcatctggcatgaactacctcagtaatcacaattatgtccaccgggacctggctgccagaaacatcttggtgaatcaaaacctgtgctgcaaggtgtctgactttggcctgactcgcctcctggatgactttgatggcacatacgaaacccaggttagaggccggtacaaacccagtgcacattcacattgccccgtaacatgccattcatacagtcacatgtatataggcacaaagacttggccaggcacggtggctcacacctgtaatcccagcactttgggaggccgaggcaggtggatcacaaggtcaggagatcgagaccagcctggcgaacatggtgaaaccccgtctctactaaaaatacaaaaaattagctgggcatggtggcaggcgcctgtagtcccagctactcaggaggctgaggcaggagaatcgcttgaacctgggaggtggaggttgcagtgagccgagattgcgccactgcactgcagcctagcaacagagcgagactttgtctcaaaaaaaataaaataaaaatacaataaaagaagcagaaagactcgtgctcaggtggacaccataactttccgtccctgacccatgtgccttcttagggaggaaagatccctatccgttggacagcccctgaagccattgcccatcggatcttcaccacagccagcgatgtgtggagctttgggattgtgatgtgggaggtgctgagctttggggacaagccttatggggagatgagcaatcaggaggtgagcccagaatattcttcctcatcttgtctccaattcacacctcttatttcctcccaaggtcctcccatggccttttcctgcaaatatctttatttattcatgaccttcagtttttctgtactcctggctcctctggttcttcacctcatgccctgctctctttactcctcccaccctgatcctcccactgtgatcgtcccaccctggtcctcccacctcctcccatcctaggatctccactgcaattatcttgtgtgaccgtcggtttctcatgggcctccaggttagcttgctactctagagcatcctcctgtcccgccgtgcaggttatgaagagcattgaggatgggtaccggttgccccctcctgtggactgccctgcccctctgtatgagctcatgaagaactg

SEQ ID NO: 128223 - DNA, 1096 bp, Homo sapiens
ctagcggctcctaccggatggacatggacacaccccattgtctcacgtgcccccagcagagcactgctgagtctgagggggccaccatctgtacctgtgagagcggccattacagagctcccggggagggcccccaggtggcatgcacaggtgagtccagggggtggggcgtggccatctggagggaggggctggatctttgctgagactttgtcagggttggatttttccagagcttgtcagatattggagatggtccagggtgtcaggcacttttagcccctgccctggcaccctgctctccctagaagaatgcagagatgtagtcaaacccagtagaaatcaaatctccccaagaggacttcagaggacatcgagaattgggtggtggtggaggccggggatcagcagctcgggtgacagcgaggtcggcttctactgatggctcctcttctcccacaggtcccccctcggccccccgaaacctgagcttctctgcctcagggactcagctctccctgcgttgggaacccccagcagatacggggggacgccaggatgtcagatacagtgtgaggtgttcccagtgtcagggcacagcacaggacggggggccctgccagccctgtggggtgggcgtgcacttctcgccgggggcccgggggctcaccacacctgcagtgcatgtcaatggccttgaaccttatgccaactacacctttaatgtggaagcccaaaatggagtgtcagggctgggcagctctggccatgccagcacctcagtcagcatcagcatggggcatgcaggtgagaggctgagaggggctgggacagggacctggtggagacagaagggcttaagaccacagaacaaactgatgggcaggaagccatagaaaagttactaaggttatttcctttttccttacatatccaaccttatccctctggacccccagagtcactgtcaggcctgtctctgagactggtgaagaaagaaccgaggcaactagagctgacctgggcggggtcccggccccgaagccctggggcgaacctgacctatgagctgcacgtgctgaaccaggtcaggatg

SEQ ID NO: 128224 - DNA, 1023 bp, Homo sapiens
ttccaaagagaaaatgttgtaaaatttgttactagtaataaattgataacgatatgctctataactcatcatgttattggcactgagtttgggaatgcctctgaatagcagaaattgtatggactgtagagtcccaatgcctggattccagtcctagccccatgatgtggtagctgtgtgatcttatacaaggtctttatcttctattagccttggtttcctcatctattaaatagagacaataagccatcctacctcataagaggattgcatgagctaaatagcataatgcacataaaatgcttagcctggcacctcacacatacaaggctcagtgttcatggttgtggaaagtattaagcaaacgattgtttctgttatgtgggaaagaagcaggactttgccattgctcccctttcttccccaccttctacccaggtaaccacggtggctgcagaccagagcttcaccattcgagaccttgtgtctggctccgtgaagctgaatgtggagcgctgctctctgggccgcctgacccgccgtggcctctacctcgctttccacaacccgggtgcctgtgtggccctggtgtctgtccgggtcttctaccagcgctgtcctgagaccctgaatggcttggcccaattcccagacactctgcctggccccgctgggttggtggaagtggcggggacctgcttgccccacgcgcgggccagccccaggccctcaggtgcaccccgcatgcactgcagccctgatggcgagtggctggtgcctgtaggacggtgccactgtgagcctggctatgaggaaggtggcagtggcgaagcatgtgttggtaagaacggaggcggtgagaacctgaggaaccactcgggaggattgcaggagtaccccggcagagaaggaggccagtgctccgcctcagtgggtttttaacctgagtgtcccagagcagcggacacacacatgcagagatgtttccagtagaagggattggggcaggaaggggtggtggtg

SEQ ID NO: 128225 - DNA, 1117 bp, Homo sapiens
atttgacattttctggttagtttgtcatgagaggaggcacatcttcaagtttagtctctgttcttaactagcagtacaacttttgtcaaattatttatgttctctggaccatggtttcagtttccctagacctagatgatttctgaggctatattcagggatggtctcagaaaataaaaagctagcaggattttgagtcaggagactttggccagttcccttagccataatgtgcctcagtttccttagctataaaatgagattaatcacgtccaccccacagagtcagtgtaatgatcaaaagaggagaaagtgctttatgaactgtaaggtactgagcaaatgttaattggctaggagaatggtggaggctaggaattgctggagttctcctgcaggcctcccagcttgctcccagagcagaacaacctcaattactaagacatcattatttttccattccaaaatcaactttactgagggacaacttgcataaaataagttgcagccattccaagtgtacggttcaatgggctctcacaaatgtatatgcaccaccacctcagtcaagatgcagagcagtttcagcatctaaaaacattcactggtgctcctgtgaatcaatcccacctccagccttagggtttctgtccatttgggtgagttttatcctttccagaattttatgccgtctctggactctgggtctttctctttagtatgatgctcccaagatccatccttctaagactcatccttctaagatccatctttcttgttgcctccatcaacagtttctctttttcgatgctgggcagtattccctatagagatgccctaagacatcatttaaaattacaaaatcaaaccccaaaactcctccttttttttggtcccctaggaaccacaggcctcgtagcagacagggcctcccagagggacacctctttccccttctggcgtctggccctgttctcattctgcagtcagaaaggaaagcctgcagagtccctgcagcccaggctgtggcttgttcttacaaacttgacgttaacactaccctgttcatattattccccttctactccctacccagctcctttctgactgaggataa

SEQ ID NO: 128226 - DNA, 1050 bp, Homo sapiens
gaaattagctgcaatttcctgcaatttataaataagactccttataaggaaaaaaaaacatgatttcccatttttttatatgtattgtttagagggttgaaataaccatgaactaaaatctggagtatttaagacatggtactggataaacacagcagggctccctttgcaatttccattggagaatttgtgctctaagaatgagcagagcagaattaatgctgagtccctctgccacccctccaacaagtctccatacccagtgaggtcagagctgtccattttgttctcccaactttcccctaagaactaaaaataacaatattagcaaagctaacacatctatagcgctcactgtatgccatccactgttctaacagctttatatagaactgtacctctaataaagaatgcatgtgtcttttgcagttgtgaagatgacctctccgacgacagagaagagcttctgcatgggatttcagagctggacatcagcaactcggattgtttcccatcccagctgctagtgcatggggctttagcctttcctctagggttagattcctaccatggctgtgttatagcggctgcccgctatggccggggccgggtggttgtgactggccataaggtattattcactgttggtaaactgggcccctttctgctcaatgctgtccgctggctggatgggggccgcagaggcaaggttgtggtgcagacagagctgagaaccctgagtggcctcctcgcagtggggggcatagacaccagcatcgagcccaatctgaccagtgatgcaagtgtctactgctttgaacccgtgagtgaagtgggggtcaaggaactgcaggagtttgtagcagagggtggcgggctatttgttggagcccaagcctggtggtgggccttcaagaaccccggagtgtcccctttggctcgattcccaggaaacctcctcctcaacccctttggcatcagcattacaagccaaagcctcaatccagggccctttcgtactcctaaagcagggataaggacctatcactt

SEQ ID NO: 128227 - DNA, 1110 bp, Homo sapiens
gtgggaagaatagcccagctactggaagagtgaactgctctatttgtttctttgtttatccattcttcgctaagctgagcctttgctttcttctctgcagaaaccaatagagccatggcgactccctctgctgccttcgaggcccttatgaatggtgtgacaagctgggatgtacccgaagatgctgttccatgtgaactgcttcttattggagaggcttcatttcctgtgatggtgaatgacatgggccaggtcctcattgctgcctcctcctatggccgtggccgcctggtggtcgtgtcccatgaggactacttggtggaagcccagctcacgccctttctcctgaacgcagtggggtggctttgctcttcccctggggctcccattggtgtacacccatccctggcacctttggccaaaatcctcgagggctctggagtggatgcaaaggttgagccagaagtgaaagactccctgggggtttactgtattgatgcctacaatgaaaccatgacagaaaagctggtcaagttcatgaaatgtggtggcggcttgctcataggaggacaagcctgggattgggccaaccagggggaggatgaaagggttctgttcacgttccctgggaacctcgtgaccagtgtggctggcatttactttactgacaacaaaggggacacgagtttctttaaagtctccaagaagatgcccaagatcccagtgttggttaggtgagtatgttaccccactggggagttggctccagggttgaaaagcagacccagttcttatcttcaggttgctccaaggctaacagaagagtgctcccaggcactcagatatggaatcactacatatcaactagattttttaaatgccctgagacataggaggggcaaggtcctcactgcccctgtcttcccaaaccagaccatttagctctttgataatttgaacttaatggtggctatggtcccagtgtcttgcttaatcaaaactgtgctgttggccccaacagttggcatagttaatccagatggtttataggagaggttgctttcaacaggaatgtgaagaaaaggaaaacaggcatgaaggaccccatga

SEQ ID NO: 128228 - DNA, 1028 bp, Homo sapiens
tgggtctaaagataggcacacctttgaagccaagtaggcaccataaaattgtttttgaaaaagagcgcagacattctccgtcattcctgccgattgtgatggtcttttaagtattaaacattattagcctttcaaatattaaactttactagccacctttgtcttcttcatcttcatctccttccccttcttctcctcctccactttctcctagaaagaagtatcatcttttttaacaatattatgagcaacacatgatatattttccattacttgactactagtgagattgagcattttttccacacaagtggccatttatattttcttttctgtgccatatcttctcttagaaggacaggatttccgtagatagaaagatttgggagagggaacagaatggaaagagattaggaagataatctaaaatgaaaacagggcatgtccaagggcgcctggcagacgggatgctgcagggagaaaggcagcaggagaaaaggcaggaaaagccagggagcagccagctctgcaggcagtccacaccaggaggcagtagatggtccccagagaccaaggtggagctttgagattaaataacatgattagagtggttttagaaaagtaaaggtgggaagaggtcttggtaacttagaaattgggtcggttgagtccaggcatgaattactaaggacctaaactaggttaatggcagtgtgattggaaaccatgaacaaggacattaataggacttgtgaccagctggatatggcagcagcagggagaagagacatactgtgacactgtgcactttgctatcctgattatttgtgggcatcaggaggagcagggaagagacaagcttcttgcttaccaaatgttcatatcagtatcttctcaatagtcccctgaggtaggtaggtcattaatgcttctgtttaactactagaaacgttgagcttatgtaatttgccttaaaagagctcacttagagggaaattaataaattcaagacttttttagtttagaga

SEQ ID NO: 128229 - DNA, 1049 bp, Homo sapiens
ttgaggccagcctggccaaacatggcgaaaccccttctctactgaaaatacaaaaattagctgggcttggtggtgggcacgtattcccagctacttgggaggctgaggcaggagaattgcttgaacccaggaggcagaggctgcagtgagctgagattgcaccactgcactccagcctgggtgacagagtgagactctgtctaaaaaatacaaaaaaaaaaaaaattgttgacctctggcatatttcatgctgcctactgggggtgggcaatggggtcagaggtaccagaactgcctcctgaaccagcctggctattctttctgcttccctccagcttcagttggttctccttgattacagcgctctctctctctctctctctctctctctctcttttctcatcaactcgacctcctcttgttctgccagctctgacttgtcagcatatttttttttgaagtcacaaccctggattcttgtgcgcttgtccagagagttagcacacaaggcttttcctgacttttcaactagtaggaaagttacaaccgaccatttagggagtttgctcttcccatcaagactgttcctgtctgcagggtgtatttgcatgtggaggtcactctagctctcccaggtattcttcctttcactttgcagactatggttctcagcattttattattttttttctttttcatttcttactgcgtggtcttggtgactgggtttcttaatcaagcctgtcatcccatcctgagattttgatattttatttgggcctatatttcctctataaaggcctagagaggagagagaatgatgccatggaaagagaatgagatttagattcagacaggggtaaatttgaatcctgcattccatttacttaatgtgaaatcttgggcatattcaccttcctgtgctttctctgaatcttcctacgtttcatttccctaatgtcttaattggggataataatatgtaatgatacctacgtcactggattgttgtggtgattcaatactgtaatatatagaaatcaccttag

SEQ ID NO: 128230 - DNA, 1032 bp, Homo sapiens
tacagcaaatgatgtgcttgcttttggaacattggtcagtacttccaatacctacgacgggtctggtgttgtgactgtggaaactgaccacccactcctctggaccatggccatcaaaagctaacctgttgactggcatccataagtgtgcctctgccttatctcatttctcaacagttcattgctcaacaagaacgattcacctgggtttgcaagaatctaaacctctctaggggaagcccactgggtttaaagatgttagtgtttagataatacaggtaacattataaatgacagatctcaattttatagtagtgggaaagatacatgctaagaaagcaaataagctctattatattcggttggaacctaatgggaatcattccactatacaattcagtactgattattcttcttacattattaatcattccatttatcctagaaaattgtttttaatttgaatcagagaaaactgttgaggttcctcttggagtctagaacatccttaaatgtctaacaacaagggctacctctgagtaccttttagtattagttttctgtatatgatatatattatcttatactgaaaaaaaattcctttcagattggggtgttagaagtgcaccaggtcactctgaccttattactgtctttggtattgtcttaaataaatcaagaatcattgacctaattgttaaatttaaaaataggtagttagcaataggtggaaagagaaatgatgtgaaagataaatgatgattcgtggagccctactcacacattaacccccaaattcaaaagtaagaatgcaaaagtctagagggggtaacagtctgcatcatcatcacaacctaaatggagaaagctgtgcagaggaaacttaagcataaaaattgaattcgtttctgacataccttagactgaaaaactgttggttcatccagaagtgtattcatattaccagaaaatgagtttgtctatggggatacatgaacttcatatactaaggagcctaactccaaagcctgc

SEQ ID NO: 128231 - DNA, 1044 bp, Homo sapiens
catgggggcgaacttcccccttagtgttctccacatagagttctcacaagatctggttgtttgaaagtgtgtagcacttccccctttgttctctctgttactgccatgtgacaaaggtgcttgcttcccgtttgcccttctgccatgattgtacatttcctgaggcctcccagccatgtttcctatatatcctgcagaactttgagtcaattaaacctcttttctttataaactacccagtctcaggtagttctttatagcaatgtgagaatggaccaatatacttgaaagtggaacttcaggccagatctctcagaccaatggactagaagatagagacttaagaaataagtgacttgcttgggcttggacttgaacccagtgctcattcattttcattgacctgagaagtaaccattacatcaatcatgttgaaaatttctttatcaaatttggaattggaaagtttgagtaatgcaaaacatcgacctaaacgcttcattaattactccacagagctgtctaaaaccataataaacttacctgttgttcattgtagctgtttacaggcttaagaaagtttaaggagaatgtaaccttataaatgtttaaccataagggatgataaatgttaggattaatggtatgtcagagtgtgcatatttttaggattctatgttgagattggagaaattcccgttactataaaatatttgaggggcaatttacctgataagagaaacaagggtgtattaccattgattgattatatagtaaacccttaccttgtctctcttcacataatgaatttcttttttccttacagcctgataagaaaatttaatgggatgcttccatcagtaataaaaccactgagccatatagaaagtggtttttgcatctttcccaaagtgtgggaaataccttgatatcagctggaaagagtcattacttccacattaaagttgtgctaaagtgaaagcttaacaagcacttagtttatcagaaacacagtagcattttccaaagctccatccatggatg

SEQ ID NO: 128232 - DNA, 1100 bp, Homo sapiens
catggaagggagtataaggatgttctgtcttcagggttatgatttgtggaattacttggttgttcccaacaaacaaaattgcaaacgtctcttctccttgtgggatgtggtaagacttcatttctgtaatatattctgtgctgttgttctgaccaaacctgatgacccaacgatcttttgtttaaggtgaagtgatgtattttaaagtccagatgtaccacaaatgaagttctttagacattagaaaaatgtcacaattacatactcaccaactactcacccacctgactgcattttacactgcctgttactgttgctagaaggattatgcttacaggtagaattcacagagcacctacgtgaaatgagttagtatgtacttatgtaggtactaactgttcaatgatgcttctttaagaagatatatcctgtaataaactgaaaagcaggatcttcaagaactttcagtatgaaatattttccatccactgttatgcttctagtgattaacttgccttattaatagctctgtgagatgtttttctaatcagtgcacacgagctgtcatcaaaactagaattcctaattctgagccaaaacagttggagaccaaccaaatcaggacctttaataaggcttataaggaaaaaccatcaatcattcattccctctccctggctttgcatacattattgaaaaattttatcaaagtttttatactaaaaagccttttatgacatttgaatgttatacatattagcatgtagtattatctaatcaaaatttgatttgcaagggtgaatcagctaatgtattcataattttaatcctgttaacaactctgaaattggctgataattaccttaggattagagactctaatttgtacattggtaatgtgtttccagtcaccagctaatgtaataacaataataaattatacttctatcttcattgagagtgtgatggacagctgaattaggatatttccactggaactgaatatcaaacttttcccctaaatattaaagccttgtaaagtttctgaacattcaaggccacgtttagcgctgtgctagtcaaggcttatcatgttccca

SEQ ID NO: 128233 - DNA, 1048 bp, Homo sapiens
cactttgatgatgattcattagccgtgttgagatcccccggccgctccagcgccagcgtcacacttgggctgtcttctcatcttaattgcaaggtttcacttctggagaagcacagcagcctttgccactcacctattttctggacacatttaatttcaaattaacaagttttccctcgcaactatctatctctaaatccggtttttcgtgtgtgtgtgtgtgtgtgtgtgtgtgtcttaatgtgcttaggaaaaagggaaaaacgtgtttaggaaaaaagtgtgtgtgtgtgtgtcttcatgtgcttaggaaaaaagaatgctttcagactctcttttcttaaacaactacagatgataactaatttttatcttaacctttaagaaattagttatgtgcagtgtacaagtggaaagtctgccaggagagagaaacaaattgtggacaattgaaatctgacatacaattaagaaaaatgtaaattgaaacttgtggtgttttcactaacttgtatcccaccaaatgctgattttctagagataacagtgaagagatgccatttcctgctgccatggtacatgccaactaccatataaatttaataaatgaggctcattccctataggtgggtgcagtaccaaagggaggagaagtctggcttgtgcttgtaggacaaagtgaatgaggacagagctagctctggcagccttctcctcctcatcccctgctgctgcaatggtgatataaatatgcgctctgttctcccctatccttactatgtagctctctttctttaaaatgagtaactttgaactaaactatctcaaaatctttttcatctctagcattagtctttcttctttattctcagtaatagaattgtactattttatcctctcctcctgagagcctattaaaagcatttgaggtccaacacatattccattttccccataatacatgacctcaccccctggtattctcagaatgtgttctccctttaacgtctccccctgcacaaatgttactcatctacaagggccattt

SEQ ID NO: 128234 - DNA, 1038 bp, Homo sapiens
cttcaaggaaaatcaaggcataggttacatggagagcaggtaaattcccaagctaaaggggtgcgtcagggaattatacagtattttctttccattccagagaaaagagtaggattgaactagcaagagagggtaaagatcctctggctttgagaatattataagagccaaaaacaagaacaaatccatgcctttttaattttttttgttttttgacttctagctttagggttcatggcaggtttgctctctagataaattacatgttggggggtttgctatacatattattttgtcatccaggtagtaagtatggtacccgataggcagtttttcaatcctcaccctcctcccacccgcctcccacccgcctcccaccctctgccctcaagtaggcccgatgtctctggttcccttctttgtgtccgtgtgtactcagtgttagctcccactcaaatcagtgctttaaacatcttgacaaaaaaaaatctctggagattattgcataatatataacttaccttctctgtatgtaatttataccttgactgttccttaaaatgtagcagaaacaaagtatgtatctgtttacttcaattcataatgaggagggaagatgacaatagggttcaaagtctgactctgtaactaatgaattaaatggtactacaagtaacatggattcttcatatatacaaagaggactgattgtatatatgatgatagatggtatccaaggtttcttttggtttgaaaaccatggtcgctgaagccacagagaagcgcgtgagtccagatcctaaatgtcaggagcttgatattctaaggaggcatccctctcctccttacattcctgtgtggcagcaatgaacggtccccatgagaagctgtaataggatgagactcaggggacttttgcttggaagctgtgttgggatgacatcgcgttgtgcatacccgtctcttgtcggttttatgagatgtagttcactgtatgacagtggctttgaacattgtggaagaagacgtcctatggca

SEQ ID NO: 128235 - DNA, 2120 bp, Homo sapiens
acaaaaatgccttgtattgctttgctgaggactcataaaaatgactggtggtgctttcaggcatcattcatcaggtttacattttagagaaagaaaaaatctcattatccactccgtactcatttaacttttaagtgcttagaagatttgtcataacctagactcaagctctgaaatggtaaatcttgacacatctcaattttagcaactcatcttagcagtgctgaaacgctgagtgctcataggtacaggagctttatattctattttgccctaattctttcacattttttatacatcactcctaactttataatgttgttagcttttacaccttcctttattttaaaactggattagtctaaaagtttcctattcagtaagaagtaccaaatgaactattgagcacgatgcataagcattaacacatttaatcgtggagggcaagtgaagagtacaattcaaatgggtcaagagaactagatttctatgaggtcattaagcattctatttaccttaattttgtgctcttatgacactgccctttgccataccatgcagacttcttatgcagcagaaactgtagaagtttaggctaggggagaagggactgagaacctatatgtttttgttcattagtatctgaaaagtgatgagttaaaatgtgtggctacttatcttaaaagtgtatatatatatatatatcatacatatcattcttttacttgcaaaagtacattatttatgataacatttagatactaactttcctcatttgaggaagtagtagtaaaatgtgtggctacttatcttaaaagtgtatatatattatatatatatatgtcatacatatcattcttttacttgcaaaagtacattatttatgataacgtttggatactaactttcctcgtttgaggaagtagcagcactctttcccttcagaatacttttttttataacttgcttaaattgaatgaggtcatttattaatactcaaagctaataaggcatcatcctgtaactttcagaagacgaatataagtagaaactatttaataggggaaaaactgcctggtttttaaaactttccttttatactttgtaatgtcagattttttttcttaacaaaaagaaagttggataagacaactccttcaaaatgaatcctaatttatctctattggatgcatgtgcaaacctagctcctgttccaccagtgtccaaaggttataaaaaattgaacagctaatttttaagtagtatttaaaattcattgagaatgtaaaatgaccacaaaattatatttttccgataacttcttatatccactgtgatgtccaacttagagtcagaatgtaagggttcacattttaatttctacttggacagtatgcccaaactctgtactgtgaatgtatgtcatttatggagatgctaggatgtaaaagcattcaaattacggtgcttttaagacaaacagcaatttggtattattggttattctttctcctacactaggcactatacccatttatttggtctatgttttcacaacagccttgagattttcggaaagtgacctaacaatcctgtatagactggtcttaggatggggaccaaggctgaacctgggtaatatggacagaggtgaatttgtagtaatgtgtttcatgtaaaagcaatgcatacaagttttgacccatcttctgctttttgttttttttctattggcttgtctggcaaaattagagaataattaaaggtgaaaaacaaagcctccttcctcatacagcatacctgtttaaaaatggaagactataaaactaatttcactcatcataacaagaaatatatctatgatagtaattgaaatagtgtgcagcttgatctctcattaatactttggtaatttataagaaaataacagtatcaagaaaatgtgaggtccatattatcttatgttttttcactgcttcccctcccaaaaacataccatattagaagtcaaattataatcagagggctgatggtcaagaaggaattagcgtgataggagtgagaggaaaccgatgtatgatagtatcagattttaggaaaattgatgtgctcattctcat

SEQ ID NO: 128236 - DNA, 1582 bp, Homo sapiens
gaatgtgaacttctttttgccataggttttggaaagtcattaaaagattttggttagcagtacagatatgctttttagatttcttatcaatttatatgtttgttaaatacccatagactcccaacagcttctgaagtttgaaacttactactattgtgaagcaatgagctttgttctattgcactgaattgatggtatgactgctaaagtattcagtcataacttgtctctgtatagatgctctggtcaatatattactagttaaagatgcagtacaatactttttaaaattataattggcagattcactgatagaaaaagccacatctaaaatatgaattctacattaaggtatttttactgttttgggtttctgtgttttccctataattggtataattatgagctttctgaaatgcatttggcttgggattcattggattttcttccatctatagattgttgtctgtcatcatttctggaaaactctcaatcattatgttttcaaatattgccctattctttttctcttttcttctgtacctccaattaaatgtatttaagatcctctacttgtatcatatatatctcagcactttcatattttctatgtcttaatctctctgggcttcattctgaagttcttcaccacctctgtgttctgttcactgtcccgcttcagctctacctatctgccgctagacccaccctctgcgtttttaattcctgccatgattattctttcttacacgcttgccctttactcacattttcaaggggctctttcttaaaacataattatcaaactggttttatagtctagaataattctaatgtaagccagctgccttttgtgttcacttttgctttcacatttcgtgacctcaattccttctctgttttatgatttttggcaggacctcacatttctgagaactttaagtgtgggaattatttgaggtgtgggttaaaagtaaatccaaggagaatttacatttgcttttgcctggctgctgagtggacttgtagcccagttctgtgggagcactaagtacttaggacattttgtctgagactattttggaccacgttgtcagtgtagactctgaatgtaacactgctgagaatctgatgtctggttacaaatgctcaggggagacttttctcatcttctcagttatggagtgccaaagtttggttggccacttttcctagcagaccagtgggagtgttgttcatattcatcttgatattttggatctctgctttacgtggtacagcatccttttagacgtcaaccttgggcaggccttgggctttgtcttctgacaaccttccctagttgggggctttagaaactgaagctcaggttcatctgatttgctaaacactctccagatgaaagttagccttggccttctttttatatcaaaatgtagtttttggcttctgggcaaaattcttatttctttccttttctttcttttttttttttttttttttggagacagagtctccctctgttgcccaggctggagtgcagtggcgtgatctaggcttactgcagcctctgcctcctaga

SEQ ID NO: 128237 - DNA, 1105 bp, Homo sapiens
atgaccagagtacctgaaattaaagtgctttcagagattctttgaagcaatctgagggtaaacagaacacacctatgataaaagcactgcatccattgtagctagggagtgctctaaaggaggagaaatgtcacagcagtcacagatttaggttgtttggggtcaacatatgaagaatctttaatttctagataagaaatttgaaccttgatctatatagataatggtaagctattaaaaaattttgaacagaaaatcataaggcaatttagaaaaataatgtaatggttgtatgcaagctgcattgaaggatggaaaatctaatgacagtaatgaaccaattacagtgttctttgaagaacaatactttagtcattttctccatcaagaatttgagaaaggaatagagacctcagaaattagccttaaagtatatacttggtgctgattgatcttttctgacaaaattgaaagctcaaaactataactattcagctaaacaaacatctattttgcatgtgccaggcactctgctaagtattatagattgagaaatgcaaactgaatgagacccagtttctgactctaagactgtcctgtctttgggggtggatgcacttgtaatcagattatctggatacactgtcagtagtgctacagtagaagtctgatagggtgggtgagaagcccattgaagcaaacgttttccagcctagagtgttcaaagactccttcctagtggaggtggtcagtctgctgagtcttgaaggtatagtaagggctaaccagaataaggggagtgtttattttgagtattcaaagttaaaggtaaaccccttaattctggaatgtcaaagaataggcagtcctgagagaatgtaataatcacacatacaccctgggttcaggcaatatttacatttgcttcctttaacaagctagcagagaacttcactgggattggtcattctctcctggactcttctcctgctggttcctatcttagtgtgtcagggacctctgccagcaagactttcttcttccacttatgcaaggaagttggagtcccttggctgagctctccagagaggtacaggggcatcag

SEQ ID NO: 128238 - DNA, 1106 bp, Homo sapiens
taattactcagcagcataaaaagatgtgactcattgggttgcaggaaaaaccatgatagtaccccaagagatatctttccaggtactctggtgtctcagtacagcctgctttcatgaactggtatctttggcatgatctaaaggaaaatatatgtgtgtgtatgtgtaaaaatgtattctgaaaaggaaaaaatctttatagtggagaatcctggcagataccacattaatcaagtgaaaaacattaataacatcgttatatcatactagtaatgccctcctacatggatataagttgagaagggcacttgtggagttcttctctaaaatccacaattccactttaacctttaaagtagtcaaagaactccaagttgaagaatattccatcaaatgcctgaccaacatttttaaggccaacagagaaagactgagaaattgttatggccagaggagatgaagaagacatgacaactaactgcagtatggtaacctgatttctgttgtgtagtggaaaaataggacattagggaaagctgttgaaatctgaataagcttgaaagtttagttaatagtagtgaccaatgtcagtcttagttgtatcctatgtactgtgtttagacaagatgttaacactgctgaaaactggatgaagagtatactccttgtactatttttggaactttttagtaaatctaaaattattccaaaacacaacatttcattgagaaaatatattcactgtttcaaatatgctattaccctagaacaggtgtaatcttttagtgaatggctcacagtaatatagaataaaggcaagtgcttcttagtacttaggcaaaaaaacaaaaaacaaaaaacaaaaaaaaaacaatgccttttgtggactctcccacctttaaaatatttcctcaggaaattttaaattgtgagtttctgatgcatatttagacaactgttttacatgaaaattatgcctggtagaaaatcttaggtagacatttgatggtctttaaactatggagacagcccagatgctctcaactttcccactttcccaagggataaatttcaaaatatggtaagactctatcaaaggtagaact

SEQ ID NO: 128239 - DNA, 1261 bp, Homo sapiens
gcgacttcaacaaaatggcagaactagtgagagacagctttaggatcaatgtccatattttctataaaaagaatgttgttagaactgggactgggtcactgctactgcttctcaacaggtaaagcctttggcctatggggtaagacagttgttccttgcgctggatatgtagcatccctgggaatgaatgctaccatcactgtcagtgtgacataacgtcaacgacataatcaaatactttacattgtgtttctggtatgtccctctaaacctttgattttgaggtagcaagggtaaaggtgcaatagttggaccagaccaggaaagagcaaaaccttataaactgataaattgttaaattacctattaacaacagctacttacaagatattggattgagccaagatagaacactgaagaatcagagtgatttggtaatatgaaattagcaagggtataggcaaatttttagtatgtctttccttgtgttaccaatgagtattttgccattccagaaggtgttgctatcaacacaaggccatgttctagatggtatgatgaaaacaaccctagcataagtcaggaataggactgtaggtccaagttctgattttatcttctctgttaatccttcaaagtcttagaagaacatagcatcaagaatattgcaacaaggtgcccaaagactcattgtaactgtgtttatgaagacaagcttggttaagggaaacattgaaccgctgtatatatggtgaatgaggctagcagaaagggtgagtcgatgctgaaccacagattttctattacagagataataagataattccaggtcccctgataattctagcactataaactggaggaatggagaaagaaacataggcagatttttgtctcctgtctttcatcgtatctttttccctcttgggaaagataagggttttttttaaagcaaattgcatgaattattgaagaatatatcttataaaaccaatattttttatagtattttcccattgtcattgaatacttgcatggccatacccaaatttttgaagagtgctctcgatgggcaggggtagtgtatctaatctttaaaaaccaatgctcccttttataaatataaaatgctataaatgttagttgcagtagcagaaaatgtctcatcattttacatttcatcataatggctattacctgtataaatgtgtttcagttacattttagggaattggggatttgggtttaaatataactttct

SEQ ID NO: 128240 - DNA, 1113 bp, Homo sapiens
aatttacttcctatgatataggtgtttctctttttatacactgctcaagaaatatcaatttaaaggtggatgttggaaataacaggcattagcgttttttctattgtaaaagtaacaatgatcttagctgaactggatttattattagcagttttacacatttgcccgctgaaattcatttcttctttccttgtcttcctcttgcattttggtgacttctttacagccctcaccacagtctacagtgcattgcatgtatttgcttctgttttcgtgtttttcactataatatgaacccagagaactagatctgtttattgttcatctttttatcttatgtaagcctagcacataataggaatacacgttgaattcaaccgatctttgcaaaatggtgtaatgtgaaaaattggcaagtcattctatttgataatccttgaccattaaaaactactatttctgagattttcatattactttagtgaatcggttattacataaaaatattccatacacttgttagttttgtttacagagaattgttttatattctctaaagataattaccgatagtttaccatctgtttctattaacgagtcctttctatctccctaatcacttgttttgtgctatattttatacgtgaaatgatctctgttttttagcttttgatggttttgatacttaggaaatgtgcgatatcttctgtgatcttctgcaagttatatttgtgacataatttgaatttgagtgtcactccttactaggaaatgtgtgttggtaatttgtaaaatgagacatcccttttagatgtctttataaaaactcttatttttgttttttattttctaagtagataaggcttttcttttccagaaacacaatcttttcagatttttttttcattctgacaaaaatggaaaaagaggactcaatgtttattgaatgcttattgtattcttgtatcgtaatgagcactatatataatcattaagtaattacttaataaccttattccataagtaatatgcttatttactggtgagtaagctacagagaaaatgaatatttttttttccacttcgcctctgctttatttctcatgtaccata

SEQ ID NO: 128241 - DNA, 1013 bp, Homo sapiens
ccttgacataaagacctttccctgatgctttcttggatttggtatgttcctataccttccatgaattgctattgcaaggaagatttgaccaaggttattcaaactttaaaagtaacaatatatctcataacagataatatactaatacatataagatctaacgtttttgttggtagtaaaataggaccatggtatattttatcagtattcagctgtgggcagtataagtttgctattagtttttcatgattacacatactgtcacagcaaatatccttgtacatatttccttgtaattttgggcaagtatttatgcaagctacatagaatttctggataaaaaggtaaacacctttaaattttttataaatctgccaaactgtccctcaacgttatagtctcatcaacagcgtgtgagataatgtttcctcctgcaccttccttctacttttatttatgttgtctctctctagtccctgaatttttgtgtgtgtgattttggtaggatatacaaaatgatcttgattttgcactaaaatcagaatgcttaggattagctcaacatcataggactaagtggctgatctagactagcactgtctgtctctcgtattctttgagttaactgaaactgcagaatctattttgttttattctcctactttaatatttggaactaatttataatctactttgcagaaagtgaagttatttcaactcaactttattccaaagaaatagggaactatttgaaatagggaactaacctctgcttgtgcctgaagctcttcattatttgtcagtaatgttaacttatgccaagtaaaaaaaaaaaaaagttaaagatgtatttcacctacttacgggttctactaaaatataaagttgctgtagaggtttttaatatattttagtcttcatctgtttatcagcctgttgcatggtaagtaattgctcaaccattgaagttatggtatgtgacaaatctgcagaaattttgctgtataagccaa

SEQ ID NO: 128242 - DNA, 1035 bp, Homo sapiens
aggtctgattccccaagttaacctattatcaccgcttagatttaatgatcactgtttaagagaatagatgtgtttgctagaaactcctactcagtaaattgtgttgatatttttgtaaatatatcaaaggtaccaggataggtggagatataagctgattaggtacttttttccttctacctctacagagtaagataaaggttaagtatcacatttttgtgtaacaaagtatctgattttgatgtgctttcacttttgatatatgcaacaatgaatctctcatttgaaatatgacttgtatatgagttctgggatctgtgaccactgatccagaaaagatgaagagaaaaggaattctggtgacaaagaaacaggcaaggaggcgaaacagttccaagcttttccaccttcttctacattcattatgtaatatggttgcagcaacagttattttaatttaaaagctttacttaaatacttttacttttgctgactggaccaaccactattattacccatttcttttattccaacgcttcttggtagttatatatattttactattttgctcattcatagatatctgccacatttcattattttgacactgccactttactgatgtttttacattatgaagttaactgatccaatagaaattgtcacttttggtgctcattctctgtggtggtgatacatgtggtatgttttctttcttttttttcttctttttcttttttttttgaaacagtctctctgtgtcacccaggctggagtgcagtggtgcaatctcagctcactgcaacctctgcttcctggattccagcaattctcctgcctcagcctcccgagtggctgggattataggcatgcgccaccatgcctggctaatttttgtattttttatttttttaggagagatggggtttcaccatgttggccaggctggtctcgaactcgtggcctcaagtgatccgcctgcctcagcctcccaaagtgctgggattacaggcgtgagccactgtgcccagccgg

SEQ ID NO: 128243 - DNA, 1047 bp, Homo sapiens
ataaaccaataacatggtcatttattgtcattatcaagtattatgtgctgtacataattgaatgtgttatacttttatatgactggtagcacagtagatttgtttataccagtatcaccacaaacacataagtagcacatgacattatgtgccatgacattgcaatggctgtgacatcactgggtgataggaatttttcagctccattataatcttttgggtctactttcatatatgcaatctgttgctgactaaaatgtcattatgtgatcatgactatatgtactattgaaaaaatgttttatatttccataaggaggcctataaatgataattgcagctttttaaaaaatcatgaaaacatgtaagtcaccttacatctattattgggagatgagataattttgacacattcattagctctgtacagaaatcaaatgaatctagtgaactagatttgtatttctaaatggaaagcccttgaaaacatagtgttgaatgatataataagcatgttttggaacacctttctaaaaaattaaaaataacacatcacacaatattacatattgctcattgatgcaaatacatgccatataaaagtaaacaaaacaaccacagctaagccataagggtaaagctagaatagtatatactactggtaaggggtgtgggagtgggttgggggcattagagaggactctagggcctaaaaacttctctagttttactgcatgacaaagcactgaatgatagcaactggcaattttaggtggaggtcacagaggtgttatattattctttgatgtattttggatttaatttataagatacattttatgcattctcagagacccagaggatttcccttgggtctgtacaatgtattttgaaagtaaaaatttaggattaaaaatagtagggatattttttcattttagtccttttacaaattatttcagttctttgctgaaaaagggtgcacagatggagcagtagcccttttgatgtacacaagtacaaaagtgcattttataaacaaattta

SEQ ID NO: 128244 - DNA, 1046 bp, Homo sapiens
ttatataacttactctttcattcaccagatgagttaatcaaaattttaattttgcattctttttgtttcacaatttaaaaagcatagagtaaaaagacaaaaagcctatggcctctaaaacagagaaaagctagctataacataatgcatttttgaactgctaaaacgtgaagattctattattctccatagatttgagtcaagacctgtgcaaaagccctggaggttaaaataattcctcagcttcatcttttgtggtgtaagtttacatgcacaatgggtgttattctaaagctgcttatcctttagattcggtgattcttatcatatacgacagtattatgtagataaatggtcaaaaattactttctgcttatttgatgttttttgttcagttgtctaaagttgcttttttaagggaagaaataatacagaaacaatgattattgttattattcgcccaaggttacaagagcaaactaatcaagcctagttttgactaatctagctagtttttgctctcttttgcctctgggcctctgcccggaataatttcattcccttcatcttttctcacttagttaactcaagctttttaagtaataataaaacttcttaccattttgattacttacggtctcagtttctgtggtttgctttctttcgtgcttatagctgaattggctttgtcctttctgcatgcccctatagagctttgtacttacccaccttaggaatcatctcactgtatgattctacttgtctctcctatcttcttgaccagaaatatattttacatttataaaatattaggtgaaccacatacgtaaaattaaatcttgctgtagccatgttaaaaaagtaaaaggataaattcatactgtcttattttctaacctaccatattcagaatattatcattttagcaaataactaatataaaattattaatgatatattttatattctttttgtactaagtcttcaaaatctattgttttacacttaccgcacatctaagttggtatgatctgcatttcagatgc

SEQ ID NO: 128245 - DNA, 1028 bp, Homo sapiens
cagtcttggtggctcatgcctgttatcccagcactttgggaggctgaggcaggtggatcacctggggtcaggagttcaagaccagcctgaccaatatggtgaaaccccgtctctactaaaattacaaaaattagtcgggtgtggtggtgtggtggtgcatgcctgtaatcccagctactcaggaggctgaggcatgagaattgcttgaatccgggaggcggaggttgcagtgagccaagattgcgccattgcactccagcctgggtgacagagcaagactctatctcaaaaaaaaaaaaaaaaaaaaaaaaaaaagaaattataagtgtcttcagtgatttttttctgattacattttccctcctgttgtggttaggaagggcaatttctcggaatctcagatctctcattctgagagattgcccttcctctcaccatatctttgtagtaaagacagtgtttaattcatcccacttacatttctgttcttatattcagtttattcctcaagatgaccctttcataaccacatctttttctgtttaccaacattaacctttaggctgctgtcctgaatgccctttctgtgttttgggtcatactcattcttgcctctgctctgcctgccctctcctcagtttataaatctgtcctctttttgatctatagtctacctttccatcaaagtccagcatattttcttcctttcctgtcaaatccatcttgatgactccaagctacgcgtatctttcccttttcagaatttccacaagtgtgaatagttgatgctgtgaaatgggatctttggttttgcttttgtcttgtattatcttccagttgttgatggatttttgtgtctaatttggataaataccttcttgggtgcagggacttttcaaaacaaagttggccatcttttctttgttgcattttcttttgatcattaacgccagttgataacctttcatttcttatacaggtgaacaaagaaggagaggagttaatatccttacatagttctcatcctc

SEQ ID NO: 128246 - DNA, 1024 bp, Homo sapiens
ctgtgttggcacttattattcagatgctaatggataaattctttggcttttatacttgggagcagatttaacgtgtcttcttagatttcattcataatcttattcacaagttctttttagcttctttgagaagtctgtaattttagaagccttagctcctgaatcataatgtgggagaacatgagttgattagcaaaaataatgttaagagtgatttcattttaattctagtgtgtcaaatctaaagaagacattgacaatgttagggctatatgtagcaccttgacattgctctaagcaataaggccagtaatagccatatcaaaatggagatttaaaaaaaatcatttatttgagtcttccagctgaaattgatggggagagggagctggtgatcattacttaaaatggcctaaaatatattttactgtgtggccaccacctctctcctaggttttctgctgtcattacctctttttccccattcacagtattggccacttttcatgcgttttgactctttgcatatggtgttttctccgggactatcctacctcctccacatagggcactgtaactcagcctccagtactgctagaatgactcttctatgactccttccccattcccctgggacagcttccccttccctgtgatctcattgcgtttggcacattgggtgttttcttcagtctgttgttcttcacactatttttgggcctgtgttcttcattggatccaaagcattaataacaatatcatttgctttttcatgacattataaggaaatcatggtttttaaatattataaacattagcttttgttagaaaagcagagaacatgttgattattctttgttaatatttgatatcttttatcctagtatcttaattccacaaattttgatttatttataaacctcattacaactcacaaatattcatgatattggtgtaaaataataaaaataataagtatagcttaaatactggtttaaattgcatccttgatgccattaattat

SEQ ID NO: 128247 - DNA, 1053 bp, Homo sapiens
ataaaagccatcacaatcgctgcaattgtatgtagagatgtattattaaagtaaaagacttaaaagaagtttcatgtaaggctggagatttttcagtgatttcaggatttgaaatgaagtcttatttttaaaatgtgaaatttcatgataatatacaggggaagaaaagtagctttcctctgctactacgtgctacatatagaggaataaatgaaatttgctataaaaatatttttatttggaacctccagtgagtatttatatatatttgtgtagaatccattttacatttgttacacatttaactaaggaacacagaaatgaaacttaaatttcaggaggataaattattttaatagaatgccataaccacaagggtaaatactagcttaccattttttatagtcagaattttcattactacacagtatcacttaaagaaagagccttgcataaatttaatttgttgtttattaacaaatccagaagcatgaactcgttcaacttattgaggaaagagaatctgagtagttacctgtttctcaaatttgatgatgtttatttaggaatatcatgctgatattcagtatatacaaatgtgtatgtttttggaattactttagaactatttcctttatagtaagttaaaatggaataatctcatgcttgaaaaatgaactttgaaattaaagtcttttttctttaaatttttattagaattgaaattttgtattgcaatttgcataacgctgattaggaggggttggagatgaaaatgtaaattggattttcaatcaaagactggtacgacttgattttttttctccctgagcttacaagtttgacctatgaaaacgtgggaagtaaagaatatattagtttaagaaaacttgcagaggagaaaatagcgtattttaaaactccatattgtaatatgatttttgtatagtataattttgaaataaatgtgaagctaatgtagctgtttgtatttttgaagagggggcatatttttggatatgtccaaaactaactgtaagcaagtaatttgat

SEQ ID NO: 128248 - DNA, 1064 bp, Homo sapiens
caaaccagtgagtgttggagtcaactctaaaaatattgtcctctccttcaaattttaaacttctaaaattataactaaaatttggaaatagaatagaatatatttaggtttgatgagatatccaaggaatggaaagtaaaagaagctggcctaaactgaagtacaaggctaggaatgtttatataggaacatcaggcatatattaggactgagaaaaataagatggtaatgggaatttacaagtaggtgtccaatacccaaagctctaaagtagcttacaaaaccagagtagttagggtgtgggaagcctggtggaatgtttatactgttttgttcaaaactgtaaaatagtttccttgtttattttttgctgtctgtcttgatccaggttactattatcataggaacaattggtttctgaacgttctctcttgcctattatcagttcaactgatttagtgttatctgtttcagtggatctgttagaatctgcctgtgacaattcttgttgattaaaaaaaaaaatgcaagtgaagggaacccatgtgcagaccagctcgtactaatgacattcatagaaactagtgattccgttgaagtgtgcattggactgtgacactagataactatgaaaggattaggcatatggtggtattgtatacttgaagcctatcataaatttaacctttctattactgttaggagatgagttattgtttccacttgccaggtaagaacaatacttgagatgagatctgacgttacgcttttgcccttgcactgctttttgaagtgtaaatggcttatgtttagtcaatcttcttgttgtgaaattgcatcatttttatgccatccaagagttagagctgctgatgcagctattagcagacacagaagcactactcagttgagacaatgtgttagaggtgggtgagttctgtgaggaattttctgctcacttgtaccacacaatttgtgtcatgtttgcactgcataaactgtatcattcatttttatatatttatatatgtttgcataatacaggtgattaccagtatttactg

SEQ ID NO: 128249 - DNA, 1040 bp, Homo sapiens
gcttttcaaagttaaaaaaaaaaaaaaaaaaggccaggcgcggtggctcaggcctgtaatcccagcactttgggaggctgaggcaggaggatcacctgaggtcaggaattctgagaccagcctggccaacatggtgaaaccctgtctgtactaaaaatagtctctgctaaaattagttggttgtggcggcacacgcctgtaatcccagctacttgggaggctgaggtaggagaattgtaggagaattgcttgaacctgggaggtggaggttgtagtgagctgagattgcaccattgcactccagcctgggagacagagagagactccatcctccatctcaaaacaaaaacaaaaacaaaaacaaaaacaatccaaagaaaaaaaaccccaaaaggcactgggaagcacattttgcaaatttcctagttctcgtttatccagtattaccaggacaaacagcattttctagagtaaacatttgatttgggtgaaatgttgactttcagatttgttactgaaacctaagagcattactgtctgaagatttctaatggtttctaggttaaaagacatatatcagggatactgactgctgcataataaagattgtattgaggaactataatatctgggtttaaatcctagctttgccacttaatagttatttcaccttgtacttccatttcttcatctgtaaaataggaatacatcatagggttattatgtgtataaatgaattagtacaaatcaagcacttagcttcagtagctataagctgttcagcagtaagtttgaggggaaagcaaaaaggcagttgaatctcagggtggatgctgagatggaaaaggagggagctgatagctctgcccctttgtttttaatagaggcttagtggagaaggccttgactgcttaagtcaggacatttgtaagttccacattggagcaaggcctgtagggaaatggtgatatatgaagtacagatccagggaacagaatccagtgcctggcctcttgggtggttctcacagttacctcctg

SEQ ID NO: 128250 - DNA, 1873 bp, Homo sapiens
ttccgagtatctgtgccagagaatatatccctgaactctctattgtctaactcacatctaaacccaaaaatgtgtgattgtcatggataattattcaaagaacatgtagtttattcattatcattttccagctagttttatcctaggatcagttcaaaatttcagaaagctgcatcatctcagcctttggcctcttcatctgtccatcatcctgctctacctcactctctacagacttgtttgggctgaattcaaaatgggaagctttactttcccaaggagcttcagcatctaacagccttgtaacaaatacatttgcagaaatgctgctgagggcattgactctgacttttattggggcccactatgtaaccaggaggacaacagactcttaattgttgctgtgtttaaaaaaatctgaagaaatagggcaaaatgtcgaaatttgtaatgtttcaatggtgggtacatagcatatggtttattattctctgtgtttttgcatattttgaactatcttatggtaataacagtaacatcacttaatttcttaccagccagaggtatctgcttctaaaattttgtgaacatccttccagacatctgtctattaagcaaggttaagagcctgtgtacactttgaagtatgacggacctgggttcgactatgctgtggccatttaccgctttctaactttgggcaggttgcatcttactttatgaactttaatttccacatctctaagatggtatattagtccattcttgcactgctataaagaactacctgagactgggtaatttataaagaaaagaggtttaattgactcacagttctacaggctgtacaggaagcatggctggggagacctcaggaaacttacaatcatagtagaagacaaaggggtagcaggcatgtcttacatggcctgagaaggaggaagagggcaaagcaggaggtgctacacacttttaaacaaccagacctcatgagaactcactcactatcacaagaacatctagggggaaatccacccccatggtccaatcacctcccaccaagctcctccttcaacattggggattataatttgacatgagatttggacagggacacattccaaaacacatcagatgggaataatgatggcacatacttcataaagtttttgtgatgactaaatgagaaaatgtgtctaaagtgcttagcacgttgccttggacacagtaagcaccaatacatgtgagctgttatcgtgtatgtgatgttgtataagtggagtatgctatgggcattttctatgtcagtaaatacaatccatggaattaaataaaataaaaatgatataataacaaaaggttcaattctcaagaggaactggcttagttcatccttatgggttgcatacttctggctgccgagaagttcacagtcaaatttatccaagtggtaagaccttgtgacctgataatcatgttctattttctcgatcttggggacttactttttgtgacttccattaactctctatttcatttaatattctccctgtaaacccccttagatcccttgtgcaatgtggttgggaagagagaaaggaaaaaataggaaggaaaagaaacatggatggcaagacggaaggaaggaaaggaagaagaaagggttagttgcacaaggctttggaattgttgattagaatgtttcgcttttggattcatgctaattgacataatttttcactgcatgccagactttttcaggtgctctctggctgcaccttgtttgtttatattttgactggcattaagccttaagctattctccctgatgcgactgtgagttttcacaaatgatgccactggaggtatgcca

SEQ ID NO: 128251 - DNA, 1051 bp, Homo sapiens
attaaagtggaatcaattttaattgcattccacatcagtaaatggcctaatggaatggttttggtgaccatctggttttatccaaatcaggcttcagaaacgattgctgtttggaactttctcaccatgtggtgggtttagtggtaggcaggggtaagagagaatgtcaattagatatcatcatgttaaattcttagggaccccatgtggctttaagtagaagagaagtacattgataacagaagagtcctggacatcttgagaaccttctgtcttcttcagcaggatcttcaccacacgcctccaccacactcctaggaaccatgtccttgcatacgggctggccagacctctcagtgtggaggtggcctgagtttaaaacttcaagctggtttgaaggtactgggagggagaggaatctgaggctctggtagttgggcatcttgtttcctcttttcagaaacattttgtcaaatactgctactttctgaaccaaataatgaaaacgtgctcaaatactttctcaggggccgaggagccatagctcaacccaaaaccagaggcgacattacaaaagctaatgaggtcatgaggtttttgatgtgtctctcaatcatgaacaggcttctctggatacatagaaatatagaagaaaaaatgaattctgactcatatacagaccaaattaatgggcaacttcccaatatatgtagccctctctcttctcttcccatagatcttctatatcagttcaatagactcaaaccattgtaatactatcagaaactaataaaatattggcctatgctctccatagaattatacatgtcagtcgttcattaaagtggaaagttaagtgctaatacacttgctaagaatcccaatagagagccagtgctataataggtaaaagttcttctggaagggaagaagccagagtgttcaaatggctcatcattattcttgcaattgcctgccttctgtcaagcatgcttgtattgcacaacccaggctgtgagtttatcatccagagtagataaaaactaaatta

SEQ ID NO: 128252 - DNA, 1558 bp, Homo sapiens
taagtaaagcaaccccagttgcttttactttattgatctttttaatgcaccagcttcagtatttaaatgagtttgagtttgtttctttaatggtctttcaataaagcttaagttgacccggttgcttttgcaatcacagcactgtaacagcagaaaaagaataataataaaaatgaactcattttatgtggttgaaaaggttacatttctattgattttaactgtaatatagttaaagtccttgatattaaagaaaacaacgtagcagacacatcctttttagtacggtggctctattgatattactttaccagtaggttttggcagcaataacaatattcaggatggagtcgaaacattggcatcatcagaggactgataaccacatccttcaaattcttttccaggtgaaagagcagaaaggtgtatcaggaagatcattacatagagagtgacttcagaatgtgggggaatgcctgaaagttccatttaacgaccagttctgccagtttatggaaagcagcaatgctctgttccctggaaacactgaagctttttaatgctatgtttggagctcgttccagaagtagaaggtggagagggatgggagaattcagtagaaatggtgaggaatggagactagaaaagaccaggggaagtgaagggagatgatggacattcgcttcttttgtgacccggccctgtacgagtgctcattgtgtgcactgagtgtgtgtgtgtgtgtacccatgtgcattaaggctctaacacaattggctgagctgaattctcagtacagaagcctattaaatttggatttggacttggattgtgtgttcaaatctactcgagagaaagcttgggggagtctgcagaccttgaacctcatggtgaccctgagcccgctctatcttgctcaaatcccagctcttcttccgtcaatcttccagagaggtttagttcctggcattctgcctgggttcccttggcaatctcgggaagaaagaaaatgctgctgaaaggatttgggagaaggaagagcagcgcgcagaatatgccagcagcaggaaaaacatctggtcctccccttcatcctcctccacatcagcatctaacatttcctggaggcgaactgcaggtgggatcccaccataagtactttacacatattatttttttaattgcacacaactctgtcggcacatactcttattcgccccatgttacagttgaggaaactgaggcacagagattaagttactgtgtctagaggacacatagttgctgagtagctagcccagaggtctgtgggcttgcagaggccaagctcctccatgtgccaacctgtatcctttgccatagaagagcaaggctggcatcatgcccacaggaaatgcacaagacaacccagttgttattccaaattcttctctaaaagtattctcaatcaactccagtccaaaattgcttttcataaaaaatactagtaaatataaatacaaaaggtacaattagtaaaaaaatacaaatgcatattctgattttattggttttattt

SEQ ID NO: 128253 - DNA, 1073 bp, Homo sapiens
caaattggaagtctgctcaaccacagggcctgctaacctaatcaggactatgaggcatgtataggagaatgtgtattgaagacagagagaacatgaaaatggcctggaggagaactttgcttggttatctgaacccaagaggtaaagaagatggattctgactgtgccctacaggctcctgtgttggtggctgtggtacgtatatggaactggggctacagcatggctgggaacttctgcagaatgaggcaaggctgcacactcctccaagcaatgtagcataatcatacccttggcatttaggaagaacatgtgactggatcatccaataggatcaccaatgcctgaggctgctgcttagaattgaaaatgtccaggaatagggaacctgctggagccaccatttgtgtactttgggccaagagaaagctagctagaagagcagtgatgagaactgaggagagaagggcattcatgtaaggaggagggtttttatgttttccttctcccttcttttcatcaaacatgcaattagagttgggagcattgagcccaaaccccagataaggcagagggactggagattgagttcacctttgtggccaatgattcaatcaaccaagcctgtgtaatgaaacctctaaaaaaaactttggacaccgaagctcagtaaatgtccctggtttgtaatactctgggcattgtcacacactgatgtgcagggagggtagtgtgtccttaggacaaagaagctttgcatttgggacaaatcttgccacctgcatctctccctttggccggtctggattgtatcctttatagtaaaacttgatcataagtatagtgctttcccgagttctgcaaatcattctagcaaattattgacctgagggagtagtgggaacctctgaatttgtagccagctgcttgtaaatgagggtcacctggagacccctgggcttgcagctggggtttgacgtgagaccagtcttgtggaggactgtgcccttggagctgtaaagtttggcctaactccaagtagttggttctagaagtctttgcagagagtgagg

SEQ ID NO: 128254 - DNA, 1015 bp, Homo sapiens
gatttatgttttatatcaaaaatttctcaaaatagtaggaagaaaaaattagctttcacacagtgatttactttatctagactaatactccacctactggaaaaacactgaatattatttaaagcataagatgtttaaaaagaaaccaagcaaacggattttctatcaataagttcgtataatttttgtaaatgtcaacggacaggaggagaaattctcatttcacagctgatatagcatttctttaatagcattgatttcaaagatatttatagcacaatggctcaagcactatataattatttcagagaatctggtcagaaaacatgtagcacttttagttttgtgactttgacttgcaaatgaaaattcagaagatgattgtaaatcattaaaaacaatatctgaactagtcttctagtaaatttgaaatttactagaaatttcaaatttctttgagatgtagtgtgagaatagttcatggttttatacactttcatatttagaatcactttagtaacaatcaactttaaccgttacacatagtgagtactttagataataatttacataaaataatcatgaattaattttatatggcattttttccctgaagagctcgaggaaaaacacattttgataacttagaacatgactttctaggaggaagaaaaacaaacaaatgcgtggaaaagggaggaagaaaacaataaaattaggaagagtcgcttttgaaaatagatattaacaaatatgatgctgcttaaattgtataatgttatggttaagttttttttttttttttttttgagatggagtcttgctctgttgcccaggctgaagtgcagtggcacgatcttgactcactgcaacttccgcctcctgggttcaagcgattctcctgcctcagcctcctgagtagctgggactacaggtgcccgccaccaagcctggctaattttttgtatttttagttgagacggggtttcaccgtgttagccaggatggtctcgat

SEQ ID NO: 128255 - DNA, 2347 bp, Homo sapiens
gactctcctgctagtccagggttgcagctctgttcctgatcctcccttggtgagaccgtaaccctgtgggttcaaggacgctgcctcagttaccactcctgccccaggagcgtggcataacacacgcttgttaaacactgatcagtgggctcagcaggtgcagtggaaatccacctggttgtcagagctccgtggctaacacctcacctctggactttcggctatttctttctctgtagtgttatctaataaaccttccagttaatttacgatccacatgaaaagggcctgtgatatgcaaggtgctcatttaacatgtgttaaatgggtcagcactggctgagccatgttcgtgtatgtatctgtatgtaaatctgtctgtgtgtgtgtgtgtgtgtgtgtgtttaaggtgtggattcctagcttttacttccattagaacttctgtttgtagagggaggaatctctgtgaatgactcagtggactgaagccctcatagcattttattgacatcgagtttgagtgagtgagcttggctccatcctcccagaccacatcgatggggagactggctgatcgtgaatctgggactccgaattttcatgcaagagacacttgcccctgctctgctctgagagtcttgatttcagtgcaacttgtttttgggaccacattgctgagagccacaagcccatcagggtgagggtcagcaggccagccccctcccaacctacattgccaagccctgcggccatccctccaatcccaagaacagccatgggtgcagatgagaggacaccatttgggaggctgacccatttagaggtcacgttgtctaccttaatttgtttttggttgagctactcataaatcctgccgacttatagagatactcaagaagaagaaagaggccaagaaacactctcccctaacagaactctggaataaacgagcaacagccatgcttttgtcactgggttagcgatgcatgccggtcctggaggtgcctggtgtgtttcacggcggatgcctttacgaagggaaagttaaccgaatcctgcaggtaactgcagatggataagtcagggagcctttgcctctttgggagagattaaatggccctggggagatcagaggggtagggggcatcttcgtagaatggagaggcgagaatgcagtgccctcgcctagaccttgcccctgtgctgtgacctgactctcacacctggggaggcactgtgcactcccaggtgtgctcagggctttagaccagctgtatcttttgcccagaatgctcttctgctgtcctttcaccaaatacaataatcaatttgtgcttcttctgggaattattctctaaaccactcactttattaccagtccccagctgggctcaaccacgttggaggactttgacttaattaattaattaactaatgtattaattaattgttggcaaggccagaggtggcctagcctagggccaaagcagacagatttgtctcctgagccccctttacctaagcctacgcctgggtctgggggctctccggtccaagagcaagaaagaaaaactggctgcaaaactagaagagatccaggtgaatccactgtgcctaagcctttctaggacagaaaatcccctgcgcatgggagctggggctctctccaaacccgaatcacctgactgtgagaaggcaaaaagagaaaagtggctggtttcagtatgtgtttcctcttctcggtaaggcactgtcctctatggaaggtcattcagggaccccttgcaaaccagcttctagacttccagtgtaagagaggagaggtggcctggggggatgagaatggggccaggagatgggccctggctctgccacgtgttaaatggatgtttatcaagttaggaagccttcttggacttcagtttcctcatttgtaaagtgaggaggttgaaccagttctgtgaggtttctttgaagatgttctgctaccatggccctaaggaatagtattttcccatgtctctgggggctttgagcagaatcatctgtgaagatacaactctagggtaccacttgaaggtgtcttttcagggcactattcaacttcgaccggttttggtgatggatggagggtgggaggaagcgtccacctgccctggaaaggcatcattctctcactttccattttgagatccagaccgtataacaagtgccatctttgccgtatgtactaaaacatctcggcagacttggctcccgacattcagccataagattgtcaatttcaggttcatttggggattttcaggtagggaggggcctcagagatgtagtttatcaccat

SEQ ID NO: 128256 - DNA, 1903 bp, Homo sapiens
gcaggagactcgcttgaacccgggaggcagaggttgcagtgagccgagatggtgccactgcactccagcctgggtgagagtgagactccatctcaaagaaaaaaagaaaaacaacagatgcacaaaggacactctgacctccccttttcttcctgaaagcaggagatgaaactttcatatggaagatggcttctctctaccaggaagaaaagaacattcttctctccagaggcggggagttgaggccgagggaaatcggtacaaacaaaaagtgttttgacagttaaaaagctcttgttaaaataacccttgtctttagtatctccatatagttagttactttttcaaaattactactttttgttcaccctgttgcataagcacttaggcctggctgcttttggatcttggtgtcctgtgaaggccctcacatgcctgtaaacattggcttgcgtttcctctgttagtctctcctacgtcaacttaactctcaggcccagctggagactgtcagaggagacaggggcagctttgcctccattacggtcagacacccaccgaggttgtccctggatgggctccctcagccctagggggccactaggaaactgcacggatttccttacatcttggagttgctgtttgccatagttaatgcttctatttatcaccccattttaaccgactgtggtttccagctcccgtttgactcaaactgctaagccctcactgcaacaagggataaacccaactttgtccaactgcagatatagttctggtcttggctggtgggattcaatagtaggaaaaaggaggaagcacatattgagcaactgctgtgtacaaggctttgtgctgatcttttaatatgtattgtcttattgaatagatattagataggtatgatctcgtatctttgatattataaagtgtccagtcacagagtaagtaccaaggctggcactctgactccagagacaaaacggtgagctgcaggccacagtctcttgaactagcccagtcacctcaattaggagagggagaggatcagctacattttaaatatttacatttaaaagagaaaatactttaaatcagatatagcgagaaaagcttaacatgaaaagcctaaggaaatgacatattatatgatttcactcgtattgccaggtggccacctcttttcaaatgaaccctggtgcatttgccacggttaagtgtaataatttcaaggtaatttctttggggtccaagtgagctcttttgtagaaatgtattttgctgtacatttagctggtggtcatttcactggcagttaagaggcgataagagattgtgtaatagaggctcattaaaattaaagactgtgactccatgtaccccaggacaaccttgagtgaacactaacttgttcaacatttgccatgaagccattagaagcatactgatttaggcaggaccttgtgtcttacacgtggagcttaaagctttaacgtctattcaggtattattttgcaatatccattcatttccatttttaagccacagtttgcgttggcagagtttgaagggatttcatcagccgtttacgctttggggatgcagtggagaagctaaagaagaaatacctaaatggcgtgggttctcctggaccggtggaggggccgggccccatctcctgagatgaaggacacaatttcaaggcagatcccgctttttccatggcctagacaaaggcctaggatttcttgctgtttttcctaatcgttaattttagggaatacttggaattagctcagcgatattgaatttagaatatatcatcttttttcttcaaaatatcattttattcccaataaagtgattatggagagattggctttaggtgtatgactaaggagtt

SEQ ID NO: 128257 - DNA, 1024 bp, Homo sapiens
aatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgtt

SEQ ID NO: 128258 - DNA, 1065 bp, Homo sapiens
tgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaa

SEQ ID NO: 128259 - DNA, 1069 bp, Homo sapiens
agcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttgagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcactcaggcttcccgtcaccacatcggacactttaccactggccacagattggtttctgaagacctcttacctccatcgttatgacttctaagttgatttctgtctatattccaagtttcctttctatcatctggccataaaatatttttatatcttc

SEQ ID NO: 128260 - DNA, 1003 bp, Homo sapiens
gtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttatcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagct

SEQ ID NO: 128261 - DNA, 2019 bp, Homo sapiens
ggaaaccactgtgctttcttgtgctgcccctccctacactgctgtccaaaaatcgctgccagccagaaaactaggaaaaatgtaggattcctcctttttgtttctctgttctcagacatcatggttcctttctgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattat

SEQ ID NO: 128262 - DNA, 1058 bp, Homo sapiens
agttcttcagttttgggactcagactgtctctcgttgctcctcagcttgcagacagcctattgtgggaccttgtgatcatgtaagttaatacttaataaactcctatatatatataatatatatgtatatctcctattatatcctattagttctgtccttttaagagaatcctaatacagatgatgaagaaataattcacattttaaggtgtgtttatttgttatgattttatcttattttaatttatttttagagatgggatctcactgtatcactcatgctggagtgcagtggcacaatcatagctcactgcagccttcaaactcctgggctccagcaatcttcacgcctcagcctcccgggtagctagggctacaggcacgtgtcaccatacttggctaaatttttggcagttttaatggttttatttaagcataaataaaatatgcacatgagctgtgtattcattttctttgctgcgcagcctggcattggggttggtgactctgagggcagctgggctgccctttccatatggctttgtggttcttggaggaaacactgtgagcgatctccgcacagggagatttgctgcacgtcagtggcacttccagctccttgacattgtggaccaggaacttccagaagccactgggcggcatgtgctttgtttttttgttcccataaccagtgttgggcatcaatatctggcccttgaatgttctccaaaccctgttgccaatactgctgggtttccaccagttacacttaattttgacacatcgatctgactggtgccagatgaacttcttggtcctctttttgacaatcttgggcttcatgaggggtctgaggtcagccatcatgtcaagtagatggttgtcacctccgtaggcggcaccgaggaagagagactggctaattttttaatttttatttttgtagaagttggggggtctcactaggttgcccaggttggtcttgaactcctggcctcaagtgatccttctacctcactctcccaaagtgctgggagtacaggtgtgagtcactgcat

SEQ ID NO: 128263 - DNA, 2721 bp, Homo sapiens
tatgtttactactgaggacataatttcctgtttataggaggtttcctgtttataatatgaagatttagtaaacacactataaacagaattattataacatttaatgacttaagttttttattcactcatggaggtgtttcatttctaaaaattccgtgagggagagagattgaagtcatttatttttgcttaggtatagaacatcttgcttgggagagaagacatggagtctagttcaagcttacctttgcagggcatatatttcctcgtttttaaaatgagatggtttttaattgacactgttgatttccttaggccccgaaagtatgtggattccatgggaatgccacagcttttaacattaacaggattttggaaaaacggtcttaaagaacattaagtattgtattcatgtttaaaaagcagggttgtgaagcctaagtttgatagttaaattttttcccttgggaaacttggaccaagtaagcactggtctgcctttcctagtgttgactccatgcttcagcgctattgcagttccattctggatctgactctttgccttttctatcacctgacggctcacacatcaccatctctggaaagctggccctgatgtcctggtctgggttaggagccttctctgggttcccatgttgtcctgcctatgtcactatcacagtatttaaccttttgattgtagttggtggtttctcccaccaaactgacctcctttgggacagggacactgtgatatgcatctgtccccagtgcctagcatactgcatgcatcaacattcacatacatccttccactggaaatctttacagtgccctctgaagtgtgggtactatggtttaacccactttacagaatataggtgaaggagctgagactttgagtggtgcaggtaagggctaggaaggtagtcaagcccgagttaaacgggacaggataactccggagctcaggcttttaaccagatgttccctgagtgtttgactagtttatgtgaagatggaagaagactagaagagattaaaatgaaaatgctttaaggactgatatctgatcattatggcagaattcattatgcagaactgtgatccactaccaagaatgagcttattcttcctggtcttttagtaacattgtgggagagtaattgggcactgatagcatagacacgaacagttctggaactttggggctattgttaaattgggtgtgatgttatgactcattggccttgcaaaaatttataaaaccattcaagactgttcaaatataacaagctgcaatttttttaaaggtctgtgttagaaaatacttcggaaaatagattgtatgaaatgggtgcagccatttaaaatatgtataaagtgtgtatgtactagtgaaggtttttttgttttttgttttttgttttttttgagacagagtctcactctgtcgcccccactggagtgcagtggcgtgatctcggctcactgcaacctccgcctcctgggttcaagcgcttctcctgcctcagcctcccgagtagctgggattacggtgcctgccactacacccagctaattttttgtatttttagtagggacggggtttcaccatgttggccaggctggtctcaaactcctgacctcgtgattcacctgccttagcctgccaaagtgctgggattacaggcgtgagccactgcgcccggccgtgaggatatttaaagtagtaaaaatggctgtcattttaggggggtaagcttgggtgcttttaaaatattttttcaagaaaaaatttaagaaccaaaaagtaacagcatggcgatctcaagatggagaagacctagatataacaccaagcacgggaactgtaaaggaaaagatttgagtactttagaataataaaacttctctgtgttaaaattccataaacagaattaaaaggtgactggcaaacagaaaaatattgtaacttacaagcaaatttactttccttactgtaaaaagagggcatgtgaacaccaccaacaaaagcggcccccccccacccccgtggaaaaaaatgggcaaactggtaatttataaaaagaggagcaggaaacatgaaaaaactttcagctttactagcagtactcccagaaatgcaaatcagtgagatactgttgttgtttttttaattggcgtagattaaaaaatgaactacttatggtgaaggtatggagaaatgagctcactcataccttgctagaaagagtgtaatttaatatgattttttgagagcaaagtacgtaacaaaagcttgtaaaatatgtatgtgctttgaaatagctattccatttctaagaatttagtctaagaaaatacaaaaaaaatgactactagattaatattctgtccagggtgtgctgttatttaactaataccctcttaagcatttgttttcgtttttttgctgttgttaaggatgattatttcagcatttagatcaatctttaacttccataatactgtatttaatgaacatttagttagtattaatgataaaatgcaacataaaacaacatatgtaagtaatagctaaactttattttggtgtgtgagtatatgcattttttaaaaagatgaaaaccagaatgttagcattgattgtctctgagcagtggagttatttttagtttctcttagcagtaggttattattttttttttcctccaactt

SEQ ID NO: 128264 - DNA, 1707 bp, Homo sapiens
atagctagtaaggaaattttcagcaagatgctttttagcaaatgcagcattgaacatatgtgcagagaatgggggtgcaaatctgacaggtggaaccacaggtgcggtgggtgacatcactcactgtgagccttgagtggttcagggaccacgggggacatgtgtcaggagcatcttaccagaaagaggtgtcgcttaactgtgcccagttccttcaggagagcggttaaagtggtaaattgtctttaaaacaaaaaacataaaagccctaaatcaaataaagagcacggtagcgccgtttctccttttgaaccagtttgtagtgaaacgggaagtgtatttgaaagtttgctcagctagggaaaattactgatcagagttttcgactcagggttaaattatcttagtcgaaagaaaaataatagaaaggggtgtcttattgatgaatagattcatgttcacttagtgatacactagcttccaaaatctgcttattgagcagatacttattcaaggccccacaatcaactgcagggcaaacggttcaccacacatgagggaaatttggaaattagttgaagaggattgtgggaactgtgaattgagattgttcatctaaatgggagttaatagcgtttgtggttgactaagggcatcctttacggaagtggacctcacgtgcacacctcactgggagagggagagacctgccaggaggtgcacatctggccttccacgcttagtggcctgaggatgtttccctggggcaccacttccacaggccctctaaaaggagggcagaatggcttgctgtttgtatctttgtatttgtgttaagctgggttctgaaaatacagtggtgccaagacagaagagaaactttttggatgctgatgtgcagtgaaagctctccagtagcggcttttccaaagtcagtgggtttcatacaacagcatcccattcattcactagcaagagagctaggaagtcctgtggagctggtgttttaaagtattctgttaaacatgtatttcatggtagaatgaaagattcatgtgaattttaagatagagtgatatttcaaggaaaatttaactctgtcacagcttaggctggatccccaggtctgtcccgatacaaaggattcctccaccctgtgctgaaagttacattttggtgggaattttagagaagtgccacctctggtgtcatcagttatcaaaggtattgtggagttttcaggtaacgttaatttacttcattttgacttcaaaaataagcatgggtggtttaacatttaaatactatcttaggaattgcatagatattagaaaccctttatagtagtgttaacatgaatagtagcaaatgcttaccgtgtgtcaaggactctgctaagcattttattttcgtaactcacttattcctcatagccaccttatacaacaggtactacagtattatctctagtacagatgatgaaatacaggcgcagaagttaaggaatctgaccaagctcacactgccagtgacttgtggagccagaactgtgaagttcacagacatcccacgcatttccatattagctgtttgcaatttgtcactgtgtactgtcaatcagtgcctcttgaattatttctttagtaaaatattttttgtgggataacccagcacccacacagacataactgggaaaaaaaaatgcac

SEQ ID NO: 128265 - DNA, 1255 bp, Homo sapiens
ggccttgttttgaattttgaaagtagtgtctgacaattctggaatccagaaataaattgttggaagttcaaaagtataaatttgagcctttgtcatcctgaattctttcttacctgtgtcaccccatccggtctgaccagttaccacgataactgctttgtgtcgcctgtgtcttgggcctctctctttccattgctgttggtctaagttgagccgttatctcggtgtcacttgtcttctccgaaaccttccataactctgtcaccctcacagaataaagaccttgcatcctcttcccactgacccagccgccacctctcatgacttgcccaaatccttcaccgggctcctgtgatcagttttctgcctcatgcttgtcttcccttggacatcagcctccctgtacctctactgctgttcaaatcctgctcatcctctgagaaacgctcaaagcacacattctgtaaaggcttcctgatcttgtagcctgaaacgacttctttcccctattaacttgtattgccatttttgtctgtatgtttaatatggcagcaaatcatccatgccatatgacatctcttccaatacctgcaggcaaaactttgacattcgtgttttcacctgtttatatattgttgcaggggagtataaacccctctctattggtaatgtcttacatagcatttcttaaagctaactttctggtagaatactcagtaatactgcttttagcgctgataccaagacccatatgtacacagaacctggttgtcttggagagatgcattcctttctgtgaatgaactgaatttgaaccataagatttacagctagcatgctttaagtctgttctttgttttttcttaacaactttattgagatttaatgcacatgctataaaagtcactcatttaaaatgtataattcagtgatgtttagtaaagttagagttgtgtggccatcactacaatgcaattttagaacatttccatcaccctgtaaagatcctttgtgtctctttgccgtcactccccattcccaccatccccacaaccccaggcagctactaacctgctttgtctctatagatttgcctattctggacatttcatgtaataaatggagtcatatgatacgtggtgttttgcatctggcattcatttagtgttaatatttttgaggttcatccacgctgcatcagtacttgattttttttttattgccaaatagtctgactacttggcattattgtgtg

SEQ ID NO: 128266 - DNA, 1082 bp, Homo sapiens
aagatccaacaaagtagagctttaactagctttggacatgtaaatataaataaaaggcaagctcatgaattcgctagttcttccctgaactattcgttggcagcagtttggacgtgtcattacgtattcatatcatgaagctttcacctgtctttttgcatgcttccttttgaagccaggttgtaatgtcaaatgcaggagtaactcttggtagcacacttcttaaggaggtggaatgagaaactcctaccttctaaggaagcagcatgggtaacacctctgagcctgggcttcctcatttgtgaaacgtagcttgtacatgcagagaatatacttactgtgaggagtaaatcagtgaaagcattaaagctgttgtacagagtctagcgtagcagctacagtaaatattaactcctttctttatatagttaataagctgacatggaacagttgtactcagtggacattctggaggtgccatgggtgtgggtaaataaaacgcagcgtatagaagaaggtccctgcagttcattcagttaacagagtgagtgcctgtttgtgttttagaaattgtggggcaacaatatggaggatggattggaggggacgaggccagtgaagaccctttagttagtgagccagatgggagttaataatgcctagactccggcagttgggagtgtaaagagaagtaggataagaaggagatagaattcatagaactgatttttcatcaggggtaagaatagagaggaatcaaagctgatgggaaatgcagaagggggagtgagtttgaagggagagagaccagtccagaggctaagcatgaccctcagttgaaagtcttggtagagggaatggggaggaaaagtgagattgcacgcaacatgaggaaaatagataggattagatatttgggcagttagtagagagggtggtgctttcgtaactcctaggattccaagctgggcagctgaggcttctgacaactaagtcaggaagaaaggcagggagagaggagttctgtgttgaacttgtgagtctgtggcttttggaagatccagcggaaggaggaggaagag

SEQ ID NO: 128267 - DNA, 1089 bp, Homo sapiens
ttgtatgatttttcctatttattagctgtttgtgttcctgggaatttcctgagcatatcctttgcccttttttctttgagtttgtctttctaattgtcatctaggtcaagtgatatatatttttgataacttccgaaggcaaaggaaggcaacatagttgtgcttgtgcaaacttttacccaggttttctcttgagtgctgatatcataatgattttgaactaaaattctaagcgtatttttgtacacagaccatatggttaacatgaatgtgtttgcacatagaaagagaaatggtctctagagtgggccctgcagactgagtttttctgtcagtgtgtctcaccttattacagtaccccagagacaatccactgattctctttatttcttcctcaggtttgcctgcaatgagatttcattctctacatttaaaggacatcctttctgagctgctgtgaataaatttggaatggtactgtatattttcatctaatggagaactagctgtactttgaataaggattgctgcactggacgactttagaacatccctcacaatgtcgtcaacccggagccagaacccccacggcctgaagcagattggcctggaccagatctgggacgacctcagagccggcatccagcaggtgtacacacggcagagcatggccaagtccagatatatggagctctacacgtatcctcctgcctagcgcaggttgattgcttagagttttgattatttactagtatgacttatgaattattagaattttatattgttttctcctcccagttcatcatgtaaaataatcgcagggttcatttttagccttaagtttttgaacagagtagaactggttcatttttagtcaaatgcagcactgggcagtacagtcaccactgggcacatgtggctgtttacatttgaaatattttaaagttccttaggcacactagctgtgtgattaataaataaaacatttctgtcatgtagaaggttccgttgggcaaagctggtctaaagcaaggtcctgaggttctcagcagatcatttgttttacgtccatttgtttatatattgtct

SEQ ID NO: 128268 - DNA, 1079 bp, Homo sapiens
ttgttttgttctgttttgttgatctttctgagtataagtatctttccgttcattttattcaattaataatacatgcagataagctcatcatatttaaaggatacaacagaacacggtggttttctgccctgcctggccccatcttctcattctctgcgctccccctgcagatgcagctgttttgcaatcagctgtctgtgctgtggtttatacatctctctctttctcaggagtgtgtggacactgctgccgttcactgataagttttagatggctatgactattgtaatataaggacttggctctctgagtcattttaaaataaagtttgtgttatttcaatatttagaatctgtgcctctgaaaaagttacagctgagcatcataatagacagtgcttattgttagctttttgtttttcctggagtcagtaattgcatttttcttttgggacagttttccacaaggtcagtcacatcagataatctaaaaggtccagatttttttataggcaacctccctcctggaatgttcccttctccaccttggcggtgttgctctcaaggcctaccaacaaccttgtgaatggggcttgttgacttttagctttatggatagtgtgaatgggatctttgttccattctagtttttaacaggttttggttgatatattgggaatgcattggtaatgaaatataagaaaatatgtttatgttaatgaccgttaacgtctgtgatatatgttggtttccttaacttttctccaagtcatgtttataactactgtactagtgttcaccagtcaaaccaagcacgaggagctggagttcctccttctaagtcgaaaaaggggcagacacctggaggagctcagtttgttggcctggaattatataaacgacttaaggaatttttgaagaattacttgacaaatcttcttaaggtaagatgttttatatatatactgagtattcataacaggatataaaaaaagtgaaataatggttctaacttgttaaatctttcactgtcatctgttactgttttagacactaacgtaggtgacagtgttttgctat

SEQ ID NO: 128269 - DNA, 1130 bp, Homo sapiens
tgtatctagccacaagatgagcaagtgggtccttcatctggttctacactgtcaaagagtgaagacgtctatactgtgaccccagggaaatttgcaggaactcttctgtgtatatattttaaatattttttatttacacaatgtgcaaaaattctgcatgctgcaaaattgttttacctaatttatttttgcaagctaattgaaaactttaaaacatcttgctaacagactgtatgtagttggctggccataagttgtgactagtgtattattttcatcttccccaaatggtgtttctaaggtcttgctgaagccactgttctttttattcacaacacatcataaagtgaatgttgtaattaattaattattctttagtactaaagtaagaaacagtatattgtgctaagtaaaaaggttgatgaccatgccatcagtgatatttttgcattttaaaaaggtcaagtaccatcatccaaaatagcttagctttacattttaaagttcatttcatattatttaaatttaaatgaacaaaaaattatttgtctcaagagatgatccggtttttacatggcttgtttggtcactcgtgtaccttatacatgtggagcttccagtctgttgtagccatttagttttcattgaagacactgaggctcagagaagccagtgggctcgccccagcccttcctgcagccctcctgcccccaccttcctctttcgtgcttctctgctgcacacacctaaatggcagtgctgccatacagtaccattaacgtttttaaagggtaaggtttactttgtagatgccattaatccctaagaaaaaaaattccggttagtctccttcaaataaaaatttgtgactcaagttgtggaaatctggataaaaataattttcgtaaatgcacattttcttgaaatattgttatactattgtacttaccttatttttacagatcaccacaaaaaagtgtttttatggtttttaagtaaatttaaagaaggaagaagatgcatgtaaaaattgaatagtattagtctcattgtctgaattgctaagtaggacatgttgatttcttttttttttgggaaggggtgcggcggagtcttgctctgtcgcccag

SEQ ID NO: 128270 - DNA, 1050 bp, Homo sapiens
ttgaactcctgacctcaagtgatctgcccacctcggcctcccaaagtgctgagattagaggtgtgagccactgtacccagccaatttttttttaaacaaatatcaaaaatacagatgattttgtggtatatttcttaataaaaaggaattacccgcatatcaaatgttcagggtactttttttgagtgtgtttgcatatttaataccatgaaaaatgttccagtttaatttgagatgaaagaattattttactatattcttgtgagtttatatatattagcatgtttttgtatacagaataatttaaagaagccatctaaaatcacatgtgtcaatgtattttaatacagtagatgttattcaccgttatttttaatttataatgtgacaaattagtcatcttaaagctttagttaacttgtttttaggatggagaagatttgatggatgagagtgtactgaaattctacactcaacaatgggaagattatcgattttcaagcaaagtgctgaatggaatttgtgcctacctcaatagacattgggttcgccgtgaatgtgacgaaggacgaaaaggaatatatgaaatctattcggtaagagttttgttttaaaacgttttaaatttgtttttgtttttgttttttttaatggcaaattgtctttcagcaagagaatctaggcaaatattaagcttttttcagaatagtaaactaattttcattgttttatcaataaatgtcacttaaatattttttagcaagaaagtagaagaatgggtaaattggagttctaaaatacaatttgcccatttctgcatttgctttttaaaaatttcttctttaattacctgaccctaccatcacagtttgcctggaactgcctgagttttcgcactgaaagtcctgagtcctggtagtcccaggcaaatcaggtgccatacctgagggcgagccctgaggattagccctcccatgctttagagtctgggaaacgctgcttcatggagaggaccctgaattaattaattactaaatcaccctcagtaat

SEQ ID NO: 128271 - DNA, 1798 bp, Homo sapiens
gtttccaacaacagttaaagaaaatgtaaataaagaagttgagctgacaaatgtctgtgcttggatacctcttgaagttgttgactctagagagtggctttctgcttttgtcctgatagcagattttgaccaacttgtaatctagaaattttgataaagtaatttgagatttaggttatttcctatgacttcaatcttggaaaaacatggtaaaagtatagacattttgtacttttttttctccagcttgcattggtgacttggagagactgtctgttcaggccactgaataaacaggtacctactggtgtgagcgtgtgcatgttccttttaaaatcccttcgcagtttcgttgcttagcttttgtctcgtcactccttcggattatcccatcttacattgtttagtggctgtgaatgtttaagggatatgtagtaatatatatcatattctataacctgtgtaatatttttctacatcctttctaaaggtaacaaatgctgttttaaagctgattgaaaaggaaaggaatggtgaaaccatcaatacaagattgattagtggagttgtacagtcttacggtaaataatttccctttagtttattcaaagttttcacatcaaatggcaattacaacaatgctctaacagatgtcatttttaaaatattttaatattataaaggatattgttagcatttacgaaggtacttacatttctttttaagtcagtgtgactttatttgtttttatccatcataaaagctgtttgatccgtgtgccttaaggaaattttgatgaaatagacattttgattattttcttttctggtctcatagtgaattactggatatgttagagtgtgagctcaatgataaccagaaatctatatcagcttgaaaaattgagattgagaaactgataaagtaatacaatgtcttaaaaacttgggtagcattgtatttctttgcaaatttaaaattagttatttttattgcttttggaaatacaaaagttctctaaaggaacttcataattttgaagcatacctggccatgggtcagaattacttgctttttatacgtcttggatttttttccttttttattttattgaaagagtgtactttaatactagtgagtaagagttacttatgtcctgccatttcacatttaccttttaaacataacttaaactgaatgctacacctaagtatattctgtgaaatataaccaaaaaaatagggtaattgaaatatagctcatattcatttctagtggaattggggctgaatgaagatgatgcatttgcaaagggccctacgttaacagtgtataaagaatcctttgaatctcaatttttggctgacacagagagattttataccagagagagtactgaattcttgcagcagaacccagttactgaatatatgaaaaaggtaagcttaaatatagtactttaagtagacttaagttaaagtcattgctactcaagtgagttctttttagcatatacagctttctttacaagtcatttgttgggcattgtttttctagagtgtttttatcaggtgcaagtgcttctcctaattctccaaggagcttctataaattaatttggtaatcgtgactgagagttctccttgctgttctaaggatataaccacaatagctacatgaattttttttaactgtttattgtagaatgtggatttatataaaatgggcatcacagtcatgtcaatgagaaaattttaagaaacaaatattttcagatttgcaaactttaattttttgc

SEQ ID NO: 128272 - DNA, 1634 bp, Homo sapiens
catgcacctgtagtcccagctgcacagggaggctgaggcaggaggatcacttgagcccaggagtttgaggctgcagtgagctatgattgtgccactgcacttcagcctgggagacagagccaagatcctgtctctgaaaaaaatatatttaaaacaaaaatcattttggagagtattggcatttttataatgcaaaatataattctctttactcagatcacctgaataatttattgaaatttcttccttgctttgataatttaatagtttctctctaaatttttgaacagtctgatttctgatgatgatttccatgtaatcacttcagggcttatatttgtgtgactcttggcttcaagtagtttttaatctaaagtaccacatcttagtatctgcacagaagatgcattcatttcttagagtggcagagacattacctcaaaaagataaaataccattctctgagggatcaaaatgatgtaaagacatgttaactgttaataacgatgatgttgttagggcacttaaaaaggaagtttgaaatggaaatacgtattacagagaaaatggcagacatcagtggctgtttaaatatggttgttgtttaccgtaaaatcaaagaactttttcctttttctttctgttttttgagaaacggagtcttgctctgttgcccaggctgaaatgcagtggcacaatcatagcttactatgtcctttaactcctaggctcaagccatcctcccgcctcagcctcctgagtagctaggaaggactacaggcgcgtgccacacctggctaattttttttttagagacagggtcgcactgtgttgcccaggctggtctcaaaatcctggcctcgagcaatcctcctgcttcagccacccaaagtggctgagccatcatgcccagccctcccttattttcttaatcgcattttattagagctggcatgtgaatttaatttgccatttttcagtttcctttaatttacatattaaagaattgtaacagttctttaccaatgaatcaaaaccattcacttgaattaattttctccaggcagaggctcgtctgcttgaggaacaacgaagagttcaggtttaccttcatgaaagcacacaagatgaattagcaaggaaatgtgaacaagtcctcattgaaaaacacttggaaattttccacacagaatttcagaatttattggatgctgacaaaaatgaaggtgagccacaagactcataaaatgtaggtatttataattatctgtagttttgatattgcttttgattctagactctcgagtcaacggcattacttgcccatgtcagttttaaaaagatgcatgtgtttgtacatcgttatgtgccaatttcagacttctgcagagcattttggtttgacttagggggaagagtgtatttagaatatgacttgctccatacactttagcattaaatgatgctaccccaagttttttcttgactgttcttcctttgaaaattctctgagatgaggagactgtcatcttatatttcccttaaccactcccatgttttactggggcatgttaggagctcaataaaagattgaagtttggatttttcttctatggtcctcctaaagtaaccac

SEQ ID NO: 128273 - DNA, 1049 bp, Homo sapiens
tattcattatttttaaacaaatatttgagtgcctattatgtgtcaggcataaatactatttcaatcttgagaattttaggaagcattagagttgtttctgataattttttttttttgcttagtcttaagttagtggtttctcacagtaagggggaaaataaatttacaatagtaaatttatagtaaatagtaacaatttcattgttacttttagcaaaatatacatataccaaatagagaatatttggttataattaaatgctattgattattaaagtctaaaaacatggttatcttttgcagagtatttttcatctcagtataaatacataattagtagaatggatatgcaaaatttttttcagtgcataaaaggggtttcttcctctttcagatttgggacgcatgtataatcttgtatctagaatccaggatggcctaggagaattgaaaaaactgttggagacacacattcataatcagggtcttgcagccattgaaaagtgtggagaagctgctttaaatgtaagtgagatttcattgaaaatcagtcaggctgattatttccacatgcgaactgcaagcatatgttatgcgtctctacttccaaatctaaatggtaccattttcattagaactctgagaaccatgttttgtctttttgaagtagatagttcacagacatctttgtttagtaaatacctccgtaagtttttccctcgcactttttaggcgttaataatgttattttttttttccttttatgccttctcactgttaaattccttgcactcactagaagaagctgcttccctagaaacaaaaggctcctggaagctgttactttgccactcacagtccacaggttgtgccttacaggaactttgatctggatagtagcctctggctgaagaccacagggctgtactctggagaggccctgcagtttatagcatttctctacacccctccgcttccccagggctacatagaatattcctgctaggtcatctgtaattcaggtcatctgtaattcaggtgataatttc

SEQ ID NO: 128274 - DNA, 1328 bp, Homo sapiens
cccattgtgaggccccatgctcaagaccgcatacctccacacagcatcacgttggaggtttgggcttcaacatagggattttgggggcacacagttcagcttctggtaagagatagagacagattatttcatcattgtattctaccagtgtcaggacaccttgctcttaaatgctcacaaattgtgtatgaattgtgtgtgtgaacacttcactgtgcaacatagagttgtggggttttttgacagtgtattaatattaatccatgcatatttgtactgtaaaatatagcaaaatgttactagctttgctagtagttccatataattaagtatatattgtatactctgatttctctaagattcccttgtatacatttgtatttttgtacaaattaataagacagtcatctgggttcttctcagcaagcttgcgggttcgagtacacctctaaacttcagcgcatgtttcaagacattggcgtgagcaaagatctgaacgagcaattcaaaaagcacttgacaaactcagaacccctagactgtgagtatccgtgtgtctctatgttgtgtttacaggcagagttctctgtagcaaatgaagaaatgacaaaatattaggtgaagatgggaggggctttgtcagaaattcaagaactaagaagcgggagattcctcccaaatgcccagccctcctcccccgactcccgtgtgacattaggagatgacaacccttgaagtggtgtcagctctactggggcaaggtcaccacctgttgggatctggggagggactcacaggcgtggttttgtcttgtaaaccttagcttggatccattctagcatttattttaatgttcacttggcctgcataggtaacagtcaagctaaagacctgtggcttcagactgggattagggatcagtacaggcaggtgcaggtgattcagttctccaggagaggcagctgggctggtattttagggccttgcatagtagtaggatggcggatttatgcttacatcatcttttgatcatctttgtctttttaaatgaaaaatggagaattttatttttcccaaatcagaatgacaattctattgtaaaactggacagttttgccagtgggctttttaactatctgcgaagatgaaattactgttataatttatagaccatgtgtggcgtttcccagtaataagtgaaacatacactataatgaagttagcggttttctcctgcttgtgagtttgcatgagtctggggctgtgatgatgccgggcctggcaagcacaggcgtggcttgagtggactgagtgattcaggacagaaa

SEQ ID NO: 128275 - DNA, 1052 bp, Homo sapiens
acagtggatttcagcattcaagtgctgagctccgggtcctggcccttccagcagtcttgtacatttgccttgccgtcagaggtaaggatgggtttgtctgccatcccattagtgctaagtggagggtggggcagggcagccttcactgtggaaggggacaggcctgcagatggccttcctgctggctggctgcatcacggtgaaccatgggggcaacactcagggaagagccctgtgcagtggggcaggtctggatgtctaaaggtgggctgtctgtcccagctctacagacatgtttccttatcttgtaaagcagaacctaattagttgtgtaatgaacacctcgatggacctgctggtcttgaagtacaaaccttttttaagattgtaccttccagtgcttaaagtgctttacaagagaggcagacacctggcgtttgtattttacttttatgtaagcactgactttgtactgtaagcttggaacagtgggctttacttagaaacgctgcctgtaggatgtggtgagatctgtattccatataatgctgtccttttatctagttggaacgtagttatcagcgattcacagctttctacgccagccgccacagtggccgaaaattgacgtggttatatcagttgtctaaaggagaattggtaactaactgcttcaaaaacagatatactttgcaggtaagatcacatttttatcttaaaatttttctattctaaatgaacataaggcaaattatggaaatcattatcagctgactcagcagcagaatctagaattcagcttctggtgaaatagtggcaggtttaaagcatggagttgtaagaatcagatgaaccaaattccaattctttctggctggggagcaagttatttaatgattgtgagcctcagttttctcctccattaatgggagtgttagtactttatagttgggaattgatgtgaaaattaaataatgtatttagtaagtgtttggcaccgctcctgcctgacacacatcagctgttcaggtagtgacttcaaaagctggagt

SEQ ID NO: 128276 - DNA, 1848 bp, Homo sapiens
gatttcattgtgcatggtttccaatacaggttcaacatccctaatccaaaaatccagattccagaatgctccacaatccaaacatttttgagcaccaacatgatgctcaaaaaaaaaaaaaaaaaatgctcatggcgcagttgaaatttcggattttccaatcagggctgctgaatctgtaaatccagtgcagtattccgaaatccaaacacttctagtcccaggcatttcagataagggttactcaacctgatttaagtataacagaattgttcatttctattattgtgtgatcaaggccagaaaggggttgatttcacttctagaagtcagggtggaaggaagcagtaaatttagtgaacttctaagaagtaccaacttttttttccttccagcatactcttcttttgggtgatttttttttttttttttaatggaaaatggactgtgaggttgcctgtggtggttattgcaaagaaaaatgcattttccctttaacttcctctttttctctttaattgcaggacattttggcgcaagttttacagattttattaaagtcgaagctattggtaggtttgcgcccttttatcttacactagaagaagccttttcctgagattgtagagtaacaattgttttcttacaggtcttggaagatgaaaatgcaaatgttgatgaggtggaattgaagccagataccttaataaaattatatcttggttataaaaagtaagaaaaatctaataagtagatggcccttgaccatagacacgtcccccgggagccctagcacggatctcagtattgttacaaaccaagggagaccggggactcagtgtgaagcgacaggcactaggctgggagtgtgaggtaggcctttgattccattcagcgagcctgatgtttctccaattctgagcttctgggatttttattattttggcaaataagtctccttaaatggctcaccaagaaagtttggacctttgtgtccaagtggcttgattttatctcacttgacaaaatttgggagagcagattagggacctggattttctgtaatgtggatgtccctgttaatggccgagtaggaaactaggccatgatcggactctacccagtgctgggtagaggacattttcacggagagctcacagaaatcaacattctcccctctgtctagggaagcagggcacttcttaaaggttgaaaaatagaaagcagccttcactgcctaccttttaatataatagtgatcggtttcctcatttttcttgatagtaagaaattaagggttaacatcaatgtgccaatgaaaaccgaacagaagcaggaacaagaaaccacacacaaaaacatcgaggaagaccgcaaactactgattcaggtgacttatctgtatgcctgtgccaggtgtgctgtccctcacgcagggatggctcgcaaggacgggccgtggggggtaggcgggggtgacaaaggagtgattgccagatgaatgggtctgtgatggcagaaggtggcaaggccgagagccagggccttgttatctgaattagtcctttatgtcaccaggcaaaacagggcagtcctcttgctctaaatgttggaaagcaaacattgtggcaggtttggctgaaatgagggggaaggagagttcttcagtggggaggatgggcagcttccgtggccttgaagatttaattttgtctccttttttttaatgctttatggttgagttaaattattgaggtaaaattgctcaaaagacccaaacattgtaatgtttgccacgttagagttgaaacataggcaggtagaattggttccctctcccgtctcacc

SEQ ID NO: 128277 - DNA, 1314 bp, Homo sapiens
actccagttcttgcttcacctgggggagcaactggcgggctgctctttggccctctttgctatggtcatcattttttccagaccatggttctattttgccttcccagcgtcaggcctaagcatcctgatgtggaccagccttcctgggaccacttgcttcagaggcataggggaggctggtcaggctctgggaatgcttgtagacaggtttgttcacttcagaacttggcagcgtctcaattagatggccagcaacacagacctatgcattgccttctatgaatgtgccgttatgcaggcagctgtgtaattggatgggttttttttttttttttttttttaaagacattttaatgcacccactatcttcagcaggctttgttgtgttaagtctcagcacatgttggatgggtggccatccagcggacatctccttcctgttgtttcagatacagccaggctgatgccctgaagtatgtcggcatcgaaagagaaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatgcagtatggtacatttttcaactttgaataaagaatacttgaacttgtccttgttgaatcatctctcataacgtgtcaataactgctttcaggactgctcaacaaaaaacttttaaatttaactccttgggttttttagttgtctttgtatgaatcttgatttaactaatactgcctgtgaatatgtggaagacatatatgaagaacactgctgtgcatcctgagggcttacccagtaaagggcttgatcttatagacaagaccagggtgggtacgttccagtcagctgtgcaacctggagaaagagatttaacctccaagtctgttccccatatataaactgacagagtagacttttaggttatttttaagaacgtacctagttctaaactccattagtctagatagagttctttagaaacaaacacaatataagttgggattccttacctaccttatcacaaaaggtgattgataggtataaccaaactgtagttttatatcttctcagaggtaaaaatcacaaactctgaaagcgtcaaggaaacgacatgtaccttgcatgccttatgataatgtggtttgtccca

SEQ ID NO: 128278 - DNA, 1006 bp, Homo sapiens
gtgtcctggggctgaaaatggaataactattaatagaatcacttggggaaagtagagggaaaggtatggagaggaagagtgatttggtggtgtccttatattaaattcaggttgaaagtgaattactcgaggaaatcaagggctgaagatacagggaagccaaaagtgcagcaggcctagagcaccttgctgaacgatggtcattgcagaggaccaacaccaccaaaaggttttctgtaagacagagattcttatctgctgtataaggaaaacataatgttcatagccattctcagcagctttcacgttgactgaagctgtgtgcccaattactgccttagaacaaacaggtctgaggatttacagtgatagcttttgttttcattctgtagtctactttgtccccagtccattttcaccctccttttttgatgatgtgattgtgttttattctctagcatctattgctggcaccatctgacgtggcaggctgggggatttttatcaaagatcctgtgcagaaaaatgaattcatctcagaatactgtggagaggtaaggcactgataacctgtattcaggtggcattgtatatactaactttactttattttagattgattttattaggtaagtctgtgggtttgattggaaatgaattgccataaactgccttttcagcctggacttctgcatgtttgtggatttgcatgcttagtaactggattgtgctgggcgcggtggccgactcctgcaatcccagcactttgggaggccgaggcaggtggattgcttgagctcaggagttggagaccagcatgggcaacatggcaagaccccattgctacaaaaaatgcaaaaattagccgggcgtggtggtgcatacttgtagtcccagctacttgggagctgaggcaggaagatcgcttgagcctggaagagcctgggaggttgaggctgcagtgagccatgtttgtgccactgcactccggcctgggcgacaaagt

SEQ ID NO: 128279 - DNA, 2317 bp, Homo sapiens
ctgctttgtgcagcattgggagctcaggagttctgaccaggagtcatggatgaacacaggaaatgacgtcttgccacacctggggcagcctgagccatcaagctgtttgagttgcttcaaactgatggcaaatataaactgggcagggcatgactcttggctttaacgcattcctgtattcatggcacagatagatccagttaagcagctctctgttggatttgtagcttcccgcagaaatttggtttaattttctttgtgtttttgcaggttgtgggctgcacactgcagaaagatacagctgaaaaagggttagcatctttccattcctctcattattagcttaacaatatctgctttgttttcatttgttttagaatagtaactggattagagcttgggttattctaatataattgccttctgtatgttaaaccaatttgaatggaggacgtctactgatgaatccccagtcaattctcttctgtaaagtggaggctgactggaaggtgtgagtccgagtcagttgaaggagaagtgctttgggatgggactgagatgtagccgtgctttagatggaactcataagcacttgggggtgggagagtattttttgccatcgttgtggaaaccggaatatgtgtaatgttatgcattcagtaaaggcaggccagctacactccacaggtagtagggaagaatgtactcgtgttaattgtgtatgatcgtttccatctccctggattcattggcctgcatgatgttatctttactcagacggctcctctaaccatgtttacaactatcaaccctgtgatcatccacggcagccttgtgacagttcgtgcccttgtgtgatagcacaaaatttttgtgaaaagttttgtcaatgtagttcagagtgtaagtatttgttgctttgatgcaattgcatgagaactaaataggtctttggttagcaatttaaaaaatcaaaaataagaacatgggagcactcccttgtttacttgacgaaactcatcaatttgacaagtatttattgagccccatacctggccctgtgccagtggccagtcagtcgcctgggtgttgtgtgtctgtgtgtgtgaggcaggcaaagttgtattaaaggaacctgaattttatttttttcttctttgatcatttaaattaagttgtattaaagttggcacagattgtaagaggaatctagaaggagctacccaaataatttttgggcaccagaaatcgtcagagttaggagggttttagtcttcagattaaaggaatgtagcataaacatagtagatttttataattgtttaatgagactgcacatgaagcttgggtattaagggagtgtttagaactaggggctattggaatggtcaaggaccatggatattgttccatccagaccctttattcacaccgactttaaatatatacactatttaacaaatgaaaaatggaaaaacaactcagtggtggtctttttcagtgcaaacagctataacttcgctgttaatacttccatttccttgtctatatagtagggtaataaggtggttgtgagggttgagagtcagtgagatgcccagtacagcccttgccacgtatctttctgcaagtttttgcatacggtgatgagtgaagaacctccaaacctctctctgaaggtcaaaaccgctttccgggatgccgctgcaaagcacagtgcaacaccaagcagtgcccgtgctacctggctgtccgagagtgtgaccctgacctctgtcttacttgtggagccgctgaccattgggacagtaaaaatgtgtcctgcaagaactgcagtattcagcggggctccaaaaaggtgagcaacaagtcacttctggaagattgtttgtagttagctatttagtgatgcaaatgtcaggattgccttagatgatttagctggggcaaaaagtaaaagtgatccttgaaaggtgcaactgatgagaaagtgttcataattttctctgggtaatgcacccttgggcagtctcttcagttttatatagagcaccatactctgatagtaggagaaaccagcaaattctgagaagtagccattcatggtatcagatttaggaataagaggtattttttctacctgtttaatagattatttgaatttgtcttttagttaatagtttatctagtatccttaatgcaaataaatggtgatttctatcaaaatatagactcattctcatcaaagagtatttatagattccttgctatgtagagtaaaagatgaaatttcccatggcaggtttttatagactta

SEQ ID NO: 128280 - DNA, 3886 bp, Homo sapiens
cagtgtacccgcatttgaatctttctgttacattattttggaattttaggtttcaaacagtgtatctttctaaaatccgtttttttgacattgtaattttctgtggcaagacactataagctctcaccaggttcttggattgggtatgattcacaggaattgaatgttagtaatctggggctgtcctctttatcattaaaaatgagtttttacaactggtgacaagctgattgctgacctttctttagaaatcaagaaattgtatgtcagaattaaaaataggaaatctgatttaattgtagagggtctatcaactgcttagacagagatagtaagattcaatttaagtaaatgtttataaccatagttatgcgcatcagttttacttgcaaggagaaaaatgagaaatcacgactcattccagaatttactgtttttccttcctgcttaatggttggaggaggaggaatggagaatacgttgtgatcattcagtaagagcctgaaggaaagttgtatgaagtaacgtaaaccacatattagcaagattataatccattaattgacttttccagtggaactggaagagtgaaaaagtaagtattttatagttatattagattctttgtttcatttattttgcagcttttcatgcaacacccaacacttataagcggaagaacacagaaacagctctagacaacaaaccttgtggaccacagtgttaccagcatttggtaagacttagtgcctaattattgcagagggtacttgagaggactttgcactttggtggaggtgatcaagtcagcgttaatgttgtctgcacccatgctgttatgggccatatgatagacagagctttctcacccatgctgtttcttccatagctcatgtactgcacattttagtccttcattaatgtggtattattctttttaaaatctgtgttatctcttcagcaacatttcaaggtctttaggatcaaggacttttatgccttccacaaagtctatgagagttgcaaggcacagatagtccgcttagaaagcaggcatgcagtaatcatacgcagtagatcccaagcccctctcatagccatatccctctacttgagttttagatgcactgtcatttcagctatgtgataggttccacagattttttttttttaaatgatggagaacaggtaaggggttaggaaaatatgaggtagaaaagttgtttttacgggtactctcttatttttaccatttcccctctttgaaccaagccactcctacctaggaactaaatgggtatatattgcctgttggattttggacagaagattcattgaatggcacctgcagaaggtatcctatttttaagcaatttggtttttgtagaatgaagtataaaactgttggctgctgtcaaacttctcccttctatttccactaaaaaaatggaattcttgagcacttgttttataatattctttacaaggcagaattttgtttggctcatctaaaatgtttctgtggtctctataaaccatgctcttaccattgttttatactttgagactggattattgtacttcataatgcaagatgtaaccctcacagtcttattcctgaagttcctttcatgtcttcctgtggctgtgtatccttcacaggaaaaaaaaaaatgttggatgttttaatagtaagacaggaagtgacaaagtcaagcatgtttgtgttttgtgttcttgtatagttgaaatattaacacgaagaggtatgcattatcttaaactctgcataggtagtctgactccgtgcacattaggtatatgattcttttgtaaagattcacttttaaatagactgtatgtccatagagataattacctttattacatgaagtatatttcatactttatcttcttatattttaacttaattataactagctaatatattttacaaattcacaatatagaactgtcttgcctgatttttgtaccattctaggaatatatagaacccatatttctctttctgaaattttcagactatcaaaagcatatcaaaacaagtatattagacatgcaaatgattatttgtgataaatggataatgtgatacattttttgactaacctggcttatatagtatttttttttctcttccatcaaaatgagttttagaactttgccctgatgttgacatttttcatttcgtaggagggagcaaaggagtttgctgctgctctcaccgctgagcggataaagaccccaccaaaacgtccaggaggccgcagaagaggacggcttcccaataacagtagcaggcccagcacccccaccattaatgtgctggaatcaaaggatacagacagtgatagggaagcagggactgaaacggggggagagaacaatgataaagaagaagaagagaagaaagatgaaacttcgagctcctctggtaagacacgtctaataactgggttttactgttctgtgaaagttcgtgttgtgaggattaaggatgtataatgcattgaataattttcttagttggttagtttcagtataaagaccagagttatctcaagaatgtgtagctgtgttgtttctgtttcctgcctgcacccgtaccctagcttgtggtgtttgccctgcttggttgtttgaaagctgatgatgcactttattctcattctttgtgccattttcttttttcgatctttctcaggtagggaataatgaaatttggatcatttggtttaatattcttgacgttctgtgagtagttttgttggaaaatgtgaactacgatgggttagtgttttgccgattggatttgagttgtcctcatcttttcgcttttttcttaagcacaccctgaattgtacttcttaatattatttccaatcatttcttgaccagtgcttacatttggttttgtagaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtaagatatccgataaaaatgttgttaaaagagcttcaaacatagagataaaactgtactcgttgtccaaacaaagaaaattcttggttattactaagctcctattcatctcctaaaaataatttttttttcttcccaagagggaattgaatgaaaattattctccaggtatgttacagaatttccccaatgtagacttttaaggttagatagcagtagcttttaaaagctagtaagaattgaaatttagcatcacagttcttgaccagaatataattacagctacccctaatgtgagggtagggacagcgatgtgtgttatatccccagcatctagcagtgtcacagaagagacaaagacatttttctggtatgcatgagtataagaatggtttgcctaaataagactgtcctcatggctctgtgactgtgcctcttgtcaggtgtatgagtttagagtcaaagaatctagcatcatagctccagctcccgctgaggatgtggatactcctccaaggaaaaagaagaggaaacaccggtgagtctgtcatgaagctccttagagaagtcaacatagatagacactgcaggcaaggcccttcctaagggctgttgttggtttctacttagtctatttttaaaaaaccttaaactgccatcaaaaacagaactatggaatcttatttccactgggaattgctagtatttttctataagaatacagcagccttcagtatatttggtatgttaagagtcataaaaattacggttaccag

SEQ ID NO: 128281 - DNA, 1130 bp, Homo sapiens
agacggagtctcgctctgtcgcccaggctagagtacagtggccccatctcagcttactgcaagcttcgcctcctgggttcacgccattctcctgcctcagcctcccgagtagctgggactataggcacctgccaccacacccagctaattttttgtattttttagtagagacggggtttcaccgtgttagccaggatggtctctatctcctgacctcgtgatccacctgcctcggcctcccaaagtgctaggattacaggcgtgagccactgcgccccacctgtcagatccattttctatttgaggggatagatttagagaggttaagtaacttataagattacactattgggaagaaacagagtcaatagttggtgttctctacttggcaaagctcatgctaaggcagcatagaatagaataatttggcgggtgaaatagcaatttctaagaagcgtatttcaaaaaagagaaaataacaaaaaggtaccttattgaccttattgatcatctagttcagctccttcattttacagatgagtaaacagacccaagaggtaaagtgatcactctaagtcacaaaatcagttagtagcagagctgggagtagaacctaggttttctgcttcccagtgctcttaaagcttttcatatttgaatttgaattttgtttttgactgactggcattccacagacatgtaaagtatgtgagaagtaagtaaaacacaaaatagagatgatttcttagaaaatcagctttgttatagagacataattgggtagagaaaatgaaagatcaaaaacttgtttacttccattctttttttcctttcatattctcctgtttagataaagaaagccgcccacctcggaaatttccttctgataaaatttttgaagccatttcctcaatgtttccagataagggcacagcagaagaactaaaggaaaagtaagaatttgttcctttgaggcaatcttgccctgtatggtatgtaactcaccattttggtttattacaaatggaatcaatgtagcggatgagccactacactttgtttacagtgtttgcaagatacttgaagcaacatgtgtacttgtggtactctgcattacaaaatatttcctg

SEQ ID NO: 128282 - DNA, 1049 bp, Homo sapiens
atccttagagtcatggtttcagttttttgtgtccaggaggccctgttaaagtgtctgaaaggataatatttgtaatatcatcatccattgtcattatcagcagaaagcagggtctgaaatgatcagttaaaggacagatccattgtttgggaggaggccaaagccacaatcagttcctagaagattcagttttctactagaaagttttggggaggggccattctacagaaagtagcaggtattaaagataagtttgcttcctttgcctaacaccagtcctgaaaatgatcttatcttttcctcccctcatttcaataataatgttttagtgccagttactaggctatgcctgttttgtccaagtagaaaaaggatacataaacttttgacattattgcttctcctgtgtgtttctgacatttgatgcgtttcagaatgtgggtttataaatgatgaaatttttgtggagttggtgaatgcccttggtcaatataatgatgatgacgatgatgatgatggagacgatcctgaagaaagagaagaaaagcagaaagatctggaggatcaccgagatggtatgcctgattattaggattctgtgtagccattacagctttctttcaaaaacagtagaaagagtagaaatagggcttagtttcttctttctctttttctttctttgttaaatatcacattgatagcagtataatcaaaattaacatattatggccaggtagggtggctaactctgtaatcctagcacttgggaggctaaggtgggcagattgcttgagcccaggagttcaagaccaacctgggcaacatagtgagaccccatctctactaaaaagtaaaaaaatgagacagggtgattgcttgagcccaggaggtgtaggctgcattgagctgtgattgtgccactgcacagtctggctgggtgacagagtgagaccttgccttaaaaaagaaaaaaaaaagcataatacttgcaacattatcttcacttgagtatctttgtttcctttggctagcaaagaacgtaatttttt

SEQ ID NO: 128283 - DNA, 1012 bp, Homo sapiens
atgaatacattaaaacctgcattttaattatatgctccttttatcccactttttcttttccttgtctgtctacggtacttgttatctttatgaactctccagttgtcctaaatttgttacctagggattatttgagattttttccacattccctggctgctactagtcctgtgtgtggcctttcccagcgtgttcttacctgtgggccatgatcatagtgctgggccgagcctacgccatctcaccctttaaagagcttctgtgtcctcccagtcaggcatagccagtccattctgcttattataattatctttctaaaattctgttttcaaccaatactcttttcaaaggcctcttaagacttagacttgtcttcacttggaattagtctctttaaacatgtacttcagaactgtccagtctttatctataactgctgtcatttttattcttcattgaaaatgctcttcctcctatgaatgtcaactttctttaccttgtatgcttaactattctattctgtcttaacttttgtttgattggctattcttctttcttctctgttgtcttccaaagcttgataaaaactcatctatcatctttactagcactgtcaactttgatattcatctcattcatctaaatattgaaatattttatgtttttgtagaatgttcttattttacatataagtacatatccttttggcataaactttaatggactatcaatactctgtatccctagaattttattatattggatgtcttacatttttttttcattttaccttaaactattacaagttaatggctgttttaataactggatcatcaagtggagtttgggagtcttagggtagttttttggtatgggtctttatagttgatcttgatacaccatatttcatcatcctctattaacatctaaagtgcgcgttaaaactgatgatggctgggcatggtggctcatggtgtcagacacctgttatcccagcactttgggagccaag

SEQ ID NO: 128284 - DNA, 1046 bp, Homo sapiens
ccaaagtgctgggattacaggcgtgagccaccgcgcccggcccaagttttcttattcttattaagtaagatttaagtggcttatttggtatacatattactattctgtgtggttggaatgtaagagaaatgaaggatgagctaggaaataaatgtataggaaaagcatggaggagttaatcagatcgctgaatctcatataagtacagtttttgattcttactgatattggtaagtatgggaagggttggaggttttgaaaatttggaaaatttgaagcatttttgcaccctaagtaaaagaaaagagagaatcctatttggtttatatgaccactttactgtcctaggtaaggacttttttttcaaaattaaatatttgggtaggcagcatctctttacaatatgatggctacagcttaaggttgtccttttattcttaagagtcaattttattttttctgttttagtgttcggtgaccagtgacttggattttccaacacaagtcatcccattaaagactctgaatgcagttgcttcagtacccataatgtattcttggtctcccctacagcagaattttatggtatgtaaataagatatcttctgcttatttgataataacttatttgaagtaaaaaagcatagataattttattgtcaaggtgaatcaagacagtataaattctaaaaagctatcaaaataacacttgaagtaatttttaaaaattgattaaggtagtttttttaaggcctgtgcagtattactcttttcctatactctccaaaggaaaagtgttaagcagtaaccatacctaggattaaaaatatttaaaagatgggctgggcattgtggctcatgcctgtaatcccagcactttgggaggctgaggcagatggattacttgagtctgggaattggagatccacctgggcaatatggcaaaacgctgtgtcctcaaaacaaaagttagctgggtgtggcgcatgtctgtagtcccaagctactcaggaggctgaggtggaaggatggcttgagggaggcgg

SEQ ID NO: 128285 - DNA, 1036 bp, Homo sapiens
aggggaaagattgtgggctctggagtgttagtaaactgttcacaccttcttgtttactcgagttaagagccttattagtattattacctttatctttgcctttttggaaagcaaattaatagatgaatcactgtcacagttcttcctaactactccatccttaaacctttacttccactaaggaaggaattatttttgtgctgcagtgactgtgatgattgagagattatcccactggcctgatgcaacccaatgctgagggtcaggtgtggcccatatgccagatttctactctgaatttcaccacaactagttctgctatttttaagacattttaaataaaaaatttaaacatttaatatgtgtgtgtgtgtgtgtgtgtgtgtgtgtgtatatatatatatataatgatttttcagtttcattttactacacttcttttttgctctattttcattgattgtggattatgaatgtatgtctaggatatttttgagaaggctctggaggacttacacctgggcagtagtactctttaaggaatctcggattcgtagacagggtggaaagtgctgtggttatttaggcacagagttataccatatttcagagaatcaaagatgcaaaatttttcacattttaacattggaaacaacatgcatcttagaatcactgtgataagaatggattatacctttgtttagttggcagcattttttcttagtgatacagaagataatgatgtaccttgaaatcgctgtcatcatagattgtatgaaatatggtgtttcaagggactatgtgcactgacacattttagcaatatggtatcatggcaatataaggagcgggaagagcaggggctccagagtcaggcttttggagtttacattctagcccgagaaccatgcgcaactttgggcaagctacttatcctttcttttctatagttttctcacctgtaaaatgggggctaagagtagtacccatcttacagtgttgtaatgaggattaaatagaagacatgtaatgtgtt

SEQ ID NO: 128286 - DNA, 1876 bp, Homo sapiens
ttgcataaaagtagcctgaacttaaattatatacacggtcattttcaccagaagggctagctaatttaaaacttgggcgtgttatcttttctttcctcaagtcctgcagaatatagggtagtttcagaaatcacccccagcttttctctagacttggtgacagctgatgctttcttctgactcttcctttcctggagtgccgaccttcctgcaccttcctcgctgttgtcacatggaaaggctacaggatgttagacaatgtcaacagtttactatgtctctggcatgaaataaatggaccaaccagtatctgagaatattttttacttggctaattgattgtatgttttcccctactatatggaagttggacttagcctttctcatgttaaagattattcagaggcaggacggccatggctgttgtctttgggatgtccactgtaaaatggggagtcatacctacctcacagggtagttgtgaaatttaaagaagctaactttggtaaagtctctagcacagtgcttggcacatagtagggtgtgttaatttctttcccttccctgcaggccattcacctgctcttccctctacgattttccataacacagtttttacttggaaccagccttctgccaagagtctcagtttggttgtgtactcctacaactactatttttggcttgacttccctctccagctcccagtggtccagccacacagtcgcctattgtaccagctggttgatgtaagtctatccatcctcagaggaacctggttacttaccagtaagctgtgtttctctgaaaatgtagcatccttggtaatgattctagtcccccccatcccctttttttttaaaccattgatgatgaatcatctctaacttccttgtgtgatcctcaagttggaactggaattagagaatctaatttgttgataaaggtctcctagtaagttcctgagtccaggacacatggctctgaccaggtgaaatgtggagacccatgaggtaaaaattcttttcactactctgagtgacatgagacttaattatgtaaactgtcaaggatgatacattttcaaagaaaaataagttgctggtaagtaactgggatttttgagtaatttttctgtaagtcaataaataagaatcccacgtttgttttcaccaacaaatgcttttgcatttgaatatttcataaatgaaaggaatatggttgttagttacggttaatagtaaagaatgggataggtttctagatactagaaatacagtgaggtgggggtagaccatcagttttctaaataggtgctctcttagcttgaaacagaaattgaagtctccattagagaaaatcatcaagtgtagtctgttcattccagaaacattttttgagtgcctactgtttttttgagacactgtgctgagtatcgtttcaagacagaggtgaagccacacttggctcagctgcttttgccctcagagagcttatttcttgtctcttagtgactctcgcatgactcagaactgaggcgatgggatactggggtatgacagaggtatgggactggaagtagtacgtagtgctgcagcctgtgccttaatattttctgtgcttccataagttctttctgttaatgggaaaaatcagctgacttcattcagaatttgcagagtatttgctgtatcactagagcaaccatagatgaagcaaagccaatgctccttctttgtcatagttgaaaactcattctctaacccttatgtgcgactttggagttaggtgttaaagcaggtgaataagtcagtcggagaggcagcccactccccattaagctttcaaagcacttcttccttcagaagccacagaa

SEQ ID NO: 128287 - DNA, 1065 bp, Homo sapiens
gggaggccaaggtgggcagaccttttgagatcaggaattctagaccaccctgaccaacatggtgaaagcccatctttactaaaaatacaaaaaaattagctgggcatggtggtgtgcgcctgtagtcccagctacttgggaggctgaggcaggagaatgccttgaacccaggaggcagaggtttcagtgagccgagatcacaagactcaatctcaaaaaaacaaaaaacaaaaaaaaatagttttttttgtcatatgttttgcagattgccccccccccattttgatgttatttctgatatatcttggttatacagttttttcttttaatttttgtctttcttaaaggttccaaaagtctttcttcacttcaagattataaattatctacctatctttcctttagttctctgttttcatttttatattctaatatcatttaacccatcaggaatttcctttggtgtaaagaatgggtaggggatttggtttttaattttgttctttttagtttcctggttgtttcaacactatttactgagtaattaatgaatagtgaggggcagttgtaaacttgtttttgaagatcagcagaatcagccttcttggttggtggtttcctgggcagttctaccactcgagcaagacctgaagtgtttcccttcagaaaccacagcctgtgccatcttgctcactcactttccttccttccttccttccttccttccttccttccttccttccttccttccttatttgacagagttttgctctattacccatgctggagtgcagtggcgtcatcttgtctcacctcaacctctgcctcctgggttcaagctattcttgtgccttggcctccagagcagctgggactacaggcatgcaccaccacacctggctaatttttgtattttagtaaagacagggtttcaccatgttggctaggctggtcttgaactcctgacctcaagtgatccgcccaccttggcctcccaaagtgctgggattacaggcctgagccactgcgcctggtcttgcccactcacttgaacctctactactt

SEQ ID NO: 128288 - DNA, 1976 bp, Homo sapiens
tccccagggatactgaagtatgtctgtctatctcatactatatttttccctttgtcttaggtagactatcagctccataggggcaaggatttaataatatttgtatattcattttattcaagttcgtatacactgcttgggtcataatatttattacatgcttgagaaaatgaatttcttcgcccctttgttacagctctgagtaaacagccatctgccttctctgtcatctgttggtggttgagtatttctgtagaaagttacccattggcctcaggactcttactctaaatcttcttcttaggcagttttctctgtgcatgaagtttttatgtaaacaaatagatgaagcctgccctactcatttatttgctcaagccagaaagtcaccttcttcttcactttccatatttaaatcatcatttggtggaattttggcctaagcaactcttgaattcacgtacttttccctgtcatcgccagtgtggtgtagaagcctctgtcaccccttgtcgggatgctgtgctgcagcatcatctaacctggttgcagttattctttcactccctcaccgcacacccttttacttaaaacactaaaagtggcttctcattgttcttaagataaagcacaaattgttagtgtggcctgtaaagctttgcatagcctgacagagaatgtcctgctaataatttgaaggtacaggatgattttaatactttaggagaaaatgttctaggaaaagacgcttgtttagacttaaggtgaggactctgcagtatgaattagacatctggtgaactataagctgtccccgcatttaaacataattggttctgagagcctgcaactaaagataaggcagaagaatttactttgcatttcctgcattcctcttttcgcttgatagcagaaacccctcatgttaataaaggtggcacaagaggcaaaaatacagactttatcacagtgtttaaggagaggtgcatgattaagtgtgtggggagagagtacctttgtacattttattatatggtgaactgtatgttttctacttttagtactgtttgtaaattttacttcttcttggatttacctttttcagttatattattccattatgccttgctactgtaacagctaatgatgaaaaacaggatctgtctttatattttcttccctccacaaatgtggatctcatagagttgaaaactaggttgtgatatagtatagtatacctaattcctgtaatgggatcatgttcctataatatggccgcaatttagtgtagaatttttgtaaataaaagtgtattttaagtttaacttaaactttcaatgaagtgttttaaggatttaaccatgcagcacaaatgagcacctttctgtaaatgccaacagtgtaatatgtgtcatttcttcactgattgttagtttgctgcggattaaaacacaggtgatcatattcaggctggttagattagtgattttaatatgaaaccattgcttttagaataatcatgggccagactgggaagaaatctgagaagggaccagtttgttggcggaagcgtgtaaaatcagagtacatgcgactgagacagctcaagaggttcagacgagctgatgaagtaaaggtataattttatcttttgtgaaaatgaatatacaattaaggataggttttttcccctcctaagttcaataagtttttatttaaaataattctagccaagtttgtatttacaataagatgagtgaatacttggaagcttaggttcttgatctgtcttaacattataccatgcacattaatcagtctttgtttagtatacttttatttgcatatgcagctgcagaaatgcctccctaaatataaagggatgcatttcatgattttatgtttctaaagtcattgtgattaaaaaaaaaaatacacacacacacacacacacacacacacacacacacacacac

SEQ ID NO: 128289 - DNA, 3267 bp, Homo sapiens
tttaaactactgaaacaatgtagacatttataaaatgaaagcgtattgatccctgttatctcattcgctacctttaacggtttggtgtatattcttccccaaattttcaaatatattcatatatgaatatgtatttttacatacattttataaaaatgggaccaagttatttggttctaacatggcttttttttaaggtcaatacaaagatctgttttattaaaaaataattgatattcctttagggctcactatatgcttggtactcttctaagtcattattttatatagatactataatatcgagagatggagagattaagtaacaactagttagtggtagaggaaggattttaatttgggtacgttagcttcaaagtcctgatctcccagccagggatcatttttggtaaggcctgtgagctggaaacgttaacacttttaaaagagttgtaaaacaataccaccccacttccctgaagaacatataagggagactagataccgcctgccaagcctaaaatacttaccatgtggccctttacagagaaagtttgctgccccttgctctaagccatccagctgtacctctttggtgtaaggggggtgcatagtattccagtttatgaatgtgcattacgcagcaaaccaatctgttgtgattgacattgttttctctcctgaaaagaagtgaacatccttatgtatctttgaacatttgtgtgacaattttctatagagttggctctttcaagattatgaacatttctagttttaataggtgttgtcaagttatattaatttttagttaaaacaacaactgtattgaagtataatttacatacaataaaaagcacacatttgaagggtatgatttgaggagttttgacaaatgtatgcacctgcaccgctgcctggatcaagatctataatggttgccatcatctcagagtcctttcatcctcttttacagtcattctctcaacttttttttttttccctccaagatggagtcttgctctgtcacccaggctggagtgcaatggcatgatctcggctcactgcaacctccgcctcctgggttcaagcaattctcctgcctcagtctcccgagtagctgggattacaggcgtctgccaccacacccagctaatttttgtagttttaggcgagatctcagctcactgcaaccttgacctcctgggctcaatcgaacctctcacctcagcctcccaagtagctaggaccacaggcatgtaccaccatgcccagctaacatttattattaatatttttttgtagagatggggttttcctgtgtcgcccaggatggtttccaactcctgggctcaaatgattctgccttggcctcccaaagtgttgggattacaggcatgagccgcggcacctgacttgtagtaaactctctgaattaatattccattgtaggcatgtgctacagtttttaaattcatttacccatggatggacacataggactgttgtcagctgttgataaagctgctatcaccatttgtatgtctttcctggacatgttttagtggtaaatattgattttactttgtaagaaaccgttaaactcttttccaaaatagttgtaccattttaaattgaaagttacagttgtaactgtgcaggagttacagtttcttcacattttcattgacacttcgtgttgccagtcttttaaattttggccatcaaatgagtattaagtatctcattgtgggtttgtgtttctcagatgatcaatgatgttggaacatcttttcatatgcttattggccatttgtgtactttttttggttcaagccttttgtccctttaaaaaattggattgtttgtctggttgagtggcaagaggtctttatatgttctgggtacatagtcacattatctgtcagattgtgttgcaaatattttattgttcatttttgtttgattttgtgtatttttaatactataaagatcaagttaaaactttaatatgggaagcataatcagataaattatgtgaaacaaattgtccttaattcacgagtcatttaattagtgtaacaaaatgttatgcatttgcagaaacttgtaaactaaaaggatattattcatatgctgttaggtgtatggatgataattttttttaattaaactagttttgaaaattattgtatttagtaattctcttcattttgcataattcaaaccttttcatttattagtgagttaagccttaaattttttcttcaaaggataaatgagaatattaaaagtaaaaagtgaccttgatcttagaatggggtatgtagaaatgatgattgccaaacttagtttccctactttgacaatcaagtaaaattttttttttttttttttgagacggagtcttgctctgtcccccaggctggagtgcggtggcgcgatctcggctcactgcaagctctgcctcctgggttcacgctgttctcctgcctaagcctcccgtaaatttttttattatagaaatggatggcttttcagattatatatacttggtttctatacactattttatttttgtaaagtagcagttcttttgctcaacacctgaattgcccccacaataaatttttagtttttcttcaatattcaagtaatacataacttttccttttcctgtttaacaaagaaaaaaatatataaagcaagctgttggacctccattgggtgttgtttaccaccactgtaggtgatcgtggcattgtccacctcagtcttctcatggctgtggattcaagttaagaaattcctgaaggtagcattccaggtagtctgtagaacagcccaaactctctgaattagtattatctctgataggtgttttttttttctttgcttttttatttgagacggggttttgctctgtcacccagcctggatttcagtggcacaatcttggcttactgcaacctccacctcctgggctgaaacaatcctcccacatcagtctcctgagtagctgggaccacaggcacatgccaccatgcccagctaattttttatatttttgttagagacagagtttcactatgttgcccaggttggtctcaagattcctgagctcaagcgatgttcccatcttggcctcccaaagtgctgggattacaggcatgagccgctgtgcctggccctggtagttttcttcttatatctttctcctgttgatctcacttgattttcttactagtctacaggaaatttcacgtggag

SEQ ID NO: 128290 - DNA, 1034 bp, Homo sapiens
attctttgtacttgccatgagatattttgaaaaacatctctttggggaattggtttaaaaattcatattaaattattttctggtacaattgagaatgtatttagtcagtttaagtagcagtgacttaaaacacacttgttgatctagtgtagttagaaaaagttctgatactttgatacctagctttgccttgcacaaatacatttaagtgaatatctttatgttggccatttaaaaattttaggcaaatttctccaagtcatactggaattttcccaggataccttccttcttttgaggtagtgtgctcaaggattctgaatttatttcagtattaccctttacatgagcagtgattgagaaagttgatctgctttttaaaaaccaacaaggacaaatcctccaatataatgtattctgtggttaattagcaatgatttatggattagccttgaagtctttatatcagtatagatgacaaattttctgtaaatcatgatagattctatatgagtaggtgaaatcttcgggggagagcataagtgaacagcagcaattcattaaattcagagaaaggttcatggtcagatgatacatactttaccttctggaggtcttccctgaattcccactcttgtgttcccacagggttttatcatattttattgtagcatgactcaattgtattgtaatcacttgtttatgcatccctctcttccctacagtcaaagtgcctcctggtagaggctctgtcttatttttttctttgtatacctagtacctacgttggtatttgctagagaataggggttttaaatatagttgaatgaattaaggaaatatgaaaaatgtagggaaataatttgacaaaggaacttgcaaagtgaacaggatatgttagtattcatgtgaggaactttgaaatgtgtttttctccctctttaatagggaatgattacaaagaaaaatagttgtcaaggtgaacaagttccaagtttttcctagttataatctgtagtactaaacattagata

SEQ ID NO: 128291 - DNA, 2067 bp, Homo sapiens
cagcgaaccccgccgccgcccgcgcgcgcacgcgctgccagtgcccgcccgcccacgagccctgagcgcactctgcgtggggctggctcggcgcctccgagcccggcgggccctgtgattggacgggcgcccgcctcgcgtcccgccaatcggggcggcgcttgattgggctgggggggccaaataaaagcgatggcgattgggctgccgcgtttggcgctcggtccggtcgcgtccgacacccggtgggactcagaaggcagtggagccccggcggcggcggcggcggcgcgcgggggcgacgcgcgggaacaacgcgagtcggcgcgcgggacgaaggtaacgcgccgctgcgggcggcccggccggcggggctccgggagtgcgaaccgggcggcggcggcggcgccaggacctccccgccactgctgtgccggtcccgggtatcgccgagcggggctcaccggggcgccgcgtttgtaggcgtgcggggggtggagggtgaggggagagcccccctccccggaaggagctgtgagcttcgggctggcccgcgggaccctgcgagtgaggcagcgcacacccctggagctgcggggcggggggcgtgtggggggctcctttcccggtgcttgtcctggccggggcgccggggccggggtcggggcgttccggtgcccggtccagggtggcagctcgagcctcaagtctcctttgtgtggcgcggccgcggcgggagcgcccgggtgggacgggacagacacaagttggtgggacccagccgccgagtccgcactcagacaaaggacggactgtgtctccggagggctcggcgcgaggggaaggggcatgacacccgggcccgccggcgggcgggagaggggcgtggggaggcgcgggccgctgccggggtgggcagggctcggccctcgcctcgcgcacgcccccggtcccgggcgcgccgaccccgggctggggccgcggcgctcgcgggacgacgttcgcggcggggaactcggagtagcttcgcctctgacgtttccccacgacgcaccccgaaatccccctgagctccggcggtcgcgggctgccctcgccgcctggtctggctttatgctaagtttgagggaagagtcgagctgctctgctctctattgattgtgtttctggagggcgtcctgttgaattcccacttcattgtgtacatccccttccgttccccccaaaaatctgtgccacagggttactttttgaaagcgggaggaatcgagaagcacgatcttttggaaaacttggtgaacgcctagtgagttgccactttctaaagaatcgtaatccttaaacattacaagctgttttggccaacttgtgtgatacatctgagaatggcgacaggtgctaacgaaatcaactgtcattcagccagattattccccaaatcccgacgggttgaatgaggatgaggtggtagaagtaggtgatcaaaatagaatggctatgacaaatgtgtgtttagattatacggttagcagtttcttattaattggtctcgttttctgtgaacaatagctttggtgattcagaaaagactgcatggagaaatgtttgttgcctaagaaatttaacgtgtgctgtccacagttaaacttcctttatcacacaggatctgtaacatttaaattcatttggaaataaaaatgtgtctttgctatttacttaaaggcttgctttttagggttcaagcaagttattattagtttaattttgtggcgttttgatgtcatcataaaacagcatttaataaacctttgaaaaacacgaatgctgtcacaattgaatgtagtttatacttttaggggttttggagtttattttctattactcttcataagcattagcaactaattcatgtttaggaatactgtacaagtgtgtaatcctaacttgtttatttgtaattttatttgcaggaaaacaagtatttaagatatattttaattttctattcatggtctctaaagttaggaataggtaggattctagtcatagatataaagcgtcttgttc

SEQ ID NO: 128292 - DNA, 1157 bp, Homo sapiens
ggtctgggctggagccacctgcaacctctctggcctttgcaaggacagagagtagagagtagcagctactactttctacagtagtgggctcttcctgtgtgactggcccgtctggtggccacaccaacctcactgcctggtccagagagagcccccagaatctttggcctttgcagcactgacgccccctcccgccttgctttccttggcaggaaaactgaagccagtcatcaaatcccagccagtgcccaagaacaacaagggacccgtcaaggtcgtggtgggaaagacctttgactccattgtgatggaccccaagaaggacgtcctcatcgagttctacgcgccatggtgcgggcactgcaagcagctagagcccgtgtacaacagcctggccaagaagtacaagggccaaaagggcctggtcatcgccaagatggacgccactgccaacgacgtccccagcgaccgctataaggtggagggcttccccaccatctacttcgcccccagtggggacaaaaagaacccagttaaatttgagggtggagacagagatctggagcatttgagcaagtttatagaagaacatgccacaaaactgagcaggaccaaggaagagctttgaaggcctgaggtctgcggaaggtgggaggaggcagacgccctgcgtggcccatggtcggggcgtccacgccgaggccggcaacaaacgacagtatctcggattcctttttttttttttttaattttttatactttggtgtttcacttcatgctctgaatactgaataaccatgaatgactgaatagtttagtccagatttttacagaggatacatctatttttatcattatttggggtttgaaaaatttttttttacaccttctaatttctttatttctcaaagcagataattcttctgtgtgaaaatgttttctttttttaatttaaggtttaaaattccttttccaaatcatgttgattttgctctttgctttttcgttgtctgagaaattgttggcgtagatttggcttctggtatgtgtttctgattgcttcctgttgagcacaaagtgagagctgccactgagcagccctgccaggggtgctgtttcaggctgggcatcgccaggcggcctccctgcaaaccaag

SEQ ID NO: 128293 - DNA, 1858 bp, Homo sapiens
gaccttgctctgcccacccctggagggcgatgtctgtgagggactccagtcgttgtgaagtgtgagccctcaggacctcctgcgtgaagaccgcacaagctgaaggtggaaagttccacacagcccagcccgtgataacccttcctgtctgccaagagccaggcctaccttgagtggtctctttgtggggttagtgagcctacacccccaaggaaagggccaaggtgtttgccttttcccaagaagccacctacggttcactggagggaaaggagccccaaaagacggtagggaatgactgggctgtgcttgagtggggtcgagccctggggtgttttgcctcctaagactgatccccttcaaagtcgccactcccccaaagtccctcaaacattgtactcaagaacaatggtggggagatggtgggccccctcacctgttccctctttgaagcagggctccacccaggactcggccatcaaggacttcgtgctgaagtacgccctgcccctggttggccaccgcaaggtgtcaaacgatgctaagcgctacaccaggcgccccctggtggtcgtctactacagtgtggacttcagctttgattacagagctggtgagggacccccaccaagacctgcgggggtggggggtggggggactcgttctttcaggcaaggtggagtgttgaggggaggtgtggctgtatgtacatggctcactcagaaatcccagcctggggcccttgcacgttggtggctcaggtatattttttaattgatggcttccctttttagcaggatgggagcttagattcaggtgcagaaccctcttagagttgacgtagctgagacttggaggagttcagaggctgcagagctgggactagaccagccctggccccaggcaggcgtggccgtgccacctgggcacaggtcttaagggcctgttgggcttgcagctgtggcccccgtgacaagtggggcttttccagaaacatgtttccctccaattgaggtaaatccagggtttgagcattgtcagaatattagcgacaggacctgaagcctgacctcagagtctgagctgggacttgctctgtgtggccgcctggcttatggcccttggtccctttcagcaactcagttttggcggagcaaagtcctagaggtggccaaggacttccctgagtacacctttgccattgcggacgaagaggactatgctggggaggtgaaggacctggggctcagcgagagtggggaggatgtcaatgccgccatcctggacgagagtgggaagaagttcgccatggagccagaggagtttgactctgacaccctccgcgagtttgtcactgctttcaaaaaaggtgagcccgtggctggggctggggtctcccatcagctgctgtgctcctcgtgcggaatccagacaggccaggggcgtctggtgctctggccacgggcacgacacccccttaagtcagccagcagtcctctctcacccccgagggactctgacttctcgtccagagaaatgtcgggtgtgaccccaaactccaaggcaccagaatagcttagaagaaggatttgcaagtgttactattttcttcttggcagttctcccagtgtttactttgaaagcaaaagcaagattcggagtccatctcagggcttacctagcatcactcagcggccttagcacatttccagcgctgatgtgctaaaattccagactagggccggggtgtgcagagggggcatctgaagatggagcccagacagggcaaagtctgggtgtgctgaacaccccttgtggcttcagagcctgactcagagcctcttcaccctcggccacc

SEQ ID NO: 128294 - DNA, 1050 bp, Homo sapiens
tagttgggactacaggcttgcatcaccacacccggctaatgtttgtgtttttagtagagacagggattcaccatgttggccaggctggtctcaaactcctaacctcaagtgatccacctgcctgggcttcccaaagtgtgctgggattacaggcgtgagccaccgcgcccagcctacagtggtcattttcagaacatttgctttggctgatgtgggtaacgaattaaatctcagacatttaggcaattttcaaaattacatcttattctgttaacgtttcagctaacaacctgagagaagattacaaatttcaccacactttcagcacagaaatagcaaagttcttgaaagtctcccaggggcagttggttgtaatgcagcctgagaaattccagtccaagtatgagccccggagccacatgatggacgtccaggtaagcgggcccctctgccatgccagccctggacaccccgcaggcatgaggactctgctttgagccacctctgaggtttcaaacgtggaggtttcgctcttgtctgcagggtctggaactccttttccagcccgttctccccaccccacaggttttctgcaggcggcctgtggtctctctttgccggagggacagggctggggctcccgcacacctggcaggtcctggggctgggcagagctccacttggttttgccagaacagttgctgccaccctttgtccctcctggcaggcaatcaccagtctccctccagtgcctgttccactgtgggtttggcctgggccagcacatggtgctccgttgaggccaagtcgtgtttgttcgggcagctccagctgggggctacagagggacagcatccctgtctgttcaccagagggagctgttgaccttggtgggtggattttgcctttctttccattactgcacccctgcacttcatcctcctagagtgtgacacactcagccctagaggggcagtgggagttcccagcccaaggggaacctggggccagttcagccttctgagtgctttagaaggggccctgcacttc

SEQ ID NO: 128295 - DNA, 1050 bp, Homo sapiens
gacgtatgtaatatagtaacattagatgtgaatgactaaatatgtatatattttgtatgtgttcaggagatgccccacaatgctatccataggcatatgtaatcaaaaccattgggagttggtgagggtttgcgtggagttagtaccatagcctgatggtaaaggaagtctcaaccatcagtaagtcttaggccctctggagaagtctgcaggctgtggaaatgcgatggacaattgttgggaaatagcgaaccttctgactcttggctgtgtccccaaaactgcagagatgcagccaggtttcaggaaatcagacacctcctgttcttgtgggccccgacacttgctttcttccccctcctcatctgcttctggagggaggtgaagtgcctgccagtttgggccttgtgtgctcagtcttgcttggtttctttcagaaattgttgccaaggtcagagaagtctcccagcccgactggacgcctccaccagaagtcacgcttgtgttgaccaaagagaactttgatgaagttgtgaatgatgcagatatcattctggtggagttttatgccccatggtaaggtggtgtcaggccctttccatattcagtaccctggtgggcactaggtgcggggtggcaggcccctgcccgtgaggcaggaacagcagaggagcaaggtgggcacgagttgtaggccaggattgaggctccaggtcttctggaagaagcgtggatgtaagagagctgttgggggagtgaatgtggaaggaactgccaagtagtccattcttgggtgggagaagggacccaaaggaaagaagatggcagaaagagaggtggtcggagtgggagcaagtacagtggctggtctgagctgcccagcttggggaactgaggtggctgcttcatggggaggggaggggagggacgcacaaccagttgcgtggataagctggcagcagtcagagtagagagcagagcggaagaagacggctctcaagggagaggggagcctggcttcaggagagaccatctgccttcccaggagac

SEQ ID NO: 128296 - DNA, 1125 bp, Homo sapiens
tagctgggattacaggcgcctgccaccaagcccagctaatttttgcattttcagtacagacagcgtttcactatgttggccaggctggtcttgaactcctgatctcaagtgatccgcccaccttggcctcccaaagtattttttgtaaagatggagtttcgccatactgcccaggctggtctcaaactcctgacctcaggtgatacacctgcctcagcctgccaaagtgctgggattacaggtgtgagccactgcacccggccatgtcaagctcttttaaactacattcgtgaaagtgcatttgcctattcatgagggatccacccttaagacctaaacccttcccactaggtcccatctcccaacactgccacactggggatcagatttcaacattttggtgtggacaaaccacatccaaaccaaagtggtatgtattattgttggatttaaatcccataggtacagttaacgttttttgcccttcctaatctaattgttaggtgtggacattgcaagcagtttgctccggaatatgaaaaaattgccaacatattaaaggataaagatcctcccattcctgttgccaagatcgatgcaacctcagcgtctgtgctggccagcaggtttgatgtgagtggctaccccaccatcaagatccttaagaaggggcaggctgtagactacgagggctccagaacccaggaaggtgagctggtacctgagctcgtagaggaagaactccttcccgcagggaatgggaatttggctaatagaggaagaaaagctgagggtaccagggactgactttctcaggaaccttagccctctggaatgtttatttgctcttggggtgggggtgggggggtaggaggggggagtagtggggtgggcagggtgggttggggcgtggcatctttacatttcagactctgaaactcaaaacatgggcaggagtgttaggaaatgggccagacatggtggctcacacctgtaaccccagcactttgggaggccaaggcagctggatcactttaggtcaggagttcaagaccagcctgaccaacatggtgaaaccccatctctactaaaaatacaacaattagctgggtgtagtggctcatg

SEQ ID NO: 128297 - DNA, 1110 bp, Homo sapiens
accagccaatgacgtggtgggcccccagggaccacccgggacttgacacattctgaagtgtatgaattttaggaaagtttttttttttttttttttttttgagatgaagtgtcactctgtcacccaggctggaatgcaatggcgcgatctcggctcactgtaacctccgcctcccaggttcaagcgattcttctgcctcagcctcccgagtagctgggactacaggcgcgtgccaccatgcccggctaatttttgtatttttagtagagattgggtttcaccatattggccaggctggtcttgaactcctgacctcgtgatccgcccacctcagcctcccaaagtgctgggattacaagtgtgagccaccgcgcccggccaggaaagttttaaggagagtcaccaccagctttgtaaccagtctgggtgttttccactcagattcttctaacagagaaaatgccattgaggatgaagaggaggaggaggaggaagatgatgatgaggaagaagacgacttggaagttaaggaagaaaatggagtcttggtcctaaatgatgcaaactttgataattttgtggctgacaaagacacagtgctgctggagttttatgctccatggtaaggaccgcgttctaatttctgcaggtggacaagcgctgtgctccattcgctcagcccttcacccggtcatccagaccttggggggtggggtaggagtgtctgggtgcaggaacttgcactctagctttaagaacgctgggagctcactcgttctaccactgtgcgttgaacggccagtgagccagccctcatggaaggcgatgtcttcttgtctcagtccagtgggttaaagatgaatacgtcctctgatggtcacagctgggggacgggcatttaacaagcggcaatgacacagagccctgtgttggtaacagacacgtccttgttatagattctgctccgacctgtctcaggccaccctgccttcctcttccctcaaaggctgttgctcaggcagctgccccaagtgcaggctgttggcctgtgtggtggattttttactacacacataggccctgcggggggaccagtcaggcatccccact

SEQ ID NO: 128298 - DNA, 1038 bp, Homo sapiens
tggtcaggaccctccgctaagtagctttgtgatctttggacaggtgactcaagttcctgcatctcagtttcttcatctgtaagatacaatataacgtgtaatacagtctcccttaaggggtgaagtggtgtgtttaagagcccagcacagtgcctggtacatacaataaataccagctatcatggttaccgtagctgataacagttcttgtttctgtgtttaatacaaactcttcagtattggctgaatggtagagtttatgcagctgtttcaggcacttctctgggggagatgagagtgatcagctgaggacggagagtgaggacatcctaaaaggagctgcctgtgtctgagcaggacccagtgttgtcatcaggtgtgccccgtgggagtggacagggattgaggcaacctgctcaggtgagggtcccccacttcaggagaggccttagcatgtgggctgagcaatgtggagatgaacttgggaattcatttgtctcatgctgaggaaggttgcatcttttcagagggtgctgaaaggctctggacatacatatatatatatatatatatattttttttttttttttgagatggagtttcactcttgttgtccaggctggagtgcaatggcgtcatctctcgagtagctgggattacaggcatgtgtcaccacgcccagctaattttgtatttttagtagagatggggtttctccatgttggtcaggctggtctcgaactcccgacctcaggagatccgcttgcctcggcctcccagagtgttggggttacaggcgtgagccatcacacctggccttttttttttttttttttttttttttttaaatgacagtcttgctcggtcgccaggctggagtgcagtggtgcgatctcagctcactgcaacctccacctcctgggttcaagcaattcccctgcctcagcctcccgagtggctgggattacaggtgtgtgccaccatgcctggctaacttttttctgtattttagtagagacagggtttcacgatgttggc

SEQ ID NO: 128299 - DNA, 1060 bp, Homo sapiens
tcgccactgctccccaccgctccggtaccgacacgtgttcttactgccaagttcggccgcaggatgctgagccgagccccgccccgctccacatttcccaggctccgcctctcctgccccgcccccggcaccgattgccaatagcgccccgaggcgtagccaggtcccgcactccccgtgcccggcccgccgcctttgttctcccccgctctccctcttggcctgtgcgctcccggcaaaccgagtggcagccgctgattggtggttgtggcgcagccaatcagaagggggcacctcacgttagggctcggagttttaaacgcgcagccgagggccgcgcgcaggagtagggagggcctagggcggcggagccgactcgtcgcggccgaggcgcgcgcggtccgtgccggcgtcagtctgggattggccggcccgcgacttcctccgccccctgccaatcgccggggacgacttccgtgggtttttccggctcccccgcgtcgctaaggagcgacgggctgtcggccagaccccgagttctcggtgcgctcagcggccgccgacgctaggaggccgcgctccgcccccgctaccatgaggccccggaaagccttcctgctcctgctgctcttggggctggtgcagctgctggccgtggcgggtgccgagggcccggacgagggtgagcggcaagcgcgccgcgggtcgggctgtgcttgcgggggctgcagagctgtgcgggggcctgggccctgcgaccccggcgggcgggcttccgcgcggtcagctccagaactagtgatgggcgccgagcccggggtaaacttggcggagttgaaggggcgggggcggtggctgtggcagtggcaggatcgatttggggttcccgggagaggaaggtggccggggtctcttgggctccgacgccctggaagacccctgtcacccgaggctgggagagggctgcagagcgccttttttgcagctgggtccttcgccttaatttacagattttcgtcaggtccaggctaactccaggcgaacgcgcccaggcagtggg

SEQ ID NO: 128300 - DNA, 1046 bp, Homo sapiens
gacctatattttccttttttcaatattatccaaagatatgtctgttcagtttagtttcagcagactcaccaaactcacggccatgagacagatcacactgcatggttgggtagctcagtggaagctgggttcccaggccaccacaaggcactcttgtgggtcacttgactgtgagaatcgctagtagtgctgcagacaggaataccgactgaatttttgttttcaattgcaggaagccagcaggctatgaattcaggaaaaactaaaagccatttccaattagatcctgaaagccagtgttcctttggatcctttgtttccttcaggcctgaccaaggcatcaccctcgggagcccacagagacacgacgccagggctcctccaccactagcctgcggccccagtgaatctaccctaaaagaaggaatcccaggtcccagaaatctggatcttcctggtttgtgggacgtccccgcctgggagagcacccagcacccttggcctgtctgcggggaaagctgttgggagaacaaccatttagtaatgcaccagagaggccactcaaaggaccggacacgtagggcctgggagaaattcaacaagagggcggagacgcagatgccgtggagcagccctcgggtacagaggcacttccggtgtggcgtgtgcggtaagagcttccgccggaagctgtgtctgctgcgccatctggcggcccacacggggaggggccccttccggaacgctgacggtgaaatgtgcttccgacacgagctgacccatcccagccaccgcctcccgcagcagggggagaagcctgcccagtgcaccccatgcggcaagcgctccctcccagtggacagcacgcaggctcgccggtgccagcacagccgggaggggccggcctcttggagagaaggccgcggggcctccagcagtgtgcactcgggacagaaaccaggctcgcgcctgccccaggaggggaacagccaccaggaaggggacacggaggcgctgcagcatggcgcagaggggccctgctcctg

SEQ ID NO: 128301 - DNA, 1040 bp, Homo sapiens
acctcgtgatccgcccgctgggatccaaagtgctgggattacaggcgtgagccaccgcgcccggcctcatgtaatcgatttaaaacattaatggccgggtgtggtggctcaagcctgttatcccaagcacttcaggaggctgccgtgggaagacagctttagcccaggagttgaagaccagcctgggcaacataggaagaccccatctctacaaaaaaaatttttttttttaaattagccaggcgtggtggcatgcacttgtactcccagctactcaggaggtgggaggtgtttgagccagggaggtggaggctgcagtgagctgtgatcctgccactgccctccaacctgggcaacaaagtgaaaccctgtctcaagcaaacaaacaaatatttttttcatactaagtcttcaaagtctcgtgtattttatactcatagcacatctcaatttaaccacatttcaggtgctcagtggccacatgtaggtagtggctactgtattgaacagtgccagtccaccctatggagaagaatcaggagacagattgacactaagaaaggaacaacctacccaaaaaggtggaaggggttggcataagtgaagcaaatgtggagagttaagatttaaataggatgcaacttccttaggaagtaaagaagaaaacttagattcggttactgataagtttgaagcaaggagtatgaagagaaagttgaatgaatttaggtctgattaatttccatctcaaagcaagaggacatgtcatcttctgagagtgggggctgcagcagacaagtcttactactcagtgtcagcatcacctgggaatttgttaaaaatacaaaatctcaggctgtgtaccatggctcacacctgtaatcccagcactttgggaggctgaggcaggtggatcacttgagctgagtagtttgagaccagcctaggcaatatggtgaaaccctgtctctaccaaaaatacaaaaattagcagggcatggtggtgtgtgcctgtggtcccggctactcgggaggctgag

SEQ ID NO: 128302 - DNA, 1030 bp, Homo sapiens
agccccttcctcttcctacacccccagcagcaaatgaggcacacctgcagacagcagctatctctctgtggacagtggtggccgccgtgcaggctatagagaggaaggtggagatccacagccggcgactcctacacctggaaggtcggacagggacagcagagaagaaactagccagctgtgaaaagacagttaccgagcttgggaaccagctggagggcaagtgggccgtgctgggaaccctgctgcaggagtacgggctgctgcagaggcggctggagaacttggagaacctgctgcgcaacaggaacttctggatcctgcggctccctccaggtattaagggagatatcccaaaggtaataccttcatttctagatgtaaagtggtaccactagaacttacattagtagtagtcttggtcattcagttacttagattttttatttccttttaaagtttcttaaaatatctcagtctgaaagaatcatgaaggtgttttatgtttgtctatttgggaaacattttatgttcaatttagtacccatttagagtgccaagattcagattggaaacctcttgctggaccaaagttggctatctggtagatggattttttttctcttttggtttctcctacccattacccatgagccgcttctttcttcgttaacttgtgtgccagattcttggggaggagactacataaatattcttttaaatcagtcaatttgaggctgggcgcggtggctcatcccagcactttgggaggctgagatgggcagatacctgaggtcaggagtttgagaccatcctggccaacgtgaggaaaccctgtctctactaaaaatacaaaaattagccgggtgtggtagcacatgcctataatcctagccactcgggaggctgaggctggagaatagcttgaacccaggagttggaggttgcagtgagtcgagatcatgccactgcatgccaggctgggcaacaagagcaaaactccttctaaaaaaaaaaaaaaaaggcctgg

SEQ ID NO: 128303 - DNA, 1028 bp, Homo sapiens
acctccagttggcgagcaggtgttctcatgccaccactgtggcaagaatctcagccaagacatgttgctgacccaccaatgtagccatgctactgagcaccccttaccctgtgcccagtgccctaagcactttactccacaggcggacctcagcagcacctcccaggaccatgccagcgagacaccccccacctgcccacactgtgccaggacttttactcacccatcaagacttacctaccatcttcgggtccataacagcactgagcgtcctttcccctgtcctgattgccccaagcgctttgctgaccaggctcgactcaccagccaccggagagctcatgcaagcgaaaggcccttccgctgtgcccagtgcggcaggagcttcagcttgaaaatcagcctcctgctccaccagcggggtcatgcacaagagcgccctttctcctgccctcagtgtggcattgacttcaacggccactcggccctgatccgccaccagatgatccacacaggcgagcgtccttacccctgcactgactgcagtaagagcttcatgcgcaaggagcacctgctgaaccaccggcggctgcacacaggcgagcggcccttcagttgtcctcactgtggcaagagcttcatccgcaagcaccacctaatgaaacaccagcgcatccacaccggggagcggccctacccctgctcctactgtggcaggagcttccgctacaaacagacactcaaggaccacctccgttcaggccacaatggaggctgtgggggtgatagtgacccatcaggtcagccacccaacccaccaggtcccctcataactgggcttgaaacttctggcctgggtgtcaacactgaaggtctagagaccaaccagtggtatggggaagggagtggagggggagttttgtaaatccaaatctctgtggcttcatgcttgtatatgctcacagcagggcacaaaatccaagagaaggtctgtgagccccatccaacacccacagtaattattatct

SEQ ID NO: 128304 - DNA, 1036 bp, Homo sapiens
tgcatagacaacagtttgttcttgcctgtgttgcttttagggactttgactaccacatgttcttttcttggggtgatttaatcacctgggagcatctgagtctgctcctaagtggctttgcaactgggcctaagttctgtttcctttatggatctcaaattttcatctgcacaatgaggctgttgaaaggaaaaaaagtgagcctctaggaattattcaaaaaaagtctgtgatacattccttttcctgccaaagttctgtctctgtctttggcttctgtccaggcaaagctaaataagacagcaaagtcaaagcagataaattcttgttgaaacttgactaaaatttatttgatttgttgttttactcccacttggaatcctgaggtagaagacagaatgcagaagtcttacatcttgggcaggaaactggtttattcctatactcttgtttcctctgcttcttcctgaggtctagaacaaggtctggaaatgtttagacaggatattttcttgatgaagtgataaggaaaggacccatttttttgctcatcacctagcccatccttcactctctctagttatgcataacaacactagaagaaggtgttagcccagctaactttgcttctgggaaggctatgtctgaacatgttgctctgtaggataatcacacttagaaaacatctgctccatgacattcacaataccagggaccatgggagacacaagaaatgtgtgtctgctgtcataacttacagtgaaaaagcccaataatacagaacaagacatgatgggcaataccctagcatattgggattaagagctttctagccagaatctggacctataccatgggaaaatttaggggtgctgggaatcccaaagccaaggttctggcttcattggcaacccactaggaacttgaatgtgagattcagctctagtttgcaccttgatttccccagtgaaaagggagaagagccaaagtattgtctaggtgctgagttcccttttctgagtggatttcaagcatt

SEQ ID NO: 128305 - DNA, 1943 bp, Homo sapiens
ttctttcttccccattttctctccttccctcccttttccccttctctttattatagaatattcaaataaaaatagacagaatagtataatgggtccccatgtatccaaattccagctgcattagctgctaactcttggccagtcttgtttcacctaaatccctgcccacttccccactcccattttattttgaagcaaaccccagacattagtcatttcctttgcaaatatgtcagtattagctcaaaaggtaaagactcttttttttttaagtgataatctcaatgttattaccaccaccaccatagtaaaagcttcagcctagatcactgtctagccagtgattagattttcagttgtttcaatttttaaaaacatttttttagtttgaattaggattcaagtaatgtccacacattatgtttgagatgtctcttaagtcttttttaatctgcgggcatctcttccatctattatttttcctttcagtttatctggaaggaattgggccacctgtcctgttttgcatctcgctgtctggattccactgattacgtcccctgtggtctcatttaacatgttcctctattctcagtattccagttgattggtaactggatctttctctctggaacgcactctgatcaggcctttgctcactaatgatgtccgtggtgttacagccagtggttgcttctcagtcttcatcctccctgtcctgtcagcagcattgtgtgtaggtgaccactctctccgtgaaaccccttgccgtggcttctgggacacctctctctgctgagtcttttcctacctcaccagctgctgtgtctcattgtttgccaattttgcctcctttggccagctttctaatgcatggagtgggccagacctctgtcttggccttttgctctttatttactctcctccctcatgactgcatcccgtctcacagtctttattatttatttatttatttattttttttgagacagagtcccgctctgttgcccagactggagtgcagtgacgtgatcttggctcactgcaacctctgcctccagggttcaagtgattctcctgcctcagctgccctagtaggtgggattacaggcatctgccaccatgcccacctaattttttgtatttttaggggagacggggtttcaccatgttggccaggctggtctcgaactcctgacctcaggtgatccacctgcctgggcctcccaaagtgctgaggttacaggcgtgagccaccacgcccagctagtctcacattattaaaagcaatctgtatgctctcacctcccaaatagatgctttctctcccctgctccctttctatatgttgcccagctttctttctggaatgccagattcacattcctacctattaattcatttggatgtcagtaaatcttagatttaacatgtccaaagtgaactgcggatcgcctgcctgagacctgttctacctgaagttgtcctcatctccgttgatgacggatggttccatcctttcaagtgctcaggccaaagccttggagtcatacttgtctcctctctttctcacaccctacttccaatctattagtaaataccctgatttttcttcagaatatatccacaacctggccactcctcaccacctccactcccatcgccatcgtctggtcccaggcaccatggtctttcatctgatttttgccatggcctcctggtgggtctcattgtcttcatccttgtccccccacccatacagtctatctcaacacagcagccagagtgatcctttgaaaatgtgaagcagtcacatcacacctctgcttaaacctcccaaatggctgggcacggtggctcacgcccataatcccagcactttggaaggccgggcaggtgggtcatgtgagatcaggagttcaagaccagcctggccaacatgg

SEQ ID NO: 128306 - DNA, 1082 bp, Homo sapiens
cgggaagcagaggttgcagtgagctggtatcgcgtcactgcactccagtctgggcgacagcgagactctgtctcaaaaaataaataaataaaaataaaaataaaatgaagaaagggatctgtattaattttcccaggttggggcttttcctgcatctggtggaaggtccagtagctaaagattctagttctgattgtaaagatggacagtgagttgtcagtccgtaggggtggggccatggcactgaggtgtagacatcgcacctgcgcatggcattctcagagttacaagcacctggtaaaagggctgacatttctaacttacataaaggtgctgcccactcaccatgctgagtagtggtagctgtgctcctgactttgccttttctaactcaccccaaggtgccatacaagccagctttggccctgtaaatgcagatacgtagatgaatggactgtaatcacaggatgggggaggattgaggggtcggatttcagaccgagagtgaaaggctggttcagtcggaatgtgaaagtggtaagagggaaggctgtgtgtccagaggaggaagttcagttatcaaagtcatggaagtgaaacgattttggacaattcggtccaagttgaggtcgtgctggtgagtggctgaagtgagtgattgcaaactgaaatcggctttctgtaacagatccgaacacacttgtcatcagtctgacaagtgactgacaccacgcgacgactcgggccgcagtggagcttcctggtgttggcactcgctgcgcagcacactcaagtatttattgattccctactgtatgctccttgatgatcaagatagggtagtgaacgaagtggaccaaggtcctgaaccttagcacaggccttagattttatatgctttgctgacaaagaggtaactgtgtgcacagaggtgacctgacctgaaatacaggtttggtaaccaggttttactctacctggctcacggatacccactctgagaacccattacccctctgtcaccctgaataccaaaagaagcatattgactactctttaccctcaggtatccagttgaccta

SEQ ID NO: 128307 - DNA, 1549 bp, Homo sapiens
tctcttcagtgtcatcacccctcattttgctgcttgcctagccctttttcttgaatgttggcttcctctctgctcctgagaccttctgctcctcagggtcccccatggttccaataggaacccgagacccctgtcttctcccctggcaagtgctgtcagccatgcttctgagcccagaatgtcctggtgaccagcatgcagaaaaaaagacacaaagcaatgtcattctctgttcccaggagcagagctcctggtgcctgcagaaaaaaagacacaaagcaatgtcattctctgtccccaggagcagagcccctggtgcctgcgcaggatgcgtcctcccaggtgaagcgtgaggacaccctgtgtgtccggggtcagcggggcctggaggaaagagccatccctacggaatccattaccggtgagtgagccaagcagccgtccacaccagggaggggaggggaggggagagggttagcatggtctgccagcccccagagttagctgtcacatgtgccaggccagagggctgagctcgaaatggaagggctgtgcatccagggctgggctgagccaggattcctccaggagacacagacgtggcaaacagcattgacaatttgctggtacacctgggctcagcgtgttctgtttcctctcttcctcatattatccgtttgtaactattccatcttcccctttagaaacaatatcctggcagaagtactaagtgtaaggcttcatgggtgggggaacagggaggtcaggaagacctgttgtgccctgaccaggaaggcctttcattgttttaaacaagtatttatgggctgctacctctgtgccaggcacctacatacctgcggtcctgtgagggacctcctcttagctggcattgcagctggactctgtcgtaggtgagagctctgttatagcagatgtatgtatcaatcagagttctccagagaaacaggacctgtaagggtgtgtgtggaaaagagagatttattttattttaaggaattggcttgtgattgtggaggccggcaagtccaaaatttacagggcaggccagcaggttagagccccagggaattgctgatgtggctgctggagcctgcaggcagaattcccttttccttgggggaggccagtcttttcccttaggccttcagctggttgatgaggcccgcccacatcatagagggcaatctgcttgactcaagtctactgacttacatgttcaaatctcatctaaaaatataccttcatagaaacagctaaataatgtttgaccaaatatctgggtaccgtggccgagccaagttgacacataaaatcaacaatcatgagacatattaacatactgtagccctttacttatccacaggttagagctccacaaacctcatcccccccttagtcagagcctcacacccataggtaagtgctcatagtgtctgggtagaggaaagcccgttcacttgtcatcaggcatgacccttgaaagcatcacagtattaggatctttaaggagatctttaagagataa

SEQ ID NO: 128308 - DNA, 1008 bp, Homo sapiens
gcttcactgtggttcttatcaatgacctctggttgcagcctctgccatcgctggtttctaaatcatacctgttagccatggccctgagggccgttatctggggctttcttctggcctgtcctggccccatgggttcctctggggctaagtggcagagctgggagatctgggttttaatcccggccctgccactgcacagaccttgggctaagcctccttctggccaacttgaaatgcatcgagcagtgagagtccatttaggaaggggcttatgagggtaaggaggatggcctggaaatgcaacaccgataccaaaacatgccctgcaggttgcagccaccgcatgggatggttttcaaacctttgatgggaggccgagtagaactgaacaaaatctaagactgccttctttccatgacaacagagtctctcatctcagcacatgacattttgtcatggatcaagcaggaggagcagccatacccatggggaccacgcgactcaatggacggagagcttggattagactctggccctagtgagtaacgtccccacctagaccctggggtttcttctctggagctgtacagctgaggcgtggacgaaggctggtcctcttctcagctcacccctcgtagggtgatgttctgttgatggcagcgtttcaaagttctgcaccaaagcactcccattctttttggagtgtgatattgtattagctccccaggactgtcataacagggtaccacaggctgggcagcttcaacaatagaaatttattctctcacagttccacaggttgaaagtccaaaatcaaggggtgggctgggccttgctccagacttcctctgaagtctgtatgggattcctccctcgcctctcccagcttctgctgggtgccaggaacctctggcactccttggcttgtagatgcgttgctgcaagcctctgttgtcacatggtgttcccttgtgtctgtcctcacatgccatcttataaagacaccag

SEQ ID NO: 128309 - DNA, 1026 bp, Homo sapiens
gggaagctgctggcctggccctcctggtctctcttcctttcctggtctctcttcctttccttgctctcacccacggataaaaccagaagcgacaggaggccagctcctggggttcctgggagccgggaacagattggctacggaacgccccaggttgtacattcagagggctctttctccatgggagctcctggtgccgcctcggccccagcctgtccccagcccctcaatctggtgcagcagcatcttgtcactgcacaacagtggcctggtcccccacaggcagttagggccccaggtcagacctcaccatgatgatttgttccagttctcccagggcagaggggcgagggagaggcttttgctgtgagagtagccgtcacgtgtctcttcccagcagcgccgggcaagtgggtgctagagtctgagcctcaggctctcctgccctgggcctcccaattggtgctatctgttactgcccgtgctcacggacatggatacagaccctgctgtgctccacaccctgcaggcgcctcgggaagcgcccaaaggattccccttcacgttggtgcacctgctccatagctccgggcgctgcgtcccgaggggccacagtctccatttcagcgtcttgcatggcctggcaccgggtggggtggtatgccccaggacccttgtttgtgtcaaaaatgactttccctgcccttgccgtgggtccggcgttcctcccagccgggatcacagtgggcagccggcacccggcaccactttggcgagcgtcctgcttccgccctcgccctcatctacgctgctccgctttcctcagacccctttttgccgtgcaaagggaattcttgacattaaataaaaggtatccagattgcagactgcatgttcacagagctgggggttctccagcttgcctacagtaaagcctcaatgaactggaatccaattcaatggggtatttttttttcttcattctgctttttgaaggagacaaatcttaagaaagcaaattgagat

SEQ ID NO: 128310 - DNA, 1037 bp, Homo sapiens
aaaaagcatatgcacgaagtattttcctaatctagatcatggaaaggtcagaatgtcttttggttgcaggagtgtgaggagaggggagacgtcacttgagacatgggtttaaaacacctggccgggcgcggtggctcacacctgtattcccagcactgggaggccgaggcggacggatcccgaggtcaggaatttgagaccagtctgacgaaaatggtgaaatcccgtctctaccaaaaatacaaaaatcagccgggcgtggtggcgggtgtctgtaatcccagctactcaggaggctgagacaggagaatcgcttgaacccaggaggtggagattgcagtgagcggagatcgcaccactgcactccagccagggcgacagagcgagaccccgactcaaaaacaaaaaaacacctgagcacaaggctcagtgtgatccctttattttaccttcaaggggctgattcccaaggagacctagggactgagctagtgagagccaagcctctctgctttcctgtatcctaggctggtggataccactgcaccaagtacccctcagctacaccatgagtcgccccaagccctggcacaggttgctggagcatcccatagtgagcctcatccccagagctgatcggggatggtgacactcaggatgttagcctctgctggctcccaggcagcgaagatcctcagtgaagaccctggagtccacatcctgaagcagaacaggggttttgctttgggggtggatttttattttccttctgagaaaatgtagtttatgtagagacaaagtcttgctctgccattcaggctgagtgcagtggtgcaatcttggcttactgcagccttgacctctggagctgaagcaatccggttgggcgtggtggctcattcatgtaaccccagcactttgggaggctgaggtgggaggattgcttgagaccaggagtttcagactgcccttccaacatagtgagacccctgtctctagagtaaagaaaaaaattttaaaaacagagacaggccagg

SEQ ID NO: 128311 - DNA, 1005 bp, Homo sapiens
ctgttgatatggaaactgttcccagtttctaaaaagccaaataacaggtgaacttttggaataaaatcacttgccttttggaaccatatttcttttccccaacaacattacatgttctttcctcagcaaaaagtctgagttgtacacatttttgaatccctcaaagcatttagcagagtgctgggcatacggaagacagcaggatcccgtggctttgcctgaaacgcggaacctggtcttgacttttgagtgactgagccctcctggtgcccgcactctggccgggagtgccaagcagcgttctccctcccgccgcacgggggcacaatgggaagcctgcacagtgaggaagagcggctggagccggtcttgtgccggggaggtcgctgctcccagaatgcacctggcatcaacacggcggcggcggcggcggcttccaacaggctctggggcgccgagcggacaggaacgcagcacgggggctccgaggcggggtctgggtgttgaggggcgactggagccatggcggagtcggcgcctgctcgggtaaagaggcaccggcgcgctggctcgagggcgcgttggggatggcggagtcccctgccgggggcggggcttcgcggtttggacgccgccggggtcttggtttcccggggctgccgttggcgcgggtgaacgcggaccctcctcttcgcgaccccagtgctctgcccttttttccctccgcttccttctgcagcggggtcggagcctcggcgccgtgcgcccttgcccagaaacttctctgacgcttgctttaggttggtggatttgtgaccctgcccacacattttctctttcgtgccaaaagagcccgttcccaggttggagtgtttccagattggaaacggtctccgtcgctacgagtgagctctcccgctgcccgggagaccccaggacttgcctctctgcgaccacctcctcttcggtccgatgtgttgtcggtttttccagtgctgcagattt

SEQ ID NO: 128312 - DNA, 1040 bp, Homo sapiens
taagactaacggccacatcaatcattattcttcatgccctacagaatagagtaccgtacgaggcggtagtcaaaacctgctggagattgagcgtaggtatgtcagagcttcaggagggaaggcagtgcaggaaaagcacttgtcagtaggtaatttgggaggttatggaggaagaacagagctggacatgaattcttaagctgtaggtttagtttgtctttaatcattcaaatttgttattttaacactcttaattgagtatagttgttacagtgtattctgtcatttttcacagggattaaatataaatttgtagacaagcttggagaactatcatttacagtattgttttataagagtaatacatttatatttccaatcaacattggaaaaactgtacatgaatatagttttatagaagtcttggaacctagccagtgtcatcctcctccacgttatcctaattcacttattcctggggtgcttctgaaattcacagatgtttgtttggtcctgaagaaaccaaaggtactagaatgtgatcttttttgttggtcttcttccactttgcagcaggtggggtcatgatcaaacaggagctacagtatacacaggaaggccctgcggatcttcctggagagttctcatgcattgctgaagagcaggctttcctgagcccagagcagaccgaactctggggtggtcagggcagttctgtcctcttggaaacaggtcctggggactctactctagaggagcctgttggtagtagagttcctagcagcagcagaactgtgggctgcccgaagcagaaatctcataggcaggtacagctggaccaggaatgtgggcagggcctgaagctgaaaaaggacacttcccgcccctacgaatgttctgagtgtgagatcaccttccgctataagcagcagctggccacacatctgcgcagccactctgggtgggggtcttgtacacctgaggagccagaggagagccttaggcccaggccacggctgaaaccacagaccaaaaaggcc

SEQ ID NO: 128313 - DNA, 1027 bp, Homo sapiens
ccaagagaggttctcacccaacagcctggttgccctgcctggccacatcccttggaggaaaagccggagttccctcatctgtggttactgtggcaagagcttcagtcacccatctgacttggtgcggcaccagcgcatccacacgggtgagcggccctacagctgcactgagtgtgagaagagctttgtccagaagcagcacctcctgcagcaccagaagatccaccagcgggagcggggtgggctggccctggagcccggaaggcccaatggcctgctttaagggtgcagcccctcgcccgtctgggggatggaggggggtggcattggttcccccgaagagacactgcagtcagggactgagttcttcctgagggcagttgtttgtgattgccttcccttgtcccagtaccaagccaagcccaaaggctgtcctgaaaaccctgtggaagaagagtccaggccaggtcttcatcctgctgccaagtttgctgtttcttggcaccttcaggtctctggttttctcattcatgccaatgcttgtgggctggggttggcgttctgaccccacagggactggtggctggttccagggctcgtcccggcatttcatgtcttcccacggggttgagtcgggccataggggtgagcagctgcctggaagagttctgggaagtataaccctccattttttcttgttttataatctctttgtttaataataagtagaagaaataatttaaatgaactgcttagccctgctctgaagaaccttttttggaattagattttagttgattttttaaagaatacagcccaacacttgttttttacattttaagagttgtagaagttgttcctaacttggggactggacctaccctctaggagggagttgttaatggggctcttttagcccactgatgcttacttaggccggagagcaggggacacggtgctaggttccctcgtgcagtgcctggtgctctcaaattgtctcaaaaggaccaagaggaaaagagtcgga

SEQ ID NO: 128314 - DNA, 1036 bp, Homo sapiens
tgctattgtataggtactattattatctccattttctagatagggaagggaagttggaagctgttgaaaacaccttgcccacagttggccagcttgtaagtggcagagctgagttgcacctgggctgtccactggggagtcatgttctctgtgccacaaagccttgtcctttcatttttagaagaggaaactgagacccaagaaggggagtcacttgtttgagactgcacgtggttgctcaagcctgtggggcatgccccgtctccatagctagcctgtaggacaggagccggggctgtttttcttccactttcccacttgctgacacgttggtccagccactatctcttgtatcagttaggctggattcctaactgataccctagcctctccctctcccccccagtctgctgctaactcaggagcccagatgggactttaccatggcaggtgtcatttccgaagtgtgtttttgaggtggaagttttgattgtataattctcataacatctctcttttctcttcttgtgagcaggaccccgagacagacaagcacacagaggaccagagtccttcgacacccttgccccagccagctgctgagaagaactcgtacctctactccacggaaatcacactgtggacggtggtggccgccattcaggccttggagaagaaggtggattcctgcctgacccgcttgctgactctggaggggcgcacggggacagccgagaagaagctggccgactgcgagaagacagctgtggagttcgggaaccagctggagggcaagtgggccgtgctggggaccttgctgcaggagtacgggctgctgcagaggcggctggagaatgtggagaacttgctgcgcaacaggaacttctggatcttgcggctgcccccgggcagcaagggggaggcccccaaggtagcaccgggacaccctggggtgggggagctcgaggggctgagcctgtgagcgtgtgggtgagtgagtgcgacacttatggttccaggtgcccgtgaccttcga

SEQ ID NO: 128315 - DNA, 1324 bp, Homo sapiens
tctgggaggcgggcactgattaaacatgtatatagacacgggttctaagaagtaggcgtagggatggagttatcttgaaagacaacttctgaggggaaaaccttgacgctcctaacgccatatcttcagttgtgtttctgccctgccttgggtcccctatgccataagagcagcttggaggaggaggaggaggcccgactgcgggaggtggtgaccaccccactggctggtgggacaggcatggtgtttctctttcctgccttaaaatgccagattctgtcatgacctgcctggcgatcattaccgtgatttcctgtctgctgaattcctgtgctgcagtttccttctgtgggacatgaggctttagactggaatctagctgccaggtatttggtggggtccacctcactatcatgccctgtgctggagctgaggccccaggatcgcagtgactctgcctttccccagagggtccctggtcatctgggcaggagacctccatgttgtgctcaatgtcactgatttacattctccaggcctccctccgtatccagagcacctcaccagcccacttagccctgcccaggaggagctgaaagaagggcaggcccccaagcagcagcaggactcagaggcgagagtggccccagccgggccagaagcaggtgagtgaggacagtgaggcggcaggatgaacagtgtcccgaggcagcacgcgatcaccaagcgatggtgctgaggaaaagccctggaagcatggggctgggagagagggctgggagactggttgggctgggccggacaggctttctgggaaagaggcccctgagacaggcctaaaagaaggtaggttttggcattttcagcgtgagaaaacagtctgtatagaggggtgggttcctctgcgtgttgggggcctgggcacatgggtccggtggagtgaggggagggggtagatgggtgtgttgtgcctgcccagggtctttacgagggtcccatccacggggcagtgtgtgtcctgtgcctagcgcggcgccagcatggtgtttctcagtaaacgccctctttctgaagacctactgggaactctggctttagtcatccttccagacttctttgtctgcttttatttaaaggcagtccctgcctgtcctttcacaaaagtgtatatcagggcatttagcggaacacttgcaaacagtccagagctctgttctctgtctagtgttcctctgcggggctggctcctccacctggtcctgccgctggcccgactttcagtctctggttgctttccctgtggtgatttctgggtatcttcccc

SEQ ID NO: 128316 - DNA, 1273 bp, Homo sapiens
gcatgaggtctccttcatctgcagcctgtgcggcaagagcttcagccgcccctcgcacctgctgcgccaccagcggactcacacaggcgagcggcccttcaagtgccccgagtgcgagaagagcttcagcgagaagtccaagctcaccaaccactgccgcgtgcactcgcgcgagcggccgcacgcctgccccgagtgcggcaagagcttcatccgcaagcaccacctcctggaacaccggcgcatccacacaggcgagcggccctaccactgcgccgagtgcggcaagcgcttcacgcagaagcatcacctgctggagcaccagcgcgcgcacacgggcgagcggccctacccctgcacgcactgcgccaagtgcttccgctacaagcagtcgctcaagtaccacctgcggacccacacgggcgagtgagcgcgcgccccgccgccgccgcccggccaggtgcgcgggccgtgccccccctcggacaccgccaggcccgagcccagcgggcgggggcggggcgccccccagcccctttgccgtgagctccccctctcctctcgtccctcctcccaaggacatgggggcagtgagaccaggtcccttgctgccgcgtttccccgggggccccaggggggagggcgcggacctggggaaccctttcgggctgttaatttccttgacaataaaatggatgaaaccaatcagcacggggggcgtgatttggccgccggccactcagaggggcggtgtagggcccatctagttggggatagaactttataattaccttttggatactgtggttctatttgataataatagagtaatttttaaaagaagagcgtttcctgtttgccgtttttgtttggtttgaaggggagggattgagaaggccggagggacatacgctagtgtcagttgacaggttctgttgggacccttttttgtgttccttctccatttgggtggtgagggagacgctgatcccgccggttctgaaatggaggaggagaggcaggactgacgtctaagggaccacgggaaccccagaccatcgcgtctgccctggagtccatgaggttgctgggagctcaggactgaataggtcccagttgactagcgtggtcaaggagagtgacggtcaggtttggaatgagctggaaagaaggtcctgtagcaaaagctgggcgctgccttcagtgcccaggcgttcctgcgtagcttgaaatgcagctggctgaggagtagggtggcgggagggaagcctag

SEQ ID NO: 128317 - DNA, 1078 bp, Homo sapiens
tatgaaaaagcaacagactgaaacatggatgtcctcaagaagggctgctgacacctatgatttggcaaggagataaataacagaatgtgcaaagggtcataagagtgcagacaccctaatgtctgttggctggaaggtcagagcagttcaccagtgaaaatgggatgcctggaccgaggtactccccacaggcaagcatggcccttcccttcctcctctcgccacctgtaccttccgtggaggctgctgtgttgagcttcagggtcccgtccgagcatgctgaagagggatggtggggagggagatccgtttgccaggaggtgggcgggatggtggtggaaaagttggaatggacacctgcggtaaggggagagcagagccggtgggttaggggacggacggggaggacagaagactgttggggaggagagcaggctaaactctgaggtccccccactgggggcttttctgagtgggcacgaggacccaacctctctgaacccagtgtcttttgtccccctttctgaggcactgggaagctcagacatcatcagtatgtttcccacgggcccctctcgaatagaggcagccagtgacttcaatgcccaatgctggggcaagagaagcggcctcacggtgatataggggccactggaacagggccagagagacacccagggacagcatcagccacccgagagaggctcgagacaagtcctttagtacagtcctacctcgagacgggaaaatttctaaagttgtcaggccggaagtgttgagggcccacagctcccccatgctgccacgagccctcccctgtccctcctgtgatccctgcaacttgttccttatgtccccgtctcagccacttaccagaggtggcatccgtggagatgtctcctgctccggaatccagctggctgaggccccagggctcctccccaatatctggctgcccggctgcccacgcctccacgcccagggcctgctgctcctggagctggagctcaccctcctgcttgatctgcatcaagaggtctggggcgggaactgggggccccgagcctaggaaagggag

SEQ ID NO: 128318 - DNA, 1713 bp, Homo sapiens
tgaacctcttggacccccgtcctcccctgatcacaccccttccttcctcttatagtatacataaactgaaaattcagaaatagagtcccttgcctttctttacatttttattccctcagtatgtatcctaagtaacacatttagttttatctgctttggaactttttgtaaatggaatcataccacatatgttcttccttaacctgcttttctcatttgccgttatgtttttgagagccatccatgttaatgtagtatagctgtagctcattcattttcatgattttcaccactttacagttttgtattttgtgaccataatacaatgtatttattccttctactgttggtgggtgcttgtgttgtctcttttcttttcttttttttttttttgctggtgtgaacattcttatgcatatgtaaaagcttctgtaggtgtagatccaggagcggaactgctgggtcataggaaagaaaagacatgtattcaaatttttccaggtgatgtcaagtggggataccaactggtattcccaggagggcctgggggttccaatcacacctcatcctcaccaccctgggaaatgctgtttttatttctgcccgtttggtgggagtgaaatggtttaaaatttatggtttaaaacttggattttcctaattaataagattgaacattacatcctctactggtgagccgtttgtccttcctcttctgtgaaatgcgtgtttatgtcttctttgcatttttttaagttgttttttgttgacagagtcttgctctgttgctcaggctagagtgcagtggtgcaatcttggctcactgcaacctccgcctcctgggttcaagtaattctcctaactcagcctcccaagtagctgggactacaggtgtgcaccaccacgcccagctaatttttgtatttttagtagagacagtgtttcaccatgttggccagactggtctcaaactcctgacctcaagtgatctgctgcctcggcctcccaaagtgctgggattacaggcgtgaaccactgtgcctggcctgttagtgttctttacgtattctaaatattaacctttttgtcaactatgtgtgttgccgttatcttctccatttgtggtatattttaaagaacagatgcttttcattttaatgtacttggatttactagtctttcctttatggtttgtcctttttgtgtcttaagcaattaagaaatgtttacgttcttcaatgttgtagtacaccagtgcaccttctcatatttcctactaaaggttttcagagttcgtctttcatgttcaagttcttcatccttcagaaatggacttttgtggtgctatgaggtggagaccctgcttctttttcactgcactttggttcttcttttcctttgctctttcagatagcccctcaaactgccttatcaagttccatgaaaaattccagttggggttatggttgcaattgcattccatctattaacattttggagagaattgacacttttactatattcagtcatgttatctgtgaatgtcctaagtcactccatttggtttgtctatagtgtcgcaatgaagttttatattaaggtcttgcacatattttgttagatctattcctaggttcttttttttttttttttaaatcacttttgtcagtggtatctttttttaacttgcattttctgtttgttgctgttggg

SEQ ID NO: 128319 - DNA, 1155 bp, Homo sapiens
caggggccaggggcaccagcccccagtcccacgcagccaaaaatctatgtataacttttgactctctaaaaagttaactgctagtagtctcctattaaccagaagccttattgatactatgaacagtcaataacacatattttgtatgttctgtgtgttacatagtgatacttacaataagctagggaaaagaaaatgttactaggaaaatcataaggaagagaaaatatatttattactcattaagtggaagtggagcatcataaaggtcatcctcctcattgtcttcttcagattgagtaggctgaggagaaagaggagtggttggtctagctgtctcaggggtgacagaagcagaagaaaatccatttataagtgggcctgcatagttcaaacccatgttgttcaaggtcagctgtatattgacaacaaaattaatccaaagctttgcaaagagtcagccttgcctccaagaaccaaccttaatttaaaccagtagcagttgtagagctactttggtctacattggtcagccttatggtttggtattattagaagcacacatttatttaaggtgaatcttgttaccagatatcagcgtctcagatttccctggagccagtcagcacctttgaaagttaagggaaggacaggtggacacaggagaaaaaccaaattcctaaagtgaagacctgctgggtcatttgactagggagaccacatctctgcaaggctcgacccctgattcctccagaagacccgcccttgaccgtcccacctgccttggttttccctttcgtctgacactgagaaaggtggtggtccgcagaggccctcctgtgcgccacttgtgtgaaattaaatgcatcccccatgttcgtcatctcatctcagtcagatttgcactttcctaagggcagaagcatgttccgggctggccgctttgccagtcgtcatcgggacattgacagtttagctctacagatgcatttttaagaatcttctaggcgtcaaggacagtgctgaacactagaggacagaaagatggctgagaacagatactattgggctggaaaagagggttacaacccgtgcgcgtccccagcttcctagcctgggtgggaggttctgggtgggtgggtttcgttgtattta

SEQ ID NO: 128320 - DNA, 1442 bp, Homo sapiens
agctgttttttttgctgggtcatcatcagtagacagttcctgtgtaatcatgaggggaggtgcaggctgcgctctagtaaatctgcagtttaccatttctccactaaaatgcccagcaatgctaagtcactgtttacgtaacaaaattgcactgggtacctgccatgtgtcaaggacagtggtatgaaaagatgcaataccatgttcagggagcccacagtgtaggtgtgggtaggaaattattgtgtagggtgataagcaccgtgataagggtctgcattgtgctgcagaggcctggagtaaaggcacccacccagacatagacctaacatacccaagcaggtgatggccaacctgagatctggcatgtggtataggatagccccacttgtccacacatatggactcccagcccaactcccccgtgcctagggagagaggggctcaatgaagacagtggatggaatgagtgatgccagtttctcttttgtttctgaaagatttctccgtggacgatggcagccacgattcaggccatggagaggaagattgaatcgcaggctgctcgcctgctttccctagaaggtcgaaccgggatggccgagaagaagctggctgattgcgagaagacagccgtggagttcgggaaccagctggagggcaagtgggccgtgctggggaccctgctgcaggagtacgggctgctgcagaggcggctggagaacgtggagaacctgctgcgcaacaggaacttctggatcctgcggctgcccccgggcagcaagggggagtcccctaaggtagccctgggacgccttggggtgtgggagcccaagcggccaaacccgtgagcgtgtgggtgagcgagtgtgacacttgtggttccaggtgcccgtgacctttgatgatgtggccgtgtatttctccgagcaggagtggggcaagctggaggactggcagaaggagctctacaagcacgtgatgaggggcaactacgagacgctggtctccctgggtaaggcctgacactcatttctctgttaaatgggattttgcaagtcctcagaattctccctccacatagttgttttcatgtcagtgttatataaatcaccagaaacattgttgaccttgcaagttgttaccttttgtgaaggatgagccctgggtgatggagttaaaagctcccttctccctgtgttgagtttcccagaatgccagtctgggaacggcggtggcttctctcctacgcaggcccgggatgtggacctttctgttcttgctgacttggagcggggaaggccccatctgctctcagatccagtatgtaattgactcacatttgagaaagactctttccttcagccttctcctacaaacatgcgtggcccttacggcaacatgcctcgaggtcagtggagaacatgggcagacggtgctgc

SEQ ID NO: 128321 - DNA, 1128 bp, Homo sapiens
actgtccttgacacatggcaggtacccagtgcaattttgttacgtaaacagtgacttagcattgctgggcattttagtggagaaatggtaaactgcagatttactagagcgcagcctgcacctcccctcatgattacacaggaactgtctactgatgatgacccagcaaaaaaaacagctggttcactgaaacggcacaaacaagagtattgctcaatttcttttttctttttttgttttttaaagcatctcatgtccccttttaacaaacataaaaatctaatggccagttcctcttcccccaggacagtctcattttgtcaccttcccatctgcccctcccccacaagctaaaatccccatgactgcaaatctccatcagtccagagttaggctttttgacactgcctgagccctacaagattctttctctttcccaattcccaccccctcaaggtaaaaatgacggcctccgacatttttgtagctgtaccaggagcagtgacataccctgcagtctggtgaggaaagtacatatatgccacagttagacttgtatatggacagcaaccatcttaattagagacgggggccttccctgtcattggaaatgttcacatggcgtatcagtgaccggcagctgggacaaggaagaatgggcacattttgcggtgggtagggagctggactgtttgagccacccacatctgaatgtgggacctacagggcacagaggagctcctggtatcgggacctgaggatcaacgcctccttacaacattctgcaaaataattcctcaacaaaaggttggtgattatttccaaaatgaagaagtagctactagaaaccagtgtggattcacttagagaaagtcactgagaactagaatgcggatggacagctcaaaaaatagagacaaaaggagagtttgagcagagggagaaacaaacttgtctaggacagtgcttaagatactatctatttggaaggaagcaggacccaaagaaggtaggactctaaggggtcttcaaggctgggagattctggacaagctgaactgtttctaggcgaaaaccccaatgcgggtgggagtcttgctctcaaggagtaggtggtcctacagcacc

SEQ ID NO: 128322 - DNA, 1789 bp, Homo sapiens
ccctttcaataaccgagtcctcgggctgggccgcggggccagcgcagtgactccccccgcgctcggcagtccggccggggtcgcggggtcgcggggtcgcggggtcggcccggggtcgctaggtcctcccgtcgggccccgcgggcggggctgggcggggcggggcggggccgcgggcaggcgggcgcagcgcctgccgttcgcctctcaggctgcaggtggggctgtgcggccgcgctgcctccaggaagcctcacgggccttcgtctgccgggccgcggcgccggctcccaggatgcagtgtggaccggccgggcgctgacggaggcggcgcgactgcgggcggcgcggcgcaggggcagccagcgaggagcggcggcagaggaaaggccaggcaggcgccgcctgcggagagcaccgggcggccgggcctgcgtggtgccgcgcgcggcggcggcgacgacgacttcctccgggccgggcgggacagcgcagggccatggccgaggcggtcgcggctccggtaagggcgacccgcgcgcgcagggactcgcggcctgggggccccaggcggcccggccccggcacacggcgccgcaggccctggggaggggttccggggtccgggccggaccaccgggcctggggctcccgcgaatggggcgcggggtccgccggggcctactgcgcccgtcggccgggcccccactccgagccgaacccgagcgctggcggaacggttgtccccgccccgggccgccccacgccaagttctttgggccctccggggcttcctgcccccgccccagccgctgtcccctccttctgggtgcccccccacccgcggctcctttctctgcctggcgctcggcctgtaggtccctctccatctcccccgcagcggcctggtggcacctgggaggtgtccggcttcgaatccgcatacaccgactcccactacgtgcccagcttcccggggtcggcgcggaagggaatatagagccacgcacttccacaagccctgttgaggcgttagtctgtcctcacagcaagcctgtgggatgggtactggtgttaatctctgtcatacaaaagaaaaacccggggcctagagaacttaacttgcccaggcttacccagctggaaagtgtgaaaagacacacagtggctgtgtgttcaaggaccaggcaggcaggtacgcgggcaataatcgtgcaaaacagaaaggggtgagtgctggcgcccaggtggaagcttgcggtgggctccgggggaaggagtgtcagggggcctcttggtaccgctgtccacccctcctggcctgatgctctgcgcctctgtgatttgagccgggcttttagggaaggctaggatttcaggcccagctagaccggtggtgctttcagggagggaggagtgcctgggcaaaggcgcagagagacgggacagtgcagggcgtgtgcaggcacagaaaggagtccatgagcctggagaagatggttttggtttggaggcagtgggaaaggagtctgcagagagagactaagaaggggtttgcatgcctggacttcatcctgcgggtgggcagtggatgagggatccggctcctcttaccatcagctcctctcaagcaaagagtttcagctcccctggcaggagtccaaggacagccccacatattccagccacttgtcagtaagaagctgggctggagtgagcagcgcacagtcgccacctcccaccacatagtgtgaagaccttacacagggtttcctggccccatcagaac

SEQ ID NO: 128323 - DNA, 1075 bp, Homo sapiens
aggttaggtttggctgaggtctcataactagtatgaaacaaggcagggattggaattctggcagcctggctcctgaggctaggccccagtcaccgtgctctgccccggtctctgggtccggaacctcttaatggccacatcaggtcagcagtggtaccagtgcaaccaacatagctggtatcatgttcttacctagagctcagacctgccttgccagctctgtgttgagccatcagaatgtcatgtgggaaccctctgcctgccatgaaccaaaattccagactcccagaaggaaagcaggggtgtggcacacaccacgtcatttgctcagcctaggcaccttgagccactcccatcatttagggaatggtgggaagcctcctgacacctaaatacctggaagccagcctgagccctcctggcaagcaggccttcctaaggacagcggtctagggctgctctgcacgctcttctgcatagaccctgatgttggctacattttctctgttccaagatgctaggaagaaatgtaaataactctttgagagaagttttggagggtgtctgagactgttcctgagagggagtgaccatacctgggccagagccacagaggtttgctcagggagagtctgcacatcgaggcaggaggcaaaggctgcagcatctcactgcccatcagcctctgggcctccgggcctcaggcaggcagtcacgggaggggctgccccttgccaggggtgtagatgcagcctggccagaggggagcactggtaagtgtgactgcatgggacaagttatcagctgttcagggagaacaggcagagagcccggcagtaagtggacaacaaggctgccggttagtggcagggacagttttttgtttttcttgaaacaggggctggagtacaatgttgtgaccttggcacactgcaaattctgccttccaggttctcctgcctcagcctcccaagtagctgtgattacagacacccaccaccatgcctggctaatttttgtattttattagagatggggtttcaccatgttggccaggctggtcttgaactcctga

SEQ ID NO: 128324 - DNA, 1341 bp, Homo sapiens
tggccctgggcattccttggcttgtggctgcatgactgtagtctctgcctgtcttcacacagctttcttcttttgtgtctgtctctgtgtctcttctgataaggaatgagtcatactggactaagggtcccccctacttaggagtatgacctcatcttaagtaattccatctgcagggactctgtttctaaataaggtcctacttacaggcgtgagggttaggacttcagcgtgtctctgcagagacacagctcacccccagcactgtctcttgaggggattcctgcatgtcagaccctggctattatcctggagtgtgcgcctggaggcctaggtggggttaccaagtgcagggacagctaggctgtcccctctgggatggaacaaccaacccccccggagactgtgcctgcaggtgtccatcaccttcaaggacttggccgtgcggttctcggaggaggagtggcggctcctggaggaggggcagagggagttctaccgagacgtgatgcgggagaactacgagacgctggtctctgtgggtaaggacgggagggagcagcacgtgtggcaggagcctggtgggcggtggaagggaggccggagtccctggacccggcagccttagtctttccacctgagaaatgaacacggggatcgttcacgctgctgctattctatgtcccgggaccgggttctaggtacaattcggtgggggtatgcggcggcctctgaggttccgaccactctgcggttctttgagtttaagtggtcacatgaatgtgcacagacctgcaggggcctgggctgctatgcaactgtgtgcgaagcggagaccactccattcccagggccacagttccctcttctttcccagggacagctgagctgctccccctctctgctttcctgtcaccctcagagcctggaagagctgttgggggagggagccacgctgatgaggggcaggagcctgctggttgtggagatccccagggtaagttatctgtcagactttgggtgtctcctcccactcatcggtcctcagccccaggcaatgcgtgacctcagcctactcagtccagcctctcacctccctgcctcccctactgcaacctcccaagctttcacccctcatccctctgggctggaagcctgttatgcagagaagcactcagagaaagcctggggtcaccctggagagtacctcctgcctcaggccccccacccaccaccaccctgaagccttatcacagccacccctgcagaacctgctccagctcccaaaagtcctgccacgaggcttacatcccaagacctcagatggtggatgtgctccac

SEQ ID NO: 128325 - DNA, 1076 bp, Homo sapiens
cggggtcgggaagatcattgtttgtgtccatccattgggtttctccagtggagaagcttcttgagggggctcccgccgtccactgctgctgcttggtttaacttccagcagaattccttcctagatctgctgcagggcctgctgggatgcctttgctgaataaatgcggttttgctgaccctcccatcagacgaggatgggccctaactgagccccacccttgggctgctggcccctgtgagatactggggtgcagggatggcacctgcctggtgggagaagccgcctggcctgtgagacctaggcctggctagaacctgactgctaatggcttccaaggactggagacttccagaaagttccccagcagactttccaaagctgctggggtcctggccaggctctggcttcacttttgtcctctttctctggcaagagaggcagccatttagggtccactagaacgcatgctgatcgtgggctgagctgaaaaggggaccggttctgtgtgcccagacactaaggcagagacctggctctcttcaggctgatgacagagcactctctggtcccctgcccagggtctgcccccaagccctccccgctgcactgcctggagagcgccctgagggggatcttgcctgtaaggcccttgcgcttcgcctgcgtgggaggccccagccccagccccagccccggctccagctcgagcttcagcggctctgaaggagaagacccgaggccagagcctgatctctggaagccgctcccccagggtgagcctgtgcggagagggaggatagcgggatgtgtgccagggcgccagtcaccactctgatgccagctttgtttgtgacgttagagagggaccgccttcccagctgtaagcctcctgtccctctgtccccatgtcctggtgggacccctgctggcagcagtggcggcagccctggtgaagaccccaggagaacagagcccaggtactgcagcggcctcggtgcaggtgagcctggggtctcctgagggggcgcccatgcgttccccagaggaccaggagtccagactggatcctttga

SEQ ID NO: 128326 - DNA, 1034 bp, Homo sapiens
ccctccatcagggacaaacggtcaagactaatagaaggttatacaggaccattcaaggtggagactctcaaataccacgcgaagagcaaggcccacatgttctgtgtcaatgccttggcagcgagggaccccatctgggcagcccggttccggagcatcagagacccacctggagatgttctggccagcccggagccgctcttcactgcagattgccccatattctaccccccagggcctctgggaggatttgatagcatggctgagctcctgccaagttcaagagctgaactagaggaccctgggggggatggagcaattcctgcaatgtatctagactgcatttcagatttgaggcaaaaagaaatcactgatggcatccacagctcctcagacattaatattttatataatgatgcagtagaatcctgcattcaggtaatacgtttataatgattgctgtatcttacagagaaggattctatactgagaacgatgtatatccatgctgatgatggaaaaaagaatactagtgataacccactgctaacatcataatgttggcatataccaacatgcttatcatggactaggcattgttttagacgcgttccatgtattatctcatttaatttggacaacaaccctattatcatctcctttttgcaaataacgtaattagtgagatagaacatttctacttctggtataaaggaaacaatcatctttattcagaatccaaaataaacacagatctcaagaaatagcctacaaccacaaaatcacagagctcttaagtagtcaatatttaaatttgttttgtttaagagacagggtatggccctgtcacccaggctggactgtggtgtgatcatagctcactgcagcctttacctccaaggctcaagcaatccttcccactcagcctcccaagtagctgggaccacaggtgtgtgcccccacacctggataattttttatttttcgtagagatgggaatctcactatattgcccaggctggtcttgaactcct

SEQ ID NO: 128327 - DNA, 1058 bp, Homo sapiens
ggaaagggcgcacccaccactccccacagtcagagaggctcacaatatccttgacaatgctttccagaaacatccctggtgcccaacttcctggctccttcagtctcagctctgtgactcctctcgatgggcgcaggctggagccacagcccctggccctcagccattctctttccaggtcatgtgtccgtgtctggctttggaatgaggaagagctggctcctgctctgggggctttcagccggagcaggcagccggaatcacactttcatatcctgtggcttatgtttattgtattcctgatttattgattttagatattctctattgattcctactgtggaagatggagatacggccctgttacatcacctgggcccccgcttctcttccctccatcctctcagaacaggtacatcacactttgttggttacattggtataaattatttgcccagttatgattatgtgtgatttactgctgaacaaggtggtgtattgtgatggtgttgccttcattgtcggactcttccccctcgaattggaaaattttttcttctttttcatttttctcactttctttaccctcatcagttcttcccagactgtccagtggaattataaaactcctccgaagagtcttttccacgtgacgggacatcctgtgatctctccatttcattctttctctggagacttcgctccggggccttctcctcccctgctctgtctgacccaggcagctgttaggcctgcggcacacctgtggtctgagatgtgcctttgtctctcccccatttcccgagtctgtctcttcttttgtggttgacgtcttcatcttcttagtgtacatcctccagtggcttcctaaggaagggtgcaggggaggccttctttctgtgacgcatcctgtctaaaaacatcatattcttccctcatgattcagtgataacttgtttgggcatataggattctaggttggaaatacttttcctcagcattttgaaagcattgcccttttaggttttactggtgctattgagaggtctagtgccttc

SEQ ID NO: 128328 - DNA, 1068 bp, Homo sapiens
tatccaagatacccagaagatggcattagaatatgtttcagggatgctaagaaactttaaacttaataccacgagagcgtctttggaggtccttgagagagccattccttccacagtgtgctcagcgccagctgggcggcccacctcgtgcttcctgtaggcagcaagtatctgggggtcacctgctgctatgctgaggccagctctaaggacacatatcaacacaaaggtgtccaagaacattcatcttaccagatacccatgaaacacttcgcatccctcaggctgcctgtcggtgcagggtgggaatcgttagcgacttctctcgcagcagcagcagcagcagcatcctggcggcttcagtcctcccacctgactctgcttttcctttcttccccgggacctatcactttataacctaccatgtcatttacttattatggttgcttattgttttctgactcccagctagagtgtaatcttggcagggatctgtgtgtttcgctaccttgtgtatcccaagtgcctagacaataaatctatgttgattgagggacttagaatacccagtcaacaaggtacactgtctctaggcaaagagatggtgtcagtggagctgatgacagtgctgtggccagctccacaccagattaacaaccagcaggttgacagtggccacccggcttgtggcatgctgggacccaaatgggacccaaagaagcctctacagtcaggtttagggtgtagacagtgccgcactcggtagttgagctcgcagcacgggtccactggtccagtgtggaccacagtgaggtgccagagcaggccataggaggcatctgagaggaacaaggcaagacgaggtgctttctagacacctgtagacatcatttcagatatgatagcgatagaattggatagaccaaggctgagattaatagctgagttgcagagaaagcagacttacctgtccgaagtccaagtgtaaccatgtctaacatgaaagacgatggaatgtgaggcttgatgcatatccacactagagtaacggtgggggcggttctgatc

SEQ ID NO: 128329 - DNA, 1031 bp, Homo sapiens
gcgttagactgccgggagtagcacccagggctctgctcctgttccccgagaagggctgttctcacttgtcctccagcctcctacggagactgcagttagtgatgctgaaagtgcctcccctgtggggctaggaatgaaaagctatagacacctttttctctgagatctttgcaaacccaggcgctttagaggaaagaacactggcctgggagtttaaagacctgttccctagtcttgattctgctgttggcttactgtgtcaccttgggcaggtctcgtcatctttgatgtctcacagttgcttcatctgttaaacagggagctcagtgtctgtttgtccagcttctcagagttgctgtgcagctcggatgtggcataggaaacagcagacacagggagagggcagcataaggcactgtagggagcagtggccacattttctggtgagtcctgtggcaggaatgtttgtgcattcagcactggagcatttactccctgtctgacactggggtagctgccatgagggggattctagtatcagagtccctcccttctggaagtttccagggcaacaaagacataagacaaacatccttgaaatgttatctaaaaacccaagattgaaataatacataccacacaaggaaacaggagagtagtctagctccatgtccggggctctaggggttcatagatggcagctcctgtccggggctgaggttgggaggggagaaacaggggcagagtgagttggtctctggagtgactgtgcttttccaccctcagcagaggaagaaccgatgctggaacgtcgttgcaggggccccctggccatgggcctggcccagccccgactcctttctgggccctcccaggagtcaccccagaccctggggaaggagtcccgcgggctgaggcaacaaggcacgtcagtggcccagtctggtgcccaagccccaggcagggcccatcgctgtgcccactgtcgaaggcacttccctggctgggtggctctgtggcttcacacccgc

SEQ ID NO: 128330 - DNA, 1881 bp, Homo sapiens
cccctccctctacagctgcgacgactgcggcaggagcttccggctggagcgcttcctgcgggcccaccagcggcagcacaccggggagcggcccttcacctgcgccgagtgcgggaagaacttcggcaagaagacgcacctggtggcgcactcgcgcgtgcactccggcgagcggcccttcgcctgcgaggagtgcggccgccgcttctcccagggcagccatctggcggcgcatcggcgcgaccacgcccccgatcggcccttcgtgtgtcccgactgcggcaaggccttccgccacaaaccctacctggcggcgcaccggcgcatccacaccggcgagaagccctacgtctgccccgactgcggcaaagccttcagccagaagtccaacctggtgtcgcaccggcgcatccacacgggcgagcggccctacgcctgtcccgactgcgaccgcagcttcagccagaagtccaacctcatcacccaccgcaagagccacatccgggacggcgccttctgctgtgccatctgtggccagaccttcgacgacgaggagagactcctggcccaccagaagaagcacgatgtctgagacggtgggcggggccgtgttggctgagagagggctggggtccttcgtggtgggagtcgcagtgggctgggggtgcctgcctagtgctggagtaggggacaatgggaatcctagaggggatggaagacgcggggagtgagctgggtgggccctgctagcgagagaggtcaaccccggtggccagggaacccacttccaagcgcagggacgccggcctccagctggtgtgtgctaaggctccgtcctgactgccctgtgccctggaaaagcagcaatagcatccgccccttagagccctctggctagaggagccaccagtggaaaggaagaccctccatcctctggtattaacgccttaatgcccctgtcttttactgtaagttacttaagatcatttttggaagcaggcgtggtagagtcctgtaaatgaatgctctgggctagatacagcttggagaacctgctggccttgttagacagcacttgggcctttgccagcagcaagaggtgaagcgaagccactcttacctctcccttcccctcccacctgccccctgcgtaggcacccagacttggagagacccgtctgctgttaatacttccatcctcttccttcccaaagagcagatcccaaggcatttactccttggtctgtctcgctttatctgtcgcccctcccagcgctgagagcctcccctggctgtcagcagcactgtgtccaggctcttgtctgaacaccgcagcccctccttcgctccttccagagctcagcatgtcacggcaaggactgccgcattggtgatggagggccagctgaggggaagttgctggtgagtttccttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaacagaacaaccatttacccctccttttcaaactagagaataaagatttggttttagaactggtggctggggagtgttactttttctgggggagctgcgacatgtcaggaggagcagcatgctctcctccctagaaggacggggggctgtgggtggggctctggccacaggccacatgcccagcttgctgagctctggccccctgcctcagttcttccctgagcatacccaggcagttgggctaattctctggg

SEQ ID NO: 128331 - DNA, 1090 bp, Homo sapiens
aagatggctgaaggggagagggcccgctgcatccccttgggccagagcccacaggccaggccctgaggatcttaggctgcaccaggcttgccggacacaggctcattgtctctagggctttctgtcttgctgtaacgtctctccagccagctgcagctcctgctgacttatcccaccccagcgcaggtcatccaacggtgacttatggccccggcctcctggctcgatgagggtatgttgcttctgtttctacctctctgagttcttttcctcggagcaagtgaccctgatgggatggccatgggtgtacaaggatacttgtgtcatgggtggctttgcagttctgtgttcctaagtgtgctgtgcagtgattcgtgctgccctggttcacagtggcacgtttgtgtgtctgtggatctgtaggtgtgtctgtgagttttaaaaaatatctcacattctctgtatttgcatagacagttttgcaggtgttctcacgtagttttgtgtctttgaacttttgtttacttagctgtatttagatatgattgtatctgggtgtgtttgtgtgtggtttagcatttacatcagtttcttatgtccctatgatcatatatttaaattaaaaacatctgctattaactgaaatcagaggcagagaataccattgcctggtcctgagggatttcttaatagtgacagaagactggagcctgaggagccacctcttgggtcctccattgtttcattcactcatccgttcattcattcaatacacattacacaccttctgcatatgagggacgcgcaggtgtgggagcaagcccccgctccctggggctaacctgagtgaggggtctcacagggagagaggactgggtgaggacatagcagtcaggtatgggctgcaggagggcagggaggcgctggggacccggtggagttgagaaggatgaggctatagaaaggggcagcatggcagggaggcattggctgggcatgggctgggactggagaggccagtttctgtgggggtctcctatggaagaccagctgagctgtgcccagcaagtgaggacctgctgggacctca

SEQ ID NO: 128332 - DNA, 1402 bp, Homo sapiens
tcgggaagagacaggggcctagggttttccctgctcccagctctcttgtttggctcctgctctcagagaatgcctttctctacttcccaccttggtgcctccccttggtggcccctgtcctgctctcgctgccttggctcttgtcccctccagcttctctgcccacctgactctcctcttggccctcctgtcctcccgtccatcctctgtccccgggttctcctgcccctttccctccccttcctcctcctccatggcctcttcgcctgcccatgctctgtgtgtattgcaggtttcccagttcatggcgtgtgaggagctgcccccgggggccccagagcttccccaagaaggccccacacgacgcctctccctaccgggccagctgggggccctcacctcccagcccctgcacagacacggctcggacccgggcagttagtggggctgcccagtgtggacacgtggctcacccagggatcaaggcgctgctgggccgctccccttggaggccctgctcaggaggccctgaccgtggaaggggagaggaactcgaaagcacagctcctcccccagcccttgggaccatcttctcctgcagtcccctgggccccagtgagaggggcaggggcagggccggcagtaggtggggcctgtggtccccccactgccctgagggcattagctggtctaactgcccggaggcacccggccctgggccttaggcacctcaaggacttttctgctatttactgctcttattgttaaggataataattaaggatcatatgaataattaatgaagatgctgatgactatgaataataaataattatcctgaggagactccagtggtgctgggagggtgtaactgttacttgctgtgtcctgtgttcctgtctggacatgcataggtgtgcctgcacaggaatccgggtctgtctgcatgcccaggcccacagggctgcccctgtatccaggtctgggtgtgtgcagtgggggtgctccctgggggctgacacaggtcatctccagggagacagaatcttgtctctgtagggccctggattcaagataacaaaaaaccccctgaaccacatgcatttagaggcagtcctgatgggacactgacctggtgtctagcccctgagggccatgtgcctctgctgggtggggcaccctggctcccacagcttggcttcacactgactgtggaagcagccctgcacttgtctccctcacccagttcctgagcctgcgttgaccctaacctgaaattggtctgagtcctggctccccctgccacccacaacttagccttatcttatccaatacaattgggccccggacacactggtgactccagccctgaccagagctcacctggtgtctggctgcagat

SEQ ID NO: 128333 - DNA, 1152 bp, Homo sapiens
tcgaggagtacttccagcacgcctggtcctacaccaacggcatcgacatgaacgcggtgaggccaccagagcgtggccagtgggtggcaggctgggaagagtggggtggcagaggggaacctcttggcacagcaaacaagtctcaggcggtcacagtcagtagtaaggaccctggaggcacgttgcccctttttgcccatgaggaaatggaagcccttggaaccccttccctggagagctccccttttggggtgggaggtatatgtcacataggcgatggggttaaatccttgtgacagcccagggcgggaatggtctctatgccttacaaataagaacatggaggtctagagcccaagggtgctcggccaggcatggtgaagctggagtggggtcccaggtccttcccaagacactgggccccctgatgcttccgagatctcccaggcctggaggttgagatttctctgacatggaggggtgggatggtggagtagagtgtgggttggggggtcccaagggagggtgtgctgagctgcccccaccctgcccccaggtgctgaagggcttccctgagtgcctgcaggctgacatctgcctgcacctgaaccgctcactgctgcagcactgcaaacccttccgaggggccaccaagggctgccttcgggccctggccatgaagttcaagaccacacatgcaccgccaggggacacactggtgcatgctggggacctgctcaccgccctgtacttcatctcccggggctccatcgagatcctgcggggcgacgtcgtcgtggccatcctgggtatggggtggggggcgggcactggactggaaatgccctctgcagcctcaagaggtgcgagccttctgaatatgcagtcactggggctgtggacctgggactgcctgcagggtcactgggctcctttaattcacctaaactcaggccctccaagcggggccatggagaggagccccacgtggggtgaggctgctgaactctggggttcccacattctccttcccttcaggatccgccacaaacagacactttttgcttccttaaagtaggatcaaatctagatcctctagcctgggcagtagaggaagaaatgctagcctggaagctcggcatttggtttcac

SEQ ID NO: 128334 - DNA, 1068 bp, Homo sapiens
gcctccccagtgctcctgcaggcctcagacctcagactgccttgaaatccttagtacctcctgtgatcagccccactcctctgggcctcctgcccttctccgtcccccaaggccgtctgtcctgtcttcttccttgccttcttcatttcttcctgtgcccattcctttaaatcagacgccctgctcttgtcaccaccacgcctcaccttctccctcatggctgacccctccccagctcagacacccactttctgcttcttttcagccccctgggtctgagctgaggatgaaagaagcttttccttgaaggggagccttgaggctgggaaggcaggtgggacagggattggtgtataagtgggttttcttgtcttgagataggaggcagaccagagcgatcccagaggatggggcttagacacaggagaacttttcctgtggcactgaagctatcaggggagcgcccttcatcatggggacagcggtgttcctatccttctggtcaaggcctggtgcagcctggagacagggctgagtgggagaatctgcagggctgccaggtgcgggcgggggtccatgggggccctgcttccgagccagttgcctcttgccctgcagcaccttccctccacctttcccttctctagctggatcagaggcctgttggaggggctccacgggggtcattcctgagctgcggctgtctgtcctggtctgccggggctgcagtcttcctatcccagtcctgctccaggggtgaggcaggcatgacgcaactgaagggtgctatctactccttgacccaccctggggtctggagagcgtcgggagagcggcttctccgtgttgcgtcttctgcagcccccggagaggagctatgtaaatatttgcgaagagctgtctgagatgggagcagagtttgatggtggccttgggctctggggaggggggccatggggcagcagaagggccagcttgggggtgtgtgaggggggagactgggcctcttttctccccagaggtggcttcctgggtggggtgattttggaggttccaagaaagcccttc

SEQ ID NO: 128335 - DNA, 1037 bp, Homo sapiens
gtagctgtgctggggatttggcctcttggcagcagcggctgagggctctttcctttggctgtggtatgtgtggagtgctcttaggtggagctggccctccctcccagtctaggctggccccttctggagaggatggctatgggcccccttctgcagaggagttattgtgggatcacctaatccaacccattcgacttgcaggtggaaggacggagaagcagaggtctgatgaccagtgaatcagtggaaggagtgggattagaacccagatccccagcccaagttcaaacttgtcccctctccaggttacaactccaaaaaatggggctgtgacccagaaaactctgtgccagcaatctctgtctgtccccttcttcactctcacctagtttccacggggctcaggtgtctcctgttggccaacaggctggcctggcactcagccacctaggaccccatgtatcctggcattctaggcctggggtgatgcagacagatttcctcagcctccgcttcttctgccttgaaacactcagtccctcctgtgatccccgggacctggcttgggctgcgtgtgtgcgtgcctgtgtgtgtactcacacatgggcctggtagggaggcggaggtgaggaatgcctgcgccaccccttgtttctgtccaggcctttctcagggtctctgcctgggccagcctcgggtagggggagctgggcaggaggtggagccttctgctggcaggcgccgccgtggacagctgtgctgtgttggtgcctctagccttgctctgcgcagtgtcagggcctggagccagacagccccattatttagttgctgggactgctgggaggtggggaggctagactgggggagtgtgggctgaagggagagacatgaggtgcctggggctcactggccctgtgccccttgaagtcaggcccgggattcaggtggaattgggggcagagtccagtggtgtgaggctggctggcggtaacatccccgcaaggccctggggaggcaccccgggcagcaggtgc

SEQ ID NO: 128336 - DNA, 1005 bp, Homo sapiens
gtgggtaggatgctttctgcagacttttctccctaaattgtttctttttgggagctgggaggagcctggatatctcactgtagcctctctgttccctcagtcacaggcagggtgcgggagagctcttcccaggaatggtctctgaaatggctcttggagctgagatgggggtggggcagattctagaggcttaacagcccagctcttggtattagggttgggcacttttctctttgtcccagatctgggggtagcagaggtgggaagttgaaggcagtgggggcttctccatcagctcatctgaggcccagaaatgttgctttggggagagcttgccccctctcaccgtttctcttcctcagctcaattcttgagtgtgggggcggctaagtgggtctgccttcaggctctaccctgagcctccaaggaagtcagaaatctacattcagctttgacttctgagtatgtggagtgggctggggggagagagggagagatctgtctctcctcagcttgagggaacagctctcttcttgcctctgtgcacagaaggagggctaccccgtgcctgggctcctctctgtttgggaggatgaagggctcctctgactcctgtcttccctttgggataagagcagaggcctgtcccagcaacacgggtacaggagtggaggacagctggccagctcagatgagtggctccttcccttcagggcctggctctccctctcccttggtctggagagagggggaggctacagatgtccctttcccttcttgccctcccatgcccattctcagctgctggcctttgctcactttctctccatcccctggcctggacaggaggacacttcactcacacatgaatcatcctggattcatggtaggcaacccagcagccaggggtggccttggggcgtggcgggggctgggccagtcgtggactaggttctacccggaacccagatgtgttgatgcacctgatgccaaatgctacaccaa

SEQ ID NO: 128337 - DNA, 1024 bp, Homo sapiens
gtcttgtcacctgggctgccctccctggttttctgctgagcctgccgtaaagtattttcagcaccttggacagagacaaagctccaacctggctggaggcattgagtagccaagtgagcttgggatctcctccagggccagctttcctggcaaggttgcccaaagcatgtcttggttcttcatattttttaatcctttgaaggcactcaaaaataaaccccctaatatatgtcaaaacagtgcactagttctgcaaactctcagggcattttttaaaacaaaaccaacctattttctagaatagtgttaggtacacattaggtgcttagtaaatacatttaaaaaggaatacatgcaaattcaaccttcagacaaatgtcccagcctccttataataggattctttctccccatcagtccctcctatatagtaattctggagcttctagtacttgctaagttttgcagcctcacttgaagccccttcttgtgtctaaaaatcccagtctttaaatcaaaggaacagatgactattaagttttcaggcagaggaaactgaaactggccccttctctttctcatctgggggtaagtatagattggtggggaaacccacacctgactcctcttgggatcttgctttatgaagatgttcaccaccttcctttgtacctgagaaagcccttaccatgcagaaggaccaaaatcgcccaggaaattttccgagctgacccagcccactcagagccctccttcttctgaacacccctccacgtatcctcaacatcaccagattgttcttctgacatttcatatccaagttttttcatgcctattggttcttttcccggttagataatgaattccctgtgtttgtggtttccagttagatgctactgtgatgcaaacacagcagataaaatgggagattgatcagtcttgggggcttctatcttgtcctaaggggtctcctgcaccacttatttttagtctgacataaatatgcaggatggatcatggtgct

SEQ ID NO: 128338 - DNA, 1413 bp, Homo sapiens
ccgagtccctcctctgtactggataccaagtcagcttccatagggatggggagacacctggcccagggaggagatgagaagcagcccggatggtgctacatatgtcagagagcagggcaggaagggatcagtgtggctgccaatggtcaggagggcgccatggagtgaaccatggcccctgcctcctcaccagcagctcctctggagctgatactcaagaccccccgtctctctcctcaccctcctctcccgctgcctcggctggctcaggtgttcgatgcccgggactgcaggtctgcacaggaaatgttcacctacatctgcaaccacatcaagtatgccaccaaccggggcaaccttcggtgagtgccccccaccatgccaggccccagccttcttccccaaggcagggaaggcggggctctgaccagctctttccccatgcgtgccagctcggccatcacagtgttcccgcagcgctgccctggccgaggagacttccgaatctggaacagccagctggtgcgctacgcgggctaccggcagcaggatggctctgtgcggggggacccagccaacgtggagatcaccgaggtgggcaccgagggccacccatgagggtgtccccaaggtggagaatgaggaaaccagtgggagaaggctcgggggatccaggcaggaagaggggagcctcggtgagataaaggatgaaaaacaccaaaggaggggtgcctgggtggtcacggagacccagccaatgagggaccctggagatgaaggcaggagacagtggatggaggggtccctgaggagggcatgaggctcagccccagaaccccctctggcccactccccacagctctgcattcagcacggctggaccccaggaaacggtcgcttcgacgtgctgcccctgctgctgcaggccccagatgatcccccagaactcttccttctgccccccgagctggtccttgaggtgcccctggagcaccccacgtgagcaccaaagggattgactgggtgggatggagggggccatccctgagcctctcaagaagggcctgcaagggggtgctgatcccacaccccaacacccccaggctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggtgaggtgcgggatggggctcgggcaccgaatgcacctgtccaaggcaggagtctggctctcactccatccccaaaatgccagccacggggacaatcagagcaggtccagggttgcctcctaaatgggaactgag

SEQ ID NO: 128339 - DNA, 1040 bp, Homo sapiens
tccccggccttccgctaccaggtgcccaccctaactggctctgccagcctgggcccagctctaattctaagcagcccctggggacctctaacctttccttttctttacctcccctcccaaccccatcatctctctgcagccagacccctggaaggggagtgccgccaagggcaccggcatcaccaggaagaagacctttaaagaagtggccaagtgggtcccctgggagccccgctctcccacacacaccctgggggccccactctcccccacacaccctgggggaccctgccccagcagtgttctgggcctaccactcagtatcccaaaaccctgttgtgagggggttggacccttgcctggggaggccctgcctctgtgcacccaggacaccctcacaccttcctctcccgcagcgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtagggctgagcccaggggagcagggagctagaaagagggggctctatcagcatcttcaggggtgccctggaggacaggaagtgttacaagtcaggactcatgaggaacccggaaccacaggtgttcagagatcaagttggggcctgaatcttgcactgccagggaggccagagtgaggagggcagggcctccgggggccacagcacccaggacatctgtcttcccacccacaggtcctgtgtatggatgagtatgacgtggtgtccctcgaacacgagacgctggtgctggtggtaaccagcacatttgggaatggggatcccccggagaatggagaggtgagaacttccaggaaaggggctgctgggaatgaggagagactcagaattggagtgactgggcaggaacctctgcccaacacacacacacacacacacacacacacacacacacacacacacacacacacacacacaca

SEQ ID NO: 128340 - DNA, 1266 bp, Homo sapiens
cagcaagtagagttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggggactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcagctccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacctgaagatagggagagaggggaggactcgcgctctccagcggggcacaccaacc

SEQ ID NO: 128341 - DNA, 1168 bp, Homo sapiens
caggccccaccaggcccgctccggagactttcacgtccagggccagccagcagccccgggctgcgcccccgcgcccacccccaccagggcccgccctaaccccgccgccccgcagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggtgcggaggggcgggccgggcctgagcgtgcggggttcctgctaaggtctccgagtcgggttctgatccactgtgctcttttccgacaggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcatgtggattacagttttttttttttgtttttttttttttgaaacggagtctccctctgccgcccgggctggagtgcagtggcgtgatctcagctcactgcaacctccaccccacaagttcaagtgattctcctgcctcagcctcccaagtagttgggattacaggtgcctgccaccgcgcccggctagg

SEQ ID NO: 128342 - DNA, 1050 bp, Homo sapiens
cagtaaatgggagcaaagaccacctgggggtgaggaatgggcttggccggtgggtggggctgagtaaggactggtgcctggaccaaggctgtcaggatcaccctgggcaaagcactgaggctcagccctatccccgagctggcaatcagtccaggggtgacgaatagatgacaggcccaggttctgcactgctgctgtatttttgggtgatggtgaacaagtccccattgtggtctgtttccttcacgtggaagatggggcagtgtttcctgtcccacctgttcccataaggctcagtgttcttagcacctgaaagactgtccttgctcacagtggctctcggcgggacagactgaggcctcgctgtctcagcgtgcggaggacggcaagactgagctttctttgatgcggttctccctggcgcatccactctggcgccccccagggcacagctctaagtttcttgggcacctctggggccgagtacaacaagatgcagctgcctggggtgccacctcggctcgcggcccctccaccccgggggtgctcagcaactgcacctcgcccctggtgagtcccaagcctggcctccccttctgccttcacccccacaactcctctccaaacccttcccctctaggctcaccttaggtagtaacctgcctcaccagcccccgcccccagcctgctctcctgccttctttaggcctctgcttcctccctactccgtttctgtcctctcttctgactccctctttggctttccctctcctcttgcacccagcctgagccttcctggccaacctcttcgtgcaccctctcctgcctccgagagatctgagcccgacagccccctgtccagctgcggccacagccagcctccttgcctccatttcccgaattgcccaggaccccaggtgaggagtggaggctgagatgcaggggcatgtggaggggggtgggctgatcctgtaggagtggggagctggggcgctgaggggggattcagaaggggagtcctctggggtgtggcgggaggagggcatgact

SEQ ID NO: 128343 - DNA, 1047 bp, Homo sapiens
atgggtccctgggccggggatgaggcgagtggattcgggggtggaggtctggactaatgtcccccataaacaggccctctcagagggctacagggagacttcaggagggacccgggcaacaagggctgggagcctggtctgactgggggtctctcggctcctcccagctacccctgccgccccggcttcgaggtgctgaaagacttcaccctgacgctgccccctggcaagatcgtggccctcgtgggccagtctggcggaggtaaggggagcccaccacctcttcaccctctgactcttctctagcagccactcagagcaaggccgggagcagtgagcccccggtggggtcccttcctccactgccacaaggggccttctttcctgggacaatccctagaatccctggcctccctccctctcaacccaattccccaggaaagaccaccgtggcttccctgctggagcgcttctacgaccccacggcaggcgtggtgatgctggatgggcgggacctgcgcacccttgacccctcctggctccggggccaggttgtcggcttcatcagccaggtgcggggccacatgggcagcccttggctcccactgcccgtcctcccctgggccctgcccccttagtcctcaggtgccttttctttctttcccaccctcatccttgctgctctcgggagaccctggccgtcttcacatgtcctcagctgttgtctgggtgaggcatccctgtcgtgggagcagccacagctctgcctggtctcccagagcagggacgctttgtccgcatttacagcagtctacacagatggggaatccctcagattctctgcaaatcccatagcatccaggtctagagaagcctatagtggaggtgctgagctgcagccgttctccctctgcttgaggtggcactgcccagcgagggtccacccttccctttgagggccgtgaatgaagagggcatgcctgctgtccgccagggagagtgcctgtgcagaagaaaggcaaatgcaagcccccaactcccagcgcc

SEQ ID NO: 128344 - DNA, 1050 bp, Homo sapiens
catgggtattctgtgatttcccatcttacgctgctatatccaggacctggaaaacctacatttttccaaagggctgcataccacccattatgtgcacataccatagtttatttaatgactcccccactgatgggcactgggggtgtccagtctttccattacaaacaatgttgccgtatcatcacacagatgtgaactcccaggactttggtgggctttttttgaccatgagtggtagaaacatggttccaccagccaaacgtgtgcacacaccatgctgcaactgctgggccacctgtctgtcctcccaacaggacacaagcttcatgggggcagggactgtcctcattccccatcgtgggctcaatggcacatgacaggtgcttgattaataaacactttggaaggactgagtaccatggttacagcacaggcgtaccagctccccagagccacagtgccatgctttgcaagtatttactgtagatgatcccactcacactctcaaaacaggcattcagcatcaagcacagctaggctcccactctccactgtggagcgaaggccgaggcgaggttaggaagacggcgcggctcctgcggtctagctcttccagctggactagccaaggggtttcactgcttctctagggggcgggtgaagggctggatttaaagaagccgcccagaagatataaatctggtgtcagaggcattttgggcagcctgaggctgatgactgagtgggtgaagcaggaaccaccttggctggctgcctggtgagggaggggtcaggccaacaagcagggccccagcagggcttgtggacttgccagctgaggccctactctgggctgccctaaggaggggtttagctgtgaaccagccccaggctctgctcctggacctccactgcttaaagacacagcctctgatctgtcaggaagtgggatatcaaatcagggtggatgtgggcctggggtttttggatggcttgtccccaaagcaccatctagttctaaaccacacccacaagagcccgtgggtccca

SEQ ID NO: 128345 - DNA, 1050 bp, Homo sapiens
ttcccgcagggctctcactccaaccttagcgttcccagtagacccgacctcccaaccgcgacacttcctgaaatttctcaccccagcctcagcagcacttggacaacctcaccccgacccccagcctcgtttcttgctgcagacctccaacctcaatatttctgcagcccctcagtcctctcccagacccctcctcactatttccagacccttccggagcaccgccttcattttagacatccttgccctggcaaccgcactcgcccctcctgccgagcccctggagcctcggtgggcaccttctcctccctccccacctgccacatcctcactcacaaagctcaccaacctaccttcaccctgaatcccttcccttgcatactgagacgctgccttcacctctctcaggaggcatttcctggcttagggaagagtgccgcatcctcaccctgacccctgacctccttcccctaggcacctacggaactgtgttcaaggccaaaaaccgggagactcatgagatcgtggctctgaaacgggtgaggctggatgacgatgatgaggtaggactggggagtgggatacggcctggggaggggtttgagggcctgggctgggtgggatctgactgctgcccaccggccccctcacatatgcagggtgtgccgagttccgccctccgggagatctgcctactcaaggagctgaagcacaagaacatcgtcaggtgtgcgggaggcgggtgctccttgccggtgtggccgcttgggggaggcgggggctgacactggacgtctgtcaggcggacctgcctggctgagcccttcttttgccctaggcttcatgacgtcctgcacagcgacaagaagctgactttggtttttgaattctgtgaccaggtgaaaggcggggtttggaggacagtagccttgggaaggtataggggcccagattgaggttaaactctgtcccattcccccactcatatcccttttcaggacctgaagaagtattttgacagttgcaatggtgacctcgatcctgagattg

SEQ ID NO: 128346 - DNA, 1016 bp, Homo sapiens
ggggacactgttgattggggtgtacttacccagcctgggcccctttggaggcccgaggagtcgcctcctggtggggcagtggtgcaggggaagatggactggtcctctctgccttccggtcagcactgtcatcctcttggagaaagaactgtaacagggacccacatgggcaggagtgaccaggccagggccctgccgacatgccctaggagcccgcacccagcgcacctgcaccgaggagggtgtggagacaggggacggctgagtgagagcccgggccccctcagcctcgctggcctcatcctcatcttcctccccctcctcaatggtcggggtttctccagtcggggaggctcccgggcgccttcgaggcttccgtcctgggccctggggtgtcttgcggcggcgtgcatccggaggcaggtgggtggacagtgggtgatggatgtggtgggaggactggcggtggtctgcagggaggagggggacttggctgtggcaggcacagtgtccctcccctgccatcctgccccctagccccactcctcccactaggaccccagtcccttctttgctggacagtcaaacctgatccccccacctccccctcccctgcctgccccctcacactcaaagtcttcctccccatagctgcggcctggctcctcccctccacgagacccggcctcctgtaggatctcctcaaaccgctccacgcccagggtgcggtgaagttcgtcttcctcctgctcggggaacccaggcgtcccagggcccaagctctctggctctggctgtgaggaagaaggcagagagaaaacacacagggctcactgggaattgtaccccgaaacctcacccttcccagtgccagagacccaggaaccctcccccgccagcagctatctcctctaatgctggtggctctatatgcccccagcagctgtcccttaaatatagggacccaggccaggcacagtggctcacacctgtaatcccagcactttgggaggctg

SEQ ID NO: 128347 - DNA, 1553 bp, Homo sapiens
gagctctcggccaccataaaactgggccctgaagcagcagagggctttgcccagggtggtggcactagactgggacagattaggatgaggtgccgggcccttcctgctactggtgtcctttctcctcagtcacaaggacatagtagctgaggggttgcgccagctgctgggggaggagaaataccgccaggacctgactgtgcctccaggctactgcacaggtgagcaaggggcaggcggcaggcccggggagacggagccctggctaaggccgccggccctgctcccctccagacttcctgctgtgcgccagcagctctggtgctgtgcttcccgtgaggacccaggaccccttcctgccatacccaccaaggtcctgcccacagggccaggctgcctctagcgccactactcgagaccctgcccagaggtaaaggaggcagggtgggggagccctggccaccttgcccgccatgccctgagccacgtccctccccctgcagggtggtgctggtgttgcgggaacgctggcatttctgccgggacggccgggtgctgctgggctcgagggccctgagggagcggcacctaggcctgatgggctaccagctcctgccggtgagtggccctggcctggcccgtggcgcatcctcactcccagcctgcgggtaacctgccgccctctcctctccccacagctacccttcgaggaactggagtcccagagaggcctgccccagctcaagagctacctgaggcagaagctccaggccctgggcctgcgctgggggcctgaagggggctgaggggttgatgtggggttcaggatggcccccccatggggggtggatgatttgcactttggttccctgtgttttgatttctcattaaagttcctttccttccccgttgtgaatctcagttttgggacggggagcagagctgagtcccccgcctcttccattcatgccccgccccccatacaaagacaaaaggccacagataggtgggggccaaagcactttactgcaggggcagtgggggaggagaagactttaaattattcacttaaataaaaaggagggaggggcatgggagggggaaccccatcccaccagcctgtcccctcgtccatcggtccctcggctgtccctcggtggcggctacacaggcatgggcatctcattgtactcgtccacaccctcccgctcatcaaacaccggctctgcctcgttagcatccagctgtgtgtggggaggtggcggtcaagaagggaagtgggggggcctttccagatccacagggaggcaagaggaaccgggggaggcagacgggagggcttacacatttcatctctcggtcggtgaagatacgggtgagcaccaccatgcggagcggcactgtgaggatgaggatgaaggggaaggccagggaggcagctgtggacatgacggcccagagcagggccaggcagagcagctgcagggccgtgaacaggtgcatacggagggtccggacctggggggcggagacaggtgagcccagcttcctcc

SEQ ID NO: 128348 - DNA, 1037 bp, Homo sapiens
ctggtactgccagatccagtaccggcccttctttcccctgaccgccactctgggcctggccggcttcaccctgctcctcagtctcctggcctttgccatgtaccgcccgtagtgcctccgcgggcgcttggcagcgtcgccggcccctccggaccttgctccccgcgccgcggcgggagctgctgcctgcccaggcccgcctctccggcctgcctcttcccgccgccctggagcccagccctgcgccgcagaggactcccgggactggcggaggccccgccctgcgaccgccggggctcggggccacctcccggggctgctgaccctcagcccgcactgggagtgggctcctcggggtcgggcatctgctgtcgctgcctcggccccgggcagagccgggccgccccgggggcccgtcttagtgttctgccggaggacccagccgcctccaatccctgacagctccttgggctgagttggggacgccaggtcggtgggaggctggtgaaggggagcggggaggggcagaggagttccccggaacccgtgcagattaaagtaactgtgaagttttcactcttgcagtgtgtctgagtgtgtgcgggctggcgggcggggagtcctcgccccttgggagagaagggcacggactgcgcctggggtctggccctccgccttcccttctccccagcgttctgctctggctttggcgccggcctccgtggccccgccctcggcgccgggcgcgcacttcccgcgggcggggctcgcggctccctggctcgcagtgcctgccgggagccacgtctccgaagaccgatagctgcttcgggattggcgtccgggcggctatctaggggctgctgggaagatggcggactcggtggctagccgatgaggaggccgcggggggaacccggcccccgggccccgagaccgactgagggagcgacctgcgcagggcccggggagtcatgtaggggtggcgcctgcggggagggctgcgggagggcagcgggagctggtgttagcggcag

SEQ ID NO: 128349 - DNA, 1091 bp, Homo sapiens
caagcgggagcgggccgggcctggcgctgggctgaggctcagcgaccgcgtgggaggcgccggcaggtccatccgcgctttggccgggtcatgagcctgacggggatccgcggctcctcggtctggaggcagctgctgggcagccgggtgctgaccgaccgccagggacaccgcacccggagtcggggaccggaaacccccggccactgcgctgcctagcgcttttttctctgggcccttaggccctggactttcgaccgctgagggcacaggaagtggtggcacgctgctggcagatgcctcgcaagccctggtgtggtgggtgctggaggcacccgcaggcaccccggtggcatggtgaccttcgagcgggcacggacagatgggcctcaccctgggccatctgcttcctcccccagctctgtttgaaaggggacgcccaccggcaggtggtgggtttggcctcagtggaaatgcagtgagagccaaggccttttgcgataacatggagttatgggcaggggcctgtccctgacttgggccttaaggttagggccccactcccagcttcatctgcttgcctgaggttctgggggatagtgcacctgaacacctccctttctgctttcagaggtccccatagccggggaagaagtactgggtctggggggaccccatgtggtgctgggttctatcttttgttgtgacatgccagtctgacttccttctgccttttcccaacccgttcttatttctttcctctcaaggctgagttctctgtgaactaattaggtgacagaaaaaactcattaacgtggatctgagtaaatggcctgaatcaccgctgtggctggggactaggagatggcatttgtgcgagccctgggccccaaagacaggagatgaccaatttttcctcttagatctgaagagggtggaggcgggagagacatcgttgctgcagcttcactgtccttggaggaagtaaagacattcctgatttgctccaagcttaccttcccccagctccttctggagggcgacaagcctcgtgggccggccacaggagggtgggggcacatctgcttccg

SEQ ID NO: 128350 - DNA, 1938 bp, Homo sapiens
gtataggccttcaacaggagcccgcttccggcttggcactcacctgcagtgagcgctccctgacagcttgggtttcctggctgagtcctagaaagagggatgcaggagaacgagggcctcagtccaaatggggacactgggcacgtggagcgcaggatgttgtaccaagctagccaggagccccaaaggagcccgggatctttccaggacctgctggtcccagtcgttgtgtgcaggtgagggcccggcacaggggaggagcaggggcttggggagggcctgggatccctgctggcagttcccagatggggggggggggctcccgcctggaagtggaagtggacctgactattaggtgtgtgtgccatatggctactattatgtgtgccggagctgggctttgtcagctgggtgacttactcaggtttctccatcgttttcccactagggctttttttttttttttttttttttttaaacagttacttcgagcattccagccggcctggcctggccagcagagcgttctcactgtcacccttaccccactcactttcattcagttcacagattgcctgccctgggctgtgggcttggtgacatcctaaagggactaaggtaaagagatgtgggggtttcttgtttgggtcaagcctcagctagacagagaaggggccacagctgtgactgcagttgggtggcagctcagagggagagtaagacggtgcatgtggccgggtacagtggctcacgcctgtaatcccaacattttgggagaccaaggcgggcggatcacgaggtcaggagatcgagaccatcctggttaacatggtgaaacccccgtctctactaaaaatacgaaaaattagccgggcgtggtggcgggcacctgtagtcccagctactcgggaggctgaggcaggagaatggtgtgaatctgggaggcagagcttgcagtgagctgagatcgcaccactgcactccagcctgggcaacagagcaagactccgtctcaaaaaaaaacaaaaacaaaacaaaacaaaacggcatacgccctggcatcccacagccctcagcccttaggcacacctggggttttagtgtttgtgtctgtttctgttcgtcctgtgacttgatcctggaggactggcatgatggtccccatgtttgtgccagggtgctctcttgagctttccttactgttcctgggtgggcactccctggccgggccctgcattccgccgtgggccctgctgcaccacacactgctgaggttcccttcaaagatgaggactgggggggtctgggatgggtgccggggacatgcatctggagccagcccaggcccctctggcaattcgttggtttagggactgagtgtctcatgggggcctggttgcttatgcaggactttgctcgcaagagttctagcaattctgaaaaagagcataaccatgtgggtgctagtagccagggaaagcttcatttgttccagatacattcatttagctcctactgtgcggcccagttgcatctagcacagtgaaaagcagacaatcaaaggagagacagggagcgaaggggccagaaggtctgggcttggtgcacctggagagaacgactcagcctgtaggaggtgccagagaggcactgggagtccagaaggagacctagattttcagaagaccagggcagggcaaaggtcagagacttgggaaacctcatcacgacttctttcttccgggtcagaagccagaacaggaagacctgtccagcctgatctcaggctgcatggcctcgtgggaacccctggtaccctgctccatccagggtctcagctctggctctccccagcagtggtaccccacagatgaagcagtccttgtccctatgatgccacctggcaatcttcctgtatcatttatttctttcctcaaa

SEQ ID NO: 128351 - DNA, 1036 bp, Homo sapiens
ccggtgtcctgcccgtgagcaaagccccagagtgtgggcgcctccctccctgtgcccaccacagccaagaggccatagtcccataggcctggctgagacacacgcctgggtagcagtacagaggctgggaggaagtgagcagggaacctggcatctgccgcagaggaggggcccaggataggccgaacctcccagggagccagttcaacggggcaggaagccagggtctcgggaggccgggagagaatcatctcccaccccaggcctcggggtgagagagaatctgcctcccgtccctctgttcctggaaggcaaaggtgggccggtgcgcctgggtgaggggagccatgcgggggtgagggctggcagaggtgagttctgaacctgggggcagtggtgccatgagcccttccttcccaggtgaccccaaaacttgagcaagggtaaaataaagcagaggtgcagatgacagcctgcttaggctgggagtggggcgtgtgggtgtcctcgaggtgcagtccctttgctctgagtgggagacgggcctggcaccaagggaaaatcagctgactgaaaagcaaagcatctcgactcaggagcatcctcagagcatgtgctgagggtggcgagcaggtttctgcgcagtggcctggggcacgaggacagcggcccagagctccggtgagcctgcagcccagtaggtactgctagacatggcttcaccgcagtagtgcttttattattaaaatcactggcgtagtatgttttcaaactactcaaacgcgccaccccacactccagcactttgtgtttgtgctgcaaatgtcacaagattgacagcttctgctgtgggtgacaggagttacaggttctaagccagggacagcaggaccagatctgctatctcagaaagaatggtagtgtggttgctcacgcaagtaatcccagcactttgagaagccaaggcaggaggatcacttgagcctaaaagagttcaagaccagcctaggcaacatagtgatacctcgtctctaca

SEQ ID NO: 128352 - DNA, 1006 bp, Homo sapiens
gtggtgggtggccccaccctgccagggtgcgctgttcttacttgcaggagtctgccccccaaccaggtgcccagcccttgggtctgttctgagacctgctggagtggcctctaacctgggcctggtatttgggccacaggggcactaggccaggtgtggcttggtggggggacaataaacctgctggagcaggaagaggaggaaggacacagggccgaaaccagggggactgagcccacagccctcagagtcctgttctgaagaccatccttactctgcttcactcaagaagaaccttcccactgcctcctggggaactaggggtgagggttgggggtcccgtggaggaagctgctgtcctctggcctgggcttggggagggcatcataggtgacacaggcagcagtggttgggacaggtgtgtgtgccaccctggccctgacggggcggctctgtcttccgcagactcgtttgtgaacagccaggagtggacgctgagccgctccgtaccggagcttaaagtggtgagtgtggcccatgggcagcaccggcggcctggagctgggggggcgaggctgggtgccgcgggcctgggccttgcttctccggcttctgtccccttctctgctcagcttggccctctctgccctctctcctccccttcagccctggcctttctccctcctgctgcttctttgcttttcctgctgggtcttctccctcgtgccctctgccctctgacccactcaccccttcctctcccgcagggcatagtggggaacctgtctagcgggaagtcagccctggtgcaccgctatctgacggggacctatgtccaggaggagtcccctgaaggtgagcgtcacaggcccagcctgggccctgaggccggccactcctccagctcctgcccacagggtctgggtggggggtctccagcccccttccagtcctcttccctcccgcatgggaagctgtagatttcttcttggcccctggattcttt

SEQ ID NO: 128353 - DNA, 1030 bp, Homo sapiens
agcgaggtgcccatggtgcttgtgggcacgcagggtgaggcggggccctgcaggagctggcagagagcaggaagtcccgggcaacgatgcatgggggcaggggtgggcaggtgtgagaaagcccccaagcccctactcttttcccagtgctgactgggaccctcagcactctccgtgctgctcgtgtctgagggcttttgcccccactgaaacctgctgtccctgtgactagcaggtctgtgtttttttagatgaataaacgtgctcagagcttaagtgcttgctggtttgcactcagtgaggccatggaagggttgaaatgagacccaggcacccgcgttcttggtgctctgtgtgttccactcaccaggccctttgcacacctgcccttgggccaaatgccccccaccacactaccccagcttctccgaaagctgaatgactcccgccctcccacctccaacagatgccatcagcgctgcgaatccccgggttatcgacgacagcagagcccgcaagctctccacagatctgaagcggtgcacctactatgagacgtgcgcgacctacgggctcaatgtggagcgtgtcttccaggacggtaactcgggtgccgggtgggagtcactggcagccgcggccccagtgctggcgataggaaggctcccagtgagagcaaggctgtgtgtctggggggaggtgctaagccaggcttttcccttctctccagtgggtataattgactctgctgtcccctgcagtggcccagaaggtagtggccttgcgaaagaagcagcaactggccatcgggccctgcaagtcactgcccaactcgcccagccactcggccgtgtccgccgcctccatcccggccgtgcacatcaaccaggttcggcctgtgccccgccctgcccttcctgtccccaccatgtctgtcttgcctctgtgcgtcctgccacttctgctggcctcctgctcacacctgtccaccttcctctggcctcccagccttgcatgttgcttggaaaca

SEQ ID NO: 128354 - DNA, 1005 bp, Homo sapiens
cctgggggctgttgtgctggcccggctgagggtggcctctggctctcaggccccagggcctgctgtctctccactcccaatgtgcgacacacagtgcccatccaaaccctaatcctccagccgggcttggctggatgttccaggagtcttgggccagacaaaggtgggtgaacccccgtgtgggttgtcacgagagcgcccgcccctccgcgtcactccatgcgcctctttccgagagcagggcttggctctcagcctgggcccgagtgcggccagccaggccagatctccggaccctgcccggacagagctggcacttccaagccctgctcactcatcctcgcctctgcctgcccagctcacttctccctcccggctgcctgcctctgtcccgagcccgccacctgccctcgcggccatccatgctaacagagactctgtgctgacggtccgccacacattgcagctgcccggccctgaccctgcctaaatgtgcagcttctcctttctatccatggccattgagacattagagcgtggggggggccgcctgctcgagcccacacctgctgctgctgctgctgcgggacccttaggtgcctctgtccacggtgcctactgccagggcctgggcaccctgctccctggcatcgtgcctcagtcatccgctgcctcagttccattcttaatctccccttcccctcgttggcaagctctgtagcaaccccagggcaccccctgcctttccctgccctgctaccctctcctccgcccacgcccagtccccggcctcctcccttgcgccccgtgcttcctgccatcctgtgctctctgctgcctgcctcgactctgctgccctccctcctggctgctcacggcacggccttccctctggcgcttccattctctccatcctcacagcggcgaccttatattttccttccattgtttctgtggtgacctcacttgcaccattgtccctgagacggcctcaagacgcgtccg

SEQ ID NO: 128355 - DNA, 1050 bp, Homo sapiens
aggggcgggggagtccaagcccgcccggcccggctgctcctggggggcgctttcctgcccctcccctcctctgctccttcctgcatggacctctgccgttcctgctcctgctccggaagccgccgccgccgccgcgcttgccttgccccctctttttggcctccccctatttcctaggatccgcattcgggtggactctgccccaggagcttgacagggtgcagggcctcttctggcctctctcctctctctgtccatccactgtgccccttgggccacgccgacgcgctcggtgccacgtgccgtgtggtgtctgtgccgcagacgggccatctgcccgctcacttgtggactttgcgctcccggttgtcgcgccctgtgctcccgaccagcagccccaccgtccacctcctcgcccccgcttctcttacgcccccgccccgggcgtgctcctcgcgccctcggcctctctgtccttgctcttttgtaaggggcgggcccggctcagtgacctgtgctgctctgtatggtgccgtgtgtaagaataaacccgttggaatactcgtggtctcagttccttcccgtcccgccgccccggcccgacccactgctagggctgcccaggaggagggaggcaggagggaggccgggaagtccaggtgggcagctctcggcagaccctgggcctctttaacacgcctcttgttttctcttccagtctcggaagggtgctgacctggaccgggagaagaaggctgccgagtgcaaggtggacagcatcgggagcggccgcgccatccccatcaagcaggtcagcgcctcccttcccgtgtgctccagggctcagaatgaggcccaggaatgtggcgcttcccagggcctcttctcaggcctctgtgatgggggagatggcatcagaggccagcaccaccctcctaggcggagtccttaacaagggactggctctccagtgagaagccaccttctctgcgccgccaccttcaggccacgagctctgcctgtaccttctgatcaccaccggagggcagc

SEQ ID NO: 128356 - DNA, 1060 bp, Homo sapiens
gggtgaggggagtcgggacgggggcggggagccgggtccatccctcacacttggttatttctttggtttgtgtgctgggggcggggcggggggtattggggatgactccaaggcatctccagagcctgagggacttagagccttcgagcacgctagtcccatggctggtcgcagcgggagggggaacagctgactgcttctgagctctcagtgcacctggcccctggccagtgacaggaataccacacccagaggcaggtcaccaaggcccagcctacctggaagactccttcgcagaccaagaggcagggcccgcttgccttgtggaaggtccccttagtgccgctagttttcagaaaccccttttgaggatagggtctcccaggccaagggggccaggtagcaggatgtgtctgcacatggccatgtacttcaactcccagcccgcatgctcgcacctccagcaatggcatttggccctggtgtggccggaggaggagcagcaagaatgtgaaacgtgctggaaagtcagcaattgatgtcacagctgctggggccgctggaagtgggtgccctttctggcctccccctcacctcctgttggggagggagaggtccaggaaacgggaatctcttatcctaatggcatccatctaggagttagccttctattaggaagaacttagaggaggaaggtgcagttgaatccagtatttaccccccacccttgggcgtcaggaccacgagctgcagactagggactgccgtttccttgtgcctgcatctcttagtccctgtgttgttggctgtcttctggcggggccctccattcctaaaggagatgccatcgcggggcctcttccctctctgggcgccccctcctctaagtatgggcagagtccgctttttcaagtctccctgctgggggtgctgccccttccgctctcccagctgagggtgagccccacactcagcccccagtttgtggatctacctgtgcccctcttccccctatgctatttttgccttgaagtctccagggagcactgcctcttctcag

SEQ ID NO: 128357 - DNA, 1050 bp, Homo sapiens
caggaacttagcaaaatctctgctgttttgacccttggagcctcctggggaggagcatcactgatggccactatctacacccctgagcgtctactcctggccgtctatacccctgactgtctacacctccgatcatctacacccgacggtctacacccctgacaggcttctcctgtcgaggtggctccacacactggggagggaagacgcccacctgccggaacagcggtccagctgcttcctgatggatgatgggggagagccgagttctggggaaggactggtctaaggggccttcccaagttcaccgataggtccttaaaggctgctttgctcaaagtggcccaggagaagcggggaggggggagggcattgcctgacgacatcgtgacctcctcatgccctatgacctagggggctggctcctggtttctgatcagacctctgttctcaggggatcctgctaaagcggagcggcaagtccctgaacaaggagtggaagaagaagtatgtgacgctctgtgacaacgggctgctcacctatcaccccagcctgcatgtgagtctgggaggaggagcctcctgggggagtatggggagggggtggagggaggataacagaatgcgggtagcagacaggctccaggatggacgggaagcagaccttagtgatttcaaatggctcatccctggagaaggaacctcacactggcagcttgggacatgcacaagacccggctggcccctcccttgccctctgggcggtcaagctgtatatccgactttccagttgtttaaggtgggggattcagccacttccacagaatttctggtcagggatgccgatgttgcccagcagttgtgttgagctgggcagtgccagtggggagctgtgggcttctgggcctgggatggtggaggaccagggctgttgagaatgggctagagcctcggacagtcctcctgggaggagagcgagggtggccttgtctgtggttaggagggtctggtggccacgtggcctgtgtcccagctggggggtgttgtggt

SEQ ID NO: 128358 - DNA, 1043 bp, Homo sapiens
ggccccatgctcttccagggtccgtccttccacacccgtttccctcgcttccagagcccctggctcccgattgctttcccccaagacttcagtatccccagtgttgtcctagaccattggatctcatgttccctgggcccagtaacagctgccctgctggtgccattcctgtgccctgtcccagcagtcagcgcttggcagcacaggtctgcagctgggtgagtcacctccctagagggcctgtgcttgtcacagtgaggggaggatgtgacagacttagtggacaggtggttggggatacgacatccagtcccctggaatggatgggagagaccccaaacaataaagaattgtcccactcacaaggctgatgggactccgctgagaaagcccaggttagagggaaggaaggcgcaatgatgcctccaggtgtggtccttgttggaggcaaggcacctgaaccaggtgtgctgggcccactctcgcagaaacaccgtggaccagcccgaaggcaggggagtggccagggggaggggcctgacacaactgagatgtaccctatgcagtggatgtctctgcatcaggtcccaggtcctcagcagctgtgaagtagagattattgtccccattttaatgaggaaacagaggcttggcatagctaacaaacttgtctgtaaattccacagtaagtgggagacctagggttcaacctaactgtgtctgacttgaagagcaatcttctttcctctaagccaccctgagctcagaaaggaagcctgtgaggtggatggagggaaggaaggaagctaagaaggagaaggccggccaccacccatcatggggctgtgccagtgggggaccttgagcctgccgtggggttgtactggcctgatggcaggtcacatgcagtcttcagtgctctgcccggagagcgggtcagagctgcggggagccctctggcaccggcccccaggagcccctttggtcagcttggggtttctcttatcattccaaaaatgaggagcaggcccaagtgagtccct

SEQ ID NO: 128359 - DNA, 1052 bp, Homo sapiens
cccaacagagagcctgccaatggcaccaacccctctgctgagctgcaccgtagtcctagcctcctataaggcccaggaagagggcagaggggccagaaggactccatggcccaaagaccctcctccctgcaggcactgtgggaacagacacagagatggagaagcagggacatgctgagaggacgaagccaaggaaattagggaggagagtcaaagggatcaaggagagttggggatttgagctgcagcagagagggatgagggatttagccctctgccctaaggtgccattgaaaagggacaggacccttcggaggtgcctgtgaggagaggggagcaggacctctccctcctccagatccctgcctcctagtgccagcccctcacacgccttcatcctgaaacaggaagaggacggcaccaagttgggggtgctggatgaaagagacgaggggtgatctgtgagtcccatgtaaactttgtacattggaatatttatgtttgtgtacatatttgatgtgtgtgtgtatgatgagccaataaaccagactgtgtgcgtggccttgtttcccccttttacatcgctgccctcccaagcgtgtccctcagctctgctctctccttatccctttcttctcattgtttgccatgttctaagattttcttccctctgttcgcctgggtcccaggtggtcattcctcatccttctatgcgcattgctttctttcggccttcccttggcagggtgtggttgagttttcagcagcacagcacagggcccctgaagagaggacacagagttctttgcttcctactgggtgctgcctcccccacctttaggcagcttttttttttttttttttttttgagacagagtctcttgctctgtcgcccaggctggagtgcagtggcgagatctcggctcagtgcaacctccacctcccgagttcaagcgattctcctgcctcagcctcccgagtagctgggattacaggcgcccaccaccacgcccagcttatttttgtatttttagtagagatgggttttttcc

SEQ ID NO: 128360 - DNA, 1047 bp, Homo sapiens
tttcagaatgccctcagatctcacattagctggagaggaattcatatgcagtaggaatctataggatcttaaaaatctataggatgcttaaagaaattaaggacaatcctaataccattagtaaatcctctattttaattttttaaaacatagtttgtagtaaataataacaaaaagaataacaaaggcttgtacaaactcagcccaatattacaatatgttaaacagtgctaaaaaggcagaaactagacttcgaggcttgaaggataaaatcagttagtacaactccaagcacccagggggtgtccaataaatctaaattgatgatgattgagatgaggctcccaggttcccgatctggcagggccctcctgagatcgtatcatccatccctctgtcttcagacagatccataaaatgaagcccacatgagccggccaccctcagtgctgcttttaaagccatacaaggagcacaggttcacaacctctcttggttacttgatcccagtgggatgctgagcggcaggggcaagagtttctctctgagcctttataatcatgacattgaagactctgataagcaactcttgaaatgaaatggggtgggacaatagaagaaagcaacgagaggagaaaatacagccacatgcctcagaggagagtctgggacaatgaggaagaccgacaaggagtgggagagagaaggaaaggccaaggcaggtggaaagaagactggggaaggaaagaagtggggtagagaaatagcagaaaaattaaatgatgagtcagataaaataaaagggctgaaaagtctagagaagggagagagaaaatatgggaaaaatcaggggaaagaaagcaaaaggtactttttaagaaatgcctcatctacctttccccccagaatactgatacatttgaagcaaagcaaaacattttggccctgccatttgctctctgctgccccaagagaaggagcactgtagactgcagtagccaaagacacaggcagagaaagagaatgagcaaaacagtagtgcaatcc

SEQ ID NO: 128361 - DNA, 1055 bp, Homo sapiens
agctttcttctggctagacagattcaggtgttctgagttccaaagcttatacaatttgctgggccctatttaagaaaaataggcaccacttgcaagtgtggggactctgatgcttcaacatctttagtatcaggatggaaccgcttctgctcaaccattcattgcatccagcttagaggtggaaatgaccccagtaggcctgggagctgacttgaacagagacaagaagggaatgcaagagtgcttttgtcctttgccagcagagataattcttgattatcagttatggggccctttctgacattgtccaaagggttaatcactctttcagaccccaaaggctgccatggggcctgtcttcctattcttttctcctttcgccctggcattttgcttttggggattcagctgttgttttcttttttgtacctggttggatcaggaagacccagtaactgaagtcagaatagcatcttctaagggggatcataaggaacagatagagcagcaactggaaggtgggagaaaatgtccacaagataaaagggcccagggcgggagcctggaagccagcaggatgatcttaagaaaaaaagattagtatgattgtcagaataggatggtcctaaggcagaaaaaagagtaagacaggccatcaaagagatgactttggaggagataggacctgaaggtgtaaccagacacatatagaaagagatgagctgaagagagaggatggaggggggatcccttggtagcggggacttaggggcatatgcccaaactgtgggacaacaagcaatttgtcccaccctttcaggtctgctcagttcttattttgacctatatgtataatgggagctcttttctggatcatatagtatattggctataaaaacagacattgagaaagagaggaataagcagagaaaaaacagaagagaaatactgatgaaacaagaatagaggaaaggaccaggggatgagttgtatactggaatatacaaagagaacatgaagaaggagagggttctctgctggaaaaggaactctgg

SEQ ID NO: 128362 - DNA, 1016 bp, Homo sapiens
tgccactcccggctcccagacctagtggactaggggacctgctggtgttggggaaggtagtatgccctgtgatctgcacctcctcccccagccctaggcccttggcctgaccttacgcagtcatctccagccctgattcctgctgctgacctgttgcctggctctggcccatttccttgctctcaggctccccggatatccacatcatggccccactcatccgctccatcctcctggtgggcccctctggcatggggaagaagatgctggtcaaggcagtgtgcacagaaactggcgccaacctgttcgacctgtcgccggaaaacctgctgggcaaatatcctggcaggaatggggcacagatgatggtgcatatagtctttaaggtccggagcccccagcttttggcatttgcggttctcagacctgtggcaacaaaggaggggggctttgaggtcacgtcacccatcagcctactgggtatgatttcaggtgctgaactggtgaggtctccctaccaaccgggctaggagcttgggttccccctgcagcccctgtggtgggggaatgaagggaaaagggaggacacagagcagtttcttttcatggtaggatgagactgaatatgcagctcccccatggggggcagtgactcagtttaccctgaggtgtgagatatgtgcagcagcaggctgggaggtgggacttccaggtgtggggagtggagacggggctccaaggtcagcccctgctcaaggccggccctcatcctgccttctgaccagcagggacatgacccttctccagagacatctaacatctgatttctacattctgacccatccaggtagcccgactcctacagccctctgtgatttggattggaaatgctgagaagaatttctataagaagacccccaaagaagacaaggaggtgagggagcatggatgtgaaggccgtgtgggcaggtagcgtgagctggggctaagctggaaggcctgggcttgttccagtc

SEQ ID NO: 128363 - DNA, 1098 bp, Homo sapiens
ccggcccctggcagcagctcacctgtggagccatgaagggcactgtgtagagcatcctggaccccatgttcccacccccagctggaaggggctgcaggggtggaccccagagggaggaggctataaagccagcaggagcacccacactgccccccacaagcctctggcagccacggggagacaccaggggctgtgttgggtggggacacactccccaaaccagggctttccaggccatgtgcctgtgtgcacacacgtgtgcctggccaaagtgagtaggcctggctccttgaatctgtctatcccctgttctctgtcctctcacccagctggtctccactgacttaggaaaggcaggccgagcctggaggggtggccggagcatgctccctgggggaagggctttgccccaggcagatcctttggaggcctggctgccagaaggagctgaggagggggctgggctggggactggagggattggagggaagggagccttcccaggtctggtgacatcttggcaggctgggaggctaccactggaggcttggagccttgggaggaaggaggggccaggggctgctgtgtgggagtggaggtcagagacttgttggggggccagagggctggacccccaggagacgagagcaggccgaaagaggcaggggttggcttcagcagggaggggtccgtgcacggcagtgggtgaggaatgagcccggccgcccgggcctatcaacagtgtgagctcagcgttttcagtaattgtctctgcgcagagtgatatttaaaatacatttgggagccaatgaggcgggaaagtggctgcgagagcggctgccaactcggccgcggggcgggggtgcaggcgggggctggggccggaggctccaggggagggtgtgctggggaaatcgggcaggggacagcctggatgcatctagcagactcattattagagtaatttacacagacgaattcggctccaaacacagtttctcccgatgcaggcatgcccgttgttccgtgtgggtgtgtgtgtgaggccttgtgtgagcgtggtgttggggaaggagtgggtacaggcgtgtgtgcccg

SEQ ID NO: 128364 - DNA, 2619 bp, Homo sapiens
ttgcccagggtatagggaggggctgtatctggctgagttccagccagccgcccccaccccctggcaggaattccagcctaggtggctcctacctgcttcttgaacccagaacaggtgcctgggatagaaataggaagttacctagtagggtttattttgaagcgggatgccagtcacacccgggtggcttccatttttcctgtagcatttacaagagcagctggacttagatctctcacctttggagtacatgatgaagtgctacccagagatcaaggagaaggaagaaatgaggaagatcattgggcgatacggtctcactgggaaacaacaggtcagtaaaggagggtgtggtgaggatgccagatagctggcagactgtggctgggtgggtcaggggatactgtcctggcagcctgggtttggaagctgtccaaaccagagtctcctccatttgactcccctaagaacctactaccttttctttactctaggttgttatgtaatggagcattttgagggggcaaggatagcgtgccagtctctgacatgcccttgtgccatagtgcttgagggcaaaggaacttgtaatctagaaaacaaatttctggattcagatctggaaggatccaattcattgccaagagagcgagaggtgtgggcttagtaatggcaagggcttcaggtttccggatgagtctctttcaggcctcaagagactagtgggtctctctgagcctcactttttataaatggcgatgctaatggaggagtcagggagaaatgagggagagatgagctgtgctgtttggcggggataatgccaagttatatgtaggtcacggttctactcaggtgagcccaatccggaacttgtcagacgggcagaagtgccgagtgtgtctggcctggctggcctggcagaacccccacatgctcttcctggatgaacccaccaatcacctggatatcgagaccatcgacgccctggcagatgccatcaatgagtttgagggtggtatgatgctggtcagccatgacttcagactcattcagcaggtgaggccctggccagggggtgaggcacagcagagcttctagggggttgggtagggtagtcatggcatgtggagggtgcataatacccgcctactgaattaagagaaggggctcagagtgtagacacaggtggtgaggaccagttcttatgcctctttggggctacttagaaagccttaactgaaacacttcatttcttcagtagctatctggagatgtcaaccaacttagcattttgggcccaaatgggaaagagagttgggtagaaaacggtgcttttactactgtcccaagattcttcagtccaaaaatagtattctaaggaggattttgattagacagctaccacagtcatttgagaaaaagttgttgctcattcctctgaagctctggggaagatgagaggtggagaaaagaaggctgagagtgaagcctctgaatagatctaggccctgccagggagctgacaataggagtgacacagcagttcctggcttggaaggctccaaacctgatgatggtacccttgggttagaacatcccaaataacttagaagtagtgagacagtgagttggatatgggtttggggggcggagttttcttcctagacgcccctcaggacagtctgctgggcagaggcagggacagtgactagcccaggattaagtccaggttttgctttctaggttgcacaggaaatttgggtctgtgagaagcagacaatcaccaagtggcctggagacatcctggcttacaaggagcacctcaagtccaagctggtggatgaggagccccagctcaccaagaggacccacaacgtgtgagccctctacctgggttcgggtcaggagctccatctgggaactaacagctgctaacctgaccagccgctcaggacaggaccctggggctacactcctgcattgctgcaatactgctcccccagcctctcccctgcccctcaacctgccttagctgcactctcttacctacagctggacagtacctgtctgtttcctgtcctccttccagttacatctgtccatgtctggactcggctggccgttccctccagccccttgctggttatcttactctgagtgtgatgcagtcagaggcacctgcgggttagcccaggggcccaagccctggatttggcctgcggaggagcttaggatcctcgttttctgggttttggtgatgttggaggagtaccccccagcccaccgccccgattcctttttgcttctggtttggagctccggaccaggaccttcgtcctggtcagtttttaaataattatttagcagtgtaacttttagacctgcgtgacatctacaaagcgcccaataaagaaagaggaagccacggtccctaccttccttctcgggtctctggggccttctcctccctgcagtgccaacatgcactgcccacagcaggagctggatccagcgtcagtgtgtcgatgggaactgaagactagtccataggagctggaagaactttgtccctttacttctgatttgaaattgtaccttttctcaggcctgtgattc

SEQ ID NO: 128365 - DNA, 2763 bp, Homo sapiens
cccaaagtgctgggattacaggcgtgagccaccgcacccggcctcttttttctcgagatggggtctgtctctgtcacccaggctggagtccagtggcgtgatattggctcactgcaacttctgcctcccaggttcaagcgatcctcccacctcaccctcccaagtagctgagaccacaggcacatgccaccatacccagctaatttttatatttttagtagagacggggtttcgccatgttggctaggctgctgtcaaactcctggcctcaagtgatccacccacctcagcctcccaaagtgctggaattacaggtgtgagccactgcacctggccacagttacaattttaataatcattctgtaggttgcttttttaaatttagtatattttggactgctttccatgtgagtatatataaatcaatcacaatcttttcagtcactgcatagtatttcgttatgtgtttatcctgtaacttgttaggccctttctggtggatatttagcttgagtccagtttttgtttgcagatagaaaccatggtagtccacttatgcagggtttgtcagcttctaaatctgaatggtctgttttcccctctggagacagctcttgcagtcttttgtggggcttcagcctctagggaacggggaaggaataggaggtggtattggaaggctctgagcctcgtgacgtccgtatgaccgtgattttcaggactattcccagtgccacaggtgtctttctagctaacctaaggatttgcgctggagcctggccctggctgggctgagcgaggggcatagaattgaaaagactccgatttgatgttaggatatgcttctgtaatgcacgtcctctcttcttactgcacagccttagagccagggccaagttagtgccatccctcatccccctaaactctgagtgagaatccaggattgaaacccaggttaaagctgcctgccttacctggcacatttccatgcagggtaattatgatcagtacgtgaagacgcggctagagctggaggagaaccagatgaagaggtttcactgggagcaagatcagattgcacacatgaaggtagggagactgcagagtcaggctcatggcctcctgtctgaaagaagcagggggctcggatgagggcatttcgagaagcggtagtgatggaggatgtcgggaagaagttacgatcaacatttttaccctggattgaagatgaattgttgagcgcctgcacatactccaagctctctttggtcttttttagaactacattgcgaggtttggtcatggcagtgccaagctggcccggcaggcccagagcaaggagaagacgctacagaaaatgatggcatcaggactgacagagagggtcgtgagcgataaggtggggtgtgattgggtggggtgtgattgggtggggttgggtggcctaaggtgaggtggataagaaaggagccaacttgataaatgccctcttttcttcctagacactgtcattttatttcccaccatgtggcaagatccctccacctgtcattatggtgcaaaatgtgagcttcaagtatacaaaagatggggtaagttcagggcagggcatgggtggctggggtgtatcttagggtgagtggcagctcatgggagttgctcctgttctgtgctgaccacacctgctagcccacgtgctctgggggattttcaggtgtggcagctggggtgcctcatccaaggctgctcgcgggcctttcttcgtgtatatggaaagaagactactcagctgggttggtgggcggaggcagtgggcgaggcggggtctgctatgagtgcttcctcccgctactctcccttcctcctctcttggtgactgggaattcagcgggcttggtctgctggtcatagcagatctgtattctagccttgtgtccacatctctctcatccccacctcagccttgcatctacaataatctagaatttggaattgaccttgacacacgagtggctctggtagggcccaatggagcagggaagtcaactcttctgaagctgctaactggagaggtatggtgccaaggtgggcgtggatccctctaagattaggccttgcgatggttaaggaagaggggagtgatgcaggggctactactttgggagggcctgagtaccctggtggtgagtgagccatctggaggggtggagcagcagccaggagagggggaatgtctggttggacagtgctgaggctgggggctgttttcctgggacagggataggtagggaggagtcttagagtgtgtgtgtgaatacatgtatgtgtttaagcacgtttctattttctttttttttttttgaggtggagtctcgctctgttgcccaggctggagtgcaatgtgcgatctcagctcaccgcaaccttcatcccccgagttcaagcaattctcctgcctcagcctcccaagtagctgggattacaggcacacgccacagctaatttttttgtattttagtagagatggggtttcaccatgttcattaggctggtcttgaactcctgacctcatgatctgcccacctcggcctcccaaagtgctgggattacaggcgtgagccaccgcgtctggcccatgtttctattttcaatcagagcatttagaatataggaacatctgtgcatttagggatgctgcaggttctcaagtaatgtcatttcattaatattgatgaaaaatagaaatgattcccagctggggcc

SEQ ID NO: 128366 - DNA, 3440 bp, Homo sapiens
tacctttttatgttgtatctcctgtttctttgtctaaattgtttcatctttgagtgcaaggaccctgtcttgggttttttttatgacttgcttctcaggtagacactaagtaaatgtttgaagaggaaaggagaattagtctgcaagttgtaacagataggcgttcagaaaagggggacttagaaagcaattagaaagagcaataaagtcaggctgtggggaagttttattcctggccacagtagtggaggacagaagttaagagtgatgggagtaagtaaacagatatgggaggacaaaacaaaggaaagcagggtgtcggggcagctctgtgtcattgtgcactctgtaaagtttgggaaacatctgagtgctcagcaggattggagcctggtccttcaggacgttgacctttgtggagagccgagtctgtctcacgccatcttcccaaactgcttttctatccgcagaagtagatttgctgaccaaggagctagaggactttgagatgaagaaagctgctgctcgagctgtcactggcgtcctggcctctcaccccaacagtactgatgttcacatcatcaacctctcacttacctttcatggtcaagagctgctcagtgacaccaaactggaattaaactcaggccgtcgttatggcctcattggtttaaatggaattggtgaggccttggaaggggaggtgggaggtatctctccttagctcatctgtcactcacaagcatttatttagcatcaactgtgttcagagcaaagcatttagaatagggatgggagaccagattatgtccaggggaaaggaactagcaacgcagagcagtatgtgttatgtacaggttgagtatcccttatctgaaatgcttggaaccagaagtgtttcggatcttggaatatttgcattatacttaccggctgagcatccctaatccaaaaacctgaaattctccagtgagcatttcctttaagcatcatgtgagcacttaaaaggttttggattttggagcattttggattttcagattagggtgcgtccaccctgtaccacatgattagttacagcaggtgctggagaagttggtcaggggcgtgtgaagctgtggtaagtgaaaaaagcttcagataaggggtggggcaagaattggaggaaagttagaaaggaatcccaagaatgggggctggcaagatttgaacgaatgaagggaagaaaggtcctcaaaaaaaaaaaaatggatgaggtcccagtttgactggggtggaagaactagtggtgaagagggataggggagttcactgtaccaagcgtctgctgctctcccctctcaggaaagtccatgctgctctctgctattgggaagcgtgaagtgcccatccctgagcacatcgacatctaccatctgactcgagagatgccccctagtgacaagacacccttgcattgtgtgatggaagtcgacacagagcgggccatgctggagaaagaggcagagcggctggctcatgaggatggtagggctccagacctgggcataggggtgggcgtcctcccagaaaggcccccaggagcctcatggccatacactgtccacagcggagtgtgagaagctcatggagctctacgagcgcctggaggagctggatgccgacaaggcagagatgagggcctcgcggatcttgcatggactgggtttcacacctgccatgcagcgcaagaagctaaaagacttcagtgggggctggaggatgagggttgcccttgccaggtgagtccctccctccttccctacccccataactcccccatctctccagtgtttagtgttcactccagtggaactgtttggaacaggagtcagtggtaagtgtcaaatgagacatggacatctgcagtgtggagggggttgttgtgtatgggctagagagagagcttcctggctgaagtggtagagtgactcagttttctattggattcttagcacccagcacagagtttagagatcctaggggtagtcctaggtaaaacggtggagtaggtctgtttctgtcctcccaccaggattccctttccaccctttttgtactctagtcctgctaattccagctgtaaagataaaatgttagacggctattatgatagctgtcgttcttattctcttgtggcctggactcaaagtgagtttccatagaccagcattcccccaataatccccccagagtcactaaacaggtaattccttgccccatcattctctgtgaagggaatttataagacttgatatacttctctagaaagttgcctgcatgtgccttagagtataagcacagtggttccacatgctagcaaggattagctgcctccggttcacccaaggagcttttaaaaacacagatttctggtttgggaaccagagctttagagtctatccctcgctagactctggccaccccacaagataggtctatcttcagaccttcagataggtctaatttgttttagcagtttatttcctctgtatttttttgtcttctccgtagtctccaacttcagtgcacaaggctcataaactcataaagacttctacagccttgcctcgaactgtccttatatgcttctgagccccgtattctactcttcaatctcttctcttcgactcttgtttctgtcctgcttctccttttccctctgaggtatagagcctaaaattgatttcaagactcaagccaggagcctactcagaattgcatgtagcaggcaagtttgtcccgtcctgtgtcacatccattataattctgaggtgcttctgtctcctttaccgtccttcagagccctctttattcggcccttcatgctgctcctggatgagcctaccaaccacctggacctagatgcttgcgtgtggttggaagaagaactaaaaacgtaagagggtggaatgggggatgtgagcgggcaggtcccaaagggggaatctagaaaatggatgcccagaaactgcactgatgttagagcggtgagaaaggaactgaaggaaggacagagttcactttcttggacaagcagtgagcacctttagggctgttgaaggctggccttttattttgattgtttttctttagtttgaaatttatgagcttttttttttaaaaaaaatccttgttggttttgtccatatttcaaattcaagatcttaattaaagatatattttttttcttaattgtataaagctaaaaagaggtcttccatctaagatcatgatgcagtgacaaaggaaaatatagccaatatggtcatggtcctacagctaaagaactgaataagctggaatattgtaccaattttaaaagaaggcttttagtggtacgatgacttagtaccttctttcaaaaagtaaagcattttgttttttattgtgtctgtacc

SEQ ID NO: 128367 - DNA, 1052 bp, Homo sapiens
tgcggccggctcaccagccaatcacggcctcgggtggttctcggcgcgccgcgctgcctccttggaagtgtagtcctcaagttgcagcggccaagagtgagacccgccttgaggactactatgtatcccacagacctcgcggggccgcgtgacgccatcaggatgcgcgaggctcggggagggggcgggattagagtccaagagctctctgctagcgggcgcacttcgggcgctggaaactgcaaatcccagattgctcgttggataaaccggctgagccttcaggctttaccccacctctcgaaaatccattgagctgttgtggagttacgagtttttagagctacctaaccgactcaggcagcagggcgtgcaactacacttcccagcttgcctcagcgggagtagatcgaaacaatgggagaggagaggtgggagcgtgaggggaggactaaaatgaagggggcgctgggcagggaggggttccagaaagcggggcatcgctgcaaagatgttgccaacggaattccttcacgaaagaaagcgccttggtttcattaaaccttaattttagaggctggttcattgttaaacttttagaaggtgccagacgttgttttggaacctcggccgcttagcctccccgctgccgcattgttaggtttccactgaagccatgcaagtttggtggaaagggccccgagataaaaaggccccttggctgagatttgttttattattagttagccatgctaccgggcccgttactttccctttgagtctcactgtttaaaatctctcacatgacattttgggctggatggtttaaaaataaatacaatctctcaaggacttcacattacctacattgtaaactccaaatgtttagcctcaagtacaaggcaggccctttgtgatctttgttacttctccaggctcctgtgcagcagaagcctcaccatcagtgacgtttggggcagcaaaggaagctattgctccctttgagcatattctccaaatgtggcaccttttcgcccacagtccgtgactca

SEQ ID NO: 128368 - DNA, 1103 bp, Homo sapiens
cctgagtgggaggaggggttcctgtagccgttgcgtcttctcaaacacggggagcagagtagaaagaggctctggccccttcccttgtgcccaccgggcctgccgcagtggctcagcagccccttcagtagcccgcctgaggaccgatgccagaggcaggcattcttccggaaaggcccactgaggcaggctccggctcctctggttggggctgttgttttgatggatcgtgtgcttttcccttacctcttatcacttgctgtcatctgttgacttaggcccagtctgcagatgtgtgtagtgttcctttttgggttagctttggcagtattgagttttacttcctcctctttttagtggaagacagaccataatcccagtgtgagtgaaattgattgtttcatttattaccgttttggctgggggttagttccgacaccttcacagttgaagagcaggcagaaggagttgtgaagacaggacaatcttcttggggatgctggtcctggaagccagcgggcctcgctctgtctttggcctcattgaccccaggttctctggttaaaactgaaagcctactactggcctggtgcccatcaatccattgatccttgaggctgtgcccctggggcacccacctggcagggcctaccaccatgcgactgagctccctgttggctctgctgcggccagcgcttcccctcatcttagggctgtctctggggtgcagcctgagcctcctgcgggtttcctggatccagggggagggagaagatccctgtgtcgaggctgtaggggagcgaggagggccacagaatccagattccagagctcggctagaccaaagtgatgaagacttcaaaccccggattgtcccctactacagggaccccaacaagccctacaagaaggtgctcaggtgagagcaacatgtgtgcatagtccccagacactggccctgttttgggctggtgtaaatccttgcctctgcctttccattggcaatcggcgtcgggcgacttggagcaattctggcttattttccatcatggtttctttctgttttttccctccttctcaggtcttagaaagtctcacattca

SEQ ID NO: 128369 - DNA, 1078 bp, Homo sapiens
aaaacaaaggtgtgattatgaagaggatgtgagtcctttgggtgtaggagagaaaggctgttgagcttctatttcaagatacttttacctgtgcaaaaagcacattttccacctccttctcatggcatttgtgtaaggtgagtatgattcctattccatctgcattttagaggtgaagaataacgtacaagggattcagtgattagcaagggacccctcactaagtgttgatggagttaggacagagctcagctgtttgaatctcagagcccaggcagctggagctgggtaggatcctggagctggcactaatgtgaggtgcattccctccaacccaggctcagatccggaacctgaccgtgctgacccccgaaggggaggcagggctgagctggcccgttgggctccctgctcctttcacaccacactctcgctttgaggtgctgggctgggactacttcacagagcagcacaccttctcctgtgcagatggggctcccaagtgcccactacagggggctagcagggcggacgtgggtgatgcgttggagactgccctggagcagctcaatcggcgctatcagccccgcctgcgcttccagaagcagcgactgctcaacggctatcggcgcttcgacccagcacggggcatggagtacaccctggacctgctgttggaatgtgtgacacagcgtgggcaccggcgggccctggctcgcagggtcagcctgctgcggccactgagccgggtggaaatcctacctatgccctatgtcactgaggccacccgagtgcagctggtgctgccactcctggtggctgaagctgctgcagccccggctttcctcgaggcctttgcagccaatgtcctggagccacgagaacatgcattgctcaccctgttgctggtctacgggccacgagaaggtggccgtggagctccagacccatttcttggggtgaaggctgcagcagcggagttagagcgacggtaccctgggacgaggctggcctggctcgctgtgcgagcagaggccccttcccaggtgcgactcatggacgtggtctcgaagaagca

SEQ ID NO: 128370 - DNA, 1042 bp, Homo sapiens
ttgatgtattccttgtcatgggagtcctgcagcctgttggtcttcacatactgccacagggcctggacaatggctgagcggctctgtgtgtgcagccccagcagccgggctaggcggggatccagtttgaactggggaggctgggaaaaggggactgtgaaagttagaccaaagggagagaaaggaaggagcccagggccaggccattcaggactagggggatgtgttgattgaggaaacatgcccctggggaaggataggtttgggaggggaaggaggtctctcaagatgcaccactttgggacctagccctgccctgagggccttgtgtggcgtgtacggggcagcatggcaggtgcagacctggtagtccagcatgaggagcagcgtgcagcgcacactcaggtccccaggccgtttcacctggaagccgtccgtctcctgggtcgtgggtgtccgatgccactgtccaggagagaagagctgtgtctcccaaaggcccatctggagtggtggggcccaggactctagggtggtccctgacccaaatctgtgctggttcttcagggattctggcctgtgggagggtggcaattcaagggcggaggggctcttggtcttacctcaacgaggtggttgtcagggccataaagatctttgtccagctcgatgaccaaactcttgaagaaagaagagaacttccgcttctgtttgctgggctgtgggagagcaacagggaccatgggggcagaacagggacgaggtgggaggagcagaaggaggccaagttggcagccgacagggcagtgggcttagatgaaatcctctgcacttggaatgtctctaggcctgcccctccacccagcctgggctgactccctagcccttagtgcagacaccttgttctgttctcagtgcagcccatgcccaccccaggacacctggagagacctgggccgggacgtacatcatccaggagcttcccctccacccgtagctcccaggaggcaatgctgccgtcggaatcctcagcatcaggctt

SEQ ID NO: 128371 - DNA, 1088 bp, Homo sapiens
acagtggcacaatcttggctcactgcagcctctgcctcctgggttcaagcgattctcctgcctcagccccccaagtagctgggcctacaggcacacgccaccatgcccagctaatttttgtatttaagtagttatggggtttcaccatgttggccaggctggtcccaaactcatcacctcaagtgatgcgcctgcctcggcctcccaaagtgctgggattacaggcatgagccaccgcgcccagtctcaaataagtgttttcactttttcctggcctctctaaactccacacctctcaagatgtcaaaccacagtgtggactgcagtgtaacggggcgacctccactcatcagagttgatggccttagagtctttcatgcccttttctatattttgcctttttttttttaagtcagtattgcattttctgatttttcttgataggaccttgctaagcagtactctgacagactagaatgctgtgaaaatgaagtagaaaaggtaatagaagaaatacgttgcaaggcaattgagcgtggaacaggaaatgacaattatagaacaacgggaattgctacaatcgaggtgtttttaccaccaagactaaaaaaagtgagtaatttccctaaatttgagtaggcactaatgtccagttagtgatgaggtcaaataaattgttgttgtttggaaagttacaatccaaagtcagaattcttttaagtgactttacatattgaacaatttatcagcttgaaagtcaatgttacaaattcttaaactggaacattcccaaggtaggcttttagagaccctcttgggcttctaaaatgccacagagctgtatgtcacattctgatcctttctagcgtgtgaacgttgagaaataatggggaataaaggattcccaagtttcctagaagcctgtgcaggaggacacagcacagaaggcttcatccttttcctgttccagtagaggtcagagggcagtccgctgagtgctctcaagcagggccgaggagatctgggtggggtcacctcctctcattgccatggccaggtagtttgcatctagaaatgtcactgtggca

SEQ ID NO: 128372 - DNA, 1046 bp, Homo sapiens
tgcacctgaaaacatgatgctcagggaagaagccagacacaaaaggccacgtactgcactatcccatttatatgaaatgtccggaataggcaaatctgtagcagcagaaaatggattagtggttgccaggggctggggggcaaaggggagggaatggggtgcaggccatggtgtttctttgagggatggtggaaatgttctgaaatgttaaagacgtccagctgtgtgagacggcccctctgagcagccctgcctggtggtgccacgctgccgcccccttgaggacgtgcaggtcacagggtcagcctgtgctgggttatgttcagtagacttctaggcaggcagcattttagtttttaacagtgaactcagtttatatcctctgccgtcagcttttctgatttcacagggtaatctctccaaaatgggttaaattcaagtacgttttactttgtcttatttttaacaggataggaaaaacttgttggagacccgattgcacatcactggcagagaactgaggtccaagtaagtatctgtgtgctctgtgtcctaggtgctctgggcctttttacattggcttatttgatcctctgtgagcgtcctcttaagataggtagggcaggtattatcttcattttataaaagagaaaattgaggctttgaggttgaaggacttattagagctgtcactggtaggtaagtggcaaagtgaggactcaagacttgcaagcactatttcctggtgtaacttccgagcaggtgggaactccatgcctatcatatggtaggcacttggtgcatgtttgagtgaatgagtgagtgatacaagcaggagacacctggtactcactagctcattagttttgaattactattttttttccctaatgtattaatagcttgctatgaccttcagcacggtgttttatctgatttcaggctgttggcccatctgtaaaacacacacacacacacacacgtttgccacatactagtgaaatcctaactttgagatctggtgggttatttcatctccttgtatg

SEQ ID NO: 128373 - DNA, 1022 bp, Homo sapiens
ttgtctcctacagtttcaaatagccgtctagtaagatggctttattgtgatgtttgtgagtcagtcagttgaaatcctgggtgtttctgataaaatggataaaagagctatcatgattaaagccttcttttaaaaaatatttattttttagagacaggatcttgctctgtcacccaagctgaagcacagtggcataaatatagctcattgcaacctcaaactcgcggttcaagcaatcctcctacccaaacctcccaagcagctagggccacaggcatgggctaccaggcctggctaatttttaaaaattttttgtagagataggatctctctgttgcccaggctggtcttgaattcctgggctcaagccatcctcccaccttggcctcccagggtgttgggattacaggcgtgagccaccgggcctggctaatgtctttttaatggataataaatcgcaattttgttttcctacaattttcactggttttattttacagaatagctgaaacctttggacttcaagaaaattatatcaaaattgtcataaataagaagcaactacaactaggtatgtatggcaaagtatgcataattttttaatgaaccaaatatagaaataatgacttccctttttttctcaatgtcttttcaaaaatttgtagctttatttcatttataatccaaaagtgatttagaagtttactaaaataaaaatgtaaagcagaaaatagcttttccaataaatatttactgtctgttctatgatagtgggaagaaagacactcattacagcttagataaaatgttagagaatggaatgtaaggtgtgctgagtgtaagatgccagttccagcaaattcttcttgaaggagaagagctaaggctgtgtcaggacagtggggaggccatggtggcgtgcgttccagactgagagccttatgtcagagcactatggtgtgaatttgaggaactgaggaaggtccagtgtggctgtgtgtggagaatgaggggaggggagt

SEQ ID NO: 128374 - DNA, 1115 bp, Homo sapiens
cttaacagtgacatagttacaaccaaatgtaggcatatttttaccaattatgtggcgtgatggtatgcaggattaagaattccattttgtccaggagcaaggcctgatgtctgtaacccagcactttgtgaggctgaggtgggaggatcacttgagcccaggagttcaagacaagctgggcaacatagtgagactccatcactgcgaaaaatacaaaaattaactgggtgtgatggcatgggcctgtagtcccagctcctcgggaggctgaggtgcaagacttgcttgagcccaggagatgaaggctgtggggagccatgatcgtgtcactgcactccagcctgggtgacagagtgagaccttgtctcaaaaataaaaacaattccatttaacatagaaaatggactgttacctggtaagcttaatggctttttaaaataataggcagttctgatttttatagggaaaacccttgaagaacaaggcgtggctcacaatgtgaaagcgatggtgcttgaactaaaacaatctgaagaggacgcgaggaaaaacttccagttagaggaagaggagcaaaatgaggccaaactcaaagaaaaacaaattcagaggaccaagagaggactagaaatactggcaaagagaggtacccagagctctgggcttgtcacccactcagctgcttgggggcagcactggatcacacagttgggggatcatggctctcactgagtctcacctcaacagtctaacatttttaaggctgtcatcatcataactgtttaacattgagttcatggaggtccttttggttttgttacagcagcagagacagtggtggatccagaaatgacaccgtacttagacatagctaaccagacaggcagatcaatcagaattcccccatcagaaagaaaagtaagtactatgagaaatgtgtggcctgttcttagatttgttgtcagggcagaggtggttttttagttgctttatgttggaagtgttgtaaagggttggaaacagtgctccatctccagcctcgtaaacagaaaatgtcaccacgtggtgagcactggcatccaatgggcctcaccctgtgcttttcagcgcattag

SEQ ID NO: 128375 - DNA, 1017 bp, Homo sapiens
ttttaatatcgtcagcatgaaaatgtaacagtgttgaatattaatgctactaaaattgtaaaccaaagcaatgttaataaaagtacactctaaatgaaattttttatttttataattttttttttttctttagagacagagtctctatgttgttcaggctggtctcaaactcttgggttcaagtgattttcctgcctcggcctcccaaagtgctgagattacaggtgtgagccaccacacccagccttctaaatgcaatttataccaggctttaagaaaccactttgccccaagcaaatgatcaggtttaaatatagttttatatataataataagtgttgatttctcaaaactaaaaggatgacatgtacccctctaatatgagacctctgctttgggttttttgtgtgtttgttcattttgttggttttcttctctctcttttttttttttttggctgcacaaataaatactcactcctgggtcaaacttgagataagtgcatattgattttatttttaactgacatgaggccatttctgcccacgctcttgatgcttagtaaaacatgaacgagcctgttaaagcaacatgcaggagatggagaagttcggccacatgcccattgctttcctgcgagtggcaggagagtcttctgtcactgggaccagaatgtgcctagaggcaggaaatctcaacacgactgtgagatcagaccacaatccacaaagcgctgctgtttctctcaaaggcaggttctcaggctgagccgtagatttggagaaagcacccctcacccagctccacatctgtgtgtctgcgtgcacacgtgtgtaaaacatggtgtatgtgttctcaaacattcacgaaattagaaatgttgagagagatgaaaataaatataaaaatactgctgtgatacatttttcttgccgcacccacaactggactgtgtacatgggccctctttaggagactactgttttaaagagtaaatgacaaaattaaagtcctttt

SEQ ID NO: 128376 - DNA, 1554 bp, Homo sapiens
tgtgacctgggaaacccatccagctttgtatcccaagtgacggctctgtccacatttgtgcccctacacgcgttagcacgcctgtatgctgtggccactgacctcgcggtgctcgtggtgaggctggtgtggcgccctgctctcagcccgaggtcactgcctgtcctgagatggctgctccctgacgcacccgacttgagtcttccaagcccccttccaggttgctctacgctcacattgcacagaagcatgacttgtgcacaaagggccatggtgcacacgccgggagctcttaaacatgagagtcggctgtccactcgtatggctgacgggggtggcagaagaggcgccaggggctgatgctgtgacccctgcgctctcccctagttggtgtacatgggttttgatgcactcgtggccgaagctgcgctgagagtgttcagaggcaacgtccagctggccgcccagacccttgctcacaacggaggaagcctgcctcccgagctgccgctgtcgccagaagactctttgtccccgccagccacgtccccttctgactccgcaggtaggtctgaggtctttgagggccgcattgagagcaaagtgtcttcagaagccaacagatgtggccctaagccacggcagatgtggagactgagggggcgtcccctgacgtcaccgggccggccacctggacagtgtggccagcaagaggcacagtctgaggttgactgtggtcgtgcagtgtccccaggacaatcctcacataattcacttactcctgcggtattttattgtaggaacctctagtgcctcaacagacgaagacatggagacagaggccgtcaatgagatactggaagacattccagagcatgaggaagactatcttgactcaactctggaagatgaagaaattattattgcagagtacctatcctatgtagaaaataggaagtcagcaacaaagaaaaactaaataatgaacagaaatagcgctaattttctgcttataaatgctatcattatgaaaaggctaatgcagctctttctgttcttactttttatctgaattacaagtcctctttgggtgtaggagggggtgggcaggggacaagtccaggaggggtcccagggccttcatgcgtggtctcggggaagaagcttcctctggcctggcgcaggccgttccatctgcctcccaggtctgcgtccctaaccccttccccagcttggtgttttaccccgaaacaggaaggaacaggggtcctgtagaacaggggtcctggggaaggtgtccagggcagggtcctgggaagggtgtcccgaccgcttcctctccagctgtggctccatctgcccagcttgcctgcctcctgcacccactgccctgaccttcctgcttcccacgctgccatctctgccagggtgccacatgggttcctgtgccaccctttccccgcccctcaaatcgtcctttaagtcttccttccaagtgctgtggggcataacgatgaggcgctggccttgggggccacaccaggtcgcagcaaa

SEQ ID NO: 128377 - DNA, 1082 bp, Homo sapiens
agatggtggtgagtctgggagtgaggactcttcgggcgtctcctggtgcctgaaggaaacagggtcaaaagcacaatcggaggctggttatggtctgggtcaggaggggtggacagtggccttactgggcgtcggggggccctgaagttctggggctcaccagaacccctcctcctccaccagtaggagggcagggcaggcggcacgccctcctcagtccgtaaaatactctcggagttcggcttcacactaacactgtgattgggtttctttctcttttcagactgctgtggatgtttttcgaaggataattttggaggcagaaaaaatggacggggcagcttcacaaggcaagtcttcatgctcggtgatgtgattctgctgcaaagcctgaggacactgggaatatattctacctgaagaagcaaactgcccgttctccttgaagataaactatgcttcttttttcttctgttaacctgaaagatatcatttgggtcagagctcccctcccttcagattatgttaactctgagtctgtccaaatgagttcacttccattttcaaattttaagcaatcatattttcaatttatatattgtatttcttaatattatgaccaagaattttatcggcattaatttttcagtgtagtttgttgtttaaaataatgtaatcatcaaaatgatgcatattgttacactactattaactaggcttcagtatatcagtgtttatttcattgtgttaaatgtatacttgtaaataaaatagctgcaaacctcagtcctttgtgctacttgatgtggctttcaaagaagagaagccttgtcctgagtttctcacttggcttcaggaaggccccaggttggattccagaaaccagtgaagatgtggccacaggaggaggtgtgctgaggtggctgctgaccgtggactccctgcgcagtggcctgcagatgttggggctgggttacagctgattgaagctgagtggccctggggggtctgtgaggggagttcctccccagtgatgaaattctctccttccaccctcaaatccctagaccttgactgaaatg

SEQ ID NO: 128378 - DNA, 1081 bp, Homo sapiens
catgcctataatcccagctacttgggaggccgaggcaggagaattgcttgaacccaggaggcggaggttgtagtaacccaagattgcaccattgccctctagcctgggcaacaagagtgaaactctgtctcaaaaaaaaaaaataataattaataataattaaaattgattcaatgacaatccatcttataatgtaaccaaatttgcttttttgaaaattgagtttaatttttaaaaaataggtgtaatgcgcatggtacaaaaataaatagtgccaaaaggtgtaaatagtaaaacttaagacgttcctaccctagctatctaaccccccacccccaccagcaaccacatttaccagtttctagtatatgcctctaggatacttgatacatgaatatgcaaatatagttttaagcttgggttttgttttgttttttttcctttttacacaaaaagtaatacatctccctcttggagattattccatatcaatacctatggcctccttttcccccaaggctgcgtaatatccagttgttgggatatatatcctaagttaactgctgatcaacagttagactgttgctggtcttgctaccatcagcagtcccttaatgaacatcccggacgttgttttagacatagggtaataatgcacataggaaaacttcctggatgtgggctatcatagggttacagttcatgttcttgccagcagtgaatgagagtgtctatttccctacaccctcaccagcactatgtgttagcaaacgttttggtacttaccaatctgataggtgagaaaaagcagtgtacttttaaaaatgcagtgtacttttaataatgcacttttcttcttaggaggggctttgatttttcctatgttagaagatgtttgtatttttccccctatgaattatcctgtctgtgtacttggccattttttttctattgggtggttggtctttgcgtgttgatgtgagattccccttgatatgtgaagaaaattagcgttttgtatatgatctgagatgcacagttttgttttcagtttgtcttttatttatggtttttatttgag

SEQ ID NO: 128379 - DNA, 1890 bp, Homo sapiens
tggaggaaccctgaggtttccattttggaagcttggaagaaaataaatgtgtttggctctttgagcttgtacacagagctatagcatgtgcctccttcactcaccctacacactccctgctggtggtgatgcagtgtgctttagcagtcagattcttgatgctttcattagagcagagccatcctaggctttcaccccctgatacctgtcctcttgacagaagaataggagttggggcttatatggaccaggggagcagtagaagtctctgttagggggtcgggggcatggcacagatgacgaggctcattagaaattagtagggaagggaagagccgcttgagtaggaaattgttttggattgttgggttttgtatctttcttttatagttgactatataatttattgcctaaaccaagacactttcagagttgtgggctgggggtgctaataataattatgttgggacaacagtgtaacttagaatgtcctgggcaaagaaatacagctgttctgtttattgtgggactctgacactatcaagacttcagtttgcttttgtatccttatttggaatctcctttaagctcctgaaaactggtgatgagaatgtaaattgataaatcactttcatgtaatgttactgtggaaacacgttttgtatcaggcaattcagggaaccagtatttcataactgtttggagtgtgggccctggggttacacttgcctggatttgaatcttggtttttgttgctaacccagtaaccttaaggaagcgaatgagggctgggcatggtggctcatgcccttaatcccaacactgtgggaggtggaaggatcacttgagcccaggagtttgaggttgcagtgagctgtgatagcaccactgcagtccagcctgggcaacacagcgagatcccatctctttacataaaagggtgaagaagtctttctgtgcctcagagctttatctataaatagtgataactggcattgttgcaggattgtcacattggggttaaagaggctgtgctctttctttgtagaccttcaatgctgctgaggcaagtgtgacgccagcatattaactgtgttgacaggctgcatggtggaagtgcacatgttcttaatacttggagagctgtctttgaaaagatttctctaaagaataaatttctttatactgactacttatcaagttggaatatgtgttcctctggggtactgttttgccctggaacataaatgtacactcaggtatcaaacaatttaaaatattttagtgatgtagtaatacaaatagtgaaaccaaaagcaccagtgtttaggaagagtatatgatatgagataagacaagagcagtggtcatattagcagccctgttgtcttgccccttcgggttatattacaactgggtaagagtatttggagaatttttgcacaaaatatatccaaatttggctactttaaattatttgtagtcattgcaactagtagttcttgaaggttatatttacagttgagagacaataaattaaagatgtgctctttatttacagctcaggatggtggcacacaggcatgtcctgccgtggtttcacccttcattctgttgaaaactggatgataacaaactcaggtgtttactgctccaagagctgctttataaattggatgcatacgggggctggttctaggattaagactggtagtagtagggtaaaatgattaaggggcaaattcttttaaaagtaatctatagtaaatttgttcactggcttccacatttcaggagtgaaattgcacgcagtgaattgctgcatagcggtatttgttagcaagttctatttactacttagtagtttatgtcggtacatccataccacta

SEQ ID NO: 128380 - DNA, 2040 bp, Homo sapiens
gtgggacctctctcagttgtatgagggatagattctgctgcctggctctagtcatataggacggccaatcaggagattggaggactcatggtgagtcaagatggctggggcgggtatgcaagataaatctgttccacttccttgtcagagttccaggtggttatttttacattgtttctgttagtagttctttcctcttttgtctatatttgtttgaagtctgtctccctctaattctgaattgacttttccggaagttattcaagtctgattttctttcctcccttgtcagggaaaagaagttgtgacaaattgcttggatccttaagcttaagtgggaaggatggcttcaacacagaacatctgtttcattgctgttttatccgtcagtaaaactgttacttcttttatgtactaaaagttcttagcacttaactaatattagctctttgtgctctgatgccagacttcctataaattaatggaaaatttttgtggttttggtttattctagacctcagactttacgtagtatatttcactttttcacaagaggaaggatttgccacacagcattcaaattactattataggatatgaattgttgcgtactttgtctctttgaaaaagaatcaaggtttaccaagcttgattttagccagtcaccgtatttcctagctaaataatggaagtaggggagaatctatacaagtcagagagttgttcttttttgtttcatggggcctttctctgagactgctagggactctgtgcttgattggttgtcattgttcaaacttcaggtggtttcgagttaatttttttaaactaatgtttaatttcctttttccctgtagcttttacaaagttgatcacagtaaatggacaagaatatcatcttcaacttgtagacacagccgggcaagtaagtgacctctggtatctcagaatcttatacagcatatctgacagtcttggtcctagcactgatttttaaaagtaccagctatgccaagaaaacccctcaggttgtgtgcagacagtccctgactcccaatggtttggcttgcagtggctcgacttaacaatttctcatctttacgatgggtctattgaggtatttgatacattttcaactcatgatatttttggtttacagtaggtttatcacgatgtaaccccatcataagtcaaggagcttacacagataactaaatgttagtatgctgtctacttggtcttttctaagacatttctggcagttatcttttaataacttgtttttctgctttagaattgctttaaatatattaacattgtaagggttaatacttattacaggatagtggttttctattttctaaactttaattctatattagagagtcatattagttgctttctttctctttgtgatatgtgttctcctacattagggcaaaagtacatcttttctagaggaaaggcataagaggggcatagggcagaaattagctgatttaatcttatgaggacctgggccataaaataccagtttgactggagtccaggctctggtttgagtgttggctttagtttatatagtagagtctctgggtgggtggatttgagagtgattactagattagggagtttcaatttatttgatagacagtagataatggccaaaagtcaaataatccccccagaaaggatattcacatgtcggttaatgtagcagggatgtgtggaatggatcaccagggaattggctggaagcaagggggaaaggagtacatgaaacaaagaaaagcccttttgacagcttagctgccccattaccatgacatccaggcctgcttttactagaaactattctgtaagactgaatttacccttcttcactggagggtgaggaatgtaaagaagctgggatttcagctcctaactcctgcccttgcaacatttttttgagacagagtcttgctctgtcacccaggctggaaggcagtggtgctatcccactacaacctgtgcctcctgagttaaagcaattctcct

SEQ ID NO: 128381 - DNA, 1047 bp, Homo sapiens
gagtctcactctgttgcccagagtggagtgcagtggcgccatctcagctcactgcaacctccgcctcctgggttcaaactatcctcctgcctcagcctcctgagtagctgggatcgcaggtgcccatcaccacgcttgggtaactttttttgtatttttagtagagacaggaccaaccatgttggccaggctggtctcgaactccagacctcaggtgatccacccgcttcagcctcccaaagtgctggaattacaagcatgagccaccacacccggccagcaaccactacttttaagccaactttttaataatttaaattttaaggaatgcctttggtgtgaaaacattgtgcaactatacctatccatagtttggaggagaaacaagcataaattaaacccagtagtgtaagatgggtgttaccatgcctctccttcactctcactgcacgtcctgttgtgatggagttaagtatgccaggcatatacagcatgtgtgtaataatgctccaaggatgcaagagagaaggaagggtttggaggtgaaattagggagagaccacttcctcattcctggtgataaagtcatctgaactatgcatctcatgcgatttcttcacagggcatgtaccctgttctaaagtcctccagtagacattttaggtagcagaagagtgagaagctaaggctctagttgttgatttattaacatacaagttcaattattggcgattttgtgaaatccataacatttcttaatttctagatactgctaggcctttcatactgaatgacataggatttctagcttcaaaggagtttttaagataaagacttatgttacatattttcagattaccctttttttttttttgacacagggtcttgctctgtcgcccaggcttgagtgcagtggtgcaatcttggcccactgcagcctctgcctcctgggggcaagcaattctattatctcagcctcccaagtagctgggattacaggtgcccgccaccacacccagctaatttttgttaattttagtagagacg

SEQ ID NO: 128382 - DNA, 1483 bp, Homo sapiens
aattatattatttccttttttctttgtaactcttgcccatatctttagggagaaaatgatcgctttctttcctttctttccatttgtaagcaaaacaaaaaccccacaaacccttatcctacccacataagggtataaaaagcccactggagtccttagaagtaccttgcaaaagcccttaagaagtttgttcccttctttctttctaattaaatttcatttctttaagcagtagcattcagtgtaaataacagtttgttttttttttactccttctaatttttcagtttcaataacatgagaggagttttcttcttgctatttttgttacctgaagtagttctgctgtattttgagttaaattctcctttacaggctagcatatataacatggtttcttttcaacacaattcattttaaatttgtggaattcttaaactattgtattcctatatcacaggcaagcctgtgattaggtaccaataaatactaattgaattgtttcttaatttctgttgaactgtgttttgtatttcatttgtataaaattgagatcttttgtagtatctaaatggctaagagtgacctttggagatctacgctttaatttcgttcatttgttcagaaatctcaatgtttacaatgtgtcggctggccctgtgctggcttcagtggagtgttcactaaatgaatatcattccaaataacttaataaaacagtagctatgagaatgacttttaaggaatgggtactaccttagggtggtcttgaaggtttctctgtgaaactaacatttgagctcagatcagaatgacaaagatgagtcatatattcagagatgggggcagtgggggttgctagagtaaaggggccaaggcaggcaggaactccaggagcagaagggatgtgactggagcctcaggatgggttgtcgggggctgttggcggatgaggtcagagtggtaaccagagcagggatggcctggtgtttgtgggccacggttagaagctgggaatttagggcaggcgcggtggctcacgcctgtcatcccagcactttgggaggccgaggcgggtggatcatgaggtcaggagttcgagaccagcctgaccaatgtggtgaaaccctgtctctactaaaaatacaaaaaaaattagtcaggtgtggtggcgcgtgcctgtaatcccagctactcaggagggctgaggcaggagaatcgcctcaacccgggaggcagaggttgcagtgagccaagattgcaccactgcactccagcctgggtgacacagcaagactccgtctcaaaaaaaaaaaaaaaaaatgttgagaatttattctaattgcaatgaggattggaagcagagaagtagcgtttaattttcaaatgctcatgtaggttgctttgtagagaataatttcaggtattagtaattctagagacattttgaactgtattgggctgcggataaggagtaaatagg

SEQ ID NO: 128383 - DNA, 2125 bp, Homo sapiens
tggtcggtgcctgtagtcccagctacttgggaggctgaggcaggagaatggtgtgaacctgggaggcggagcttacaatgagccaaaattgcatcactgcactccagcctgggcaacagagcaagactctgtctcaaaaaaacaaaacaaaacaaaaaaacaaaagtcatagaggtttgttgaagggccctacagaagggaaattggagacttcttacaaaagagtagtggaagatttgtcttggggcttatactgtatagggaagaaagaaacctggtggagattggagattcaaggtcatggtttagtatatttctaaccttttcgtctgtagccaccttagtaagaaacacattttacattgtgacccagtaataaatgtatgtataactgagatagaaggttcataacacctttcttgtttgcagtccatgctgggattcctatttcttaaaaaaaaaaatagtatgggtcatggctcagtatattgacttcatgaatagttaggccacaccactgatttgaaagcattgctggtagagatggtttggattagatgatgagaatcagaaagggagaccactggggaatactgtgtattgattgataggtgggaagaagggcaggtgccagaggaacagcagtctgggtggtgaccaggcacttcttggtgtgctcaggaggtgggttgctgaagttgcatggagaggattactggtgcaaaggccagtgggctttcaggcccactgttagcttgtgtccatggtcatcaaagccccttaaagttatgttgtgaatttgaggtggtgaaagcagccctggaatgggttgtgtcctagatgcattacatcggttctaatggactcccccttctgcagaatgccttgatagactagttaatagattgaaaatctggtcttccccatcatatcccaatgaacaagcaatgtataaactgggaaaatgctgggcttgtagggagtcggtgggaggggggacagaccgtggctggagtgcagtggcacgctcaacgcacactgcagcctcaacccttcggctcaagcgatcctcctacatcagcttcttgagtaactgagactatatgcacacatcaccacactcagctaatttttatattttttttgtagagatagggttttatcacgttgtccaggctggtctcaaactcctggggtcaagcaatccaccggcctcagcctcccagagtgctgggattacaggcatgagccaccacaccgggctaataagttattttttaggagaataagcatgataacaaagtcaatattaatctgaaaacttaaaataattctgtaaacagtgcctattttgcagtaatcatgaggtataagattgagtcaacacccctgaaagtacaccttctgtagtgaaaataccagctgagaaactcactgtgccattttatcattggaaaaaataatacaatgctgttccctgataaaagctcagaagaattttttaaaataatttttatttttaaaagttaaggtgggttttggtttggaggaagagtatttgacagttaattgtaggaattgagatactgccttttaaaccatttatagtaatttatgtcattaaatgagtgatttgtgtttgaggataaacacacatctgagtatgggctacttttccatttatttgggatcactcctgtgtagttttcatgtaacatttttccaaagagttgatctggagtgtgagattatcttcagcaagcgagtaacagtgtttccagacctgaatttgctaaggacaaaagccaaagtaaatatatgaagttattgagagaaaaaggttaaaggtgatcacagtagagatcaccaatgcctttttgtggttgcaaacaaactagaaaaacctaaccaaaagatctgaactacgtctccagaagacactccttaaagccagaaattacaactggaactgagaacacttgaaaatgagcggtggggtttatttatgaagattcattagcatttaatgctgacttgtcaagatttcaacactagttaataatagcactttttaatggaaatggcaaaaaacagcatgttagcaaatatagccttcctatccctt

SEQ ID NO: 128384 - DNA, 1032 bp, Homo sapiens
gattgatttttaaatataatcagctgtgcgcagtggctctcgcctataattccagcactttgggaggccaaggcgagtggatcacctgaggtcaggagttcgagaccagcctggccaacctggcgaaaccctgtctctactaaaaatacaaaaattagctgggcgtggtggtgggcgcctgtaatcccagctactagggaggctgaggcctgcaggagaatcacttgaacccgaagggggaggttgcagtgagtcgagatcgcgccactgggcgacagagcaagactccatctcaaaaaaaaaaaaagaaatctaacattttaaaggttctggaatactattttagtattttaattttcttcaatatatgttgggcttctggttattaaaaaaaaaaaaggagttcctgtaggattggagctttaaatctaaactggtattagtttagaacaggaagtgctagaaaagcctttacgttgtgctcttatgggcaagttaagaaagcagggcagtttaaagatagtgatagaattcactccgaagtgtcatgcttgcttggtttgcgtcttatctgtagtagaattgagtctttctctcccgcatttctctttttgttgtgcttacatgtttgcagaaggactcctcatggacatttgaaagagaagttggtgttttagcaagatacaccatcccaccttttgcaggattgagagttgaatgttaataactacctgatggcatagtacataatttgtgaatggggatgcaaatatgggcttttacagttaatacagttttatgagatgaaatgcttttctaagacttctgtgtcttagatataaatgtgtctgcctattttgctagctttatttttttttttattttttattttttgagacggagtctcactgtgtcatccaggctgcagtgcaatgtcgcgatctcggcacactgcagcttcaaccttccagcctcaaggatcctcccgcctcagcctcccgagcagctgggactatgggtgtgtgccaccat

SEQ ID NO: 128385 - DNA, 5620 bp, Homo sapiens
aagtcactaattgttcaaatatcaacatggaacctgggatccagcctttattggcagcctgaatccatgctcttgtctctgttctcttgatttcctcctctgcattttgaggagttgggaccgcgaggtgttctggctcttgggtgagccttccctagtcagtcaagtaagtacttattggcaactatttggaaatagtagtccctgaataatcacgttataggcaacaagtacctcggctacctgatttcaacccaagagaatgacctaaagatcttgactgatttacccttttcaaatgtcgaaatggtagctctagtctttggtgagcagggctagttttatcacttttttttttttttttttggctacagaagttccttatgtccagttgaaatccattctgttttatcttccctctattcagcgtcctcctgaggacggagatgtgacaggccaccccttagccttgtcctcacaaactgttgcttgttaaatactgtgctaacttagtctccggtgggatacagggtcacttttagtccctattttctgtcttcagtatttcatatttctgcaacctaccccacttctccatatttattttcaagcgtagtcatattaaacgattttggagaggttaagttgctcccaatcttgtatttgatttttttttttttttttttccgagacggagtttcgctcttgtgacccaggctggagtgcaatggcgcgatctcggctcactgcatcctccacgccccggactcaagcgattctcctgcctcagcctccagagtagctggcactacaggcgtgcaccactatgcccggctaattttgtatttttagtagagacgggtttcaccacttggccaaacgtcaggcttgtctcaaacgcctgacctcaggtggtcctcccaccttggcctcccaaagtgctgggattataggcgtgagccaccatgcccagccgcatttgattttaaagtgtattatgagccaggatattttgtagtatgtggggtcttttttaggggaaggagattaggttttgccagcaggtttcttctagtaagccacccttttgagaattactcagcatgctcacttctgggagcttactggcatgtttgcttgcaaatggtggtgctgtaccagagaaatttgagtacctgtgtttctagattgtggtattttgtgatgctgagctgtttgtcctatattctgggggtagagccacataaaaagcctccacacctttcttagaatgttctcttgattaaatacattaagccagtttgactagtaggatacttgtcattgtgatttgtcatgccacaaactttatttttaaagttgtcttcagataaaacaaaaaagtgctatgtttgtttaactagttggctttcttttttttttttttttttttttgtgacagagtctcactctatcacccaggctggagtgcagtggcgggatctgggctcactgcaacctctgctgcccaggttcaaccgattctcctgcctcagcctcccaagtagctgggataacaggcgcctgccaccccgcccagctaatttttgtatttttagtagagactgggtttcaccatcttggccaggatggtcttgaactcctgacctcgtgatccacctgcctcggcctccctaagtgctgggattacaggcatgagtcactgcacccagcccactacttggctttccgttttctttttttctttttttttgagtgttgtcagaactaccaataggtaaaatataattctcaggtagtctatacaattctccctgccagtcccctgtacttttcctggtatttacaatgttaaagcttttaaggacacgtcacctataactctgggagtctggctttcagggagtgctttgtattaactgttgccgtgatggccaaaagtaccagctccctgacattccgttatttctaccacaacggagtagtcccgcgataggaagtaactcaacttaaaatggtagtgttacgtaaactgtcttcagcctggtacatctttcactgggattttacctgtacagagagctttggtaacctagtttaccattagaccataattaaaagctggttgtcatatataagcctcttacatacagttaataagagggatgggatcacaggcatgtgaaagatcatagggggaaaatgaaacagctttgtggtttggaagaaggcaattcagcaaaagtactcaaattattactttgtcaaaatgtttaggtagtatttagagtcttcatgaggaaagatgtcattaaatatttggttgttcccagcagattctgacttactgtttattttttaagttaacctatcatttgttgacactttttattgaaaaattgaaaggcaaaacaatatttgctatgtatgacatctaccagtatgtgaaattgtatattcaggtgcttaatattctgatgttgtatacttgtgggtgggggtagtcctgaagtgcccactttgtattgaaacttgaaattactgtttttcagtctcattcattgttctgcacaagagcataatcagaattcagatttctgattatggctttccagtgccaaatgttattttgctgtccatatgggttatatctctctgtacttcatcaccccaaaaagaaactctgtactcattagcagtcactctccatcctgcttccctgtcagcccctggcaaccactaatctttctgtttctatgaatttacttactctggacatttcatataaataagaacatacatatgtggtcttctggggctggcgtcttttacttagtataatgttttcaaggttcgttcatgttgtagcatatgtcgcttcttcctgtttagtgctgactaatattctgtcatgtgagtataccacattttttctatgcatttgtcaattggatatgtgggtggtttcttttctttctttttttttttggctattattttttatttatttacttttctgaggcagggtcttgctctgttgcccaggctggagtgcagtggagctatcatggctcactgcagtgtcaacctcctggactcaagtgatcctcctgcctcagcttcccgagtagctaggactgcaggtgtgcgccatcacacccagctagtttttttatttttttgtagaggtgggaaccttgctttgttgcccaagctggtcttgaactcttgacctcaagcaatcctctggtctcagtctcccagtgttgggattacaggtgtgagacaccacttggagctctactttctggctactatgaataataatgttttgaacattcctgtacaagcttttatgtagacatgttttcatttctcttgggtacattcctaggagtggaattgctgggtcattatggttaactctgtgcttaatattttgaagaactgtcagattttttccagaacagctgcacaattttatattcccatcagcaatgtatgagggtttaattttctccacattctcgtcaacaattgttacactgcctttttcattttagccatcctattgggtgtgaagtggtatcataggatttgcaaataatttctcctgtctgtgggttgtccttttaccttctcgatggtgtccttcaaagcagaaagtttttaatttgaaggccgatatatctatttttctcctgccacttatgcttttggtgtcacatcttagaagccattgcctaatccaaggtcatatagatttactactatattttcttctagatattttatcctgttaactcttacattagatctgtgatctatttgtggttaatatttgtatatgatgtgagggagggatagaactttatacttttgcatgtggatatcaagttgccctagcttcttttgttaaaataatgttctttcttcattgaattcccttgtccgagatgaagtgaccgtcaatagaagaactcactcattccattgatctgtatgtctgtcctgccagtaccatacgatcttgattactgtagttttgtagctggtttttaaataggggcatatgagtcctctaactttattatttctgaagatgtttttgggtattctcagtcccttgcatttccatattgaattttaggactagattgccagtttctgccaaaaaagcaactgcaattttgataaggtgtttcacggttttgcaggtatcttttaatgtcttaacagctggattctcatctctgctcctgaattcattcccttaacgttattttaatgaagtaaggagtacttgaatagtttttcaggtagttgaatattctttgataccgaaacttcataagtgatagtttgcaaagaatagttacactatgcaatctgaaatcatattgatgaatttgcccaactccgcaggtctgctttatacttggaatggatcttctaccatgcctggttttgtagcgttactggtcatttggaaaatatttgttcatcgttacgcagatcttccacatgttgacacattttattatacaagcatttttaaaaatcacatttgttaatatcaccaccaatctctgcaaagtcttaagttttagaacactgttcgctatgagtggtgcaagttttccaaaattctaatttcctccttgagttcaaataatttccttggcaacatgctaccagtttttacttgaattgactgttttgtttctttaatttccaagaaaatgtctgccagctattcacatttgcaataatgatagtttgtcatcattcttgcaagtaaaaaaggcattccatgataaaagtggccagttcagatcacttctcaaatgactgcacaagtgctttttttggaaacaaccatcatacttcagtatgtaacagaggtgctttatgtgtacatctcattttgtcgtgcagaatattaaaaagacaggtaccaaagggtcaagatttaatataattttactgctttttcaaggacactgttaagtagaaacagctcttttcccactgtgaatgcatggtagtaaagaatacagtgacttaccactcagtttgtaactactgtttttgattcatgccaaggggtgccgagctagcagttttccctaccattgcttttgcacccttagtacaaatgggaactttgtggaaaaggcaaatgataacttaatattgctatgaatatcgttttgacctcatgagacccctgaaaagattttggtaaaccccttagaggtccacagaccaccctttgagaaccattaaactgttgtaagctaggatcttgttcactgctgtgcaaaatcgaattgacagtgactgcatcctaaatgctgttcacagcgatatggttcccacagtgttagaagagcctcctaggagaggccctgtagcgttgtgagagacaaagatggcaaggcaggaaagaacttggcgtggttagaatggaaggaagcacgagggaggccagagaacatcaggagagttatgatatctgtgtgcctattggtttggcctctgattgtgttgcatttttggatgagttgtgtttggacctggtgatggcgaggctcccagagagtagtgaaaattgcaa

SEQ ID NO: 128386 - DNA, 1049 bp, Homo sapiens
gcgggcaggtggcggccgggcggagggcgtgggaggcgcggggcgggggccgtcggccgccgaggagtccgggtctcgtctggggaagtgaggcggcgccggggagccgcgctagaggctgccgcgagggagtcacacctgcctccccgccttcgccgcgggcgcgcgtgaccggggctggcggtctcccccaccccgcccccgatgtaaggaaaagaaagtccgtgggattttaacaaaggaagcagcgcctcggcttcattccatctgtggtgaagtttacccttgtaaagaaaactagggatttagaggacgtttgggcactgaacgcaagttttctgcataggaaacctaggcgatcccccaaaagaggtccctctggaggccctcgagatgctgctggcggcctgggtaggaagacagagaaaaaggaatgtctgatctctcggtgccctatttttgttcgggaaggaataaggtcaggtacttgcaaccaggctgttgaagtaattccaaagtctttttgttttctttttcttcccccaaaaggttgacatacatttgaaacagttcctagcagtcgccttattgctgaataaggtggcttagggtcgggttggggggcggacggggtgttacagaacgagcggttttctggcctgtgtgaaaccagagcgattgaacttagacacgcttcagggtgaggctgtattgtctcccgacatccggaagcctggagaaattagttcatcttttcgggctgttttgaagtaactgtctatagaaggcgtgcaccgggccacagttgaggggatggggaggtgaaagcgagggttccgaggctcccgtgattgcggaacggggtgactatctgtcatgggaagcttgtacctgcctgccgctcactggatgcactccccaactgcgctttccaccgcctgtgccagggtctgtgctctttgaccaagatcagccactgcatgcttactcatccttttaccacctctccgtcgagagccggggggaaattaagggctgaaagaagcttg

SEQ ID NO: 128387 - DNA, 1003 bp, Homo sapiens
tctcaggtgatccgcccgcctcggcctcccaaagtgctgggattacagatgtgagccaccgcgcccggcctaaacctttttttaatacatatttgtaagagtgcacaactgaaatacttcacaccttcactaaaacatacctacatatttcttagtaaaattttttaagagtggaattctttttttttgttttccaagttaaatctgacatatttagaatgacaagatgttacgtggatccaagctgcccgaacgattgggtgggagatgggagcttgggccacctgctccttcccacatcgccctcctccgaagcctctggatcatcctcctaaggcactgccagacacaggtagaaacccctggggtagagaaccctgctgttaccatgagctttgaaactttcatcttccatccactgacaggtgccaaacaaaaggagacagaaacggagtgaccgccgtgaatgtagacgccctaggaggagaacttgaacaaagtctctgggtcacgttttgcctcatgaacactggctgcaagtggttaagaatgtatatcagggtttaacaataggtatttcttccagtgatgttgaaattaagcttaaaaaagaaagattttatgtgcttgaagattcaggcttgcattaaaagactgttttcagacctttgtctgaaggattttaaatgctgtatgtcattaaagtgcactgtgtcctgaagttttcattatttttcatttcaaagaattcactggtatggaacaggtgatgtggcataaggtgagtgcacggtatgttcagatcacagtgccttatgtccgaatacagcaatatgtcaccgccgcagccggggcgcacgcgtgtgaaacaacaccgagcttgaatgtggaagtctttgaaccttttaccaaatcagtttgttttctttagatttgtcaaaaagttgtaatttgaatataaataattactttaaaattgtaatgacacttttacacgtaagtg

SEQ ID NO: 128388 - DNA, 1678 bp, Homo sapiens
ttaaaaatatagaacttaaagacatttcagagcctgatttttactgaattatgagatcattttctgagaaaaaaggagcattacccttcaagacgtttgaaaattagcctaagcctatagtgtgcaacagggaattcgctatgttgagatggactagatgacctaatagggctttctttttttttttctctaaatttctaggagtctcatgatttgaatattgatgaactctttgacttgaacattttgtttcttctaattgttcatcttttcctgataattataaggtacaccaggaggatggaatcaactataccctttataaaaggtggatttttgaaaccgtagaccttattttgttatactcaaacatgatcctagacttttctctcctgccatatccctcctcctttaaaacagcccatgaaaagttaatttttaaagattcttttaattctgttcagctggcttctttgttcctagtagacaaaaattggagctctccaaggagaattcaggatgtagaggcgggtggcgtgaggactagcttagcagtggctcagacagctgccgtcaaatgctttgggtttggaaatgtataggttcttaataaatattacttaatcctgacagcaggaccaggaatttaacatgaacaattaagaataaaggattcaattcttcgtggcttacaggtcttaatatcccaaatagacctgttcttccctggttctatacgcgttcttagtgagtgaagaggagatggaaaaagattacagtatcaatgctctgcaatagtttgtgaatagttaaatagaagcatagacctacaaactggttcaaacaaaagatacagtcctttgtaattttctcatgttaattcaggcatccaggtagactgttagaaaaaactaactttaatttgttggacatactttttcattcaaatctggacctttgaacatgacaagagtgtgttctgggtctagaacgtttgcgtttatcttccgtttagatgtctgatatgccaaagcctgccttcatgaagcagaacctggatgagcttggaataggaacgtaccacaacattgccttcatacatccagacactcccatcatcaaagccttgaacatatttgtggaaagacgaatatcagctctgcctgttgtggatgagtcaggtttgtgtgtttggcgctgacaggcagaaataattgtttatctcagggtgcaattattgtaagatgacctggcacaggagatacgtggggaaaatgaaaacttgggtatggtgaataaattcagcaccaaggggcacgcaggatcgtaaaaaaagtttaattggtttattttcatatgtccattaaaatatgatttcatatctaagttttcatttaaaatagacaaggttatttatcagtgtttaacttttagtaattatgtcattaaaactgattttaaatgaatttctttttgtcccttaagacatttttctaacatatatttttcatttttaggaaaagttgtagatatttattccaaatttgatgtaattgtaagtattttaattttgttcaatctgtcacctagaatgcattttaaacattcatgtaatgtgtttttatgtttttatcttgtttcttaatttaataatttctaaccttttggggtgtgagga

SEQ ID NO: 128389 - DNA, 1121 bp, Homo sapiens
aaatgctattatccaagctatgttttgtttcattttccaaatattttttctatgttgtatatgtatatttataaataagaatttttttatttgcaggtacagatttatgaattagaggaacataaaattgaaacatggaggggtaagcactattggatgtttaaaatcttttagtatcgggaaagctatgtttagtatgaaaagtatgttttcattttgcagatccttttctctctgctccataaaatgttatataaaacattctctttatttctgttaattttgatagtatgctactgtactaaagctgaacaatataagtattgtcccttctgtttatagacatgtataggacaccttcagcaggcaaggccttatcctagggccaggaatgtgaagatgaatgagctaaccaagccccacctcgctgcccacaatggggccaccgctcactactaagtctaagccctcagagatttgccttggtattaagaaatgcatcagaggcatgcctaacttgaaccaaagcaagcatctgttcttatttaaacctagtaattgtttctttacaaattgtggagaaacttaggacaaatgaacctcaaactagatggtttggagcaaatagcatggaagtaatttgaagaccatattctcttcattgtcacattgacattcaccctgtaaaatcatgatactcttttctgccatagaaccatttcttaaattcgcatttcatgattgtaaggtggtggtctcactgacacttgtcatggtgggttggtggagaggaccgggggtgggaatcacggcagacccagtctgtctgcaacagcggagcctttggagggtgctcaaggaaacactggtagaaatggagggaccaactgaaggaaaattttgaattcaaaattgaagagtttggttctgtgtttcccataatatgcttgataggagaagcaacctttgtagctggctgtgaaatcagaatacatcttggagttctcttacacccccaggggccctttcaaatccatacgatttagaagtttcactgagtgatgggtttggtttattacggctttgtcaaaccaagctaaacaaatttggcatgggatctg

SEQ ID NO: 128390 - DNA, 1020 bp, Homo sapiens
caccaggccctttagacctccccagggacccccaggtgtggcctgcttctgttcccatgccccacacctgccgtgcgtcctcagagggctccccgggctcttggagccccttacctgtattctgtgcctgccacccaggacttacaggatgaccaaaaatgactttgcttttgtttaatttcattttccaattgtttcttgttaacgtatggaaatacaattgatttttgcaaattggctttatgttctttgctgagttcactttggaccaggtaaccttcagagtcacttttaaaaccctaagattcttgattatttgacacaaagaaggaagcatccaaatacaatcttatagtagggaaaacagtaggcagttgttttaagagatgcggtctcgagaactgtgactacatgtttcaataacaaaataatgagaagttctgaattcccaaaataaaggaactactggctcaacctatttcagcctcacgcccatcccccagaaggtttactttttaaaataccagattttctgaccaccggcatttctaccaacttaaaaataagcgacagtaggccgggcacagtggctcaaacctgtaattccagcgctttgggaggccaaggcgggcagatcacttgaggttaggagttcaagaccaccctggccaacatggtgaaaccccgtctctgttaagaatacaaaaattaaaattagccgagtgtggtagaagtcacctgtagtcccagctactcgggaggctgaggcgggagggtcgcttcaacccaggaggcggaggctgcagtgagccgagattgtgccactgcactccagcctggatgacagagcaagactccaacaaagcaagactctcaaaaaataataataacaagtaacagctgatttgacttttacccagctttccatgtattactcattttggctaaaccctagagaaagtcaagtgagtaatacatgaaaaatgcaatgccttatggatgtccaaggtgactgatcca

SEQ ID NO: 128391 - DNA, 1008 bp, Homo sapiens
agcagtgtggttgttgtgagtgttgttagcccacccgtgagggattttggccggtgtgaggttctggagggggcggcatacctcccaggcaccttcatgtcctatctggtagctgcctgcagcgtggccctggcggtgtggcctggaatggggagtagcagacaccttctcctgacctggctggtctttatgcatcgctgctggctagatgctagatgctggccggtggcatctggagcccctccatgcagagtgtccgcgcccgtcagtctggaggacacgacaggttccatggttcctgggaagttcctggagcggctgccgcctgcgtggctgggatcacagactgaagggctctggggaagtcacagattcatgtacaataaatgacaccagaaagggagttggagcacgggctttgtgctgtcgctggagacaagatgcaaaggtgcccgcagaacccaagtggcttcatagaattagaacatttgctatgtgcccagtatagccaggcccgtgcgagggatggccagcccgttgcaatcctgtaagagttactgttaccagcttatgtagtggaaacacaagctagaaagtcagaagcagctataagagcatgacatgatcaaaagggaccttggttagaagttgcaagaccaggatttggttctggctgagtcacggctctaccatgtggctctgagcaacttgcttgaatctctggacatctgttaccccacctgtaacagaagggccttggagaatttctgaggccatttccatcctaacaccctgtgactgcccagttctctgggtttaggcgctagaggtgagggcacccgcagcaggcccgggccagttgggaacagaagctgacaggcaccgctcggcagggggctggggctggtggttgtccccaaaggtgtaattgctgttctgggtctagcggtggcctggggatgaggccaagctaccctgcatgtcaaagggccaggggaggagcagatg

SEQ ID NO: 128392 - DNA, 1023 bp, Homo sapiens
acctcttccccagccaggcaacatttcattcagaggtgataatttaaaatgctgcacccaggtccagggcctacaacccgctgagaagtgaaatacccacagtaggagagttaacgtaaaggaaatccttgatcagagcttatgaaggggacactggctatttaatttcacttaatctggttttccaaacttacgtgttcccttacgcccacccatgcttttttttttttttaatttggcctgttattccatataaataaaaatgactttgaaaaccatgagtcatctttatatagtatagacagtcttagaattgggggtgtcctcatgggtttgaagtccaagcttactctgggtgcttagaatgtagcagttagaagcttcctctgtaatcaggagatggatgtctgtgtctgatgagttcccaacctcagtgacagtggattccacattgcaaagaagaaaggaactttttgatcactaataacatgccaggcaccatgttaggtacttcatattaactatctcaccctaatttccactaaaatccctgaagagaacgatcacatccactttacagatgaagggaacagaaacctagttgctggaatccgctggcattcatttcacttctgcccgtgagtattaattggctgtgccctctaggaaaacataaaatatgtggcccctctgcttttaagaactttgctgaagactctttaggaaatgcctttgggataaccttggaccgtctaagagagaccaactaagaacatcttagctgccttggtctatttgcctgtgacacaaatggagagagcaatggtctgtatatgcaggaagacaacaacagctcaattttacaactcttagaaaaactaaacagcaagttctgggctcaggactctgtaaatgctttgataacttattgaataccaagctaagggggtgttatctaattgtgaaaaacagggcaaatagtcacattccagtttttatttcctttaagcttgggcaatggtt

SEQ ID NO: 128393 - DNA, 1063 bp, Homo sapiens
gtctcccttgccgactgggaagaatgactctcacggatgaatggcatagctgacacaggaaagagtatgtgtaggatgcaagcgaaaaccctttaactaatactactattaataattatgtataacagctggacacagtagcatgtgcccatagtcattttatttcaatttatattatttgttttccttactgttcttttctacctcatagaattaggaggtagaaactactgacctcatgcttgctccctgaggctagcttttacctgaggtagcttttaccttcttgtcttccacaggtctatagtgagcgagagctgctactttttacttgggcattcattcaaagtgttgaagaataacagcctctaccatcccttattcactggctcatcagctgtcccaggttttgctcttctaggtatttgccatgttgtttgtccttttagtttcttttctatgtgtttgattaaatttgcttctttctcccatcagcattaccttgtggttttcttctgcatttgagacacagtgttagacatttgatgcattcatgttcttttcgattgtcttacagagaagagattcataaatatcagggatgtctgaggatcattcccagggagcatatgatgtctggaatttgctctgaacctttcctaattcagcaatcgccttatgtgtaattataaactactattggtagctatgttttcttctagctttctgggtagataaggaatgggaaagaataatgtgtatttttatgttgtcatcacctggtaatttcacaggggtatgtgggtactgtactgttgtaaattaatatttgtactcacatgactacagctgagttaaaatatgagtgtgcctcttttatggaaaaagctaataaatatttgctgtttgacaatttgtaatgcaagagtatcttacaagaaaatagctggaaactactgaaaggtaaataaatacattttaaatgcattaaatattatgaaaattagtttattctggtagaaaatgaaagctgtcctgtgaaatagaattttctcattagtct

SEQ ID NO: 128394 - DNA, 1036 bp, Homo sapiens
ctgtaatcccagctattcaggaggctgagaggatgatgacttgagcctagagtgtggagtttgagtctagcccgggcaacagagggagaccctgtctctttaaaaaaaaaaaaaaaaaaaaaaaacttttacattttcaagttgattttgttagaactatacaaaatcacctcttttaaatattttctctcacagtgttttcaaatttattgttaagaaatcatggactaagaggaagacttcgtacttttgttggcgtgttgagtattttgtttcataatgaaaccgtctaatgaaactgtttaaactggttagccgtctttcttgcctctccttcttcacaataagcattcatttccgaggatgtggtctgctcacacattatactcttctctaagatttcgcattgcacagaatgtgaacaatgtcctttaacctcttctggaacagaaatacacttcaaaaattatacaaacaagtatgtattaattgttaatactaagcgctatgctaaatatatggggctgaaaagatggaaatgatctctgtcctcagggggcttgtttatggtaagtatagcagtgcttaccctacaggcaaattgtctgttgggatatcttgggttcacatacctgtaaaggatgattctgctgtcaatgtccccctccaaagtcacaatgttgagcatctcattttccagccatgacatttcacctttctggttccctctgtctggtaacaactccagcaattatttggccacaccaggtcctctaatccataggcctatccacatttttcatcttgcctcatacttccacatcctcacatctctgtttccctggcttaaatctgtgatttgtcataatcatcccactgcatataccttgccccattcctgtactgttgtacctccctggcaaaaacccacgtctcagcttacaaggcacctatccctgagcagctaccagaccatgactgaagaaaaacgtaaaaccatagtgacttgtctcactttaataaattcaagttcaca

SEQ ID NO: 128395 - DNA, 1072 bp, Homo sapiens
cggggttttactatgttggccaggctggtcttgaactccagatctcaggtgatctacccaccttggcctaccaaagttctgggattacaagcgagagccaccgcgcccagccctaacttcttgacctatccgaaaacagatagttcctttattgcttctgaataccattatgcttaattgtataaaagaaatgatgggattttataaatgtatatgtttttaaatttagtcttacgatttactatgtaaaaaatactctctaaagaattataatatggtttgggaaaaagaataacatctgcctgatagagttgttgaaagttagtatattttacagctcaggaaaccaaggaatcatgatgttgagctgttgtggataggatgagccagggtggttattccatggagaatctggacagagttagccaaatcctgttggtgaggtctttgagcagaaaactttttcattttgcccttaggtgctggcaggtagccaagagtgaacctaaggaaagtagtttcccgggttttttgtttatttgttgttgtcagtgaattctgtaagattagtctgcctgtttttatcacaaagaccattatttaagttttgaaatgagacaataaattcctgagttgtttcttgtaccttttccaaaaataaacatggctgttgttctgtgctagtttttatactattgttgaataagatggtcatgacctctatgcatagtattaaggtattgcttagcccaaacaagatagtaacagatttgtttagaaatttgcaagcatgttgctaaccatattacagtaatttttttcatttattaacaaatatttattaaattgttgctatattctacgcattattataatctccagggatagacaaaagctctttccctattggagcttacttcctggtatgggagagataaacaataaataataaactcagggaataagtaattatgtatacgtaagaaggtgataaattccatggaataaggaagaccaggtttaatgtttagtgggtggattgaagttttaaatagggtaatcttggtagggc

SEQ ID NO: 128396 - DNA, 1035 bp, Homo sapiens
gtgacagggtttggggaaatgggggcatagtactggagtggtccctgcagagaggtgacaaggctggagggaggcagggctcagatgctggagggctgtgtgtgccctgggaaagaattcagggttctcaatgtgttctctaagttcatggcttttttttggggggggggggatggagtctttctctgttgcccaggctggagtgtggtggcatgatgtcggctcactataacctccacctcccaagttcaagtgattctcctgcctcggcctcctgagtagctaggactacaggcgtgcaccaccacgcctggttaatttttatagttttagtagagatagggtttcaccatgttggccaggctggtctcaaactcctgacctcgtgatctgcccaccttggcctcccaaagtgcagggattacaggcgtgagccactgcgcctggccagttcatggctttttgatgttgcttaaagctcctaaccctttttttcccaaatagttgcttggaatgatttgatacatggaagctcttctgttatcttggtatatcataatttattcaaatcttttttattattgggcaaaaaaataaaatttcaaatataaagtcttatatttgtttccttttgaaacctcattgaggagaagctggacatcagctcatgagtgctgcatgaaacacttgcagtgattttggtaaaaagaactcacatttttatgtaccctctcttccaaaaaagaaaaaaaaccctgaagtttaaaaagtctttattcggctggacatggtggctcacacctgtaatcccagcactttgggagggcgcggtgggtggatcacgaggtcaggagatcgagaccatcctggccaatgtggtgaaactctgtctctactaaaaatacaaaaattacctgggcgtggtggcgcaggcctgtaatcccagctactcaggaggttgaggcaggagaatcgcttgaaccagggagtcggaggttgcagtgagccgagatcgcgccacagcactccagccta

SEQ ID NO: 128397 - DNA, 1018 bp, Homo sapiens
ttcttaactattttgaaatggactaagacttaataaattcctttgtaataaaaggcatttatatctcattttctttgttatcaatgtgatttatatatggtcagctgaacatttatgcactcaaaatactcatttcaaacattctttgtgcaaagcattgtgctcgatgctatggagatacaaataagtctgtaactaaagtaagtattcctctttgctagtattccagctcttacccttcatttctttttcttcctacaggataagctacaatactcttttaaagtaaaatattctgtagtatttgcttgatagtttgttgtaaattttagcaagtactagatacaactttagaatagctgtaaagtgtctttatatatgtctcatacagtttgaataattgtgggactttattttcagatgatttgaaaggagaactagatgaatatgtccaaaaatacctccctggaaaaattaaagtcataagaaatacaaagcgtgaggggttgattcgagggagaatgattggcgcggcccacgcgacaggtatcacttctcgttagctttgctctacaggtgttggatgacaagggctcgagcctcagcgcctgtcctgattctgcaaagtctatgaagagtagtgtttcaaacggacattgccagcaggagagatgaggcttgttctgtttgggaaagacctgttcataacgccaagcctgccatcccaaagcacatagtgcagggggctgaactctcaaatcctcagtgtctattttcatagcaacccttctttgatacttactgcccctcaaatatattttatatcttattcacttatataagcagaaaagcccagaccaaaatgtaactgaatttttatgtttttaaatacaaaatttaaaatgtatgaacccaaactgtcgattggaactatgcttttaactcttagtgcggagtgcatccctctggagccacacatcatgactttaattggttaatggacgtaagattgacttac

SEQ ID NO: 128398 - DNA, 1045 bp, Homo sapiens
tgtcgatgatttatatgttgctaactagaagaaaggtgtatcccattggcaggtgagagccactgaagctaagagggtggggggcagtagaaaggaaaggtgggagatggaagaaacagaaatgagcaagaggcgtccccgagagcgccaccagctgcgcctccctctctccggggagaactgctgtgtggcagccatcatccatagttacagtgcatgtcctagtcaccagtgagaaggcagctgtgttctctgtactctgtttactgaggcagagagatgtcttctaagtgtgtgccaaacttcaaaatattttgattaaaataattgtaataaaaatacctacatacaactggccaccgtcatggcaccaaaacatcttggaatactcaatatctgggcttccaaagagttgagttgttacggtgagactttgactctgtttactgaagagattctgaattgcctgtcagttttttcaagagtcgcgcgtatgatttgtatgggtccctcaatcacagcaggacactgcacgcagcattactggctgagggacgtccttgttgaccaccggcagtgaagtgtagtggagcagttaggccgtctggggctgggagggtggcagtcgtgtttcatgctgtgtcagcgcgtcatcccattggacgggtggttgtacctaaattgagtgttgtgacactctcctgagcctctgttgtttcctccccaggagaagtccttgtgttcctggacagccactgtgaagtgaatgtgatgtggctgcagcccttgctggccgccatccgtgaggaccggcacaccgtggtgtgcccagtgattgacatcatcagcgccgacacgctggcctacagctcgtcccctgtcgtccgcggagggttcaactggggactgcacttcaaatgggatcttgtccccctttctgagctaggacgagcggagggagccactgcaccaataaagtaagatcgctcctttgtttgacaaattcctaccagtgcttccttaaaagagaacaaaatgatattaa

SEQ ID NO: 128399 - DNA, 1050 bp, Homo sapiens
cacacaaacacatcaagatgtgacagctaaaaatgctcccaacattatgaaatgtctgttggggacacagtcatcccagttgagagccactggtctaacttgtgtgagtccaactcccaacgtgtgatgtttgtcaggtctctccttggtggaccttagagcccagttttgatccccaaggctctgtgagattgtcagaaggaatgaccatatcaggtggctttccatcagaaatggttataataggaaaagaactttcgagacttagaaaagtagccttcgtatgccagatactagcatattattagcaatctagaaaattcagttgtatggcctggctcattctctgatactggataaaatgattcataatcattaattcaatttttattagttatgttccaaaatgacactgagtattttaaacaaaagtagtaggtaagataactgactataaggaatgagtacagtaattttcctttttctaggtcaccaacaatggctggaggtttgtttgccatgaacagacagtatttccatgaacttggacagtatgatagtggcatggatatctggggaggagaaaatttggaaatatcatttcgggtaatttaatttttgcatgctcaattaataactgtgtagtggaatatgattttcatccatgatctcatattttctttatattctccttgattatttttttttcgagatagggtctttctctgctgcccaggttggagtgcagtggcgtggtcatggctcactgcagccttgacctcctgagctcaagcgatcctcttgcctcagcctcctgattagctgggactacaggcatgtgcctgtaatttttctattttttgtagagatgggcgtctcactatgttgcccaggctggtgtcgaactcttgggctcaagtgatcctcctgcctcggcctcccagagtgctccatgactatctttattgacaaattgtccttaatgaatgctactttgtcagaatctgtgatatggataatatctgttcgaaatgtcaagagtatacatgt

SEQ ID NO: 128400 - DNA, 1048 bp, Homo sapiens
ttctgctgagctcagatgacttctgggaacaccaggcatgaaatccatgtccccactctgaccctcactaccacctctgctctgtgatttggttcccagagctaagagcaaatagcagatcactgccccatttctccacttgttggcctggcctctgacacacgaagttgacacttccatggcctctgtccggggtgtattcccatatgcctctgcgctcttggaaagcgtcacataacttaccctcacagaaggcagctatgccggcaaggcaaggatctacacttgaggtcctacacttgcgtagagaagttcccataaagagaatataatgaaaggcaagctgaagcctgtcattacactctgttaagtccacagtgtcacctgtcatagcttatggacacctcaaaacttttcatatcaaacgcttttcataagccacttggaaaaaacagctttcttacccttccacgttgaaggactttgggtcgttttggccctctattgacaaaaatgggttgttggggtttggcgtgggacccagatatctgcatctctgggtatacattatccaaataccatttaaatgatttacagcccaacttctttctcagttccacacgctcactgatattgccatagcttttcgtcttcaggtcaggtcttaaggaaaaatactgctcctgaatttaaaaaaagtaaaaataagaaaatcgaattttttgttaaaaatgatgatacaactatatagagattttttacacgattaagtccattactaacaatgataataacatgtaccttaaactgtatctgagaatcaatgaaacaggcgtatatatgagatcagtgggtctcaaactcgtgagtctcagtcatcgatgttcttaaaaattacggaaaactcccaggagggtctgcgtgtgtgggctgtgtctgttcatatttatcacacagaaattaaaacagagaaacctacaaattattaattccttaaaataattaaatactcattacaaacacaaaatgtagtgagaacagtgacact

SEQ ID NO: 128401 - DNA, 1047 bp, Homo sapiens
cactgcacttgccatgtcacccagttgtgttcctgaagataatctgtgattcagcctgtgcacttcctgactgccccgatgaggcatcgacgaaaatggcagccgtgtgcccttctgtctccagagggtcagccagaggctgtcgggctcctctgtcacctacacagtccaggaattaagagagttatgtaattgttaaaccctaaaattggaaaagagttaattcagtcaaattcaatgaacaaaattcagccactgcttaggtttcttcccagaatagcacctcactttctcctgccttagctatctgaagtggaatgaaccaagttgaaatctgcttccctgtaagtctagtgcattggtctgtttctgctttgagaccttacagaatcaatatgtggaagaatatgcaaagtgttgttcagtcttaaaattcgttatctaaattttattttatttttcttctctagatctggatctataatgaagagcatgaattggttttaaatagtctcctttgtctagatatgtcagagactcgctcatcagacccgccacggctcatgaaatgccacgggtcaggaggatcccagcagtggacctttggggtgaggagtgctcggtgatgttgggagaatgcgcagaggcccacaaggttgagtgagggagtgtggcagatgaactcattttctaccttgggggtggtcttctcagtctgcagtacagtggtccccccagaaaccacaggtagtacaaaccctgtatatactgtatttctttctagagatacacctgtgataaatttatcaattaggcacagtaagaggttcacaacaataactgaaatgaaacggaacagttagaacagcatactgtggttgcgcagtggctcccgcctgtaatcccagcactgagaaggcggaggtgggcggatcgccgtagcccaacagcctgtttgttttctctataaaaacaaatcagtatactataatacaaattgtgattgcggtcagaaaatatcttattgtattgtgctgcagataacaa

SEQ ID NO: 128402 - DNA, 1048 bp, Homo sapiens
ttttggctagaggtttatcaattttattgatctctcaaatcagcttttagctttattttctctgttttgtttcattcatttctgttctggtatttaatatttcatttctgcctctttgtctaacttgctctttttctgttaagatggaagctaaagtcattgagacttgtatccttttctaatataggtgcttaatgctataaaacttccaagtactgcttcagctgcatgccacacactgttgtattttcatttttggtcagttcaaaatagccttttgatttttttctctgacccataaggtattgggaagtgtgctagttttttataatatttggagatttttccaagtgtctgttattgatttctattctactttgcatgacttgaatttctatacgtatatcacaccttgctcaatatcccagaatatggtctatcttggtaaatgttccaagtattgtgttgctgggtagtgtcaattaggccaagatggttgtttttctgtctacttgttctatcaattattgagaggtgtgttgaaatctcttactacaattgtggatgcgtgtacttcttgcaattttaacagaactttgggattatttcttcttgataagttgaaccttttattcatgaaatgaccctctatatcatctgtagtaatattctctgtgctgaaatctactttgtctatctattcagatgtctttcatatatctatcttcccatccttctaattttaatgtattcataaagtgagtttcttacaggcagcatatagttggatcttgcatttttatctaatctgccttttaactgtggcatttacattcattacacttaatgtgattattgacactgttggatttcaatctgccatcttgctgctcttgttttccatatgtaccatcctggcctttgaagtcaaatgacagataaaatatttaggatgtggcaaactgttttgtggttcagataaaatatctgagtgcatcccctgcaatatgagaccatctctcctcttaagatgtggtttgggaggaaa

SEQ ID NO: 128403 - DNA, 2924 bp, Homo sapiens
agacatcctttcagtcttgagtgaggaaaaatgaaggagggaaaacagagttagctggcagttcatctcacccagaattgcatgccccattcagtaaatcaggggaggtgaaaggcttctgggttttagggagagggctaggaaagcagttgcccttccagtcccctccatccacttgcagggacagcattatgagaagtcacagaaatacagctttctctggtcaggctcccgttctcagatctcgctgtttaaaaatactgcctccctcatttcctctgtgcaagcacaatgcctcttttcagggttcccccagggtcccatggaacctcaataaatcaggtcttccttaatttacgtctgtttcgtttgctggttttaaaatgcaagggagatggaggcagaaacgctattgccttccttgctgtcctttcttaccctgtgtctttgccgtgggcagctctgctatgactataagtttgactttgaagatgaccagcacaagattccgtgtcactgtggagctgtgaactgccggaagtggatgaactgaaatgcattccttgctagctcagcgggcggcttgtccctaggaagaggcgattcaacacaccattggaattttgcagacagaaagagatttttgttttctgttttatgactttttgaaaaagcttctgggagttctgatttcctcagtcctttaggttaaagcagcgccaggaggaagctgacagaagcagcgttcctgaagtggccgaggttaaacggaatcacagaatggtccagcacttttgcttttttttcttttccttttcttttttttttgtttgttttttgttttgtttttcccttgtgggtgggtttcattgttttggttttctagtctcactaaggagaaacttttactggggcaaagagccgatggctgccctgccccgggcaggggccttcctatgaatgtaagactgaaatcaccagcgagggggacagagagtgctggccacggccttattaaaaaggggcaggccctctaacttcaaaatgtttttaaataaagtagacaccactgaacaaggaatgtactgaaatgacttccttagggatagagctaagggataataacttgcactaaatacatttaaatacttgattccatgagtcagtttattgtagtttttgatttctgtaaaataagagaaacttttgtatttattattgaataagtgaatgaagctatttttaaataaagttagaagaaagccaagctgctgctgttacctgcagaactaacaaaccctgttactttgtacagatatgtaaatattttgagaaaaaatacagtataaaaatagttattgaccaaatgctaccaggctctgcagcagctcgggggcttataaaatgttcatagggatgttacaatataattttgtgttataaaatatgccattataattatgtaataaccaaaatttcaacctagagtgttgggggttttttggaaaccgcagtctattagtactcaatggttttatacaccttacttctgacagagcggggcgtatgctacgactacaacttttatagctgttttggtaatttaaactaattttttcatattatattgttgcatccctacttcttcagtcaggtttttttgtgcttacaatttgtgataactgtgaataactgcttaaaaatacacccaaatggaggctgaattttttcttcagcaaaagtagttttgattagaactttgtttcagccacagagaatcatgtaaacgtaataggatcatgtagcagaaacttaaatctaaccctttagccttctatttaacacaaaaatttgaaaaagttaaaaaaaaaaaggagatgtgattatgcttacagctgcaggactctggcaatagggtttttggaagatgtaattttaaaatgtgtttgtatgaactgtttgtttacatttctttaataaaaaaaacactgttttgtgtttgcttgtagaaacttaatcagcattttgaaccaggttagctttttattttgtacttaaaattctggtactgacacttcacaggctaagtataaaatgaagttttgtgtgcacaattcaagtggactgtaaactgttggtatattcagtgatgcagttctgaacttgtatatggcatgatgtatttttatcttacagaataaatcaattgtatatatttttctcttgataaatagctgtatgaaatttgtttcctgaatatttttcttctcttgtacaatatcctgacatcctaccagtatttgtcctaccgggtttttgttgttttctgttctgtataatagtatctaatgttggcaaaaattgaattttttgaagtatacagagtgttatgggttttggaatttgtggacacagatttagaagatcaccatttacaaataaaatattttacatctataagagctgcctagagcttctgtgttaactcctcatattcaaatttgagctcttaaattgaggattgtctgaagttcactgaccatctgatagatctttcacaattagagtgttgatgcgatcaacttggttttcttagattttcaaataagtttagatgtaaattcataattcattctaattatgatactttttccttcccttcgactgaataaagaagggaacttctgtatctttttagggtgtttaccaaatttagaatatccttggtgccttgttcaaagcctgtttttgtttaattggtaaatttagtcttggttatgttgctgtttttttttttttttttttttttttgaggcagcttttcagactttattctatgtggtagactttctttctatcttattgaattatttaacgtattaaatataaaggggttaagaaaaaaactgctcagaatccccttt

SEQ ID NO: 128404 - DNA, 1035 bp, Homo sapiens
agctgcctcaaaaaaaaaaaaaaaaaaaaaaaaacagcaacataaccaagactaaatttaccaattaaacaaaaacaggctttgaacaaggcaccaaggatattctaaatttggtaaacaccctaaaaagatacagaagttcccttctttattcagtcgaagggaaggaaaaagtatcataattagaatgaattatgaatttacatctaaacttatttgaaaatctaagaaaaccaagttgatcgcatcaacactctaattgtgaaagatctatcagatggtcagtgaacttcagacaatcctcaatttaagagctcaaatttgaatatgaggagttaacacagaagctctaggcagctcttatagatgtaaaatattttatttgtaaatggtgatcttctaaatctgtgtccacaaattccaaaacccataacactctgtatacttcaaaaaattcaatttttgccaacattagatactattatacagaacagaaaacaacaaaaacccggtaggacaaatactggtaggatgtcaggatattgtacaagagaagaaaaatattcaggaaacaaatttcatacagctatttatcaagagaaaaatatatacaattgatttattctgtaagataaaaatacatcatgccatatacaagttcagaactgcatcactgaatataccaacagtttacagtccacttgaattgtgcacacaaaacttcattttatacttagcctgtgaagtgtcagtaccagaattttaagtacaaaataaaaagctaacctggttcaaaatgctgattaagtttctacaagcaaacacaaaacagtgttttttttattaaagaaatgtaaacaaacagttcatacaaacacattttaaaattacatcttccaaaaaccctattgccagagtcctgcagctgtaagcataatcacatctcctttttttttttaactttttcaaatttttgtgttaaatagaaggctaaagggttagatttaagtttctgctacatgatcctattacgtt

SEQ ID NO: 128405 - DNA, 1050 bp, Homo sapiens
ccatggtcattgagtacatcgggactatcattcgaaacgaagtagccaacaggaaagagaagctttatgagtctcaggtaggtgtctggtccccgagattgtatacacagcaccatcatcctctccctttctccgtgccagccagacaccctggaaggcagaatgaaatctgtcatgctgcattcagctttaaacaaaagccatatctgtatattagtgtatttttatcagttgtatctctttcaattggtgttacagtttactttgatagacaactgtaaattaatgagcctggcttcacacacaacctactgattccatgctttccattcgtgccatgtaaatgtcatctgtgcctaatagaatatccacagtaaggatgatcaggctgccgttccgttcagtttcgactgagtcctcctggtgtggataggaacacagaggggagtttcaggtcgacattgatgacttactgactgacttttccctcagaaccgtggtgtgtacatgttccgcatggataacgaccatgtgattgacgcgacgctcacaggagggcccgcaaggtgagacagcgaggaacctgacggggagtgcttttgcttgtggggccagtgctggtggagagaacactgaagccaagggaaaggctctcacggcagcctggcggtgactaaacattcagagcaaatgagttgagaatttttatttaaatgttatatttgtgcttctaacaatgggcaaatagaaatttaattagcaaaaactgctttatcaataaatgggaagtttttaaagctgcttctagctgttttacaatacagttttctgacatggtggcttgcaggtatatcaaccattcgtgtgcacctaattgtgtggctgaagtggtgacttttgagagaggacacaaaattatcatcagctccagtcggagaatccagaaaggagaagaggtaagagtgtgagagattgcatctgccatgttgttcagatcctgggcgaatagttccctcctcacacaggtcacttactcacttgtttcccaat

SEQ ID NO: 128406 - DNA, 1112 bp, Homo sapiens
agaagtttgtaggatcttctctttattgatatttggacatttcacagaactacacctcagtggaggtctttttgttgattgctttcctcccttgatgagccctttcaacctggagcatcgtgaccttccgtctgagaaatgtgttttgtattcattcttttgcaagttctgcccctctgtttcctctgtgtttgcactaaaacccctgagattcaggatctcacagtgtggacctgagactagaagcagcagtgtcacctgggagcttgttaggatgtgcaggttcgggggccccagcccagcctcactgaatccagctctggaggtggggcctcctggatgattctcatgcatgtcagagagtaatttctgtcttatatcctttctccccttctgttctttgtttccttgtctctctgttctttctgagacttcctctactttatctgctaatctttcttgtctatttttagagattagctacgagccctttctgctcttgatcttgtttgatattttgtttttacattatgagtggagtatctgtgttttctctgctgttgcccctctctgttgagcctctctcggattctgtgggtgaattagtgctttgcctctactccttccagttctagctttcccctgctaagtcaattacttttcattttaaatagtccattcactcttatacccattcgtgttctcgaggagtgtgcttttactgtgattttagtgggtatcttaactgtgttcaacctgtcacctttaacctgaagcatttttgagagctctggtttctgtctctttacttatttcatcctgccaccctcccatctgtccacctccctggggatcccgtggatgatctaatatgtatcctgtttttctgtgctaatatcttagaactatatacacttttatgtacatatataaaaatggaatcatgttatatttatttttctccgtcttccttttctctgtaataatcagaggtccctctcgatcaactgacgtagcttcatttcattcttttgaatggttacctgatgttccatagtgttgatgaactgcagttaaaccattgcattactgatgagtgtgtatttgattta

SEQ ID NO: 128407 - DNA, 1009 bp, Homo sapiens
tttgaccagcttgagattgtctgtagtctccatcagatggggtgactttgtgtctgctttgcttcttttcagcttcctggggttgaggcatgtgaaaattataccttccgatacggccgaaatcctctcatggaacttcctcttgccgttaaccccacaggttgtgcccgttctgaacctaaaatgagtgcccatgtcaagaggtttgtgttaaggtattttgttttaacttcacatagtacagcccagggtttctaggcgtattagtggtttcctgtgcttgatttgtctgctgcttacaaaccctgctgtctggctgtgtatgtgcccaactacataagagaactcgccgtgtgtctctgctaggcagctttccatgtatgtttctgtcagtaagaatctgaattaacctggttttgggcattactcagaggtatcttcagttttccttgtatttttttcctgttgatatgccattgtctgcaggcctcacaccttaaacagcaccagcacctcaaagtcatttcagagcacagtcactggagaactgaacgcaccttatagtaaacagtttgttcactccaagtcatcgcagtaccggaagatgaaaactgaatggaaatccaatgtgtatctggcacggtctcggattcaggtgaagaaatactttgtgtacaggaagtggagagacagggtggagtctagcaatctgaagctattgatgtccagtatgtgaaaatgatttcacatagctgcagggacagaaacgtgttttcaaaatcgtatcaaatcctgtcccttggtaacactagggatttaatatgtagtcttgggacttggtgattggcttccccaaagggaaagcagaccagtggaatccacatctttgcatcttgttgagagctcctgggaggcaggtagcattgtaatttgcacacactggatttgtggagtgctcagtagagctgtttcaagcacttgagagaaatacaaatgaaaatattttcca

SEQ ID NO: 128408 - DNA, 1067 bp, Homo sapiens
tatgtggagctgctttcttaagtttagcacttaaaaaaaaaaagtctgaaaatactctaaagataattccaaagaaaatatcaatttaacattttaatttaaatctgaggggaaaggaacatagctatagacattaccaattagactaatcattttaaaatctggtatgttatatggccactatgaaagtaaatgaactgtttgcatgaatttcagttacattaagttttttcactttaatgtccttaatctattattttccccaaaatttaggtctttaaaaaaaattgctgccatttaataaacaggttcattagattattaccaaacagatttattagattattgcccaacaggatttatttggaaattagtaaatccttgtgagtggttattcttcattttgctcttgttttttatactgtatcctatttcctataaaaattatgtttttgtccctgtgtaggtgtctgggataagattttggagcctgtggcatgtgtgagaaaaaagtctgaaatgctccagcttttcccagcgtatttaaaaggagaggatctgtttggcctgaccgtctctgcagtggcacgcatagcggaatcagtgagtgtcttggtcaggctttgagattggaattgctttcctgattcagtgtgaccacttgaacacatgctgtaacatttgtggcactcttcagaaagtgactgagcctgtgcattaacccgtttctcttagaggaataaggcattggtgattaatcgggagagctcagccgtgttggtattcacccagttgaggtagttaaccaacttcaggttctcttccaggctggaggcaagcaggggtgaaggacaccaggcttgtcacatcttctgggtgtgctggatgggtgaggacactctcctcttcccttgcctttctgaagtttctcccacctcagaatgtcagtgtgcccatttcctgacacttgggtatttatggccactctcctgccctcttcctaggatgaagtcactagagggcagtagatcgcagcagcactgatttctgtcctctcttgacatttc

SEQ ID NO: 128409 - DNA, 1594 bp, Homo sapiens
acaagaattgctttccgggcttgtgaattatttttctttgtcatggtttctttatgttgcccaggaatccattccttcattgccacaatcacctatgagagaaacgccttccaaagcatttcatcagtacagcaacaacatctccactttggatgtgcactgtctcccccagctcccagagaaagcttctccccctgcctcaccacccatcgccttccctcctgcttttgaagcagcccaagtcgaggccaagccagatgagctgaaggtgacagtcaagctgaagcctcggctaagagctgtccatggtgggtttgaagattgcaggccgctcaataaaaaatggagaggaatgaaatggaagaagtggagcattcatattgtaatccctaaggggacatttaaaccaccttgtgaggatgaaatagatgaatttctaaagaaattgggcacttcccttaaacctgatcctgtgcccaaagactatcggaaatgttgcttttgtcatgaagaaggtgatggattgacagatggaccagcaaggctactcaaccttgacttggatctgtgggtccacttgaactgcgctctgtggtccacggaggtctatgagactcaggctggtgccttaataaatgtggagctagctctgaggagaggcctacaaatgaaatgtgtcttctgtcacaagacgggtgccactagtggatgccacagatttcgatgcaccaacatttatcacttcacttgcgccattaaagcacaatgcatgttttttaaggacaaaactatgctttgccccatgcacaaaccaaagggaattcatgagcaagaattaagttactttgcagtcttcaggagggtctatgttcagcgtgatgaggtgcgacagattgctagcatcgtgcaacgaggagaacgggaccatacctttcgcgtgggtagcctcatcttccacacaattggtcagctgcttccacagcagatgcaagcattccattctcctaaagcactcttccctgtgggctatgaagccagccggctgtactggagcactcgctatgccaataggcgctgccgctacctgtgctccattgaggagaaggatgggcgcccagtgtttgtcatcaggattgtggaacaaggccatgaagacctggttctaagtgacatctcacctaaaggtaacgtctgccgttcacatgctgtgcagtgctacttactctgatgtcaggctaatgaatgtattttgtcaattttccatgtttgtctcatgttagttttatattttataatgtgtatttttcatttacaaatgccaatgtttgtgttctcacaccttgctctctttgctatacagttgtctaaacactttcataatcaatatatctttgaacatacgagttggtgaggtaaatccgagaatgatttgtagataaaggttgcctgtcatttgcattggggacctcctttttctttttctttttctttttttttttttttttttttgagacggagtttctcttttgttgcacaggctggactgcaatggcgcgatctcagttccctgcaacctccgcctcctgggttcaag

SEQ ID NO: 128410 - DNA, 2044 bp, Homo sapiens
actctgaattctgtgaagacatttcagtagagaccaaactagaagtccaatgatgtgatattttggttatcaacaaaatacagcagtagcaagacctttgtctgttcttacgggttgtgtcagagctggagggaagcccctggaagtaagctttctgaccacctgtaggaactgacggggtctgtcagatgttacaatatctaaaatagtttaatgtgttactagatatttaatgttaattggaatccctttatgaggatttctgtttataaatttctttttttggatattagttcgttagagctaatttttttcctgaggttctttaagtctaaataaaatttgttggattttcttagaatctatgtatcatgcaaagaggatttatcctaagtgtgtatttttcttcagtggttcactgttgccttctgggtgaataatacagcatttgcatttggttttagaacattagcagtgttgtggctgcattttccgaccttcttcacgtccgaatccctaacagctatgaggttagcagtgctccagatgtcccatccatgggtttggtcagtagccacagaatcaacccgggtttggagtatcgacagcatttacttctccgtgggcctccgccaggatctgcaaaccctcccagattagtgagctcttaccggctgaagcagcctaatgtaccatttcctccaacaagcaatggtgagctagtgagctttttgttaaccccaaatccattcctgattcaaaagttaagcttactctttgagatactgattatcttttaacaacggacaggtaacatgctggcgtatagtccttggtgaacttaccatgtgtgggtgttctgttttctgtgctgtgattttgacctctagtgctttggcctgtgtattctgtcatgctgtcaccaggggctatgtgagtgccagccatctgtgcaggctgccagaagaagcctgtgacgggcttgcccttgagcagcttttgttcttcctgtctcccaacccccatcccgctgcacctgggccacctggtacagatggggctggtgacctgacgtgggttctgtttcctgttctcctctgctttccatcctcacctacctcttgttttacctctgcaccagctctatagggcccttctcttcccacagaggtgttcatgccccccatctctgagaatggaacaacttccttagaccgaccatgatgtcgctttccttcctgcctcactggcaatcttacaggcgtgctcagtccaggccctggcttcctcctcttggcttctagctgttctgtcactttttccctgctcctttttgccttcacactgcacctgaatgatgctttctaattcctgagtccttatttaccttcttatccttggccttggctctttcctcatttctgactctgcaagtcacacttatttaagactcttatacatatgtcattgtatctttcataaaatgtttttttaccatcttaacctgcaagcaaaagtaatatctgtttccctctctgtcttactttgtacttagactgaatagtaatctctcttggtgacttagttttattagattcttcttttatactgccattgctttcccagctatttgagaataggcatgtttctttatttttgccctagtgtcagataatcgactctgtaaccattgcttagaagataaattttttttattaattaaagaataatgttaatgaaccatgttgtaatgagttgatactgcataatttttcaccatgtgccaccttgtgtcatcagtcagttttaattactaacaaaagttgattgcctttaggtctttctggatataaggattctagtcatggtattgcagaaagcgcagcactcagaccacagtggtgttgtcattgtaaagtggttattcttggaagtggtgtgcggaaatctttcaaagatctgacccttttgaacaaggtactttgctactccttttatgaccccacctcctacctccagcgaaaatgtccttggcagtgtctct

SEQ ID NO: 128411 - DNA, 2707 bp, Homo sapiens
tttcatagaactagggcatatcttaatgagaacttaaaggatattttgataatattttgcaatttcttgattgcattttaaagttatccttcactagctataaccacgaaacttgaagaattgcataaataaaatcaggtagaaaggaaattagcttcttaatttcagagcttaagtagtcaagctgggtaaagtaagcaagttggtatgtccataaaatcacgagtatctgttccactaagaagcctcctggccttgtaggtattgttttcttggtgtgcaagatacatcttgattacatttctgtagccttgcttctatgtgcaaaaaattcacagaactacgttttagcaaggtcattgcatattcgctcagtagcatataatttaaattttttggtctcctgcagcagaataatttaagtaatcctccaacaccccctgcctctcttcctcctacaccacctcctatggcttgtcagaagatggccaatggttttgcaacaactgaagaacttgctggaaaagccggagtgttagtgagccatgaaggtatgattatagcctccaaatttcacacctcggagaaatgtgcctctgccagttgtgtattgtgaaatggcaatagaattgtaaagttctacccatttatcaatattgactgaatgtatttatggttttgtgtttttgcttttccagttaccaaaactctaggacctaaaccatttcagctgcccttcagaccccaggacgacttgttggcccgagctcttgctcagggccccaagacagttgatgtgccagcctccctcccaacaccacctcataacaatcaggaagaattaaggtacaggttatttttttctcaaataattcttagttatttcttcttttaaaaaaaataaatgtatgtatgtggcataatgtctttaggaatagcatgtaaaaacatttgaagagtacaatttggtgaataatcttcaggatttaaagtttataagacattgttaccattaaacataattagtttgcatttttttaagcctacatcatatagagagttaaataatctaatagacagttaagtattagattatttaatctaattaaataatctaatagacatgaaggtagtggaaaatctccatgcaacatatttcagaaatcattgtcctttaaagggtattaatgtgatttattgggtttattgttgtttgtagatgtctaaaatgaaagagcagaagttgctatatcagagaacgccgtcgtggaagagagtttaagaactgtctggggtttgatgtctttgtgtcagttctttaactgtaagattctaattggggagaatcaagttcccttagtagatgatcgctagccaactctttagatccagagggttcttacaacttcatcaaataattatctcttctttggaaaatctgcccactaccctctatttgatgagacatttatttaacctaagtcccttactttattaatggggaaactttggaccgaagtggagaataatctgtcccaattgaggatccaggtcctctttctactgtacctcagtaggccagcctttcttgggtctcctgcatgacagctacttctctgcgtgaggagtgggagacagcagttccacagggttgtggaacttagtctgagacctcacaattggcctggtagactcaaacttgaactcaacagaagggaccagtcttttgtttttctcacctcactttatcagttaagaaaaataagggccgatcaagtcaatggctaagttttctcccatcttgccagtgtaaagagcagcagtaggacagctgttttcccagtcaggtgaatgcaggtgtgaccattgcatatgtgttggacttctctttccttttttttttgtctttttaaagttttccttttttattgttaaatccaaccagcagctctttccttttcaagctgcaggagtgctgccctaggctcaacgatctgggattttgaaaaggtgctttcatgctctctatgttacatgctaatcagaacatcttcctctttggcaggtcttcaaactttggtgctgaagctttcgttaaaaggaaacataccatttaaattattttgtaactaaatattgttcttgtatttttttcccagtgtggctctgagctgattcatttgctgctcatcgtataggtgctgcccagagtatccttacagctgtattcacagatgtcagcagggttggtacaggaagcccccagtggtggatttgcagactttgatgtgtgtgtttatgttttttcaggatacaggatcactgtggtgatcgagatactcctgacagttttgttccctcatcctctcctgagagtgtggttggggtagaagtgagcaggtatccagatctgtcattggtcaaggaggagcctccagaaccggtgccgtcccccatcattccaattcttcctagcactgctgggaaaagtaagaacaacacttaaccttattatttccctttacactacgccaatttactaatgtaaatattttgattttgaaaatccattaacactattttcctcttttttttctctctttttaaaggttcagaatcaagaaggaatgacatcaaaactgagccaggcactttatattttgcgtcaccttttggtccttccccaaatggtcccagatcaggtctt

SEQ ID NO: 128412 - DNA, 1031 bp, Homo sapiens
acggtaatacaaatggattgataggtgatagtcaagattttcttatgttcataaggagtagcctcagtaccaagaaaaaaatctgtcctcagtactttgttgtgactctgaatccaaagaaacacattgtgaattctgttctacacctttgtggttgttacagaaggtgggagacagttgctaacagtgctgttggtggtacccagcctcagttgatgccccagtttttgctgagcatagataagaaatatgtttttcttgttagatgcctggcagcattcatttagtacagagcttatttttaagtctcaaaggtctgtagtctctctcacttactccagcattttgatacttgaaaattttaagtctcatttttctgaagccttattcaacaaagttgcttcgggtcttagaaagttgagctacactgagttccttttatcatgtacattactcttaaatgtgttttttaatagcagctctctctgctccctctaatggaaccaatcattggagtgaactttgcgcactttcttccttatggcagtggccaatttaatagtgggaatcgacttctaggaacttttggcagtgctaccctggaaggggtttcggactactattctcagttgatctacaaggtatgtttctctgccaaggtgttgtcttgcttcatctttgggtaacatgtcagaattgatagagcttgtcttatttttgtatttagtttacatctactcttccaagttttattaaaacttaagttcagctacagggttaaaattttacctggtgaagtatttctagcataaacatttgaagttgtttttataggtaagaatacaaattgcaagaaatatctattatgtacttccatggtagtggaaatccttatttccttataacctttattaacacttaaaatgaattcaaaaatcattgtaaatggtggggatttaaaaaaagtagtagtttaccttgaaaaatgaaattaaacaattttaagtatatctaataatttaggtattaat

SEQ ID NO: 128413 - DNA, 1140 bp, Homo sapiens
atacctttacaagaatctgtcccctttatttcagttaacttcattaagatagttccaaaactggagtttgagtcatgggaattggtctgcttaatagctcttgcctgtttatctttcagaaggtgcagtgccattaccagtgcattcataaagctgtccctagagagcttctcaaattggatttcattttcatattttaattaagggttgagtggtatatttagttgtccagttttttcattttaagattgttaatgaagctcatctttttgcaagtgttgctttttttcttgtctttgaccattcagtagagattgagtgttgacttgatagatttgtgtaatttttgtaaattttactggttatgcttttacagttgtcaccagtaaatataggcaactctccagcacagtctccatccactttctccaagacatcttataccctgaggagtactgaataacttgcagccttctgtctttttacccttctatgtataccacatgctgctgcttctgcctgttctgttctcccttcttatatacgtctggacaatatatttttatcttttgaaatgcagttcttgagtcatctttttccagatacctttctcacctctcccaatctcaaatatgtgttgatgctcgtgttctcacatagcgatttctgttgtaccacttaacattatttaaatagctccttgaaggacgtagactacattttgagcatgtttatattaaaatttgtgggtgtaagaatgtttaatggcatggggaacaaccacgtcaagtttaaaaagtagcccctccccccaaattaaagtgtgatttaaataaatatatagtgatttaaatatatataaatatatacatctatatataaatatatatataaatataaatatataaatatatatatataattaatttttaggttcttgccactcagagtgcagtccttggggatccgcagcatccacatcaggtgggagctttgtaacacatgcagaatctcccgccacacacctgcttctcagaatgtagacttaggaagatccccaggtgattcctgagcatctgaaggggagaagtactgctctaggcaggtgattctcaaagctaaagtgtgaggagcaccagg

SEQ ID NO: 128414 - DNA, 2876 bp, Homo sapiens
ttaatctgggtggggggtgtgatattcgtgctggtaattcatcttgtcttaaaatgttgtacaggccgggcgcagtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaatgttgtacaatttatatatttaagaaatgaaatcttaacatttaaatggttcaagtttgagttaagtctgttattctaacattgtatattgtaatttctaggacatcaaaattagctgcttgtgtaaccttttttattgtatattttttatgtatagtataaatagtatatatgagtttcaccataagattttaatattttactaaaccgtttttgatatttcatatgtgaagcacttttacagataactttataaaaatcctgttgttaaagagattgacagttgttagttaaggcttatcaattcaatttttttgtgacttttgcagttacccaagcaaaatatgtttgcttctgcagggccaaactgccctctgtgtaacctcaaccacagtcatcagccagtgttttacttcagtacctatgctgtatagaaatgagtaatgatgcattttgttattccagattcgtaaacaacagaaagaacatgctgaattgattgaagattatcggatcaaacagcagcagcaatgtgcaatggccccacctaccatgatgcccagtgtccagccccagccacccctaattccaggtgccactccacccaccatgagccaacccacctttcccatggtgccacagcagcttcagcaccagcagcacacaacagttatttctggccatactagccctgttagaatgcccagtttacctggatggcaacccaacagtgctcctgcccacctgcccctcaatcctcctagaattcagcccccaattgcccagttaccaataaaaacttgtacaccagccccagggacagtctcaaatgcaaatccacagagtggaccaccacctcgggtagaatttgatgacaacaatccctttagtgaaagttttcaagaacgggaacgtaaggaacgtttacgagaacagcaagagagacaacggatccaactcatgcaggaggtagatagacaaagagctttgcagcagaggatggaaatggagcagcatggtatggtgggctctgagataagtagtagtaggacatctgtgtcccagattcccttctacagttccgacttaccttgtgattttatgcaacctctaggaccccttcagcagtctccacaacaccaacagcaaatggggcaggttttacagcagcagaatatacaacaaggatcaattaattcaccctccacccaaactttcatgcagactaatgagcgaaggcaggtaggccctccttcatttgttcctgattcaccatcaatccctgttggaagcccaaatttttcttctgtgaagcagggacatggaaatctttctgggaccagcttccagcagtccccagtgaggccttcttttacacctgctttaccagcagcacctccagtagctaatagcagtctcccatgtggccaagattctactataacccatggacacagttatccgggatcaacccaatcgctcattcagttgtattctgatataatcccagaggaaaaagggaaaaagaaaagaacaagaaagaagaaaagagatgatgatgcagaatccaccaaggctccatcaactccccattcagatataactgccccaccgactccaggcatctcagaaactacctctactcctgcagtgagcacacccagtgagcttcctcaacaagccgaccaagagtcggtggaaccagtcggcccatccactcccaatatggcagcaggccagctatgtacagaattagagaacaaactgcccaatagtgatttctcacaagcaactccaaatcaacagacgtatgcaaattcagaagtagacaagctctccatggaaacccctgccaaaacagaagagataaaactggaaaaggctgagacagagtcctgcccaggccaagaggagcctaaattggaggaacagaatggtagtaaggtagaaggaaacgctgtagcctgtcctgtctcctcagcacagagtcctccccattctgctggggcccctgctgccaaaggagactcagggaatgaacttctgaaacacttgttgaaaaataaaaagtcatcttctcttttgaatcaaaaacctgagggcagtatttgttcagaagatgactgtacaaaggataataaactagttgagaagcagaacccagctgaaggactggtaagtgtaaatcataaaaacgacaacttttttcttttgttttaaattatacttacagcagattagtaccagcaactgtatttccacattattctacaacctttttattctaaaggaccattttttattttgtcatttctacctctctggaacccatgtttttacttatatctaaactatattaaataataatttgtttactattttttaaaaagcaaaggcatgtattgcatttcatatataacgtgatgtgtagcaactggttattaccacattgagttgatatgactaaagcaaagtaagtaaatgtctatgtactttattgtaaataagtgattaat

SEQ ID NO: 128415 - DNA, 1118 bp, Homo sapiens
ataatattgtagtttctatgtatattcaaaacaaggaaatgctgagttttatttactacttagttttgttttggtttttgtttctgagacggagtttcgctgttgttgcccaggatagagtgcaatggctcactgcagccttcacctccaaggttcaagcgattctcctgcatcagcctctggagtagctcggatcacaggcacgtgccaccatgcgcagctaatttttgtatttttggtagagacagggtttcaccatgttggtcaggctgttcttgaacttctgacctcaggtgatccacctgcctccccctcccaaagtgctgcaattacaggcatgagccactgcacccgaccagcacttagttttaaatatggacctcagaatttgaggcctttcagcatctgatgctcttttagcatcatgcatctgccggttagatacattagtcatgtatcaggtatatggcttagtattctactgactgctttttagaaatggaagtgatagtcccttcttagagtagtgtgatatgttgagttaggatgatagaccatgtgtgatattcagattagaagatcatttagaccagacctgtagcagtgggtagggtgacagatcaatgaaaaacctgagtaaaaaatttaaaaacatattctatatcctaatagtacttaaatagtaatatacagcttttggaatacatttttaaaattgtatgtatatcttgatacgttaaagcatttgataatgccagaggaaatactttcatgtaagcagtaatgcttctgtgaagtttttatagttttaattagaatgagtaacatttctctaaacacgtttaaccatgcagactgatcttggtcagtcgtccatttttgatttgctttaacattagatatagaaatgtatgaaaatgtatgaaaattcttaaattgggaaatgtcttttgttttagaatataaaataactaagctctcaattagtttttaacacagactggaatgagaaaacatttccttagagttcgttataaaactaaatcaacttatttttattctgaagtcttgaattcattttatcgtaaagtggagtgaggcacataatagagtaaaac

SEQ ID NO: 128416 - DNA, 1027 bp, Homo sapiens
aaagatttggaagattggatttcctgattactcaagtcaaagtatttaggtctgtgctcttttaaatacctttagaattgttcatgttatctaagatttttttcagttaagacactgagtgattaaagcaattataaattcagttctaaaataaaatgttcccaaaccggttttgaatcagaaaaagaaagttacaaggaatagataagaggacagttggaagttggagttacagagtttgtcttttctctcttaggagaaaaacagaaattacgcattaaagaagacagtaggggttatttcaatatctgaatttttgaaattatgccctctaagggttgttaaccacatggcactgtttcttaaattttgatcatggaccaccatgagaattatggggtaatttttttaaaatgcagattattttgctctactgcagacctactaaataagaatatctggagatggttgcctgtgtgtctgtatttttagcaagcgtcatgaatgagtcttacgtgtattactatatgagaacctctgtcaataaagtaagcatagagcctcaatttagtctagttatcttgttgaaaaacttttatataaaaaatgtggatgattatagaattgaatataaaatttgcacgaatttaagatgtatatatttcaaagaaatttgaattcttaagggtataattcttttcaattgttgagatactttggacatggttaagaagcatttttgagatcaaagtagagatagtggtttccaatgattttcattattgagcaatatttattaacactatttctctatcatagagattcctaactgttttatgtcttgaatatttttggattccagtgaagcctttgaaattctcagaatgttttatatgcagaaaatttaagacatagcattacgaaggaaatgattatacttgaaatatagttattaaaatataattaaatttatgtatatatgttccttaaagtattaacaaatttagcaataaaccataatttgaaa

SEQ ID NO: 128417 - DNA, 1038 bp, Homo sapiens
tcagtcatggaaggatgaatttaagaaaattatgatggaaataaagcttcttactgtccttttgtgtatgacaaatgcttggcgattttttgctatataaacctctttaacttgtttctaatggtttactgattctaaaaacaacaaaagcaatgcagtcaaaatgcctcagtgcctctaagaataagaattagcaatcaaagggcacgtgtctaagcagtgtgccttattctaaataataaaattgacattccattttatatatccccaatttcatcattttgctccctttttttcatttagatgcaaataggttttttcgtagtagcttcttattgagaggttatacccttaagaaattggtgcatttttcttttaagagtgataactaatttagtagaattccttagtattgcaaattcttatttgtgatgttatatttactaaagaagccattctgattagcattgcaaaagtttggatgaaaggaaattaattgcattgctttagattattgcttataatctcccttaaacttgactttttgttttaattcctgcaggactaaggtattaaagcatgattcagttaaggactactgagatgcgattaaacccaggataaggttgccatctcagaaatctgtaatgattattaaataataaaatttaagagcttgtaatatttgaattacttcttagtgtacgttgaactaattactatgaaataagtaactttatatttcttttctagattttgatgcaattacagatcctataatgaaagccaaaatggtggcccttaaaggtataaataaagtgatggcacaaaacaatctgggcatgccaccaatggtgatgagcaggtaggtggagtggctgcttgtttctactgggcatctagacattcatgaaatcattactagtttttagaaaaaacatacagaaaatggaaagcccttgtctaggaatgaacaacactatttaagttgtcatggcatcagctcgatatgatcagatacaaaatgctataccaatt

SEQ ID NO: 128418 - DNA, 1403 bp, Homo sapiens
actgggccaagcatatattgaactgagacatagggctcctgacggaaggcaacggctgcctttcagtgctccacctggcagcgttgtagaggcatcttctaatctgagacatggaaacttcattccccggccagactttccgggccctagacacacagaccccatgcgacgacctccccagggtctacctaatcagctacctgtgcacccagatttggaacaagtgccaccatctcaacaagagcaaggtcattctgtccattcatcttctatggtcatgaggactctgaaccatccactaggtggtgaattttcagaagctcctttgtcaacatctgtaccgtctgaaacaacgtctgataatttacagataaccacccagccttctgatggtctagaggaaaaacttgattctgatgacccttctgtgaaggaactggatgttaaagaccttgagggggttgaagtcaaagacttagatgatgaagatcttgaaaacttaaatttagatacagaggatggcaaggtagttgaattggatactttagataatttggaaactaatgatcccaacctggatgacctcttaaggtcaggagagtttgatatcattgcatatacagatccagaacttgacatgggagataagaaaagcatgtttaatgaggaactagaccttccaattgatgataagttagataatcagtgtgtatctgttgaaccaaaaaaaaaggaacaagaaaacaaaactctggttctctctgataaacattcaccacagaaaaaatccactgttaccaatgaggtaaaaacggaagtactgtctccaaattctaaggtggaatccaaatgtgaaactgaaaaaaatgatgagaataaagataatgttgacactccttgctcacaggcttctgctcactcagacctaaatgatggagaaaagacttctttgcatccttgtgatccagatctatttgagaaaagaaccaatcgagaaactgctggccccagtgcaaatgtcattcaggcatccactcaactacctgctcaagatgtaataaactcttgtggcataactggatcaactccagttctctcaagtttacttgctaatgagaaatctgataattcagacattaggccatcggggtctccaccaccaccaactctgccggcctccccatccaatcatgtgtcaagtttgcctcctttcatagcaccgcctggccgtgttttggataatgccatgaattctaatgtgacagtagtctctagggtaaaccatgttttttctcagggtgtgcaggtaaacccagggctcattccaggtcaatcaacagttaaccacagtctggggacaggaaaacctgcaactcaaactgggcctcaaacaagtcagtctg

SEQ ID NO: 128419 - DNA, 1459 bp, Homo sapiens
ttaaaataaatgagtgagtaatcagtatgaacagcaaagctgcaagtagttactagatggtacctggcttgtgctccatatggaatttctggcttgtgctccatatggaatttctaaagagtgacaggtttgtctttcatattttaacttttcctactgtgttttaatttctcaatgtcacttttagacatgccactttcttaatgaaaaacttttttttctttgctttgtttcttacagcatttattctgtttcacttttattgcctacaggtctttaaattttgtctcaatatacattagtcacaagacaaaatcgtctgaatttttagtaaatttttgtaattcaaaacattatctcctttgctatggaaaatttttactgtaaaattaagagtctcaggtttttattccagtacttgcctcactcagtatctgctgtactctaggtttttagcaaatggcttaatatctgagaaaatactgaaattttaaaaaacatatttactatatttaggtcctgctgatgacccattagctgatatttctgaagttttaaacacagatgatgacattcttggaataatttcagatgatctagcaaaatcagttgatcattcaggtatatatgaatactgtttaccctttttctggtttctgatgtgagcgagaggtgtatgatgtgtggaacaagtttagccttttgtctgtttcccagtaactgtgtttttgtttttggctttgttaaaggactcagcattttctttgatctgcctcagctttcctgctttaggaggggtatagcaagttagttaatttctgtcgtctttctaattgcatcacatttaaggcatgttgccttaaagtcttgctgtatcttttttcttcttttgtttgtattttccctcacttcctgctcctgtggtaatcatccattttatttggtttgggtcttataggtcttgatttatgcactttccaggttgagagctcaccttttccatttggtaagaaactgagcaatggatgacggctgactagaagtagtcttctttttttatagtgatttcagctgaaacaacctgtaggtgcatgctgtttatcagtagtgctaatttgtcactaatccatactttgcttttccctttttgtgtgtggctaaagcatagtatagctgtactgtacttcgggtgactttctcagtagtttttctttaatgaataattttatttttgttaatatgtggtttacaatattacctaaatgtcgtagagctagttcctaatataagatcaaataagaacagactaaatttttactttttaatagtaataatattgagaaagcatgaaaaaaatgtagatgataaaccacttttacatgtgactcttacaaatttgagctgcagcatgttacaattttataaaatgtaatgtacataatcagaatgtgcctataga

SEQ ID NO: 128420 - DNA, 1050 bp, Homo sapiens
ttcaaaacctagattaattgttctttgcaattgaactactcttttcactttataatggaaaattaatgactaaaggcttttttttaacatgtcattcattgtagcctattatatcaattttaatgatttattcagatataaaatcctttaggtaggggcaaacttgtaaaacagtctttaaaaaattagttataattgtatagtagaattccattactttaaaacaaaaaactgctatatgactcctaaaaaaattatccagattttttttcattcaactacagtgttgtcattattgaaataattttctctaaaaagttcctggatatttgggcacgcaaaacttaatgtgatatgttacatatgaattacattttgaaaactatataatgggaccaagactgtttgacagaagtatttgacctggaatattacatttatgccctcctcccccttttaagtaaaaataagcttgagatggattaaaaatttcagtttctctttactgaatgactaatataattattaaagctagcctaaacaagagttccaatagtttcttggttaagcccaaacccgtagaatcctccttgacttttctttccctttcattcatccacgtttgtgtctgccttcaaaatacgtcccaaagccgaccacttgtctcagctttccttagaaccctggtgctgtcatcacctcacctctcagactgcaccagtgcccttttctaatcttaccagcccctctctaattcccacccctcatctgctctacatatagcagccagtatgttccctttaaaatattagtcatctcctatctttcagcctcccagcaacttctcattacacttcagaataaaacccagtcttccccataatctctaaaatcttaacataatcttgccctagctgcctcttttttatccttaccacagtttttcttactgttaacactctggcctctcgttggcaaacccggcttgccccaggggctttatgtctgctttgccttagtttggagggttatctccatctttgtgcatat

SEQ ID NO: 128421 - DNA, 1623 bp, Homo sapiens
gatagttctatgcctgttgatagacattaaggccatttttacttcttgacattacaaaatatgctacagtgaacttttttgtgcatgtttggcaagaatgtgttaaatgttgtattgcaaaattgtcctgtatggaggatcctttttccagatagactacatcataggatatagactaaagcagagttcctgggttgaagcagggtaaaggggtggaactgtgcttcccttttgtctttggtattgatttttgagaaattttggagagatcttggagttgcaaggaacccagcttgaaagtatattgaaatggaaaaatgttaatatgcctaaataaatagaaaaccacaagcctttagtagctgtaaatattgcacacatagtatggctaaactgactataaaaccgtctttcagattgatgatgtaagtagtcttatagtgtaagtgtggttatatgaatcaatagattacaaatctacctgaagtaaatattaaagccgtagatcaaagtcttatgctgtcctctgcaagtaatctataaaaattaataatactcatgaagctattctgcagtttctagaaacctttggtataattgtgtggttttatttccataattttgtctctagtaaagctaccaaaaaatcttatttttaaaataaggagaatctatataaaataattgacaggatatttctattttttaatacttctgtattcagtttctatattgttaaatataaaccttttctgttatttctgcttccttgtcaaaaaccatgacagaataatctattgtctttttagaattttctaaccatttttgtatgtgcttatcttcatctaggaagctttctttggaaaagatcttctagatacaagtagacaaagcaagataagtttagataatctgtcagaagatggagctcagcttttatataaaacaaacatgaacacaggtttcttggatccttccttagatccactacttagttcatcctcggctccaacaaaatctggaactcacggtatgtagaattattcacagatattttctttatatcatataacatacatcttcctttcagttaaatctttttgaaatgtttttgtttggcctcatatgcattttaaaaatcaacagcattgaagtataacttacattcagtaagtggaactattttaagtggacaggtgtataagatgtagcaaattaatttacctgtgtaactagtaccaacatcaagagttgtgaaggaaaacatttggtttacactttgctgagggcaatgtgaggggttataatttggccaacagtgactttttgactaaaaatctaagatagatttttgttaatcatacagcttaaattcaaaacagagaaaccgaaatggatgtgggggtacttgggaacttgctggcatactgtgttactacagtgaagtctgttgccctaggtcatggtttcttactgctgacagtttgcaccagtaattctttgttgtgggagggagcctttctggtgtatagaaggatgtttaacagcatctttggcctcatgatgatcaaaaatatctccagatattgccaaataccttttggttttggtgggcaaaatcac

SEQ ID NO: 128422 - DNA, 1042 bp, Homo sapiens
gtacgctaaattcatttaaaaaaataaagtaattgtgctacggtgttataactacggtgatgtctgtatgtggtgggaatttttcagctccattataatcttatgggaccactgccttgacatgcagccctttgttgaccaacatcattatgcagtgcatgactgttatgtgatgtatgaggcactaatatttgtcaaatagataagccagcgtaatttagtgtttgatatttacactgatactgttgagaagaggaagtgcacacaggtctttttgtattctgtttgataagtgataagagtggctttgccttttttttttttttttttggtcgtttttaacttctattttacctaaaaatcaggttattgatttagattagcacagatttaattttggaaaatgacttactattcaagataaagcagttttatcctgtgtactgtggaaatgtagggagaaattacttatcagtttacctaatttcttttttggataggtattggtggatttatggtgcggcaaagaagtcgaactgggcaagggaaaaccaaaagatctgtgatcagaaaagattcctcaggctctatttccgagcagttaccttgcagagatgatggtatagtactgacttaaaaaaaaattttttttttaatgtaaccctttggtcttgatatttctattggaaaaaactatcctaaataatgttacagtcaataagagccttattgcctcttattgttactcaataagagtcttattgccttttattgatgaaaggatttgagtgcgtatagagttcatatctgtaatacagtaatcaggttttataaggaaatggtttaaatccaatagactttattcttttgagattttttgacaagctcttttttcctgtatcaaattattaaatatattttctatatttaaatataaatggtttagggactgaataacttagttacataaggtactttctggtcatctccaaagcctttctttgactgccttagctacttatcatataatttgaaattctca

SEQ ID NO: 128423 - DNA, 1073 bp, Homo sapiens
atgatgataggtaacatgggaaaaaggagaaagtttattttaaattagtagttcattttggatatacagttttcagtaactaggtaatattcaattatagctgtggttgaagctcagaagagagttctagtctagagacctggacctgaagacataattaaaagcaagtgaatttgttaagtgcaaatggattgcacttaacagaactctgagttctgtgttccccttctctgattatgttttatttcatgggaacactgcactaagcagcacaatttctacaaccatttggggcttcttctatctcctttcatactttccctaccaacagggatgtacaattaaaatggctcagcaacaaccctactttttattccccattatgtagggattatatatttgataggtttttccagttttgtgtatacatttacttttttccagaaggagaacttatggattgtgatggaaaatcagaatctagtcctgagcgggaagctgtggatgatgaaactaagggagtggaaggaacagatggtgtcaaaaagagaaaaaggaaaccatacagaccaggtatagtgcctgaggtagacatttcaatatcatcaacacttggttaattaaagaaaaatacaatactgaagacttcaattaaaattaaatattcaggcttcagaactgtctaaacaaaaatatgtgcacataaattaaagaactaaactatttgaatacgactttttagctctagagttctttattttgaatgtgtgaatacttcacaatgaatcattattgaatgccttgtcccaaatgttaaccattttattaaaggctttactagattggcttttgttcatacttggactttgaaggccatttatatagttcctctggatgtgtacttctgtaacgcttttaattttcagtattcactttctaatatctttttttgaaaaaacttatttcagtgtttatgcaggagtgccagtaagtatacagtgtgaaggggaataagacagagttattatggctcctagaatttatagtccagttaaaaaccatgactgattaaa

SEQ ID NO: 128424 - DNA, 1690 bp, Homo sapiens
tgccttacattaatttttttggtattttttctattgattctaagcatggaaatgtagatggagattttgttgatgtattttcaaattatgtatcaataatagggaagcttacttgatttctttaaaatctggtcactatatctataaatatagtggacattaaatgtacagcataaggtaattatgtggactttaaaaaggcgttaaaatatgtgccattttctattattctgctcagtaggcttctaaaagcgtgtatgaacatgcccaacccagtattgggcctccgtaggtgctcaataaatgttagttgattgcctcttttctgcttctaggtacataagcaccatattaatttatatagtatatttgattatgttaggttaatgcataaatcacatggattggttgtttcttttacagatcactaaagtggttcttagcaaaggttggaggtgtcttgagtgcactgtgtgtgaggcctgtgggaaggcaactgacccaggaagactcctgctgtgtgatgactgtgacataagttatcacacctactgcctagaccctccattgcagacagttcccaaaggaggctggaagtgcaaatggtactctagggtttgtttgccttgttagtctttcaagttcagagctttctcataccactttggtttttaaaaattagccacacctatttaattgaataatacacatattctatgatagataccagtaatcagaaaaattttcacatacacattaaatcatttcccccattatgttcgtatgtagcttcctgaattacagtaactgagtaactaagaaaataaaattgagacttttcggggggatttggatttcaggtgtgtttggtgcagacactgtggagcaacatctgcaggtctaagatgtgaatggcagaacaattacacacagtgcgctccttgtgcaagcttatcttcctgtccagtctgctatcgaaactatagagaagaagatcttattctgcaatgtagacaatgtgataggtattgtgctattttttcatctttttaaagcttttctctttgaaatgtagcaaaaaaaaaaacaaatggaaaatagcttttccttaatcacaagttttaggtacagaactttttgccttgtagatttttagtcacctagaaacttacagaagcgatttcctgttttgaattctcaactccggactaaaattttgttttgttttgtttttaaatttagagacagagtcttgctctgtcaccaggctggagtgcagtggcgctatcttggctcactgcaacctccacctccgcctcctgggttcaagcgattctcctgcctcagcctcccgagtatctgggactacaggtgcatgccaccacgcccagctaatttttgtatttttagtagagacagggtttcaccatgttggccaggatggtctccatcttttgaccatcttttgaccgcccgcctcagcctcctaaagttttatgattataggtgtgagccactgtgcccgcccaagactaaagatttttaatttaggcctttttgagggtttaggaatcccttgaaattagatggagaattattgccttcatctatgccgtttcttatgaagggtttctgaatcttctaatagattataaaaaatatctaacacattctgttctccttaaaccac

SEQ ID NO: 128425 - DNA, 1104 bp, Homo sapiens
gaaatgctaagaaggaagttgaaaatcctgctaatttggagatctttgattaaaactagaaataagaatatgggaagcatcaacttccaagatgccctcattgtagataataccatttaggatctaggctcaagccctgggaaactccagggctttggaagtcaaatagaggaagaacacgtacaggagatgaagaaagattagcgaggaaggcagtgaaatatccacaggtggactgctgccaaatccagcagaacagtatgccagatgtcaggagcatgagtaaaatgagaaaagagaaatggcttttgacaacacttccttactaatagtagggaagaagacataggtacagattcaagttgattggaaattatgaaagtgaggtaattgacctgcagtggttgctgctcagtgaaatcagcatagtgattacctgagctaggttagagatttgatgggtaagaaagaacacctaacggtaatcctggagggaaaaaaataaagtgtttgctggagagaatgagttggattgctggacttcaatgtgtgtggattcagtttgtgacttaaaaatgaaaccagtctattgcttgtgtggcttttctcaaaatactgttattccattacctatctcttaccccaagagtagtcacattcttatttctggttattttaattcctggtggtatttttatgtgattaatgagatagtactttttaatttgatgatattctagaaacctggtaagtactatgtaccttgtcttaagttttggttacttaattggtaaaattatagcatgcaccattgaattacctaattcaaaatatattcttttattgtttgacatttgtcttgtttttctttaaaatgttatctttgtggagtaaacatttttctttatgctgtttagcatcttcatcagattagttcagggtattgctgaatgtggttgtttggaagtaaaatgctttagttttagttatatagattttaataagatactactttctatataatttatcaggtactttaggcattttaatttgcaaatttaggacaatttgctttaacgtttcttcacttttgtccattggatg

SEQ ID NO: 128426 - DNA, 2011 bp, Homo sapiens
ctccctggctcaagcagttctcctgtctcagcctcctgagtagcggggactacgggcgcacgtcaacacacctggctaattttttaaatatttttagtagagacggtgtttcgccatattggttaggctggtctcgaattcctgacctcaggtgatccacccgccttgtcctcccaaagtgctgggattacaggggtgagccaccacgcccagcctacagtaaatatttcaagaaaatttcataaatgaaaacataggtactgtattttgatatctcttggacaaattataagaagtttactttatattataagaagagtactttcagttttaaaagtagccagagaaccatagtgttaaacctaaaaaatacctacccctttggaacaccaagctaacaacacagccgattagaagtaccagactttccttttagttcacttgtgcttgttgtggtatttttggagatattactgttgctagtgccacctaatttgtattgtgaaattattgaaggctaaagctgataatagctgtttctgtagttatcaaaacaggattaggtctaatttcttgttctacttgatatcgaactcaattttatatatgagacttcttttaagaattccctaaatagtgaagtgtttgctgctgtagctccactgtatacaagtgattatatttaccaaaaagacaaactgtaaactcttttgtttcttttaccagttatcttcctttcggctctctctcttcattgctttcacttttcctaaattagacttactgtttataagcaaccttggttttacatagtatgttggaagagtgtggggctggggttgatttaggatttggaggtgtaaagtttgccagtgagacaccaaaccttctctggctgcttttaaaactgatagtactcttgggctgtaagagtgactttgatcatatttaacaaccagcaatagaatttgacttttaatagaaagttgcttctaaatagcctatcctccacgtgtcattattgttctcatttccccatcccacagtccttgtataacttactagcttggacagtttacctgagaaattggcctcaaaacagaaagaaacttaatgctaatattaaactgtttttgggttaaattatttttcttgggttcaaattcagtccctgccaggtagtgtttttttagtttctgtagtatttgatagcaagttgattctatttacaacttaataatgattacattaggaactattttgcttttaattcagtttgtagattaaggaggcattatatagattttttagtaatttttagtaactttttttaagtgaagaaattcaagattctaggttattactggtggaggcattagtgtgtttcatatcatagttcattgtttattgatgaattcatacacatatgcaaaaaaagataatagatgctcagcagaaaaaaagttcaataagtgctgaacagggtgcttaacatagcagtgaacagaaaggggcatgatctttaattacagtgtaaaaagtgctgcaactggattgtaggggaagagcccatacattacaggggcagctaaccttttctgagtggtttgtgtaagttcttgatcaaagctaagatctgaaggataatttaaactttggtaattatagctatattttagttttaaggtctaaggaatatactagataatttgtcagaatatctaagtataatgataatttttcttcagaactataaaattacacaaagtctgtcttctttttgaagtgagataaaattttggcatcaaagctaacttttaaattatgatgaataatacataattaccagaaaattcttacttctgaaataaaattattcaacattatttttatcttagagtacgactttctgtctcatatttttgagaactgtctactgccaacataatattaaactatcgactaaaaggaatttaagatgtatgttagccaaatctcagagaaaaaccaa

SEQ ID NO: 128427 - DNA, 1122 bp, Homo sapiens
tcaatccatttggaaatccttaagttgtaaaacataatgttttcattaggttttctggtgtgtggctgattctaatccataaatccttgtgtactttggctttcattcacttaataattgtctgctttgatgaataccttctgatttaagttctagtgtagccaaatgttttatatatctatagttagaaaatttaaaatttgtttgtacattgccataacaaatgttctgaattttgtagtatcatcccaacatacagtgaatactgaattggaaaaacagatttctaatgaagttgatagtgaagacctgaaaatgtcttctgaagtgaagcatatttgtggcgaagatcaaattgaagataaaatggaagtgacagaaaacattgaagtcgttacacaccagatcactgtgcagcaagaacaactgcagttgttagaggaacctgaaacagtggtatccagagaagaatcaaggcctccaaaattagtcatggaatctgtcactcttccactagaaaccttagtgtccccacatgaggaaagtatttcattatgtcctgaggaacagttggttatagaaaggctacaaggagaaaaggaacagaaagaaaattctgaactttctactggattgatggactctgaaatgactcctacaattgagggttgtgtgaaagatgtttcataccaaggaggcaaatctataaagttatcatctgagacagagtcatcattttcatcatcagcagacataagcaaggcagatgtgtcttcctccccaacaccttcttcagacttgccttcgcatgacatgctgcataattacccttcagctcttagttcctctgctggaaacatcatgccaacaacttacatctcagtcactccaaaaattggcatgggtaaaccagctattactaagagaaaattttctcctggtagacctcggtccaaacaggtagggtgattttaatgatattgacagaaaagatattggaacaattctataaaatcagaaggtatatgtgtagctttggtgtggatggcaactttttctgtcttcagatagaacttcagtgtaatgttgattatgtgtttcagccattattttttaaatgct

SEQ ID NO: 128428 - DNA, 1924 bp, Homo sapiens
catcattatgagtggcagcttttgtaaaacttctctttatcatcttcaaggataactaaacatcttaattactaacctttcatttccagaatgccatcagtatttagttttgaaatatccttttaaaataatgtgccagttaccttttaaaaaaaattgttttagagatgggttctcactatgttggcctggttggtcttgaactcctggcttcaagcgttccttccgtcttggcctcccaaagtgttaggattacaggcatgaactaccacggttggcccaccttttgatgcattataattttcatgttttttaaaaatgtaaatatacatgtggttcaacagagaaaaatctgaagaaaaacttaaagcatttttggtgatgatttgcccttactcatacaaaatcataattgttgacttaatgaacaaagaaaaaaactcattctgagctaaagaattaataattttttgttaagattataacaatgaaatggaagttgaaggccctgaagatcaaatggtattctcagagcaggcagctaataaagatgtcaacggtcaggagtccactcctggaattgttccagatggtaagaatgtttaatggatatactctgtttttgaagaaaatgtgtatatacaataaatatgtgaatattgactaaaacttcagtaaaagccaagatgcagtcacttaggaagagttttttagtaaaataatcttagacaaattaataggagaaaggacatgcgtgtatttgtagttcagctaccatctagacttaatcataagtacttacttggttaagggaccaagtgattttctattaaaaagcaattcgtatttttatttctttagttgtagttgctaagtagagctgttgctgatgatgagatgtttcatgctgagataatgaaaaatttactgtattggatcatctcagcagtcctattgagggttatttcacttatttccatgatgtttcaattaagctttttgtagtaaatattgataagagctattattgtacttgcagatctggaattaataagagaccatgttgggggaaaactacttgttacatttaatcacaggctcatctgaaagtctttggtgttgtatgtgaagttgtatgttcaattatatagtatacataaaaattataatgtatacataaaaagccactgagatgttttgaaatttattaagtttacgtataataactctcattaaaattattttctataatctttcttgtgaggtctagttgttaaagaaaaagagaaaaagacaattaaaaaatttttaccatagtgcaaagacttctaattttgtcttcataacttactaataagtggtacaatgtttcatgcttatattggaaattgacatttagtagaataaaactctttactcaaattactgttgagggaacagtgttacagaaattttgactccttagagattttataaatgtgttactcacagcggttcaagtccacactgaagagcaacagaagagtcatccctcagaaagtcttgacacagatagtcttcttattgctggtaagcagtatgttcatattgtctaatttgattgagttacaagataatgtctttatcccaaagacatttttgcgattgctgtatgtatatacattacggtaactaaatcttttagttaagagattctggaaaagaattgacaatggatctaaagaaggttagtttctcttgaaaggttttttttttttttttttttttttttggaggggggaggtcatgattaaaaatattttgtactttcagatctgttacttggtagttttcttttatccctacctgtagtctttcaataaagtgggaaagaagatgagatttcagtttgatatcagaacatgtataggcctgggcgatatag

SEQ ID NO: 128429 - DNA, 1064 bp, Homo sapiens
tttcctggagattttagtgcagattttgtgaggccacatcagacattgaaaacagctttttaaaaggtgtataccctaaggccaggcgcagtggctcacacctgtaatcccagcactttgggaggctgaggcaggcagatcacttgaggtcaggagttgaagatgagcctggccaacatggtgaaaccctgtgtctttagtaaacacaaaaattagctgggtgtggtggcacacacctgtagtcccagctactcaggaggctgaggcaggagagaatcacttgaacccaggaggcagaggttgcagtgagccaagattgcgccactgcactccagcctgggcaacagagtaagagtccatctcaaaaaaaaaaagcatgtaccctaaattagtgtcatgaaaataaaagcttaatgtataatccacaaatgattcatgactttttaaaggtttacatcagaactacaattacaaatgcataacaaactgtttttgtttttatttttcctggtgtttagaattgcagaatatgtatagagtgtggcacacggtctagttctcagtggcaccacaattgcctgatatgtgacaattgttaccaacagcaggataacttatgtcccttctgtgggaagtgttatcatccagaattgcagaaagacatgcttcattgtaatatgtgcaaaaggtaagaagatagttattctattcagttgttttgtcgattgttttattcatgtggtcatttgctctaccatcttacagcttctaagtttttatcactctagcaattccatcagtactgattgctgttatagatggaattaaatgatgtttttgagtctcaaaggcataaggaagtaaatgggcaaaagataagaccagaccacatcagaaatgagcactaatagggaaaagtaaagagaaaatagcttaaaaatgtcaagtaaaaatacggcagcatctctagtgacatgcacaaatgtgctttaaaaaacctttgtcagttagcaactcctctaacctctctcctctcatacttaattaactgttttcatatccag

SEQ ID NO: 128430 - DNA, 1755 bp, Homo sapiens
gttaaataagtaacccagattcctttagtggggaatgggtgctgggtgtgctcattgctactgaagggtgtttgcttcttcatcctttcagcaggtggtgtcaggaaatacatgcgtgtgtatacacttacagaagtttgtccaacccatgacccgcaggctacatgtggtccaggatggctttgaatgtggcccaacagaaattcataaaatttcttaaaacattatgaggtgttttttttgtgtgtgtgtgtgtgtgtgcgtgtgtgtgtagctcatcggctatcgttagtgttagtgtatcttgtgtgtggcccaagacaattcttcttctttcagtgtggtccagggaagccaaaacattgaacacccctacacttaacgtatatacacataaatattcatatacatatgcataacttagaaataatgaatttacaccagtacctccagttcttgtccttctccactgaattctttgccttctcattcttgcatgtctgttcttctacaataaaaattctgggttgtagcaacatcagcacatttattcagttgctcaatctaaaaagcaagtctgcttcagtttgctctcagtaatagattttattcccctttcttttcttagtgatttaattttttaaatatagaagatattagtatactttcaaaactcaatactatatgaagttttactcagaattgtcactgcctcttgtttattatttatactccatttctcccaacctcttggaagtaactaacttcattgttttctgttttaaacctcctgttatttttcgtctaagaataagaagatatattgctcttattttcagtgaaggtagcatgttgtgtatgttcttttgcatgttgcttttttcgtgtaataaaatctggaaatcacttccaggcaagttaggcaagttcaagagatctcattctccttttaaacagctgcatagcactccattgtgtatctgtgctatgggttactcaaccaatggcctgtgctttggtatttcagtagtttacgatattttgcattataaatgattttacactccctagctttgtgcatgtgtgtttttgaattctcagggacaaatctgtagggtaaattcctagaagtaggattattgcctcaggagtgtacacatatgtagctttgttagatactgtcagattccctttcttggggcttatggtactttgcattgccaccagagatgtgtgagagaacttttcttacgtctttgctaacaggatgacttgttcagcttttgaatgtttgtctgtcttctgggcgaaaagtggtgtatcaatgtagttttaatttttgtttatcctgagtgaagttgatcgttttttcatgtgtttaagggtcagttttaatttcttctcgtgaattgtctgttcatgtgttttgcctgttattgaagattttggcattttcccctaaatttaagagttctttataagttagggatgtaagcttttatctgtgttacatgatgcagatactttctgccagcttatttgttcttgttttttttgcttatttgtgtgagacagtgtctcactccatcaccccggccatagtacagtggtatggtcatagttcactgtagccttgacctgggctcaagcagtcttcctgcctcagcctcccgagttagctaggagttatgtgtaccaccaagcccagctaattttttacttttgtagagacagggtctcactatgttgtccagg

SEQ ID NO: 128431 - DNA, 1018 bp, Homo sapiens
atttatcagttgttagcatttcattgtcactgggcatgccctctcttgctttctctgtgtgtgtgtgtgtgtgtgtgtgtgtgtgtgtgtgtgtgtgtgcgcgtgtgtgtgtctgtgtttttgtctctattccccctaaccccctactatttgagggttaattacatacgttgtgcctttttaccaccatttcagtatgtatttcttaatagtaggaatattcttaaaaaatcacaatcctgctatcaacttcctaaacttacatcaatgtagtatgtttatctaatgtactagccatattccagttatgtcatttgatcttatgtccttcataacctaccccttcctccaagtaggttctaggatttagtttttgtcattggtatttttgaagaatagagttcttctcgatatacttgtttttttctttttttcaaacaaatttccccattttgtctttgatatccccttataattagatgagaggcatgcattattggccagaatactgcaaagtactgatccatcctcagggtatcacagctggaagcacacattattccactttccctcatgggaatcacctggtcaggctgttgtccaatttcttttccccctcctttgtatctaataaagcagtatgtaaggacactttaagaccatgcaaatatcttgcttttcctcagaatttccttctagatttgaaaaacttactccctaggctgggtgtggtggctcatgcctataatcttagcactttgggaggctgaagcgggtggatcagttgaggtcaggagttcgagatcagcctggccaacatggtgaaaccctgtctgtaataaaaatacaaaaattagccaggcatgatagtgggtgccatgtaatcccagctactcaggatgccgagacaggagaattgcttgaacccgggaggcagaggttgcagtgagccgaactcatgctactacactccagcctgggtgacagagatagactctgtctcaaaaacaacaacaac

SEQ ID NO: 128432 - DNA, 3139 bp, Homo sapiens
cactatcatggaatgtgcctggatatagcggttactccattaaaacgtgcaggttggcaatgtcctgagtgcaaagtgtgccagaactgcaagtaagttttcatttcaattcaaagctgtgtattgggtttaagagggaccctattactaggtgctaaaggtttgtgtaatataatagaggttgttcatattttagctatattcattcagtgacttcatcatacttaaaaaaattactggatattataacatttatccagtatatatccataatataatttgttattatattataatataaataacatttatataattttgaaagaagtctaaacaaaactgattttaatcatttaaattgctctggtcgtctaaagagctaatttaaatttgccaacaatttaaaaaataagcgatattaacaatttaaaacaaacagaagaataaagtagtttttcttaaggggtactggggaggagatttaataggatttaaacgtctaactacagaagtagaagaattagagttgagccaaaaaatcagtcatgtgtttgaatttccattccaggaaggacaatttctactattattttaatgtacatctgcatctctctaaaagccaccttgagtagatcctggtcagcataattccaaaacgaaatatgtggcatttacaaatttgtaagggggttatattttcctatggtatttcatctcttggtcatttctccagtcttttctgtgatttccgcttgcacccccatgattctaatgagcatgataatttggggatgttaccagtatcttcatttacaggctgagaatttttgttgtaaccagcaagaattatgcccaactgccatgatcagtctgtttttattatttagtttgataagaaataaacgtcagtatcttagagttacgtgacataaataggactatgtacctccatattttggtaaaaattagataaaatattcagtaaacatttattcgataccttatatctgcgctcagtttcttgggaaggattaaaagaacttgaaggaagagtacttgtcctccaagatctttccacgtagctgaggagataaaacgtgactttttatggagaggctgaactgaataataattggaggctaactgacccatcttcctgttgacatctatttatcccccagatttcattcagagattcctctctcagctcttcttgctttccctgttgtttcttttcccctcctcttgaatttaaaatcatagtatctgaaagtgattatagtcaaaaatctcaacagagataaagctgtaggacaggggcccaatctttgggggcagaagagtgtttagagaaagattttaggttttcaactataattcttaataattatgacaaggttcgtattttgaaataattattcagcatttaattgcttaatagacattctaagcacttgaacccgcattacctttaattctcgcagtaatctttattattcccattttatacctggaactcagagagctttagtctaagttgtttagtgacacagctagaaaacagcagcctgaatacaaatagagatctgatgccaaatttgatcctctttacgttatacgacagtgtcttttcaattcgctgtgccaagatttgttcctttccacacagtagcacctatcagttatagcaccttcctctcaaaaattctattttaaaagtaaagatcagaggctattcatcttgccttaacccttcctcctttgcaggaatcctaaaatggctagagcaagttaaccataggtgagcattgagtaaagatcaccatttaggaggtaatccttatggcagggttacctctgttactatctgcagagacaaaacagatactgaggtatttatgaactgtgcagttcccaggactgattattttcatgattacttatgttacaaaacataagtttaaagataaggcatcattaatgctatcttattttttagacaatcgggagaagatagcaagatgctagtgtgtgatacgtgtgacaaagggtatcatactttttgtcttcaaccagttatgaaatcagtaccaaccaatggctggaaatgcaaagtaagttgtttatttatttatttttttaaatcctctctatgttttatatggagaccagacaaatcggatacctattcaaatctgtacatcatcaccatcagctttttaaaaacagctttattgacatataactgacatataataaactgtacactcttcaagataatgaacatagtcatcaccctcaaaagtttcctggtgcctcttggcttgctttgtggctgttcaaacccaaactctgtcttcctagtctgctttttcactatagattagtattcacttcctagaatttttaataaaagcttcatatactatatactcgtttttggtctggcttctttaactcagtgtaattattttgaaattcatccatattgctgcacagatcagtagtgattcttttttattactgagtgctggagataccacaatttgtgtattgaatcacctgttggtgaacatttgggtccttcaaaattttgagctattacaaaaaatgccgatgagctcattaactaacttcctacctcacttggcttctgccccttcagggtgaggcgttcagagccgggttgggggcagtggggtagtggagatagcccttggaatccaaggtgcggtttagcttttaagcttagtcttcctgggctgctggtgttgcgaggttgagggatggagatgaccctcaggtgctgcatgggcctggagcgggtttttcctggagctggagagggcatgatggcccgtgtgcgggagtggaaggcacagcattgtcattgctcttcttggaactgctttttctagtgaggaggtggagggcctgggaaaggagggtgatgtggccagaaccccaggtccccagctgggggaggaggtggagcagacgcagggagattctgtacctgcaccctgtcctcgccagtgaggtttggcacctagaactgcaagcagtattaccaggttcttttgtggtcttcagcaagtcctattaggcatctgcctgagtggtgggggttgaggggagg

SEQ ID NO: 128433 - DNA, 1033 bp, Homo sapiens
tttcttaaaatgtagagatggggtctcaccatgttgcccaggctggtctcaaactcctggacccaagggatcctctcttctcttcttggcctctcaaagtgctgggagtttagttgtgagctactgtgcctggccttcctttttttttttttttttttttttttttgagaggagttttgctgtgttgtgcaggctggagtgtggtggcatgatctcagctcactgcaacctctgcttcctgggttcaagtgattctgccgcctcagcctcctgagtagattggattataggctcgtgccaccacaccggctaatttttgtatatttagtagagatgtggtttcactacgttggccagcctgatcttgaactcctgacctcaggtgatctgcctgccttggcctcctgacgtgctgggattacaggtgtaagccactgtgcctggcccctttggtttttaacaagtatatttgggagaagtgagacagcccttccaatggaatattaaaactggaaattttgaccttagaaactatatgggctttaatagatagaacataggcaaagctttcaaaagtatagttgagacaaggacttagattcaagtaaaaattcaatcattagaacattagctttacttggattatcaaaatgaactgatttacatagatgagtaagcatcacctcaagagtagtgaagtcagagtgcttgttttggaaattttacattaaagtgtatatgtcatcaaattttgaacagtttaatgcataatagtattttccccagcctgaacattcttagagactggattaagacaatgatatttcagtgaaaaccatctgttttatgaattacttcataaaagtaatttttattttgggctattttgtgacagtgaaaagtattacagggaaggtaacaaaggctaaatgagctttttggtggtggattagaaccagaggaatcaatataaactcgtagtgtttgatacttagtacagaaatgtaggtgtatgtatttgcatgagtttgta

SEQ ID NO: 128434 - DNA, 1114 bp, Homo sapiens
aggctggagtgcagtggttcaatctcagcttactacaacctctacctcccggatacaagcgaggtgcctcagccacccgagtagctgggattacaggggtgtgccaccacacccagctaatttttgtatttttagtagagatggggtttcaccacgttggacaggctggtctcgaacttccacctcccagagtactgggattacaggcatgagccaccgtgcttggcccccacctttagctttcttacttggatttttttctagtcaaatataaaagaaaataacttttctaactgctaactagaattttttggatttgatatgtgtactactttttaaaatgctatggaaaagtagaattccaaatgtataattattaaacttaattgttcttatgggtaatcactgaatagactgtagaaaatagattgaaaagcttagcttgtgctttagacataatttaaaagcacaagtatctatagttatcgcttaaagcagttgaataaagctacttttctccttctctgacttacatttcatttttactagtgaacagctctgcgctttttgttactgtggggaaaaaagttccttaggacaaggagacttaaaacaattcagaataacgcctggatttatcttgccatggagaaaccaaccttctaacaagaaggacattgatgacaacagcaatggaacctatgagaaaatgcaaaactcagcaccacgaaaacaaagaggacagagaaagtaagcagtttcgactttaaatgttggaatagattaagactgcatataatttatttccattataatgtttataaattttcaaatgggattgttcttgttgaacagtttctcctgttctccacatttatgggatactctgactcaccattaacccaattaatccaacaaactatccttttcacaaatttttcttgttattttttaaaaagtttatattaattgtatatgaaagcggtgtgatcacaaaactaaacttttggaagaaaacttcaaagaacataacacaagctgagagggagggagttcatggaatttataaatggaaataatgtaataataaaacagatcaataaagtccttcttt

SEQ ID NO: 128435 - DNA, 1076 bp, Homo sapiens
cgtgaccatcctggctaacacagtgaaaccccgtctctactaaaaaaatacaaaaaattagccaggtgtggtgccgggcgcctgtagtcccagctacttgggaggctgaggcaggagaatggcgtgaacctgggaggcagagctttcagtgagctgagatcgcgccactgcactccagcctgggcggcagagcgagactctgtctttaaaaaaaaaaaaaaaaatcaagttgtataagtgaggtggacaagtgaatccatagactatagtgtgtgaatgtagatagaggtcatcagaatagcagctacatcactacacttaagacgttgagctaagtgcttttcatgcgttcttttttttttatttttggatcataaagacagttttatactaggtggtattgtctgtcttaaatgacgagcaaagtaaaattgagatgaagttaagtaacttgccaaaggtcacattgctagcagatggcagagctagaatgcagactcggaaccattggattccaagcctttggttttaactaacacagcagacaccttttgctattaaactttctcatgtcttagaaccaatttgtgtaggataaattagagtcattggaggtggaaaagtaaaggtttaaaagagggtatgttatgaacttatttaagggaaagggttagatctaatttatctttgcatccccagagataatgcctggcacatagctgatgctatttaatgaagtgcacattgtcttcaagttctcttaggaatctacttacatgtgattaggttctcttttttattgttgttgttgagacagggacttgctctgtcacccaggatggagtgcagtggtgtgatcttggtgcagctgcaacctctgcctcccaggctcaagtgattcttccacctcagcctcctgaatagctgggtctactggtgtgtgccaccaaggccggctgaattttttttgcttttgccatgttgcccaggctggtcttgaacttctgggcttaagtgatcctcctgcttcccaaagtgctgggattacaggcttgagccaccacgccaggtcaatg

SEQ ID NO: 128436 - DNA, 1050 bp, Homo sapiens
tttgttttttagtcatctgcatcacagtcaccaaaagcaccttttacaaagcttttaaaaatacatatatctggtcatttcacatcaactttattaaatatagaagttaaacctggtatgtgaactttgtgaagaacccattatgtagttaaaagccactactgtagacagagggagacttcagaaggttacctaaaaaaggggcaaaaccagagtgaggaatacttaagtgaattatgaggacacaattatattcatgtgggtctgtcctcacatttagagtataaggaagtgctggatttaagggagaaaatgactgtaaactctgatattttctacttgatatggtaaaatgctggaaaaatgccctaattacttattttgtataccttcaaattgtgccttatgttgaatataagtctaagccttaaaatttaacatttaactctatgtacttattatttttttttttttctgtagacctcgaagtagggggaaaactgcagtggaagatgaggacagcatggatgggctggagacaacagaaacagaaacgattgtggaaacaggtatcagaactcaagaatttataagaatgtataatgatgctttgcatatgtttgtacactgcatgtagcatttgtataacaatattctgtgttaagcatttgtttttatactgaactctaagtttcccatctgccttgttttgataactaatgacaaagtgaaaaaactgagccctctatctctcttttttccctaagccctggtttagtataattattttatatctgaagataaatgttttatcaaggaaataaagactgggagaaacagtaatccaggctgttagtataatcgctcatagtatattctggcctatgaaccatctagtgtttgtttaaagcttattttgttaatatgtgttctgaaaaaagtagtatgtttcgttatggaattaatattgtgaaaggctaggccaaactagaccaaatagtttctggtctgttggacttttaggtgcccttaaataagctgctgtatgtt

SEQ ID NO: 128437 - DNA, 1042 bp, Homo sapiens
ccgagtggtattggtctgcagctataggtggggggaaccctgagtacgataaactatcttctagaataatttttttaatatattgaagcagtagtgcctagtttataagtagacatatgtatagtataaactatatagtttatattcagagtacaaaatccaccttggccactatttttttttttctttttttgagatggagtctcactctgtcacccaggctggagtgcagtggcacgattttggctcactgcaacctctacctccctggattcagcgattctcatgcctcagcctcccaggtggctgggattacaggcacacgtcaccacacccacctaatttttgtatttttagtagaaacggggtttcgccatattggccaggctggtctcgaactcctgaccttgtgatctgcccacctcggcctcccagagtgctgggattacaggcgtgagccaccccacccggccaccttggccactattacaaaagtaaagctaaataatactgaagtatatgttccatattttgtaaggactgttgatttggaaacagtgtattctaacaagataaattttaaatgtaactaatagtatatgtttctgaataaatagttgctgcttctaatataaagtgtcatatttgttttaaaatcattgctcaagttgtatagttgttttgggcacgtattttcaacttctagaccaatacaaaatgtaaaataagtaaaagacgtgatatagttgtatcctttctaaacactgacctattttttttttttcctttgctaccttttttttttttttgagacagagtctcgctgtgtcgcccaggctagagtgcagtggtgcgatgttggcttactgcagccttcgcccctcgggttcaagtgagtctccggcctcagcctcccaagtagctgggattacaggcgtgtgccaccatgcctggttaagtttttgtatttttagtagagaccggttttatcatgttggccaggctggtttcgaactcctgacctcaagtgatctgcctgtct

SEQ ID NO: 128438 - DNA, 2438 bp, Homo sapiens
gttggaggctacagtgagctgtgatcatgccactgcactccagcctgggtgacagagcgagaccctatctcccaaaaaaaaaaaaaaaaaaaaaaactatgacataaaataatgcagttgttattggaggcggggatagtggggtggcaaagattttctttgtacgcagatgtccccaatatatagaagaaagatttttaaaaagctaggtcagcagaaatctctatgaaatgtttttcattatgagcaatacacgaaaaacagtcaaagcaattccctaggagttgtatatgtagtaatattattccaaagttttttattgctcaaacttttaaatgttgttagagtagatttttacatattataactctactggctagggttttattagtaggcctccctcagtgagacttgttttaggtggttttaaaatgatttcttacatcttttatccttggtcactttaaatctttacaccttattgtaatcgatttacattagaagcagcatacttgatggtctcagtgaagtctgtgtggtggtgttcttttagtggagcctagcaaaaaaagaatttccttgatttcctgatctttgggattctagtcatatggaccacatttggaataagcacatagttgaatataaaatgacaaaatgaaacataaccatattcttaaagttctcattgaattgttctaccatagttgaagtgtttggtcagtatggccaagtgtttgtttgtttttgagacggagtttcgctcttgtcaccctggctggagtgcagtggcacgatctcggcttactgcaacctatgcctccctggttccagcgattctccttcctcagaccccggagtagctgagagtacaggcgcccctccaccacgcctggctaatttttctatttttaatggagatggggtttcaccatgttggccaggctggtctcgaacttctgacctcaggtgatccacccaccttggccttccaaagtgcagggattactggtgtgagccactgtgcctggccctaagtgtttcttatattagactttcatacttatagagttgtagaatattagaactattaatagatgagaattcaagaagattgagtctaacccctcattttatagataactgagccccagagagattatggaatactagaagtcatatattaaggtgttacttttacagtaaataaaggagatggtagtctactgtattggtgtagacccatagtaaatcatgcctatgggtattcatgctattgtatagtcatctctctttgtatctcgcctagccctgtgactcactttaaccagtagaacatagcaaaaatgacactttgctatttttgggtacaagccttgagcatgtcaggcagcttctacttttgtactcttgggagctctgagttgctgccgtgcaagaagctgtcataccttgctggagagatgatgtggagaggaagagattccaggactatatggaaagagggaggcttaactatctcagtgtcctagctgccttcagcccttagttgacttgcctgttgaatacagacacaaaagtgattagtaagattagcgaaggggccggcgtgggggcttatgactgtgcagtcccagcactctgggaggccaaggcatgtggaacacttgagcccaggagttcaagaccagcccgggcaatatagcaagacactgtctctacaaaaaaatacagaaattagctgagtgtggtggcatgtctctgtagtcctagctacttaggaggctgaggtgggaggattggtcaagcccaggagggtgaggctgcagtgaaccattatcttgccattgcactcaagcctgggcgacagagtgaaaccttgtttctctctctcacacacaaaaaaaagattaacagaggaaccacctagctaagctcagtccaggttacgaaatcataaataagtaaaatgctggttgttttaatctgttttgctggaagcagatagttttctgaattaagggacgctaagaacaaagagtatttggagctgggtgtggtagtacatgcctttagtcccagctacttaggaggttgaggtgggaggatcacttgagcagaggagttggaggctgcagtgagctatgatcctgcaactgcaccccacccagcctgggtgacagaacaatacccggtctcagaaaaaaaaaatgcatttgggatacgagtgataaaaatcattattttccatcctcttttactgaaatagttaaatgaagtttctccttaaccttaccctttatttttctaaagtattttgaaatacagatttttattattgaggactttaaatagtatttaaaaatggaattgtcacagtgtagattgggctatagttaggtcatacagaatagaaagataaaacaattatgaatatc

SEQ ID NO: 128439 - DNA, 1055 bp, Homo sapiens
catgagccaccgcacccagccctttttatgatttttaaacttggattttaagtgtttttcattaattagaatctaaaacggtatttgcgcctatactttgtaggctaggtttaatctgcggaccaccaggggactacaggtctcaatctctgctttatgcccagttattttattttttaaatgaaagttttcaaagcaggtatttacagtattcttgaggataggaaccttactaaattactttgtattctgtttagcatttatgcatttgaatgtaggcactcaaatacttggtgatttaatgatgcctattattaaaaaaacactgtggtaataatatggagacaggagttacctggaggcagagataataggctgttacaatagttgtagtgtgagagatcaagccaaagcatagaatgttggtagtgcgaatggggaggaagattccagtcactgcaaaggaggaattcggcagtttctggcatagatgttgtagcaggcatccaaatagattggatgcctgctaagcattcggggaagtaggactggagttgaggaatcgattaggataagtatttaaagatgtgacttaacatgtaatcactgagaatatggcgtatgggaattagtaaaggattaggatgctttgttgcccttaggagataggggaccagttatacccggaaaaacaagaaaggaaatcagaatatattctcatgacaaatggacaacatatacatacaagatgctcatggcagcagtattagtagtagagaaaagttggcaacaacaaaatatgcatcaatggactaccatgcagttttaaatcaagacatagagatagatctgtgggccctgaagtgggagaatgtctatgatacattgttgaactagagaaaaacctttccaaaagttgtaaagcagtaagtttagcagtaactttattttgtgaaaagcacataaacccaaactgtgtgtatattttgtgcatataaaaagattgggaagaatacataataaatattaatactctgggggccgggcgcagtggc

SEQ ID NO: 128440 - DNA, 1077 bp, Homo sapiens
aggaggcagaggttgcagtgagctgagatcatgctattgcacaccagcctgggcgacagagtgagactctgtctcaaaaagaaaaaaaaaaaagtaatagaccaatcttggatttataattggaagtgttgatccctttatttgcagaatttgaaggacttaagagcacaagttgagagaaacaaatgacacagctctttttgcactttgtaatattctagaaaaagcctcaggtaaaaggaaaattgtttcactttgtttctgctgttaattttgtgatggcagtaactacatatgatctacaagtgtaaaattgtttaacaagtcttaagttttctatacttctatgtaactttttagatctttcatttggtacatgttatttaaagagctacaaagtgctaaatatgtcctgggatgaacagtcaaccctggaagatttattgtggcctagaggggtgctcaaagatttggaggaagtagtatttgaattagaccttgaaggattggtgggatttagccaagtagaatgacaagaaaatgagtgtgtgagggagcaatgtgaatgaaattattgagggaaggaggtgtaaaaggtggggtggcttctgactgtgtgactagaacagaggctgtgtgtagtggtgaggccaagctgtgatagttcttgaatgccagactcatgagtttgggctttatcctgtagtccaggagttataaactgtttacagggagcaggtaagcaatttaaatgaacagtaggctgcttctaagaatctgaatgacaactgacactttagaccttgggttggggagaaaatgggaaataataacagccttggggaagtctaggagtccttatgccctgcttaaggtgaaactgatacagaattctggctgatggttgctatttgagatgctgtttctagatttttcaagagggcggaaatttggatttttatgatttttttttttcttttttgagatggagttttactcttgttgcccaggctagagtgcaatggtgtgatctcggctcactgcaacctctgcctcccgggtacaagtgattctcct

SEQ ID NO: 128441 - DNA, 1280 bp, Homo sapiens
caggtcttaaccattggcaggcctctgtcagaatatgcacatattaaagatctcattatttttgtgttaatgttaaaaaatttttctgaagcttttttcttattttttccatccttacactgtaaattcacattaccaagttgggaagccaaagaaacattctactctactatgtttcttaccagttcatgaaagttgatgttagaaatgggtgtgggtgtgggggatgggggtggttgtacagaagcagcaggtggtaggtataggatttctgaagcactatccttggccttttttgagtaaactctttataccctgaaccactttcttttcagagggcaattgctattattagagagccaccttaagcattattgttgtagaaaaattaggcacaaccagtgattgtcattacaaggaccagcaaaaatggctaggttgctactctgtatttgtaacgcccttcccccaacaaaatttctccttttcatagctgtgaatttgaaataagtgatagaaaactgtactgcattacaatatataccatttaataaaacaagtttatagttgagagacagcactattattcatgctttttgagataatgcaaatttgtaatttttatgacagcaattcttaataatttattgtccaagagatctgataaaatttttgatattattggtctctgggactcaataggcactgaaatgttttaattcagttgaaaagttgactcaggattgctaccctctcttacctgttaggaggttgttgtttaacctgacctgaaattcccatgaataagaacctgttttttttctttttttttttttttgacagagtcttgctctgccgcccaggctggagtgcagtggtgcgatcttggctcgctgcaacttccgcctcccaggttcaagtgattctcctgtctcagcctcccaagtagctggagtagctgggactgcaggcacgtactaccatgcctgactaatttttgtatttttagtagagacggggtttcaccctgttagccaggatggtctcaatctcttgacctcatgatctgcctgcctgggcctcccaaagtgctgggattacagacatgaaacaccgcacctggcccagggaatttctaatatttgagaagatgttatttttagtctattatacaaatttatatattgtttactaatatataaatttacatattagttactaatatgtaaacttaccaatttacatattggttactaatatgtaaacttgataaacatgga

SEQ ID NO: 128442 - DNA, 1707 bp, Homo sapiens
ggaagaactgtgaatgtctctcgaagttgtagaatggcgtgtgtgcttactcatttcgtgagatgatattctcattgaactgtcgggagtggaagggtgcgctgggacgtgaaggaagccagcacgtttatggataggctgtttctttggttcgggtgcattcacttagtaatagtattgttgtttggtgatttgtagtaaaaatagtagcgtgaactgaggcatagcagagctgggttgtgggaacccattgagctcttgacttgaatgtgctcttttcttgccccgctgtccttttactatgaaaatgattcagggccttcaacttgcctccatattttattgccagctgttacctagctatgataatcgtgagggaagcaagtacaggatgtgtgtacattattacattagcttgttcgtgatacaaagttaggacttatttattatgccacttgcgttgtaatacagtggcaagtataaaatgcccttattctgtattaactgaaatttgtagaaggaagtggaggtttaagtaatttttagacatgtaagccacttttttttgcatcctttaaagcaactcaggacaagccatattggggttttaccttgattgcctcccatttcactatttgcaaagcatttcttcatctcttactgaacattaatttgcaagtattgttttaaatttgcatttgaattcttactccagaaagattagatctatgttgtcacaccccacaccccatactcctgtaagggcgtgcttgtgcacgcgcacacgcgcacactcacacgcacgcgcacactcgcacacaccctacttttgaaatgagctcatttgtattagtgcagctcctgagtgcactggacgattagggtattgccactttattattttaattctgaatctcatgaagaaataggcagcctttggagaagataaaaaatttctgctgaataacagtataatctaactatgaaaaatcaaaacttttggaaatatttagaacaaatgtaagtctgtagagagctttttcttttagatttgaaaactagtactgctttctttataggaaattaaagtctactggtaaatttgacgggtctaaactttttagagcgttttttttgaaattgtgtcttttgaagggaatggaatctccagttgtttttagcaacatgtaaatggaaactaacatatgaattggaaagcaaagaggtttttgaattgtgtatctctatactgtataagaatccatgcagaaaagaccctgtagttggacagtaaagaccctgaaagtgaaacttatgtgtaaccagtgtaaattaggtttgtaaccagtgaaattatgtgaaattgcaaataattcacctgagaaatgaaaattaatcttctttgctaaatctcatagagatattttaagttgctaatgttacttagatgttcattaacttagtgagttacattaagtagagaagatgccttttttttttttttctggacgaagtcttgctctgtagcccaggctgtagtgcagtggtatgatctcggctcaccgcaacctctgcctcgtgtattcaagcgattctccttcctcagcctccagagtagctgggattacaggtgtgcgccatcgcacctagctaattttttgtatttttagtagacacagggtttcaccatgttggccaggctggtct

SEQ ID NO: 128443 - DNA, 1031 bp, Homo sapiens
ttcgccgccgccgccgcccgggcctgacgggcctgacgcgcgggggaggggcggccggccgggggcgcgaccccctcgccgcccccgccgggccccgcggccggccctccccgcgccgggcccctttctcctcctgccgcgggcggctcgggggaggggccgcgggcggagaccccgggggccggcgcccctcacgccgcccgcccgcccggctgccccgcccgcccgcacccgccggccccgcccgccccgcaccgcccgccccgcccgccgccccccgcccggcccctgcgcgcggaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccgcagccgccgccaccaccccccgaggagcctggagccccggccccgagccccgcagccgcagacaaaagacctcggggccggcctcgcaaagatggcgcttcccctttccagagagccagaaagaagtaagttgagtgcgagggagccaggccgggagccagcggcggcgccgggccggagctgtcaccgggcgcccgccccgcggcctccgcgccccggcgccccccggcggggtgggggcggggcgggcccgcgggcggtggcggctcccggccccggccccgcgcccctcggtagccgcccgcgcccggcctcccccgctccgcgccgcccgcccgggctcccgccggcgcccggctccgcacactttacttttcagtcgggccttttcactgggtcttctccgcgactcttcttttggagaaatttctcgtagccgcgtcttggcctagctggatcattgagaaaacaagcccgga

SEQ ID NO: 128444 - DNA, 1461 bp, Homo sapiens
gaggaggcaggaatcctccagtgtccccccgtgcagcgtgcacaccccaacacgctcaggcttgaagctgccgtctagctccttgatagcccagcaggcgtgggccaccagcttggtcaagtggttcatggggggcagggtgtgggtattcatcacagaatggagggcccaggacggatcttccaaaggccccagagattggatggccagggagggcagtgtggccaggacctctgcagtggctgtggcgtaggcctcccggagctgcgggcgaggcaggccgaacttcagcagctgctctgcctgttccagcaaggcttccgtcagcagaaccacgaaggctgtgccatccccactattctctgcttgggtttgggctgcttcccggaggagccatgccgctgggtgctccagctccagggccctgaggatggcagtggcacaccccgtgcacactgtttctcctttcatggtcaccaggaacttctgccggccatgggggccatagcaaggccggatgacattggccagggtctggactgcagccaagctgctcagcaggtggggctcctcctcttccggactccttgggctctcccttgggttcagtgccagccgctggggcagctccagggctgaagggactgtgctgtccatggcccgcagaaagaggagaggccaccgtgggttgcagagatgctctagaaacagcagcaggggcacccttgacaccgatcgttgaaagtactcaagaggtcagtggaagcaaggagccaaatgcccattgattggtatctgaagatgttagcacagaccagcgctccactgtgggtccaaggatgagctccaaagagcccagtcctaaagccaccccagggttgattctgtaaaggaactgggtcttggggcctctcaaccttggtggctgaaatgggatctttaactgatgaagtcacaaagtggaaaatggaaccaggatagagaatgaggtcgcagaagtctggttagaactgaggaggccctaccagcaggcaaaagtcaggccttgtccagcaatggaggtacatgcacctctgcaccaggtctgagacttgtttaaacgttagatacaataaggaggagatcaagtgaaaaactacccacttcaccctgtctggagtgcaggggcatgaccatggttcactgcaggcccaactccctggtctcaagcagtcttcctgttcagcctcccaagtacctgggactataggcgcacaccaccacacctagctagtttttttattttttatagagacagggtttctgtatgttgtccaggcaggtctcaaattcctagcctcaagagagccttccaccttggcctcccgaagtgctaggactacaggtgtgagccaccaccacacccacgcttttttttttttttttttttttttgagacagagttgcactctgttgcccagg

SEQ ID NO: 128445 - DNA, 1048 bp, Homo sapiens
aggtcaagaactggccgggcacggtggctctcgcctgtaatcccagcactttgggaggctgaggcaggaggatcatgaggtcaggagttcgagaccagcctggccaatatggtgaaaccccgtctctactaaaaatacaaaaaaatagctgggtgtggtggcgcgcacctgtagtcccagctattcgggaggctgaggcaggagaatcgcttgaaccagggaggcggaggttgcagtgagccaagatcatgccactgcacaccagcctgggcaacagagcaagactccatctctaaaaaaaaaaaaaaaattcgagaactggaaaggaactaagcacatgaaaagaaattttatgttccttcatgtttttatttaaagaaactgaatcaagtaccaaacatggaataaaggcaaacattcatttttggggtgattgttcccttcttggcaatccctgttttattgagggtatcactagttattcattccaaggattttttttttttccacaggaggtgggcgtttctttgtcttcttagagtcaggattccagatctgctgatgtgtgggacttttcttggccactacgatttcatctacagtcacgagctgtagcaccacctcagccactgctcgaaatccttgggctttgactattagggtgtcccacaccccttcctgggccacatttattatcccttcagctcccacacccattaggaggttcccaccttggtgcactccactcatttctgcaaccacgtctgagacagctaagcctgcattctctgccaaggttttaggaagatacttcagggcccgggcaaatgctaggaatgcaggcccattgggcccttccaatctgcttcctttatcagagagcatttttgccaaagccatttctgtggccccagctcctgggatcagtctgggatcttgacatggctggaaataggcatcaatgctgtggtagacggcctgctctgcactccgcagcccctgggtggtggctcccctgagaaccacggtgagggcaggtgtgcctgta

SEQ ID NO: 128446 - DNA, 1002 bp, Homo sapiens
gcgtgatggtgcatgcctgtaatcccagctactcaggaggctgaggcaggagaatcagttgaacttggaaggcagaggttgcagtgagccgagatcgcgccactgcactccagcctgggtgacagagcaagactctgtctcaaaaaaaaaaaaaaaaaaaaaatatatatatatatatatatataagctgggtgtggtggcacgcacctgtaatcccagctatttgagaggctgaggcaggagaatcacttgaactcgggaggtggaggctgcagtgagctgagattgtgccactttactccagcctaggtgacagaggaagactctgtctcaaaaaaaacaaacaataacaacaaaaagaaacccacagtaataaaattgaaatagaaggaggtttgcaatcaaaatgactgactaggaatgaaataggaaacataatatgttgcatctgcatagggaagtctgagattggctgatattgttctcttctgtaggggaaatactagtccagaacttggggtgcctgccaagaggggagcagccacagtagggaggggggattctggaatgctagggttctggagtctgtggacacaggaggcagaggacatgtgttaagatgttttaagaaatgaatgttgatctggatatgaaaatatttttcagccgggcgcagtggctcacgtctgtaatcccagcactttgggaggcttaggcgggcggatcacaaggtcaggagatcaagaccatcatggctaacacagtgaaacctcatctctactaaaaatacaaaaagttagctgggcgtggtggcggaggcctgtaatcccagttgctcaggaggctgaggcaggagaatggcgtgaacccgggacggagcttgcatgagccaagattgcgcctctgcactctagcctgggcgacagagggagactccatctaaaaaaaaaaaaaaaaaaaaagaaagaaaatatttttcactatagagaggcatatgtcccc

SEQ ID NO: 128447 - DNA, 1131 bp, Homo sapiens
ggcctctcaaagtgctgggattacagtcatgagccaccgtgcctggccgcctcacagtgttcttttatgtgctcctttagcccccatattttctataaactagtagaaaaatttagaccattcatgagagttaggttttttttgttttgtgtttgtttttgtttttcaagaataccttgggctgggcgcggtggctcacacctgtaattctgacactttgggaggccgaggtgagaggatcacttgagccctagagttcaaaaccaacctggggaataagacaaaacccaatctctacacaaaatacaaaaaattagccgggcctggtgccacgcacctgtggtcccagctactcagaaggctgaggtgagagaatcgcttgagcctgggaggctgagattgccgtgagccaagatcgtgccactgcactccagcctgggtgacagagcgacaaagaaatacaaagaacaaacaaataaaaaacccaagaatactttataggtggtgctgtgaacttgcttttgctttttattcaggaggcacaaaatctctcactatccaataatgttagaactgatcagagttcaaatgttgtcagcctgacccatctattctaaagttccctattaacatttcacccaataattttagcagatattgataatcagtggctagaatgattttgttagggtttactaaatggcagcattctaatgttttcattcctttggcatatattagctatagttcttctatagagaagaattcccccgtcatgtttgcaaaggcaggataaatacttgattccttccccttattggtatcaaattaatgagttgcttccttaagcacctttaactatgaaaatatttttggaatatcattacgaactcatggatttttctatgtttgatgtgtttcaatctttgcagtcctactttctaaagctaaagttaacccaagtttaaccaatgatagccttttccaccgggcatgatgccttgcgcctgtaaccccagcactttgggaggctgaggtgggcagatcacttgaggccagtagtttgagaccaggctgggcaacatgacaaaagcctctctctactaaaaatacaaaaaaattagcggggcg

SEQ ID NO: 128448 - DNA, 1053 bp, Homo sapiens
tgtgcattggccatttctatttcttttgtgaattgtctacaacatgggtctgtttatcttaattttttttttttttttgagatggagtctcgctctgttgcccaggctggagtgcagtgccgccatctagctcactgcaacctctgcctcctgggttcaagtgattctcctgcctcagcctcctgagtagctgagattacaggtgtgtgccacgatgcctggctaatttttctatttttagtagagacaggatttcactatgttggtcagcctggtctcgaactcctaacctcgtgatccacccgccttggcctcccaaagtgctgggattacaggcatgagccactgcgcccagcgttatcttaatatttttatctcaatctatcacttgtctttgtttatagtatcatgttaatatatttttctacataattagaatcattttgagaaaaaatattacagcaattcttcatttattcatagtcattccttttggagaattttctggtcatatgggtattaaatacttcaagacccagctcaaatgaccctttcaccatgaagtcttccctgacttcctctaactcaagcgtcacttaatcatccatcccgtgttcccacgcacacatttagcacttcattcagactttgttgtattaaatgtgtttacaaagatatttatcctattataagctttttgaaagcaggaacaatatttcatttctatgaatacaacagagcctatattcaatacaagggcttgatttgtgctttaattaccaatgcttttaaatcttttaatatttttgagagaaatatttctggattatgtgtttgcatacttttttttttttctgagacagggtctcactctgttgcccaggctggaatgcagtgctgcaatcatggctcactgcagccttagcctccagggccaaggcgatcctcccacctcagcgtccatagtagctgggactacaggcacatgtccagctaatttttttttttttttgagacagaatctcattctgtcacccaggctggattacagta

SEQ ID NO: 128449 - DNA, 1057 bp, Homo sapiens
aaataaaataaaaagccgtgatctcaccatccaaagatctccaccattatcatttggagtgtatcattccagatgagtctctatacattgttcttttttttttttttagagatagggtctcagtctgtcacccaggctggagtgcaatggcgcaatcttggctcaagtgttcctcccacctcagcttcccgagcagccgtgactgcaggcacacactaccacacctggctaattttttaaatttttttgtagagagagagtctcgctttttgcccaggctggtctcaaaatcctgacctcaagtcatcttcccacctcggcctcccaaagtgctggattacaggtgtgagccactgcatgtggcccacattgtccttgagggagtgttttggctttttgttgttttttctttgctggacatactgttctttatttgctttgttcacttaacaatgggttttggacatctttccatatcaatatatcgatccaatcattttcaaagctctgtacatcatactttgcttaacccactcctgttgatgggcatttcaattgtttatattttttcctaaatccttacagacacagcttggcagttacccaattatttcctttagataaataaagagatatacttcttggttaaaggatgtttacttttttgagttttcaacacgttaatacgtaccactaaaggtagaaaaaagtgaggccaatgataaacaggtctcgggcagaatcatttgatctgcaaaactcaattcttggacttttgatttatatgaggtaatgaatttacattttgcctattctggcaaaatctgacatttgtaatttcaaattctttctaaagtgagacagtcgcttgactatacctatattagtatttcagtaacataaggctcagatttcagctgtgatgggaactgcaaaatggtatgattcatgtgagtgctaacaaatcattcaaaatttaggaagtttgcatctgttttatatagatatatctaaattatgaatatgggttaatatttggagtattcttagcctaatg

SEQ ID NO: 128450 - DNA, 1123 bp, Homo sapiens
accttgcttttcaaaggagactatgaaaaatagttttaaagtggacacatttccctccccatcaaattgggttttatactttaggaagaagggaagaatggatatagtgtaatcaactaccagaaagggtgtgtactgtagtcatcagattttggaaaggccctagatctgtggctctttatttttgaatcttacaaattgaagtgggagtgcatgtgagcctggccggaggagagtcccctagcctcttccaaccttcccaccaggctctaatttccttatttattgtatttgcttgtacagctccattttggcaaaagtgaatttagattttctttcacattccagtaagtgtctttttaaacttttttgcagactttgcattttgtaacctacccttgagctactgcattttgactgagatttttaaattttacacaggtgatattcttgaatttcatggcccagaaggaacaggaaaaacagaaatgctttatcacctaacagcacgatgtatacttcccaaatcagaaggtggcctggaagtagaagtcttatttattgatacagattaccactttgatatgctccggctagttacaattcttgagcacagactatcccaaagctctgaagaaataatcaaatactgcctgggaagattttttttggtgtactgcagtagtagcacccacttacttcttacactttactcactagaaagtatgttttgtagtcacccatctctctgccttttgattttggatagcctgtcagctttttactggatagaccgcgtcaatggaggagaaagtgtgaacttacaggagtctactctgaggaaatgttctcagtgcttagagaagcttgtaaatgactatcgcctggttctttttgcaacgacacaaactataatgcagaaagcctcgagctcatcagaagaaccttctcatgcctctcgacgactgtgtgatgtggacatagactacagaccttatctctgtaaggcatggcagcaactggtgaagcacaggatgtttttctccaaacaagatgattctcaaagcagcaaccaattttcattagtttcacgttgtttaaaaagtaacagtttaaaaaaaca

SEQ ID NO: 128451 - DNA, 1122 bp, Homo sapiens
aaatcagatagatgaaaaaacagttacaaatacaaaaacacgtttatactatcttttttttttttttagatggagtctcactctgtcgcccaggatggagtgaagtggtgtgatctcggctcactgcaacctcctcctcctgggttcaagtgattctcctgcctcagcctccccagtacctgggactacaggtgtgtgctaccacacctggctaattttttgtttttagtagagacggggtttcaccacgttggccaggctgctcttgaactcctgacctcaggtgattcgcccaccttggcctcccaaagtgttgggattacagaggtgagccaccatacctggcctgtactgtcttttatatttgcctagatagttacatttccctgtgctctttattttctcatttggatttcaggaactgtgtcctttcattcagcctgcaggactccctttagtattttttgtacagcagatttgctaaccaaaattctccataataaaacacaaattttgatcaaatatgtaagacaaaaaacagaatggtctttgtactctctctgtaaggaaggatattattaaggtgagccttatgaaactgacaatatgttaaaatgggtttgtggaacaacttctacattagaatattatattatagaaacgttgaaaaacaccatcatgttcagtaactaacaaaaaagtttactgaaaactactgaagatcctatagctgtaaaactagttagatgagtattccattggaacaatagcagatagaagactgggattataaagattatttatcaacaatagaagtttatcagagcttgttacagaaaagcttaagttgaagtagtaagatttaggggttatagagtctcaatgccattgtaaactttttttttgagatagagtcttgctctgtctcatctgtatttttagtagagatggggtttcaccatattggccaggctggtctcgaacacccaacctcagggaatccacccaccttggcctcccaaaatgctgggattacaggtgtgagccactgcacccatccgaacattttttaaaatttattttaatttaattttaaattctaggatacatgtgtagaacgtg

SEQ ID NO: 128452 - DNA, 1053 bp, Homo sapiens
gcctggaagtaaatttggtctcttagcgatttttttcaagaagggattttaatcatttttgccacaaaatgtaacatggcatgttcaccttacccttgattcttttctatagaaaaatgcacttggtttggtttccttgacaaccttgtgggggtgccttctttagtttgctacagtccatctcctactgttagttccttccttttgctgctgaagcgaccagaagtggttgtggactggaaaaatcctctttgcttgtgtgaattctttttgaaatacacgtcatatcaagctttgtagctctttattttagaacttgcttttctacctaaaacacaagccaaaatcagcgttgtcgatactacagctcccctccctcaattattgacacccttaactcatgccctcccccaatgggttcacctcaggtcccctcaggtctggttgtgtcaagagtgaaaccagtgggtgaaagtatttttcatttccacatttgcatgtgagatttttgctttgtagttttagtcttgcagaactattaaaatataaaggaattcttggtagtagcaataaaataatgctcacagagttgtcatacctttaagattagtaagtcgtggaccttactcatctttcttgctataaatacctaaaatgtcgtgctcagttttgaccttttgaggtaagtgattaatgtaacttggctaacttggagattcaacttctatagatcattgttttgtggcccaaagtcatgcttcagaagttggtgtcaagacttagaaacggtggcagggaatctccatatgaattccccatatcgagtgtatggccagaaggagcctgaaagagcccgaatttaccaacttgagcacatcagtagttcttacatttcccagagagccaaaatgatttttggatttagttttgcctcaaaataggacaaaaagtggtaaaattcagataaaaataaccaagccaaaggaaaagaacggacctaggaagtcaccctgagctttagcccagtggctgctgaagttggtccgcacattc

SEQ ID NO: 128453 - DNA, 1003 bp, Homo sapiens
ccttggtgccatcatccctgctcctcctttccttcctctccccttcccatgaatgtggggcttgatttgttttaccccttaagtgggctgaagatgtaaagcttaacctcttccaaactagatgctttgaggtttcagctgtcactgagaacagcttggtagctggtgcagcgtaccagcgtgcagaggcagcattgttcagctggagcctcactgctggagcctcatctaccagagggctccttccatactgcctccatgcttcgctgtagaatcaggaggcgaccacagcagcagaacactgccaccctaggatccagagctattgcacaaaattcacacacaggtgtggctgtgacgtgtggccataagcatcttcttcctttatggcacagtttctgagtgtagcagagcttgatgggggtgagcccaacacccacacttctcctcactgccttcctcccttctcagcacctcgtaactgaggctggctgaaggaaaggaagcaccagagatgattcccgaggtgtttttaggtcaggaggcactggcatgaggcaggctctgcagttgggtatgacctgccctgctttacctgggaccagagattcctgggaagggggctctcagcgctgaaatggtgatgtggggaagacgtggtcccttccatctcaggggaaggtttcctgaggtatcattagatattcttttttagactaaaatatttcctaaggggtcaccttctcctttctttgcctttcctccatggaagaatatttgactatttgatccaagctcccttgccactccaaatctgttagaaatgtaagtcagaattgagccccttcatagtggctcacatctataatcctagggctttgggaggctgaggctggagcattgcttgaggccagggttcgaaactagcccaggtgatatagcgagatctcgtctctatttcaaaaaagaaaaaaaaaaaaagaattgagccttttgttattga

SEQ ID NO: 128454 - DNA, 1067 bp, Homo sapiens
agcctggacacctggatggtaaaagcttcccaggtgactctaatgtgcttctaacttgaggaccgccatcagcgccagcccactcttggatcagccagcgtttagtaacttgcacgctttacttgagggggaagccagtttgaattgctttgtaatgtaatggatgtctttctacttctcagttctattcaggaggtacttgagtacctactaggtacaagacactgttgttaaattaggggatttaagtatgtacgagatgattcggttcttgccttcaagagcttataaaaaagctaaaaatacggaaataactctaatgggaaccactacaagctaaatgtcattaaagtgaatcatgcaaattatggtaattgagagaagggacagattgcatttaattagaggggatcaagaaagtctttgagaagctgccatctgagctgagtctgagagcttggcctgcagagctgggggtgggtggacaggccaggtggagggaagataatgagcgcagatagaaggagagtgggcagatgcctgcggtgcctgttttgaccagagcctacggtggtggggaaggtagtgggaaacaaacctaggagggagggtggggccagcaataaaatatctttagcctgctccagcagtctgggtccagcagtgggttgggagttgttaaaaactcttcatgaagtttgtgaagcagatgtaaatacatcctgctatagcaaagggattgatttttctgtaacaaattgcttgaattgaatatatataattatgttaatgcattttaaactagagaagcctgttgcagggtaaatgagttatagatataaaataaataaatacttactattgagagacagagccttgctctgtcgcccacgctgaagtgcggtggtgtgatcacagctcactgcagcctcgacctcctgggctcaagcagtcctcccacctcagcccctcaagtagctggaactacaggtgtgggcgaccacttgcagctaattaaaaatttttttttgtagagttgaggtcttgctctgttgctcaggctggtc

SEQ ID NO: 128455 - DNA, 1048 bp, Homo sapiens
aaacaacattagaaaatggcgcaaaatcgttaggtcccaggagagaatgtgggggcgcaaacccttttcctcccagcctatttttgtaaataaaatgtttaaacttgaaatacaaatcgatgtttatatttcctatcattttgtattttatggtatttggtacaactggctgatactaagcacgaatagatattgatgttatggagtgctgtaatccaaagtttttaattgtgaggcatgttctgatatgtttataggcaaacaaataaaacagcaaacttttttgccacatgtttgctagaaaatgattatactttattggagtgacatgaagtttgaacactaaacagtaatgtatgagaattactacagatacatgtatcttttagttttttttgtttgaactttctggagctgttttatagaagatgatggtttgttgtcggtgagtgttggatgaaatacttccttgcaccattgtaataaaagctgttagaatatttgtaaatatctttctgctgtagtgtggtggtctgttggttttctccctgtcgctgtgcctcctttaaagaatattgacattgttttacatcattggagaatttgattaatactcagcttgtgggaggaaatgtcttttcgcgaatggtgtgggctgcctgccccgcagtgaccactccatcgctgggggtatcgtgggtctggataacccgtcagagatggtttttgaatctggggtatagtgggaaggagtgcctaatgatttctgatgttccttcctagaagttcaggattcatgactgtaagctttcagtaactactctgatgtttgctgaatggactgctagcttgaaaggtaatttgctcaattaatagatttaggttgatttcactcttcatattattcttataattatgttactttaaaaattgttatttatggtatttcttctaagttgtgaagtatgttttttttttgttctgttttaaaattttttccttagtttcactctcaaaggaggtgaatgaaatatgttttgttctcaga

SEQ ID NO: 128456 - DNA, 1005 bp, Homo sapiens
caaacaaaatctgtttttgacctccagctcaaagccagtcagtgagaaactcagggacctctggtgggttactatgcatggtgtctgcatgtggcaataactgggtaacctagagcacaggtcttgggtctgagacctcagcaacctggctggtgtggagtagaatggggatggggagaccaacccagttgcaagtctaatcccattatgcacagttaggcaatctggtgaacagcatttgatgtattggcaaactgagctatgatccaggtaggtgctaatatcagagacagccaaatccacaggcagaatatggcaacagggagaacctcagcatcggggggaacctgagcaggagggagatcctgggcagggggagaacccgagcaggaggggaacccaagcagtggggacagcctgagcagcagggagaaaccaggcagcggggagaacccaggaagcggggagaacccaggaagtggggagaacccaggaagtggggagaacccaggaagcggggagaaccggggcagtggggagaaccggggcatgggggagaacctgggcagtggggagaactcaggcagggggtagaacatgggcaagggggtagaacacaggcagcggagagaagctgaagtcaggtggccagggctcgatgctgccaggtggtcagcaggctcctggcacagtcctggtctggccctcgagctgtgagagcactgtcttttgaaaaggcttatacactggactgggcatggtggctcacgtctgtaatcccagcactttgggatgccgaggcaggtggatcacctgaggtcaggagttcaagaccagcctggccaacatggtgaaaacctgtctctactaaaaacacaaaaaaccagctgggtgtggtggcacacacctgtagtcccagctactcgggaggctgaggcaggagaaccacttgaacccgggaggtagtggttgcaatgatctgagatcgtgccattgcactccagc

SEQ ID NO: 128457 - DNA, 1054 bp, Homo sapiens
gtccatcatgagtagaattttatctcataccgaatttaatattcttatgacttaagaaacagaatcgcaccagggataacaatagcttaagatatatttcacacattttgtctgaagagcttaggcaagagagaaaatacgtcattctattaaatactgactgcttcacttccaatgaaataacggattgattagcatttcctaagcaagctgttctgcatttatttgattcacttagcgtccatacatataactgatttaaacttaacattcttcctacacttttacagatcacatcagggaaaaaggaagattttcatggaataaattaacttacactaaaaacaatttgagcacagaaacattagcagaatgaatatttatgaatttgcaattaattttaccgattttattgtgtattacttactatgtaatatgtgactaatttaatgtactcatttatgtaatagatgtctacagaggaccaacaaggggcccagcactgtgtaagtgccaaaattacaacaataacagtggcaaacaaactccctattttcatagcgttaatattctagaggaggagctaacatttccaaaggcagctccacgttttctatgacctataaagaagaggtgagatgatgttgcctgcatgtggctgagtgaaaggcagccagcaaagacctctcagaggaaggaaattgacacctgacctgaagcccaagtgcatgaagaaactaagctacgaagagggacagagaggaggtcagtgaggctacagcagggggtggcaaacgttttctataaagggacacatagttgacgattttggatttatggcccagacagtctgtgtcacaatgacccccttttatttggcaagtaaaaagcagccacagtaatatgtaagctattatgccaataaaatttatagatggacaccgacatttacatttcatataattttttgtgtcacaaaataatgtttttttaattttgttatacccactgaaaagcataaataccattcttaggtcacaggctgtataacgca

SEQ ID NO: 128458 - DNA, 1058 bp, Homo sapiens
ccaaattggttttgcccatattttaaaatcttttcacatttcacttatatttccacacaaatgcataaatcttaaagcaactagagtcagctggaaaaaagaagtgttctaagcatttaccgtgaagaacagatcgttaagaaagtaggctgaggaaaattgggaagaatgctgaaatgagtagcaataactgatgagctatgctgatctaacacactccaagaaaaagaagactagcagtcagttgacatggtgttgtttctttctatgcgttatattcgttttgcttaagaaatttcctaatacaaaataactgtgtcattcttcgtttctaactaaattcttctatatgattctctaatttaatgtgtgcccaggtttctcttgacgtttcattgatgatccagtggcaaagaagaagaaacgatactaagatggaaggagttattgtgaaaatgtacatagataaaagcaggaacttattgcataaacatgtcgttcctataaataaaaatcaaacatatatatgtaagtcttctgatcagtactgcaaatttgccctccagaaaggttatgcaagtgtgcagtccaagaagcattatttagaaatgctactaaacaggttggcattgctttgagaaataactcattattcgtttaaatagcatttttaatttagtttcattatatattgtttagttgtatttcttctttgtaatttaccattctttatttgcaaatcattttgactacaataatcaataattaatatatcaactgttataattcaatattcctgtagttaatattctcatttgccttataggtttttctttttttgtgtgagatacagggttttttttatttttctattttgcattcaatcttttcctttatggcttctgcctgtttaatcatgtttaaaactgcctgtctactgtaaaattatataaatgtttatcttaattacctcataatcattttatgacttcagtttttacatttaaatcttcaaaccatctgggttttactttaccgtggtaagaaggatgagatag

SEQ ID NO: 128459 - DNA, 1037 bp, Homo sapiens
tggggacgctgactcccccaaaagcttgactgtgccggaggaggtcaggggcacttcgtcccccaggagggccgcgtgcctggaaacgcggctggtccgcggaaggctccgggcagctggccaggggacagttctgcacggataactttctaagtggaggacccggcgatccgcctccccagcgagcccacccgcctcgccgctccccgctgacccgcgcggcctgggcgcgcctgctctcgggctcacgttagtccggggcacggggccgaggggtcagggcgctggagtctctggcgaggacgagagagttgccatcttgttctgttgaaattgtttgtgtgccttcgtgtgtttattttaacccattaggtcatggtctgagaagaatcctctgacggtcccttattttaagttgctggctggcactttttttttttttttttttttttttggcgacagacaaggagatggggattgccttgctacttttgaaggttctgcagatttgcagatgctacttttgagggttccgtaagaattgaagaaattctttcaggggcaaggtccagagttgtttacagaagtgggttgggtccaagtgatgggggtgcagaggcacctttgcgggaacccaggcagtggtgcattttgagatctcgctttaagcaaaacaggcaataagtgaaaaattctacattaattgaacaaatacccagctggcttaaccacacccacggcagacacctgttgcctggcagagagaagcgccgtgggttcagaacttgactctggacggaggtgtgagtctctgggttcaagacacctcgcagggaagtaatcgccgcatggaggggcttactcttcaggaccctccccactcccgagacgacaagcccccatctaggggcggttcgcagtcctcggtccgtgggttctctgactgacctaattgcttgtttatgaaaatgcatctgcttccctcatttttcccactctttttcttttttagccattgtgttgttcagcataatttc

SEQ ID NO: 128460 - DNA, 1045 bp, Homo sapiens
ttacacctttattagaaaccttatggtctttgccctccccctaacccctctctgcgttttacttcagaaaataaagaatgaaaggattgctaattacatttctctcttctgctctgaataaggatattccatgtgatactcattgcatcccttcccctgtgtctaatgttaagaagtgtcatcggagcaaggtgaacctgagcctagagaattctacagcaacccatattttcagagttatttgtgggcccaagaaaacaatgagatgcacacttactcaaactttgaatgttcttatcaattcttgaattgataattatggctccacagcctgctgtgtaacttatttgaattttcatgttccaaggaaatccacgtggcttcagttgagtgatcatttaggacttacccatgcctaatctctcaagttgctttggaagactcttgctaatcacagcctctcttggattagatgactggcaaattctttgcactcacaacttgattgaaattcaggtgatattttacattcaagatgaggactgaatgatttactcctattactgacagctgagctgccgcacatctgacagctacaaaaagtggcagaatgttttctactttgcagtaacagtgaacccacatacacacagagaccagatctcagttcaggggactcaaagatctctgagctgtctggactcgcatttgaggtttgatatttaaaaaagagaaagacactttgcactgcccaaatggtcacggaaatgtcaaatccagttcagccatgcctgtaaactgctttctaatccagcccctgctcgctgacatccacattgtatgattgttctggacctgcagcctgttgtttcaccgggagttctacaagaatggtgacaatagcctcccggctggtccttgccatgccacattgcttagttgaaagtatgttcttataaaatctttaaaaaatgttttattcctcacatattgctttaggaatttatttctgagtacagctagaggattaagagaaggcagatgc

SEQ ID NO: 128461 - DNA, 1083 bp, Homo sapiens
ttggagcaggtgctatgtgtccccagtactttttccctggccccgcaactcacacattgagttgcttaatgaaaatggagtaaagactacagactaaacttcttggggactgccctgtgacccttggtttccaaggaccacaaggattttattgggtatgacaagaatgacccaatttgtataatcagcttttgcagaggtaaatacatttagtccagatcattttaaaattttctgtttattaaactaaaataaattcagcaacatagaagaattccatgacctcttttggttgtgggagccaattttatttgatagcaagaccacattttagaactcaagagcgtgcctcagatcttctaggtcccttgaacatactaagctcagaacagacaggcaggcagaaccaagcagaattccccctttaccattgtggcttcctgggatgatgggagaaagggttccattcgggaagtagaagtttcaaaaacccatcttggacagtggctcttggcaatggctgaacagtagaatcagctggaatgttttgaaaaacccagtcatctatgggtgttgtggagttgggaatgtttggttaagtgtagaggttctcaacattgcctggagccactggttcctcctgcccccgacctcttccccagtacccacccctggcctagagatacccaggggattctgattccactgcttcaaaatgcagtctgtgcactcatatgtttaatagtgcttctgttgtgcagccaagatgcagaaccagtggatcagaggcaaattttttgaataaatattgccatcaaagcctaaggaaataattataacatttataagggagcttcttgaaaaatatgcaatcaagtcttgttccctgggttgtggaggccgccaaatacatggaaagatgggcagagaacacagaataaggagaaaaatgaagtgaaacatgcatgagagagaaaagtaaatagtcaccagggaaaagatgaggaaacatgctgtgtttttaagttttctaacctcagttatagactgaatttggggaaaaacaagaatctttaaagaaat

SEQ ID NO: 128462 - DNA, 1117 bp, Homo sapiens
ttaacaatcagttacccagggaatgagtaacgggatgactaactcattatctcgagggtaacaccaagccattcatgaggcgtctgcctccatgacccaaatacctctcagtagattccacctccacctccaaccttggggatcaaatttgaacatgaggtttggggggtggataaacatccaaactatagcagcacccaaaagctgaaagtgccatgtcttattttttattttcagccttatccgtagcacgctttatggtagcaaagaggtctacaagctgtggccccaaaataatttaactttcttactgtaacctttccattttaaatttgattcactgtagagcatttccatgggtagaactgggtcaaagagaagtctttcattttagagttttgttattaaggaagaattgggtattttcatactttttaaagtttatttttggctatgattacttacagtggttcattttttatagacatctaggaaatgttaattactgcagataagattcccaattcagaagccaaccacaaaggcttttcttcttcttcttctatatatatataaaggagataatgctaaaatgctcttatgcaaattttaaaattccctagtacattaacaatgctaatgacagttaatgcattcctgaagcttctgtgtgatccaaaatattcaaaatgcttagaaatgttttaggtccaccctgcaaatatatgggaagtggaattttgttcatggaaattagttccttgaaaatagattcagtgccaagtttaagagatgaagaagagctgaaaagtcagtgtagtgcaatatagagtcttctgcggataaaggtcgaaaccctcttttcccagaccaccatagtgggtaggtacagaatctcagataatcactgcagtttggttagaagaggaaattgcccttcataaagcaacacagaagaaggtaaggagaaagtggtattagattgataggtcaactaatgataatgaagaaactttctcttgctgacggtgatgtcagcttctaccaggactaacttcagtgagcacaggaatggcattgctgttcaatagggttataccctcaggtgggatgacag

SEQ ID NO: 128463 - DNA, 1038 bp, Homo sapiens
tggctaatttttgtattcttagtaaagacggggtttcactgtgttggccaggctggtctcgaactcctgagctcaagtgatatgcccgcctcagcctcccaaaatgctgggattacaggcgtgagtcaccacacctggccagttattctttgattctcctgcaccatctttcaattttttacacttggggcattttccctgttctcagcaccctcatcagtgtggaccaggacaacgggagagggtaaacctgaattcctccaactctaatgactttattaaaaggcttgagggggagggcagaaagggtatagtggtaacagtgagcactttgaatctcacttaccctaatcatttcttgaatgattgaaggagtaatgggaccctccttattccttactcctaaattctcactattgattgaacgtctcatacgcaggcactgagacacctcagtgaataaaatatagtcctcgccttccttcttggggcttccattctagtggcagaaatagacagtgattacacagctaattatttaattacaagtctgatgcattctgcaaaaacattgtaagggccaagggaaagcttctcctttgccttctgaaggttcactgaaaatcaactgatgaaagacaggtgaacaggagaagaggcttacaaatttgatcacagttttacacaggagctttcggaatgaagacgcaaagatagacaggaagctgtccatttttatgcttaggttcaacaaactgtggacagctgtgtggaaataggattggcacaaagggtctgatctaatgccaatacagtgagggggaaagcccagtaagatctgcccatctagattcttcttggcctctctgcagaattccttccttctgggcatggggcagcaccctctctgtaatgggaggtcttatgacccacagtcgaacaaggcaggtcaggtgatttcgttatggtcagtttttacacagaaaggtggggaaagttggagtagtagttttaggttttatggctggcttttgggaa

SEQ ID NO: 128464 - DNA, 1027 bp, Homo sapiens
gaaatttccatactgtttcccatagaggttgtattaatttacatttctaccaatagtatataaccattcccttttctctgcatccttgccaacatctgttgtttttttgactttcaaataatggctttctgagtgctgtaagatggtatctcattgtggctttaatttgcacttctctgatgatgagtgatgatgagcattttttcctgtgtttgttggccaagagctaagcattctgatggcttcgtgtggatcaaatcacagctggattgttcagttttggatgccaaatataaagagggacagacaaactggcattcatccagaagagaggaatcaggatcacgagagattagaagttgtattggtaaagggaatttgaataaatgatattatctaatctaggtgtgatagctaaatttatgtgtccacttggctgggctgcagtgcccaggtacgttgtgagacatcattctggatatttccatgagggtgttttggatgagatgaacatttaaatcagtggactttgagtaaagcagattgccttccctggtgcagtgggccttgtccaatcagttggaggtctggatagaacaagaggctgacctccccagagtaatggggaattctgcagcaaatggcctctggacttgaactgcagcattgacttttctctgggtttccagcctgctggtctgtccacattttggacttgccagctcctataatcacatgagctcattccttagtataaatctttctatatacgtatgtgtacgtcctattccttctgtttctcctgggaacgctgactgatacactaggaaagcagagatgtgggatggaggcatggtaagtgtttttagatatctggagggcttttatggaaatagacacagatttgttttctatgaatttgagagacccagatccctggattgaaatttagaggctggaagttttttttttttttttttttgcttaattgaaagaagacaacaagaattgatacattgatacaatt

SEQ ID NO: 128465 - DNA, 1050 bp, Homo sapiens
atttaattgttcagcagtagaatcttttctgctgtacgtgtgatttctcttggaggaagtgaattctttcttataagtgagtgtcaaggggaaagcacagaacatcaggcttaaagcttgagttgtggccctatgatttcagttccatatacagaaatccatccgcccaacaaagaaccttctaaacattctacagacttgtccaaagtgactctactgtgtagcagagcagagaaaccaagtttgtgacccattttctggcatcctaaaggatatctaagaacctagtgatgacacccccagtccctagctcctacccccatgccaagctgtctcccactcattgcctctggatcatggtgcaacttgccactccaagaagatccacatgcaaataagctcatgaaatggaacgaggtttcctagggccatgtcctactcacatttgaatgaccatagttttagcaagatcatctttttaagaatagtttgcttctttctaacaccgaagtgaaattggtagaaacagagagaatcaggatcagaattaaagagacgagatagctctggaggcctttgaggacagtcactcccatgtgaagtgaaaacaaaccaagggtagcagtggcccctaccactgggggcagagatgctggttgctagaatggcaccaggggtacagaaagtcaccttctgctcctgtgacttgcttatcccatgctgcatgggtgtgaaaggttctgatgctactctttgtatttttggtagagagacaatgaatcagcatttcaagctacaggcaaaataaataatatgtttagacatgtcttaaaggattaatacttcagaatctgagaaagcaaagttagtaaacccaacctgggccagtggtggacacactaagataaatagctcctctgatttttatttatttatttatttatttatttatttatttattttcgagacagagtctcgctctgtcgcccaggctggagtgcagtggcgcgatctctgctcactgcaagctctgcctcccaggttcacgcc

SEQ ID NO: 128466 - DNA, 1087 bp, Homo sapiens
gtgacgcgtgacccttcagtactgcctccagagccagggatggtacgcttctgtcgtttatgccaacagtgtttgtgggactttgtatggcagccagagtggactcacccacaaccagagttccacagggagagaaaaactcaaggtcaggactcagaaatcttgatcaacggacttacttgcaattggcctctaggcaggtgtggtcgctggtggacttagggtcccatggaggaccttggggaggctcagatcccaggaaagcagctggggaaccagggcggctatgaggagaaccccttgactcaggaaagtagtctggtctcaagttctagggccacccttaggatagccagaggaaggctagaaagccctgtgggcctccagcttccagccttccaaaagtgaggaggtggggctgtaagattacgctggctgatggctgtcgcaaaacactaagtttattacataaaagcctcaattccctcctaactatcaccaaaacagatgagttgtggtgtccagctcatcatcattgaagaaagaacacctcctttcttcaatttgttcttttgtgttttcttccctcttcagagctaactttttttttttttttttttttttttttttttgagacagtctcacttggttgcccaggctggagcacagtggcgcgatctcgcccactgcaacctctccctcccgggttcaagtgattctccttcctcagcctcccaagtagctgggataacaggcgcccgccaccatgcctaactaatttttgtatttttaatagagatggggtttcaccatgttggccaggctggtctcaagctcctgacctcaagtgaccatctgcctcgccctcccagagtgctggaattacaggcatgagccactgtgcccagcccagagctacctttgatgcccattttcatcatgttcagcttggtgttggggaaagcacaccaggagattcctgcccagggatggccctaggacaggtcctggagctgcccctcagagtggcccactgcatcacgtgaagcaagaacgcaccctttggttaagcctgttggaattacac

SEQ ID NO: 128467 - DNA, 1044 bp, Homo sapiens
tataatgtggcagagggaaggtgggaggaagggagataaatacccatgtttatctccagcctgcagcagtgaaatgagatagttcaccatgtattccttgaaaaccactgaaaataaatatcaatactaccattatcttttaaaaaaattcagtagtctttcccacttgtcaaaacacttttttaaaatcttcctttaaatttccagagtgtcctcatatctagtttgcattttatcctcaacaccacaagaattaaataagggttggtattatcactgccatttatagataaggaaacggaagccaaagaagttgggtaatttgcctaagatcacacagctatttagagatggaactaaggaaatgacacagatctccaagcatttctgtaaattttttctaagtaaaagatgtttccttcttttcccaccaaccctcaaaattccgtgtgctgtctgtggaattcatgcacagattgctgtggttcggggaaagatcatgcccaggacgtaggggataaagagggaccagacctgcctcatctgtgccctcgctgcatgggcctgggcaagtcggtgatctgtcagtatcccactttcctctccataaaatgataaagctgggaaggaaatggtaaatatcacctgatcacctggattaaactctgacttggaggtttcttggctatactgttagtcagcattctccagagaaaaggaactaataggatgcatgtgtgtgtatatgtgtgtgcacgtagacacacacatacacacaaagaaacaggatagatgagtgcatgtgcgtctacaggcacacatacaaagacatttatttcagggaatttgctcacctcatggtggtgctggcaagtctgaaatctggagggcagcctggcaggagggaaatgcaggcaggtcttccatgttacagtcttgaggcagcactccttccttcccagaagtcctcagtttttgctcttaaggccttctgcaaatcaggggaagcccacccatattctagagagtcaatctccttcacgt

SEQ ID NO: 128468 - DNA, 1026 bp, Homo sapiens
gctagcttccagcttttcttctgcagcttcctcatttttctcagcctccatagaattgaattgaagagaggtagggccttgccctggattaggctttgtcttaagggaatgtggtggctggtttcaccttctatgcagaccactcaaagtttcttcatgtcagcaataaggctgttttgctttcttatcattcatgtgttcactggagtagcacttttaatttccttcaagaactttgcctttgcactcacaacttggctaactgtttagcacaagaggcctagctttcagccgatctcagctttcaacatgccttcctcactcagcataatcatttctaatttttttttttatttaaagtgagagatgtgtgactcttcctttcactttgacactttgaagctattgttggttgattagctggcctaagttcaatatcagtgttgctttttgaaaagagtaaaaaaccatttggagccaaatcaagcaaatgaggtgtgtgatcaaactctaatcacttagatatctgatatcacttagatatctgatatcataaagtaaaactttatgaagtttggggtacctgtggccatttcttaaaataagacaacagtgaggtttgccccactgattgactcttactttcataaaaggttctctgtggcacgtcatgctattttataacattttacccacagtagaacttctttaaaattggagtcaatcctctccagttgacttccttgtgtacgcataattttataattcaaaggcctagttttagttggacaaaaacacattggtcacattcttaatagccgcaccccaagtgagccaggaaaaatgcttgtaggaaaaagctgtaggaatgtgctcttcaccttcctgcaaaagattagggatggttgatatgtgagggaaggtgaaagctggaaagagtgagtgataccgaactttattttttcataggaaatacaatatttccttcactgagctgactggtcatctgttggaccccagcccagc

SEQ ID NO: 128469 - DNA, 1124 bp, Homo sapiens
ggcccagacaggcggatcacgaggtcaggagatctcccatgcaccatttccatcatatttttgttactctgagtggtaacagaacctgtagctgctctgttaacctggaaacgggcttgctttgtacaaaaaaagttacctgctttcagatggggccggtgttcatttaatttttctgatgacacaaacttgatgatgatgaagttccctacagagaaagtcacactagaaagactgataagttttcagacccttgaggttggccagaactctaaagaagaggtagatatggagagacttggtaaaaggaatcatcctgacgtagtgacagatgggatgtggaagatgaaggagagggtggaatcaaagacgaatcatgaaagcgacccctctcgtggcgttgaaaagcttctcagttgttggagaatctttcacattgtgagctgattagattgaaaaacacacatatatggggctgtgacctgaactatatctgacgaagtcagcaattgctttgtgtgtttgtgcacgtgttcatgtttgtgcatgtgttcatgtgtgtgtaaatgggcctggtgtttgtgactcagtaactttttctaagagaaaacacgcatcctcacccttgcaggggaggcaccagctgtcagtggtgaaagagagagaagggtcttcattcccctcgtcttccctctgctgtctccccagccctttacctcccgccttggccccttctcccgttcatcttcctctcctcctgctccagagaaggaagtaattaaacggtctgtcctgtgttggctttttttttttttttttttttttttttttttttactgcatatagccctttttttttaaaaaattatactttaatttttacagtatatgtgcacaacgtgcaggtttgttacatatgtatacatgtgttggctttttaaggatgtgagacttgtaaaaacaaaatactatgagtagaagtatggaacaaaatgacaagcctcatttaccttaaaataagaaatctcttggccaggcttggtggtggctcatgcctgtaatcccagcactttgggaggctgagacaggcagatcacttgagctcgcaaattcaagtccagcctg

SEQ ID NO: 128470 - DNA, 1049 bp, Homo sapiens
ttaaattttgtagatggtataaagtaaagatcaaggatcatttctgctggtatgtggatgtccagtttgttcatgttatgttgaaatggtgattgtctccatggagttgcttttacttgcacttttattgaaaatgaatttgctactgatggatgggtctgtttctggactctattctgttccattgatctatttgactacctttgcaacattattacagtcttgattactgtaacttttaaaaagacttaaaatcaggtcgtttaagtcttcagattttcttcctctttaaaattgttttggctattctagattacttatgtttcaatataaattttagaataagtttgacgatttctgcagaaaatccacttagaatattaagattgcattaactctatacatcaattttgggagaattggcatgttagtaacattaagtgtatttgcgtgtagatctctttatttaggtattttaaatttttaccaatatcacatattttttaaagtttatcactgagattatatttttaagattattcaaaatgtgttatgaatttttaacttactatttccaattgttagtatacagaaatattatttatttttgtaaattgactttttatcctacaaatttgctgaactgttttattgattttgtagtttttccatacatttcttaggattttctacatagctgttcattttatctgcaaatcaagccagttttacttactaatttctgatttttactgcttttatttccttttcctaccttgttacactggctaggactgccagtaaaatgatgactagaagtgtgagagattaaatctctgcctgggttctagatctaaggggaaaagtgttcagtattcatccattcagtatgttacttgtcagtttctcatagatatcatttggcagatatcttttggcaggttatgagagttcctgggttatggaaaatgccataaatttcctcttagcacttccttgcatgcgttctatgaattttgacgtgtgattatttagtgtttgttcatttc

SEQ ID NO: 128471 - DNA, 1109 bp, Homo sapiens
cttggagagaggctgaggcaggagaatggcgtgaacccaggaggcagagcttgcagtaagcggagatagcaccactgcagtatggcccaggtgaaagagtgagactccgtctcaaaaaaaaaaaaaaaaaaaagaatgaagaaggcagatgcaatgtgacagagatttactagatgatgtgctcgataacacccttcaactagaaaaaaaaattagcttctcttagaatgtgctatcggcatatattggcatacagtaattaagtgtaattgagaaaaggtaattctgagagggaataaaagcaccagatgggagatacggcattcactcttacctaagtcctacctaccttcaagacctggatgaaacatcacttcctccaaggagtcgttgacagacttaggccacagtgatcattgctgcttccaaacatctatggcatttgttgaccaagctatttatgttatactataaggaagcgttgacaaaaacgtggcagttttggtatctgggcaacattccgcaggggctaggattgtgtcatttattgtagtaaatccaatgtctcattcatttcctgtcacccagtaggccctcaggtttgttgccatggatgagttaacagatggcactgactcttggtggcactggagactgcagccatcagatgatgtttcaagagacactccactgtgatgacacatcctgaagacagggaaactaatgtcctttgagaagtacaaatgtctatttttatttcacgtagtattggcttgaaaagatacaaattcacttaggatgaaataaaagtgttctgtatttgaactttatttcaaattattatttcttggaggtttttattaggcaaccagttcctcctgtcttagaaagatgtagggacggagaagttctaaaaattctgggcctatccttcaaggttcaatctcatagtttcttcctcaggaaaacctcctctggccatcctagcagatagacatggcacttccatgtctgtccaattcccccaaaacatgacctaaggctcatctggaataagcaatcttcttctgtgtaaatattttataactatagcctattataaactattt

SEQ ID NO: 128472 - DNA, 1074 bp, Homo sapiens
ctaagtgcctgatatatggttgctgatgcagagaggttctggtgacagcccacactgagggatgcttatggagggcccaagtaggcgagagaatgcaccctgcgtatgtatgtggaagccaaggatccagctggcaagttggcaccagccaggctgagtacagaggttccagtctctacatcagaagagccgagtttcctgacctagagaagttattttggctttcaagttttcatctttaataagaagggtttggaataaaagaaggaatactgacaatagctgacgtttcctggatacttatgggtgccagctgctcttcttcgcgtattcatctgtgcaatccaaacagcactctatggctagaggccactgcgacctctcttttctaggcataaacctgagtccctggcccagggtcacagctggcaggctgggcactgacggactccaggctttaagtcacattgctacactgtactcagggtatctgccgcccgggcccagacccagagatccaccctaagggcgaggataaggagacagaggacaggcagatgacaaggtgggggcagttctcatgaagggtttccttcttggacactgatttcttcccaggatgcctgaggatgctgaccagctccttccatccctgtcctcctcacctctttccacatcccctgcagatcagcccagcagtgaggcacagcctagggtcggatgtcccatagatcatcatggaagctcagaagcaatccgttcttcattttagaggctcctctccgtcaagattctggaaacacaggagaacactgtgacctttctcagaggatgttttcctaacatgcctgggaggaagacttgaatggtggtgtgaaaatgtcttttcatgccctaatcaatagcccatcaattatgtatgtacttatgtatgtaaaccctgttaccatcctgtggagaggataggacttggtgatgtccaactattgagctctttcttcaaagtcttaaaggaagttcagtacataaaaccatggcagcgggttggctctggcagagtggagtcagtcagac

SEQ ID NO: 128473 - DNA, 1057 bp, Homo sapiens
gggttcatggagccataggggtgaggagggtgacatttactgagtaatcacttcgtgtcaggaactgtgccaagaacctcgtaaactccagattaattgagatagacattttggtggggagatatctatgcattgttttattgttagatcaggcataatatatccaaagtgtaaagtctttggaaactctcgatgaaggaaagggattcagtttccaaggtgtgggctagaatgcagaaaataaaaatgtgtaagtgaaggttttctgtggctttggtaatggctgtgtttttgatatatagtaaacaatgataaatcgttgttcttttaactctgaattttttttaaaagaatgtcactgtgcacggtttgaagctgcaaagattgccttcgagagggaggagtcatttctccacgtccctataacattatgtggaatgttgtctgtcagctttggactgtagtttatatgtcagtgactgtagtttatatggagtattttgtttaacttttcatttgttcccaatgttacaattttgctttctcatagatatgcatatggaaccaatgcactaataaggttcatttctcctaatatatgctgtctgtacatttgtcgcctataatagttgttaatggttttaaagagggtcatgatagtccgttatgtcaaaagatgccattgccttctgtctttttctgtgcattcctggttttgaaaatgagggtacaatcagacctgaaaaaaaaaagcatatgactttgtttcatgacctacaaaaagtaatggtaagcaagatgcaaattcttattctccaagggtatatacactgtcaaacaattgaaagaagccaagactatctgaaaaggcctatttttcagatttcatcttggagacctttcatcatagttcctaccccaagaaaataactaatttgctctagccttatggaatagcctggaatggctgcctgggccatctgagaagttggctggtcctatccagggcttccccagttggcctggctttgctcaggggccgggggctgaactttag

SEQ ID NO: 128474 - DNA, 1039 bp, Homo sapiens
ttctgtcaagaaaggatggttgctggtgggggctggggggctgtgggggctgggggtgctggagcagggaggtgtgacccaccccagggaataggaggagagaagtgggtagggttttcttggactctcacttcaccttccggttggacgagctgcaagcatgagcttctaagctttgcatcccagagtgttggcggctatggagatcctgcgggcctcactgccgccattccccatggccactcagccagcactacctaggcactgagctccgtgagggacttttttcctgctcaccttatctcaatggggtcaggcgggctgaagcttctggagtcttggtgaggctgttgctggattgaatatgagcagctgcagggctggaggaacccaaatctcagtggagcctgttcattgaagaccttactgataggttagtgccaaggggtgctgacaggtacagttatggggaactggcacatacgaggtagcagcatctgccctgaccttggccctataatcatccgtggcattgttgagaacagataaacagtaaccaacagtgggctcacatcacagatgttttcccttggtgcttggtgggccccaagatgttggggttcaaggtttttattatgtctagggagggccagaatcagtcctatctgctcgcattgagatggcctttgttcaagcaagaggtgaaattaagtgtccagaggcagaaatagatttcactctgggttctgttatccatggttctttgtagattctttctgaatgtccacaggtgtgctcaactgctaaattcagctgcctttgaaatcacaaaaagggctcaacaagtggaggtctcttccaccagcaaagcaaaggattgtgtaattcgatcactagggtaggctctgaggctgcgtggcccgagttgaaagctgagctctgcacggacagctggtgggtctctgcctaagttattttacctatctgtgctctgcttcctctcctcaccagaaaaccgaggctatggttgtatttgcat

SEQ ID NO: 128475 - DNA, 1050 bp, Homo sapiens
ttgttttagttctcccaacaacctgtaagagaaaattggacagatattcctgtccccattttagatgaggccgcaagtacttagagtgaaaatttgtttgaggtcacataattagttaacatattattccagataatcacagatttcttttttagacaacgctccctacatctcaatagcttaaccaaagaatgtgtcagagggccatctttttgcatctctgggttctgcagggcctgctgcaggaattggtgtccacagggggttctggagccaattctccacagatagtgaggtagttctcctgtggtcacacacctcgggatccttcacagccaggtgtgtgggcagacgagagagtgtggtcatgctacagatagcctggcattgacgttcatcactttagcccgtattccgttggcctgaactgaggcataccatgccgtgaggctcagcgagatgcaacggagtgtgggcagtgtcctcccggatgttcagaagaaaaggaccctgctgaacacatgcagtagtttccaccactattaatgaccgtaaggcaatgaatctaaatagtgaaaatctttgcatgaaacctatgcttttactgacattgtattgttgcaacaatccagggatgtagttatgtatctccctattgtttaaggatgataaaacagattcagagaatttaagtgacttgcaaaagtccacacccctgagaaacaagagagccagagaacccgtgggcagctctcagctctggcgccagggctgtgtggttgggacatacccattgaccttggaggcagaacaaagctggtatcaaaactcagatttcttgactgccatttcagtgtactttttccactacaagatatttcttactgttttgagcatgctgtattaccacagggactagcgacataggtttaagcaagtcttcagtgactgaaggagaaaaacatgtagtaaatattgcttaaatcttttctcattaccacatagaaacacatttctatgtagaagtagaagacatttctacttacctat

SEQ ID NO: 128476 - DNA, 1100 bp, Homo sapiens
tttttttttgtatttttagtagagacggggtttcaccgtgttagccaggatggtctcgatctcctgacctcgtgatccgcccgcctcggcctcccaaagtgctgggattacaggcgtgagccaccgcgcccggccaggaatattatttctaactcacaagagttcttctgcatgttagccaccccccagagaaaatagtctccattgttgttctctcttcagcatatcccaggtatgtttccaagcaagttttgctccactataagttgatgaggacctttttttttggaagctgatggcctggcaagagttagtcttaataggttgtgtttcttctcactttagctggctctccctaatgataatgtctgttcaagttgagcccagtttcagccagtttctctgggagtcaaaagcctgtagcacacccagagagccaccacctgtccacagcatatggtctgaaggcatctctgctgctctagcctgaccagccagcccaggatttccaactgtgagctcaccctccttgtaaggcaaacagggtttagccagcgctcaccttgacctggtgacctttgaagattgaggttgcaggagaatgcaattgagaatgcagcgggtttccagaccccatgtgagccatccctgatgcttcaccctggctccatgggaaggaacccagagccctgcctggctggtctcctgctaatgagatggaaagcaggggtcctggccacaccatgaaactcatgatgttctccactcttgtgtccctgccatggctcacattcagtaattagataccagctcattaattcctgctattctttcagaagggaaaggatggtgccctttgttctgctctgctgggccctgagccctcacagcatgaagtagctagattctgcctcactccagaggcggctgccactttctcaccccacagtcagcccctcaaccatgaaaagatgtaaggatgtagctaaattacataacccaagcatgaaagcacctgacgtgtatgaaaccatgttctcagacacttgtaggcagtgacaactttataattaggcatttcatccaacttatgtatctta

SEQ ID NO: 128477 - DNA, 1088 bp, Homo sapiens
taatgcatggggctgggctcatgcctgtaatcccagcactttgggaggctgaggcaggtggatcacttgaggtcaggagttcgagaccaacctgcccaacatggtgaaaccccagctctactaaaaatacaaaaattaaccatgtgtggtggcacacgcgtgtagtcccagctacttgggaggctgaggcacgagaatcgcttattgcttgaacctgggagacggaggttgtagtgagccgagattttgccactgcactcgagcctgggtgacagagtgagactctgtgtcaaaaaaaaagaagaaagaaaaaagaaaaaaaaatcatgggctagctactctgcttgtattttttgtttctgtccatcctcttacttgatacccctccacgttctaaaaacaaagcctcccttcacattttgagtgtgtctgctatggataatgaggcagcaatcctggttctaaagaattgtgataaagcagtcactaaggatcccattaaaggtcaaaccatctaattcttaatctcacggcacctgcttgataatgatggatacttattaaactcattccttctgggtctcagaataccctttagaatgatccaatttttcattcaggcacttgaagttcattaaatgaatgctggagaaactgttttctcattgacgtacttgctttaatgaaatgagaaagtaagaagtgcctgaatattggtggtggttctcaaacccaaggaaatctaggggtttgtggagatccagaatctcctctctcctcaccacttttatggcctttatctaattttacttttcagccacgtttgatgtagctgacttccatctcgaaacactctcttctgattttccctttgattgcactatccactcctttttccatgtcctcgaccggttctgtcttcccgcgtgacctctcagcattgaagtcttatctgcctgccctcttctggatgcattgtattcctggatgagcttctcaatgccctagtctcatatactggccatatgatgaggattcctggttttacatgtcaagccttgtctccgtaagtgaactgcaaactcagt

SEQ ID NO: 128478 - DNA, 1069 bp, Homo sapiens
gtgtattatttttcttgtcacccacaaatcatgttgcaaagattgatagtaattgaataaattgccatgtgtacttaaagactgggcttgttggagacacaacacatttattagatgatcagttttttttttcctgttatgtcaatgctcactggaacacttcttttcaaatgtaggaaaaccaagctaactagatctagaaaaacaagcagaggtttcaagggatgcctttgaaaggtggtgtggtatcagggagcacgttgaattggaagtcagatgtccatgtgtggattcctttcatggcactccctgattgagacaatctgtaaaatccctttaacgtgcgtatgttatgattgcataatgtaattcttgtttagggtttattgtgtgactctttgctaagtaactgtactgtcataaatggagtccgagcagcggggcttgtctccccgtgagtgtgagatctgcatgctgccacctttctcctcctacttttctcgccaggtaccacagtctgtgtaagatgcaccaggctgatattttgtaaaatcaaggtcttcaccttccatttatgtggcacgagctggaatttgccagggtcaaatagtcaaccaggagttctttatggattcagccacatgggagaacttgagggaccttgcatgtcttatattctccaaaactccatccccacaggcttgccagtgtccaaaaggcctgatttttgggggaggaggcagctctaaaatagtgtcaattctagaactccttttttaaatgtcccaggaggagtaactattggcatcatcagtatttaaaactttgggctaattacatcacctgattatttccctcctttgtgctttctagagggatataaaccaatgagagtcttgagaggtggagtcagttcagctcagaagacactatcttgagggaaaaggccatgatgagtgggtttgtatgttgaattggaaagaggagaagggagatgaagagaaatagggtagggggagtactgagaggaaggatctgaagggtgatagagagaatgctgcctttggtt

SEQ ID NO: 128479 - DNA, 1042 bp, Homo sapiens
ttttcataatgtaggttgtaacacgatagaaggttagggaattaattgagtgggccatgatcagcttaagaaaataaaatgcaatagaaatatacctagtgcataataactagtagaatgaactaatatgaaactttgtccattatctatgtatgtagtatgtgtttactgtattgctatataaaatatatttctcatagtagattgcagtcacaaaagtttgaaagcctttgaaccccctttgaccatggaaaggaagagggattctgtacaggaaatggttaactcagcaggcctgggttgctcaaaccgtgcacattctcagaaagacctgctttgggactggcccttggatggtcctgggaaattagccaccaacctttggaatagtgtgcccaataagaatttttttggatgccttaggcttcagcccacatgaaaccagtttgatgactttatcctaacaatgtaatttatgtatggtgaatgcctgcttttgctttggggtggtgtgaggatctgaggtcaggtacgcaggtgccacatgcctgcatgactaacccccagtaagaaccctggacgccaagccatgggtgagcgtccgtggttggtaacatggtttctgggaaaattaatagagcccgtgagactccactagcaaagaacacctggaagctttcacctggtttctcctggactctgccccatgtaccttttattttattctgatttgaactcatatccttttgctgtaatatatcagaacagtacatctaattcagaaaagtaagcttttctgagtcctgtgaatcctagtgaatcatcaagctttagagtagtctcagggaacctggcgcagatgcagagattagacttgagacctagagaagttaagggctttctagaacatgtagctcaagcctgggcctggagtgtgatgaggtcatggacattaagctggaatgaaggtctgtaccaactcagtccttttctggtgaggcagcatggaaagacattggccttttctccatctgtgatgaca

SEQ ID NO: 128480 - DNA, 2216 bp, Homo sapiens
cattgacacacatttgcctccagattttctagttgaagaaatgtgcaaaaatcaataaaaagcccaaatacagtggtatttttccccagagttatggacaataacaaataatcaggtgggaaggcttgatgattttctttttagattgtgagctacaggcggccatatgtgttttaaaggttaggtacataaaagaagttttgaggtttcccctctgtaacaactgattggccctctcgggaactctgtgcttaaataaagctgataggattggcctctcttagcatgcttatgccatagatgagcgtctgatgcttagcgacctatcctggtgcaagagccaggcagtggaagaaccaggtgtgcagtgtgtccaacaggaatgcttttggctgtgaaacaattcctggctgaaagggcctaagcccgggggattttatctgggtgggaagaggattctggttttagttcagtacctgcatgctatcagggctcaaggtgtgcatccttgcaaacactggccccttcttctcatgtttgttttttttgttgtttgtttgtttgagacagagtctgtctctgtggccaggctggagtgcagtgagtggtgaaatcctggctcactgcaacctctgactccctggttcaagtgattctcctgcctcagcctcgcgagtagctaggattacagtcatacgccaccaggtccagctaatttttgtatttttagtagagccggggtttcaccatgttggccaggatggtctcgatttcccgacctcgtgatccgcccacctcggcctcccaaagtgctgagattacaggcgtgagccacggcgcctggcctcttctcatggtttcaaaaaggctacagcagctttgagcatcaaatcctcacacaactatgttcaaagacagaaaacaggaggaagtgatgttggcaggccaggggaggggtccctcctctgaccactctctcttaccagagagaaaaataatctttgccacagcctcccagaaaactttttatttctgcttcatcaagcggacacccttaacttgtggatattctatattggcaggtaaataagtgagaagggatatgggtgcagcacgggggcaaccaatgaaaggttggccatacaagcaggtgttccaataagacagaagaatacatgaaccatgctcacaggaaaatttatatagtttcctcttggaaaacaacaacaaaaaccttctggtcttatccaaagcattaattggatgaaaaatgtcaagcttttctcagtgttcggtgcagtacaaacgtaggattatttctaagtggaggagcaatagaagatagcactgtagaactcttccgtcatgccaagagaagttagatatgaccaatacgatgaagggaaatgataaggtgacattatccctgagctaaaagtcaccgaatctgtgacaaggtatgggctagtcaacttgtggagctctccagcccccttctcaatgaagattttaaggcaaactagaattgcattacatttagtgattatttttcctcaaagaccaacgacttcaatgggagatagaagagtctgtggatcacttgcttttattctcttcctatagctgtgaaaattgattcaagaaattgccaacattccactttaatcagggtagaaaccaagagttgggtgtagtttatccattgagatgctctatgcattggcaatgccatcatttaaaaacatcatggagactgtttttagtcatatggacaaatccaagcaggctgccttcccaggaaatcaggagcaacctatgaagttctaggcttgaagttttttgattggtggacttaataaaatgtagatataatcagtagattaaaagtgagtactggctgggcacggtggctcacgtctgtaatcccagcactttgggaggccaaggtgggcgaatcatctgaggtcaggggtttgagaccaacctgaccaacatcgtgaaaccccgtctctaccccagctaaaaatacaaaattagccagctctggtggcgcatgcctgtaattctagctacttgggagtctgaggcaggagaatcacttgaaccgggcaggtggagtttgcagtgagctgagatcatgccattgcactccagcctgggtaaaaagaatgaaactccatctcaaaaaaaaaaaaaaaaaaaaaaaaaaaaaaaaa

SEQ ID NO: 128481 - DNA, 1055 bp, Homo sapiens
gcgtcctctgccgccccgcgacctttcctgccctcctccggagagaggcgaagggaaggggcggtttcggagggagctgggctgtggagggagggcggcctcttcaccagcgtcgtccgaccaccccgcgccctcctggtggctctcccacgccccattcgcaccccaggtcctcggggtgtctctggtgttgcttcaagttaggcaagaggagctgggggcgcggggagcccggcgccgcagcgcgtgcgtggctggggcgccccggggccggctgcaccttcagtcgccccctggccggcctgcctgcctcgacctccgcatccccttgcaccgtccgctcgcgtgctgcggggcactcgcagcactaccttcggtggggccgcagcaccctgagctcccgggactcccccaccgcccccgcacccacgacccgcgtggtcccagcccctccaccctcttcacgcaccctcgcacccttttgtgcgaccccgtgccctctccgggctgccaacccctgccacccaggtgccagtcccgggcgcggggaggaggccggtggggaagggggcggaggggccggggtggaggaggagctgcgcgaggggcctgggggcggggagcgaggagagcgctcggaatgtgtgccggtctctaggtggtgccaaattctggggcctaggcatttccctcgctttatgtttttggttttttttcttccttcaatctctttgattaggccgtacgtggctgtggcaaggagttggggaaaaaaattataaaaacaggaaagagagaaagcacagccagagccccggcttcgcgagccgccggggagggggcggaggaggctgagccaggcagagtcgccagcggagactcgcgagtggcgcgcgggaggagcggccgccggcgctgggcttgccttgctgctgctgctgctgctgcctccccaccgcctttttttttttttaatctggagcggggtggggagtgggaaccggagagaaagcaaaatattaaaaagccccaaagacagccagcaggagcgcggt

SEQ ID NO: 128482 - DNA, 1043 bp, Homo sapiens
tataatccttaggactttgtacctgttgtccttctgtctggaaattgagaaatatagttcttggcttctgtgcatgtgtgtacacctacatgcctgagcatgactgagaatgggcaattacccagccacaacccaaataaaatttatggtagtctaacaaggctaacacagagaaataaaatgcggagatagaatggctagaattaataatgcatggtctaaatgcacaaactacacaggcaacaaagggacttcccaactgtgtggctccacaggaaagcctgttttgggtgggtcagtactaacatgcaaagtctgacttcaaaatagaaataaaaccagagggtcttctctatccacttccttgtaaatcttagatttatttaaatataaagtcaattacttgggcaactcctctgaggaatcaatagcccttctgatttaaaattcattgtgtaggtttaaaaataagttgactcttaaaggaattgttgctggaagtgacttttagtggaatgtattaactttcatttggattaactgtggctaattttaaaatactgaactttgtcatccgcctgcttgaacatttctttttagttttttaaagggctttggaggccttctgtaccattagagcagtagtttttttaaggttatacagtgtgttcctgtatccttcattttcagtgacacgtggcttcttagcaatacaaatgtgatgacaacaggattttaaagcagcaaattggttaaaactgggatagatgggcaaatcaccacccatgatgtccaccagccttggaagggccaatttcatcatccgctatgtcttcggcaaccaacccatttttttcctccaccttggtttttcattggtataatgtcaacattctgttaatgtgtccttgggatctatcaactttacgatttcttaactagcttccctctacaaatatgtttttatactctattacttttcttctgtttcaactgtaatttaaaattttttaagtttcacatgattttcctgataaatgaga

SEQ ID NO: 128483 - DNA, 1102 bp, Homo sapiens
ccaatccaatagccacttgccccatatggctgttgagtgcttggaatgaggcctgtgagattgaggaactcaattttaaattttatttaaccttcatctattttaaatttaaatagccagccacatggggctagtggctaccatattgggcagcacagggctggaggcacatggtaagaaatttatatccaataactaataggaagacacattgattagtttttttaaacctatatattaatcgtttcacaagtactagggcttcaatacatggtactgcataaataaagcagtccttgccttcaagtcaaacacatcaccttatcttattgttatctgagaaaatgcaaaggagcccatgggagcgagaggagggacacttcattcagcttcaagggtgtcagggagagttttctgggagattcgatgattaggatgattcttgaagagttaatgggagataaccttgagaaggaggagaaagctatctcaggtggaggcaacaaccccatggttatcagagaagcagcagcatcagggagaggtcagagtattcagggaggtatgtgggcctggagactcgtgcatgtggggcaaagccattcagaatgaccctcggagatgggcagggcaccatggggcttttgcatggggctcaggcctcagatgactttttttaaggtcatggggagtcatttgaaaattggaagcagacacgtgagatttctgtttttctgcttccatttcagtattttccaaaaagcagtaatgttgctggaaagaaggagagcagtgtaagagtttttgtttgttttattggttgcagtgagatctggctctgccacccaggctgcagtgtagtggtatgatcatagctcactgcaacctcgaactcctgggctcaagcgatcttcctgcctcagcctgtcaagtgcatgccaccacacccactcaaggtttttttttgttttttttttgtttgtttgtttgtttgtttttttgataaagattgagtcttcctatgttgcccagcctggtctcaaactcctgggctcaagcagtcctcccacctcggtctcccaaagtactgggattacaggca

SEQ ID NO: 128484 - DNA, 1087 bp, Homo sapiens
ccttggtgtctttgtctgtcttttagggggaagggaacccacgttttggactagagtagcacagatgccattcttacctcactgtaggtttctttaaagaatgtttagtcctgacaatgcgatgcagatttctttctctccccactctatcttctcttgcagagctttatccctttttcattgttcagcatgactgggaacctgccagctcgccacaatgaaacataatgtttttgcaaagtgtgtgtcaaatgtcgtgagcttagaagagattcatcgtagagactgctgcttaatgagtgtaaattaactgatcatttgctaaatctgatgtgcccagtggtgtgggtgggagaatgctggataggatgtaggagatgcaggtgagcagacgggtagcagagacacataccgtgtttctgagcgaggactgtagcatggccagaaggctgttctgatgtagagagggattttccgctcacggtaggacccagtaccatgagactgaggactgaaacacaaagttaacacagatctcccgaacagtctgctttagggctggagcctgctgggatcagtcctcttgagaagaactacaatctggttgagattgaacttgccaaagacaatgagactaaacaagagatgcctgctggtaaacatcaggggtgttgtgtggaagctgagggaggaagaaaacacaaaagctgtgcatgatgataaggctagtgggcctagtgttaccagtaccacagatctacagctcctcctagaggcagggcacattcagaataagcaacagggagctgcatgtcatgtagtcaagcaactgtatatttcttcttcattgatttctgggacatacatatgaaatatcttcagcttcatatctgagatggcaggaacatgacaacatattagcttttaggtagacacccgtaggtcttaggatgtggtggaaaattgggtgtcattttttccagataatcactggcatttttataaaacatgaagcccttcctaaagtctgtgcttcccagatagtagtgaggagaaataggcttgtggagaccataagggtttattt

SEQ ID NO: 128485 - DNA, 1094 bp, Homo sapiens
aaaatcctgaaaaaaaaaaaacaattctagtttaggatccctctttgagtgctctgcaacataggcgagagcagtaaaaacacgttccattgaacacagagcctcagacatagacatctgtctgttggaaggaagtcactgactatggctttatgctgaaatacacagatcacgtttatataggattttatcatttgaaaacatccctgctcagagatgatcctgcctcattctgcaacagccttttgcagtttacatggaaggattcagattaggagggagaagttgaagagcctttagactagaggcagcaggaggaggaacagcctcagatgggggagagaggagaagttggcatgtccaccactagcaaagatctgggtgctgcttcaagatagaacccaagggaagtggcagggtcccaaggggaatgttgagtgaggctctcactgggggaggtcccagattcctggcccccagcccctccaaagggttatgagtcccaggatggcccagaagcaacagggctgacacaccttaaggagcaatgcaggctgaagaagttcctgccactggtgactcatcatcagaattcccctttccctgggctgtggctctgcataaactcacaggactgcagaccaggcctggaggagatgaccccagagaggaggaagactgagtgtgctgccagcctattagaactcagcattgcattcaaattctagttgctctaaagaaaattaggaaatgtgatatttcttgcacacctgaatttgtaggctacatgcagaacaaaggacaaaatgagagtccaagaaggaagtgcagtgctttaagggttgagtgaatggagactgaagggtatttaacgggccattggcatcaaattagaaagtatgggtcttagaatttcttttacattagaagactttgggctgaatattgatattctagggataaattcttgataccctaaaattcagccctcatacaaagcagtgattgtgatttcatgaatgttgtccctgagaaacaagtgtctggcatgagctccccatgtctggaccaccaagctgataccaataatggct

SEQ ID NO: 128486 - DNA, 1125 bp, Homo sapiens
acccggttttgcagcatgtgccgtaattgttaatctggttatgccaggttgctatgcataaacaatgtctcacatcaatttagaaaatatgatcattactgtttatgaactgataatatagaaaaaaccatttagaatggatagaaggaaaatatcatttttctaaagaaaagcaaaagaaaacatgtcgttggcagagtaacaacatgaatcatagaatctagaagctcgtaagggtctgagaaaccatgggctccagctcaccaagtaccagaatgtgaagtgatgtgtccaggtgccatgtcccccagaggatgctcaggtctaaggctgaaatggccaatctgttcagaagcacatgggtctcctttcctaataaaggaagtagctaagatccacccttaaggcggcaaagtgtgtactaaggcatcaaaaggacaagtcaggtagtgagtaggtcacttattaccagactcaataccagtagctcctgcagaacaggggatgacttttcctctgaaaacaagagtacaagtgcctggtctctgggtgtgcctatggggaaattctgccctggttctggggctcagtctgattccaaagcacacagtcctaagaatggggctttccacgcctcagcccctgtgtcttcccccttcacctcctacaacactgccccagtccgtgtgggtcaactctcctttttctcaaaagccttcacttctaaaagcaaggttgtttattaagttaagtgacaaagagatactgcaacaataataagctgtgatcaaagactgggttgatgttccacatcacaagcactttcattggaagtttctaggattccaggatgtctgtttctgtgaatcccactcagaagactgtgtcttcattaatcagagagaagacaatgcaaaattttaagctctggtaatagtctatgtaaactgactattgtccatttattttgtctctactgagtttaaagattcagtgataccccatttatgtgtcgatccaatcagacaggtaccagaggtgtctctctctggggtagcaaactcagaggggacaaaaatgacagctctactattggttgtggttgcgaacacatatattgttgca

SEQ ID NO: 128487 - DNA, 1084 bp, Homo sapiens
agctttaagtgaggagcaagacagaatagtgatggtgagccctggagatgcagtcagttcttgctgttcacagtagtcatgctctataaggttgccacaaaggcagaattaactaatactgagctgttgctcctagtggaaatgtaaggttaggttccttcaagcctcgggtcacaacattttcatccacagatccacacataagtttcttaagtgagcatttctgtttaaaaacattgtattacatatatagtcttcattcattaacactgatttcatggccaacggtactataacacatgcctgcatgaagcttttccaacacacatattcttctccataaggcacatcacggtattcttgtgcttgggaaccctacacagcacttcagcacgcacttgggggccattttaaacagcaaaatcaccaacaaaaaatacaaaaatgtggaactaaatagaccatgaagaggacacttgtttatagtatgagctaaagcaagaaggcagagtgccgtcatgttcagacccagctaggaacatgtgtgtcaggcaactcacttttttttccactgtgtacatgactgcaaaagacctggaaagcaccatgagtattgatttgcaagttacacataaattttaggagtaggtcgatctgcaaatattgcatccatgaataataaggatcacctctgttagcattagcacattgcccattgacaaatctactggattcatctgagctagtaaaaacaacaacaacaaaaaaaacaattgtcaatcagaccaaaggtaatctccattcgtacacaaatagaaggaacaattagcttgggaagatctgcctgtttatttaattaaaaataaattttaaaagatggaaggctgggcatggaggctcacgcctgtaatcccagcactttgggaggctgaggtgggcagatcacttcaggtcaggagttcgagaccagcctggccaacatggtgaaaccccatctctactaaaaatacaaaagattagccaggcatggtggctcatgcctgcaatcccagctacttgggaggctgaggcaggagaattgctt

SEQ ID NO: 128488 - DNA, 1031 bp, Homo sapiens
aagctgaagagcctccttgaggacactgtgtgacagaattccatgccaactcttcagagacttacacgaagatgagtttggatttgtatttagtggggtcatttcccaaagcccatttatcgataaaagggggccattttattagtaccatcattatcatcatctaaagaacttaaatgaagttttatgtcatctgggaagaagattctgtaaatacggacattaaaaatttttatattcagtgtgacagtgtgcataaggattgatgctcagtatagcttgacaggttcaaaacagacaaaccaaaccctcctcctttcaaaaattccacagaatatttgctcaataaagaaatatttccacactaaattagcattctgtaattaactgggtttctttttattacagttctcctccctcattagttatgaagtaagtgtgcgatgggctttcaggcttgaactaggactcaggtagcatccctgaccatgggagagaagtaataattacgaaagagtgcattgctgttcataggtctacacccgatacacccaaggattgggagtcagaagcccaatctgtgttatgtaaaagaaatcccttgtttcctgtacaaatttgctcttattttgcctgatacctgagcatgccaggagagtgggaatagttaattagggtgtgggttttggaggacctatgagctcttggtttgattttatacctttttgtcattggaaatcccatgtccttgaacctattcaatcggagaaggcttaaactgatataaaactgaagagcagaggcagccatggctacagcgagcaggtgggacacccagaagaagcagctgtcctcatcccatgcagttgtgaagccgctttttctccctcctcagagaggtgtcacctcaaccctaaaaaatgaacagcccccacccccaccatgaagtataatgaagaggggaacagcagagataagataagccagatgggacagggggtgaagaccccacatttcaagtgtatatacct

SEQ ID NO: 128489 - DNA, 1099 bp, Homo sapiens
cctaatatcccatccacttattagacagatattggatccaaggaagatttttattttgataaacagtaatgggagagccaaggtagggggaaaggagagctggatgggaacagctcaaggtcaggagagagcagaacagtccacagccagggtgcctggacccaaggtgcagccagcggtctgctggagaaaggtggaatgtggctgcaggggcacacagagatggtttgggaaaacagaaacaggaactgtgatatgaaagtgttttgaaagcatacaatggaaaacagcaatgggcttgtaaagttctagaagggagggaggaagtctgaacgtggcacgagaggctcttgcttaagagaacaggtgtttgtggaataggtaaaaccagaggagtgacttggacatcaaaattttattttctgaatgtgattatttaatctaggcatgttttgataggtgaaaaaagggactagaaacttctggctttcaaagagcaaaaagagtttgttatttcacaaataaattcaagtttacctagaagcaacaagatattttaagatatggtatatatatatatatatatatatatatatacacacacacgcacgcacacacacacacacacacacacccttacatatatatgtagtacttcctggaatagcctgagaaagaaacatttaggaagactcaatataattattaatacaatttctggctctgattttgatgagccagatattttgatgttcattttgatgcagtctgccatgcctggaacaccaggtcatatggtacatatgacttggttaaagaagagattaaccaataagagaactttggcaggtaagaactattttgccattaaaaaccatgaagctgtaacaacgtctcaaaagctcccttggtgcattttattaattctttctgctcattactaggcttgggatgatgaagacctgacccttgacttgccaatagctaacttacgggggagttgggagaattgctgtgctttggcatggatgcccctgacttctgatccgagctcctccacctgctagctgagggatattggacagttctggactgattc

SEQ ID NO: 128490 - DNA, 1968 bp, Homo sapiens
tggacttttgttttagtaacgtaaaccccttttccaaagggcacgtcttttccaagattggcatgtgaaggtggtgaacgtgctggcttagtgcccctgagacgtgtcagcagagccccagggcatgggggagcccagctcacaaaccacacatctaattcagcagtctaatcttgcacaggagtaaaaccaagctcagagaggttgagtaaattaccaaaatcatgcagctggcaagctgcaaattcagaacacaactccctccttttttttttcctccaaatcaagcaatcctgagtgaaacgtgggaaatataatatgccaagaagattaacacgaaaactgttaactggcagctgcaaaggaaataaaggaattagataatatgaatgggttaacaaattctcgcctggaggtcagttaagaaaaggtttgtgtcctccaggtaaatcaaacctactgcggtttttcctcttcacatctcatggacaaacacagccatttcttctttttattgcaccagtgctggatgcatgaggttgttcgtagcaatctgtcatatttgagtaattcgttatttaatgagttgcttttgaaacaaggaaaataatgaggatgttaccgttgtgtatctccccaatttttaaaaggaagcaacaaatagtaaattatgcatgctttggaagtatgcagtagttaattttcaatctcatcttacagctgaataacctcaaaggtagtagttatacaacaggtgtgggaatatgtgagtgtgagggagaggaatcccaggacatcacctgtacacattgggggtttggcccagcagggcttcagatgttgaaacatctggaaattttatttgctcacaagcttaaaatgaaccaaaagtatgttgcttattaacacttttgaggatctgatgaaagccataggactgcttgccagaaaaatccctacaattttttgagttcctaaggttcacattcccttcatttctgtctgtggactccaggttgagcgtctctgtggtcaccatggtccccagcaagctagcacagtcttaagacacatcagtaggaatgtactcagtgctcaaagcttacatagatattgaccagcagccatcacctctggggggctgtgctagggaggcacagcatgtagaagaggctggaatgggccagggagagtggtaagggagcaatgggtaggagatcccagaagtggtaggtaatggaccgtgatccatgtcaggtgattaaaggctaaaggaatatggttctgtcctcaaccacatggtggcctcagcctgggatacatgactgtgtcttcctccataggggtcagtttaactaagaaccccaagtattgaagacctcaagactttaatatggtacttcctgtaccttgacacacatatataagcttctgaaggacacaaaacatgccacgttacttgttgtatctctgacgccaagcacaatggtgacccacttgcttgtgtgctaaatgaatcagtgagtgaatgaattgtgtcctcctctctaaacctcctctactgagttatacacaaagttgagggtctgtggttttactatttattcatcgaatgaaccattgaacaaagtaatcaaattttcagagccctgtagagaaatcaaatctccctctgaattgctaactcaccttgctttccctattgtttaaagtgtcatagccactcttcctttcccaacactccaccctcacctgtcctacccaaaaacatttctctgctacagaagcatgaactattcactccagccaccagccatgcatcaacattcagtcttgctgtgattcatctccataagataagtgaatattctctcatttaccaactgtatagataagaaaaccatcagaaatcaaagaactgttgaaaaatgggcattttacatcaccaaagcccttttttgttgttga

SEQ ID NO: 128491 - DNA, 1086 bp, Homo sapiens
gctttattattttaccttcaacatttagatctatgatgatccagaatatctttttgagtatggtgtgaggtaggggtcatgattcatttatttgtatatgaatattgagttcttacagccccatacagtgaagacaccatgctttcccccacattactgctgtgaaacatttgtgagaaatcaggtgacaggtggatctagttttggactttctatctgttcccctggtttgtttacccctggagagaaatcacaatatgtaagttactatatcttgttaactggtagtttaagtggtttagatatcatctttaagattatctttattattctttgccctttacgttttcattaaaattttagaatcggcttgtcaaattacacacacatactcactcacatagtggttgagattgcattctatgaaagattaaattagtaagaatttacatatttacattataaaattttccaatccatgaatgtgatgtactcctccatttgtttagatcatctttaatttctcttaacctcattttaatgttttctatgtaaggtcttgcttatttttatgaggttcattcctaagtgtttgagggttggtgaggctaatataaatgttttattattttatttccattttctgttttttctatttaatttctattctgttcattttctgtgtgtttatatgagtgaaatggaaatacaattaacactaattttatattgactttgcattttcttagtccttacttaaaacttggcattttattttatacagttttgtaattttatttggatgtttatttttcctgttctcacagtacttagcccaatgttgaccaaataaatacttaagtacttgtggatttgttgattaatgatttatttaaataacttttgtcctagctgggttaccttaaaagttctaacttggtctggcacagtggcccttgcctgtaatcccagcactttgggaggctgaggtgggaggatggcttgaggccaggagtttgaggttgtagtgagctgtgattgtaccactgcactccagcctggacaacatagcaagaccttatcccc

SEQ ID NO: 128492 - DNA, 1097 bp, Homo sapiens
tttttccttgccctggcgctaaaatcagttatttctccaaagagtgaggttccttttacttgtgaatggcattaaaaaaccaagacctatggtaccaggttttgatccctgacctgtggcaccactttcaacataccatggttctgtagcagtgctggctgggaggcttaattcttgcctgttaagcatggccttcagtttggaagcccagtcgctctccaaggtcctgattttgaaaggcttttctttattgtgtgccaggaaagacagaggagaaaatagacaagaacataacatttaagcacaggtacagtcattctctgttcttttcacatttatgatgctaataaaagaaggaagatatattacatgagttaaagaaatttagaaatgttagaatttaagaagtagtgcctgtctctttgcaaatccatttcttgaagaggacaagtgagcctctttaaggagaaaattcaataagatacgtggaaacagagcttacataacttcagattttcctaacatcgtgtcttagggatgacagttcaagagaaaatgtgctaaagctgtgacttgaagggtttatttagatatgtgcatttcctgacaggcgagattagtggattctggaaaaagcaataaaaaggtttacagaattttcttctaattctgctgataaacagatgcaaactggcttaaactctgctgggattaaaatatttccgattcagtatttcatcaggtataaatgtggtttttcatccacatttcatttatgaggcagatgaaacattgagatctttttgattctgtgcatgcatttgatagtacacctccttggataaccaatattatgatatgcaatactttttttctacatttctctaacatgctgatctgtggagataggtggaggaggtagtgcttgttataattaaataatcacacattagttttcactaaggatctttcatcgaaggatgttaagagcaaaatggattctgcattattgctgcagtagatttttaattttactgttaataagcattaaagtcccacagcatgcaatattttgtttcttcccttttaaagaatta

SEQ ID NO: 128493 - DNA, 1041 bp, Homo sapiens
tgtcatagtccattatacaaatgtatcacaatgcctttatccagtcctttgtccatggatatttagttttctatttttaaatgtatttacagttttgctatgtgcattttgctcatgttttctggtgcacatgtggcaaagtttctgtaggttttgctgtgtgtatatttcattactgatggtgctgaacatctttgcatgggtgcattttctattcatgtcacaacttctgtaaaacacttgttcatgtcttttaacctatttttccttcgggttgtttgcccctttcttattgatgcgcatcatttctttatacatttaagattcaattatttgtcaattacattatttccaagatcttctctcattttacagcctgtcttttcactcttattttgatattctttggcaggaagatacattgatttcaatgcaatttattcctttatggtttgcatttttaagtcttcttgaagaaattgtccctaccccaaggacatagtctcgtagattatcttgtaacatttttttactttcatctttgacaattatgtctttagtccccctgaactggatttttgggaagggtgtgacgcatgcttacaattatctttccctaggaataatcaattgtcccagaacaatttattgagaaagtgttcctttccttactgatctttggagcctctgctatttatcaaacttctgtgtatgggtggatttgctttcagactctccactgtgttccactcatcttttgtccactgttgtaacaacaccacacgttcttactacagcttcaccacacagatggggcatttggtacagccagtcacctgggcatgctgctcctaagagtgtcctggctgtccttggccttttgcatatgtgtatatatgtgtcactcatgcacacacacaatttagaataagtttgttcagttcctctaaaaacactattgggagattagtgtgaactgcattaagtctatataccaatggagggagaatttataaacttcagctgttgaaactttcaata

SEQ ID NO: 128494 - DNA, 1769 bp, Homo sapiens
ctgggcaacaagagcgaaactctgtctttaaaaaaaaaaaaaaaaaaaaagaagtaaaatttgcctcagtcccagaatccaatgtcatgtttagccataaataaatagcctgtctagttggaatgaggcttggtgcagaaacgctcttaccattcataccagagcttgctgtattccataccgccatctattagaaaattattgtaggagctactgataggaatgataagaggcctgttaaatttttacagatatgctataagcatttggtttttatacaacatgtactcttgcattttttccagactttttcctaacattcatgtttgtatttgtgaaagcctgttctacactacatttactttcagaagaaattgctttaaaagtcatacaggagacttatgagtattaccttgggggccttttttcatatccatagcttgatgaattttgcccaaagtggacggtttagaattgcagaggtcactacctgctcctgcaggtataagtaggagtcagctatttgtggtggggctttggggatgtcagctcttgggggttgtgtgttgtacatgttaatttaaaggacatttcagctattgctgggcctcagttctggccgcatggtggataccttgcggagctggcacaggtgctgatgtccccgggctgagtgagcctgtgtgtcggggctgagggcctcctgtgatgtgggtatgcagcagagcgactggtttgaatgggtaagaaagaggctgtagcattccttcaagggtgtctctgaaactggatgatgaatgttggaacccttggtttcatgtttttcttttgccttgtgtttgaaagtcgttttcctcaacaagcctacatataagtttaactgatggcgtctaggctgccgtgcatgtcgactcctgcggtgcggggctggctgtctggctggcgaggagctgctgcgcttccttcacatgctcttgttttccagctgctttcctgggggatcagactgtgaagcaggaagacagatataataaatatactgcatctttttaagatgtgcaattttattctgaggaaacataaattatgttttgtattatatgactttaagagcccacattaggttttatgattcatttgccaggtttttaaatgttttcacaaaactgttacgggacttcaactagaaataaaatggtgtaaataaagaccttgctatctctaaattatggatgttaaagatttgaaatgttttgtactttgattatttttatttcttatactctgttttcttttatattgatatcttgcccacattttaaataaatgtacttttgaacttagaattgagtaatcctttattattccacattttttgcataacttataatttgcatcaaaccggatcacattttaagtaatttcaagacaaaatattttccagtcaatttttacctcaagaaataatttctagaagccagccattttttttgtcaccgtaataaactccatcccaggcaggggtggattcagattattttgcaatcactaagcacaggcgcaaccagtgagaaccagtgacgctacggaacttgcatccatcctgcttctttccagaccctgttgcagtacacgtcttgttggatcataggtgtgataaaatggtaggagaccgcctgtttattaaagatgagcagggcagtaactgctaatatctttagatcgtgctgaccagtgctgtcgcagacattcagagctgttttttaacc

SEQ ID NO: 128495 - DNA, 1050 bp, Homo sapiens
ttttatatgctcaagtcttagccagtttttatgctatcatttcaaaaaatgaagatagcaggtaaatgttcttcattaacaccagttttggcctaggaagtcttggctgtttactcttcattgtgaagtgagctgcatcattctcatgtcatttaatttattcatggagatatgttattgatgtttgatggagaattcatgttttaatcttgatttgtgtggaattgaactacagaaatgtaaatgataaattctcttttttatttttctcttgtagttacaggttttgttttacctgtcacactgttttctgtggctgagaattacagtcataaaccttgtctttaggtagatattcctctgtgttactctgtgtcagtgtggctctgtggatgctgaactttttcatttccgacctgtgtttgtgacctttagaagctctacattcttggtggagaggttgcggagtctgcacagaagtgcacacacctcattgccagcaaagtgactcgcaccgtgaagttcctgacggcgatttctgtcgtgaagcacatagtgacgccagagtggctggaagaatgcttcaggtgtcagaagttcattggtaaggagcagcgccagtaactttgcttttaatgccaaataaacttttttttttcttgaattcatctcttttcatcccaacaaatatttaatttttaaactatgtgatagttattcatttaaatttaaaaatttatttcatatccccagtgattcctttgattgatgtctttgcattttaccctaggtgtaaaagttttggtaaattggacaatattagggggaaaacaacctctatatccctctttttattttcttgttagtatattttgtttggaaatctggctgtaaaatgagatttttcaaagtgcagggaagtatttttttctttatttggaaagagagcaggtgtatgtaaatgtcctactcaaatacactttgaatatcagtttatataaggagggaaagacatctatgtcctcttgcccatcttccattgttcagagc

SEQ ID NO: 128496 - DNA, 1054 bp, Homo sapiens
gcagtaacataaacaaggcatctcatgttcattctttttcttcctccccgtgagggctatgtgtgtaaccttttgaccattaatacagttctggtcttgaaagttttaggaatgatattaccaaatgtgttccataatgccaaagaaatagtgaaaaaatatgtatcaactaagaagtagaagaaatagtacttggttttggttttttgcttattttgtgtttaccttattttctctttttttcttagattatttctgtgactggatttgttgatagtgacagagatgacctaaaattaatggcttatttggcaggtgccaaatatacgggttatctatgccgcagcaacacagtcctcatctgtaaagagtaagcaaattttcgaaactgtttttaatcataaatttacacacaatatagtggctatttcaataattgtgccttttttagtatgtcatagttttgtggtagaaatttgtggaaatcaaagtctgttaaagtatgacaatgatatagtaatgttagtagaaatacctagaaaacatttgaattaatgaaattagatgaactaatgaaatttgaatgaacaaaacaggaatagggtagaagtaagactccttagtggttttgtaattctgtgtgagccttgaggtgtatatttcattaccattcagggtcaccctcaactttgctaggatatgcctcccacttctattatgagaaattttttattgccttttgttggaaataaatgtacatttggacagttgacatctctaacatttaataaatatgttttctcctcaaaaaataaaaagaccaactggtttaaagtatgaaaaagccaaagagtggaggataccctgtgtcaacgcccagtggcttggcgacattcttctgggaaactttgaggcactgaggcagattcagtatagtcgctacacggcattcagtctgcaggatccatttgcccctacccagcatttagttttaaatcttttaggtaagtgaaattctacatgctgcaaatcttacttaaataaaatcattagc

SEQ ID NO: 128497 - DNA, 1052 bp, Homo sapiens
aggagaggccatgtgaagaactgagggcacagagttcccaggcaaaaggaagacccaaatggcatgaatttgctgagttctaagaaaagaaagttaatgaaatttgaacttcataaggtgaatgagttctaggaaggatttaaaaggggccttgccatatagggccatagtgaggagtatggtctttcttggaaggaagccactgggcttttgagttggggtgagatgcactctgtgtaaacagtggatctttgaggggcaagagtgaagcagagaggccccttaagaggacatagagttggagtttgagacagaaaaaaatgaatgggaggatccagctttctggcttgagcgagtgaaggaagatgatgctgtttcagagataaggaacactggaaagctgcaggtttgaagaacctaagtttcttttcagatgtgttgggttggaggtatctgatccatgcaggggctgtctgctacgtggtggaaccagagaaaacaaggctgactgaagctgtggaggcggatgtgagaatgtgtagtaggtggggcagagcaagaggagggtctggggccaggctctgaggagccgcaccattgagagccagctgggctgttccatctgatggtgacaccccgtctgccgcttcaccttgttctggacactttcatttcataatgacagctcaaagtcccagaaaaatggctctgtagcatataggaacaacctgaagccggatccagtattctccacatccactttcagtggaaaggcttgatgttgatgaagtggggaaattcagtatggcgtaggtataaggtgatgttgacaatgatcattttattgggtatgataatagcagtggtttacgtagtgtttagaaatgctgtgggacagacaaaatctttgtctcccctcccctccacctaagcagcgagtattagtagtacacggttcttgggatgatgacagcggttggctggcatccagagtaagatagaggcaaacatgccctttagatgttagacagcagacagttaagatggtgggg

SEQ ID NO: 128498 - DNA, 1525 bp, Homo sapiens
tccatgagtgtacgtgatgcattggcggcactctgccacgctgttactttactaactgtcatggaaaaccaagcttctaaatattatcaatcagtaaaaacttaggtagcaattattcatttcataattttccataggattactagctctacttttgtacttaaaatatcattttaaaaagttaattttcagccaagtcttttaagactcctgctacaggtgtgagaccttcctatgatcactgctgtatggttccttttcacttttgcctcatgtcctctgtctaaaagatcaaacgttgcttctgtataaaattgtaataatagttgctcaacatttcaactgcattccttgactgagttttttctaaaatgcgtaattgtaggaaatgtgataaaatttacagctttgttttgtgtgtgtttctgctttcctcgtaggagaaatacgaatgtgctttaaagcgagcaagtattaaaattgtgactcctgactgggttctggattgcgtatcagagaaaaccaaaaaggacgaagcattttatcatcctcgtctgattatttatgaagaggaagaagaggaagaggaagaggaggaggaagtagaaaatgaggaacaagattctcagaatgagggtagtacagatgagaagtcaagccctgccagctctcaagaagggtctccttcaggtgaccagcagttttcacctaaatccaacactgaaaaatctaaaggggaattaatgtttgatgattcttcagattcatcaccggaaaaacaggagagaaatttaaactggaccccggccgaagtcccacagttagctgcagcaaaacgcaggctgcctcagggaaaggagcctgggttgattaacttgtgtgccaatgtcccacccgtcccaggtaacattttgccccctgaggtccggggtaatttaatggctgctggacaaaacctccaaagttctgaaagatcagaaatgatagctacctggagtccagctgtacggacactgaggaatattactaataatgctgacattcagcagatgaaccggccatcaaatgtagcacatgtaagtcactctttccgaaaaaaatgtcagtattggatcttagaattggatttcacagtctatttcaatgtagtttattggttttgctttttcagaccaaataacttacaagcagtatttgtgtgagaacctgtttacttgtgtgtgtgtgtgtgtgtgtgtgtgtgtgtgtatgtgtatatatgtatatttcagggtcattgaaaaagggtaacagcgtattttaagttgaagatttaaagcagctgagtagaaccaggatgtcagtgatggagtactatccgttgaagggtttccactcttacttagtttaaaattagcaatggcagcaaagagaataatgaagtttaccagctgtacctgatttgcttataatgaacttcatggtagtaaataaataacacaaattcatgcatttgttgaggaaggcttgatttcaggttacagtt

SEQ ID NO: 128499 - DNA, 1779 bp, Homo sapiens
gaagcacagagatcatctgccttcttctgacccggtattgatgcaggctgaggcctctgttgtaatgtgctgggtaggttttggggaataggtcaagagtgtaatggagagcctggctaggtcatgatttgaatctagaagactaaaaagtcctttccattctgtatctcaatcaacagtatttcttgactgcctacccatgtgccttgcactgtactaggtgctgtgaaagatctcagagaagtttaggacatcatgtaagactctttaagaaggagtgttagagttcatagtcaagactggacaaggagaaaatcctgtaagctagaatcaaggagtgtcttattgggggtggtgaggcctgaagaaggaaaagggagagtgttcctgattggtttaaaggaaagcttttattcctgggggcacagacttgaaattctagtcctctgctcctggttgctttggagtatagctgggaggacagataagcaagcagatagttgtagagtgtgagaagtatttagatttctgtccagcttgctgtgggagtacagtggtaatgccacctgagctgagtcttagaggaggaggtcggagggtgggcgcagcggggcacaggaaagcagaacgtggtgaggacggcaggtgcacgtgggggcagtgctcatgggcaggaggaggtggttaggagcagccagacaggaagggcctggacactatgggggagcctttggattttagccttgcagcactgaggagacattattagccaacatgataacattggtattttggaaagatggtttttaaaaaagaaaagcacttttccccaattataaaattaatgcttttgaaaatttggaaaatacagaaaagtataaaaatgaaaataaaaatgtccccataatcctatcaccactaagtaactattgttaacattttggtgtggaaagagcattcttaattacgctggtggagattcattaaatgagctggtatggatgttcaaagtcatttaatccaaacgtacatcagtgaagaatctgggtcatggaagttttccaagttgacataagcgagttattggaggcgtcgtattaatgccaggtctcctccattcctccctagctgatgttctttccacagcaatctcctgcaccctgttgaggtctacgcctgtgacacaggccaaatagggtataggactagatttactgcagtcagtaaaataaaataatacttaactgaacagataggcaaatcttggtaataaaggcatatctagattgttttttaatttcatttttaataaagattagataatgactcattggattaatctgtattatcatataattaaatctcaactctccaatgctgcaggatataaatgtttttgtgaaagcctctaataaaaataacctggtccagtcttctgaaatgtgacattgacttactaaattaacaagttataaaataatgatttgaaaagtgttttttagaaagctaacatgttcttgttaatattcatagaatagtgtgtaatacagaataatttctagaaatgtttgtaaaatggatgagagtagatgaacaatgctagattattggcaagctgcatactggcagttaaaaagagattaacatgctattatcaatacttttaaaaaattaacgagacaaagttcaggattcttcaacaactataatcctcaacttacaataaatttatccagaaaaaatttactcggttaaatgattatcttagaattaatgctt

SEQ ID NO: 128500 - DNA, 1277 bp, Homo sapiens
aaagtgctgggattacaggcatgagccaccgcgcccagccactgggatcttctttgagctcttacttgcctatccataagaacaaaagattgtgccactgcgctccagcctgggcgacaaaagcaagactccatctcaaaaacaaacaaacaaacaagggagcctgggagactcactggtagacagtgcactctgagatttgcctttattaatatttccccaagtctttggaagtagaaaatccatgagcttaggttggaagatggaaacagatcttcgataatggggctgaaggtatcattgcagtcttcagagttttttttacagccagggaagtctcaaatgtttataggattcatctgtgtaaccatataggagacttcaaacttggaatagaatttttaagctgatatttttcttgattcacctatctcaatcagtatactttactcctatagggaaagagaagtaatactttaacccattttgaattctacacactccaaattattcaaaaaaagtcattgtttgctctgaatagactatgaattacaggcacatagagatcatgactgccttgtgtcttgttaaattcacagtgtgtgatgtgtagtaagtgctcattaatcattttgaatgaatttttaagatcagctttagaaataggaaggatctttggaatcatatattccaacttttgttttaaaaaaggggaaattgaagctcacagttgtcttgcctaagttcacaaagttagcggagataataaaactagagctcaatcaagctcttatgaaggattcttcctactgtgcagtggaagcagtcacaacgtttcaatctaaaagaaacaagacgttttaattttgcttttaaaataactgctatgccatttgtgtgtatgtgtataggcatgtgtgtgtttatatatttgtatatagttagctagctatcagagatcaaaaggcttccccctgtgagtatactttgcctatttgatttatgatataagtggagagattggatttcaaaatgtgctttacagaaaagcactcagttctttctgtgccacccactactctctattccactctgccctgtactcttctttgtctatcttaagtctgtctctttcttaaatggactgagtggggacggagtgggtgggtaatgtctgttagtgaagtacaggttgcactaatcttatttcattgtaatcttaataactataaaacagagtaaatggtttttctccagaatcatgtcagatttttttt

SEQ ID NO: 128501 - DNA, 1333 bp, Homo sapiens
gcacagctgccaatctttattttattttataaaatgtttaatattcctcttctcacagaaaatatacttatttagagttatgctgaaaaattttagatgtcatctaaaaaatgataaggggggcatttcattgtctgaaatttatttaaggtgtacatgacaaaaatagcttgaagatcattagcttggaatatgacttgcaggagagcaaagactgcgtttctcgttttcattgttacatccccagcgccttgcaccatctctgcataaaatagattctcaataaatatttgatgaatgaattgatgggtgggtagtgagtatatatgtctgtttcagttggctgaagtttctggaagtcagctgccttccagaatgtagtaatgggggcattactacattttgatagtaattttctgaagtagagctatcaggagaatgatttgtataattataaaaattaaacatagaaacaagataatttttcaaaaatataaattacccagaaaggtagtaattaatctgttttataattaatctcagtttttagaatttataaaaatattttcaggcttacaaacattgtatctgcttgacttcactaaaacaaacaaacacctcatgaatttagacttgactgaatttgggattcaagaagggagcgtatgagaggctgactatgccctggatgaggtgtcggcggtggtggggcaggatgggtggcagttcccctgtcctaaatgtgggggtcagcagtaataagtgtgtaaacctggaacttaaatgtttatacataattttaaaaaaatatggtagtgcttcattctgtaattggatttttcatcttgggtattagtaactaatctttgactataatatttctatttgaatattcatacttgtaatctggatgttttaaaataggttgtaacagagacttttaatttctaagaacaacactagtaaaataatatgccacttgtaaattgagaatactttttgatttaatcttttctttttcagccttcttgggtgattctgtccgttcagtgtggaactcttctgccgtatccttttttttgagtgggggaggagggaaagggtaactctgggtttaagactgaaagaaatgatagttaatggagtgaaaagtggattcattcgttaggacagattgttttgtctacatcttatattcctactattttccatcctgtttcaaattttatgtacctgatccttgttattactcatgttaaaagggggctcagctgtgacaagtaactctaggccgggaactggaggcaggagctccggttctcttcagcttttg

SEQ ID NO: 128502 - DNA, 2018 bp, Homo sapiens
ttataggggacttgaaccaaatgttacttaaaacctggaacaagttgaactggaaccatatttactcgactttgaatcaaatctaagtgcttaaaaatgtccttggcaaaccactttcatctgaaacagtatattttctgaaaagttttgagcctggacatctgattctctgactcttatgactgtggattataagttcacatgttgaccatctaatatgaggcaggcatggactaggtgccaggtataatacagaggtgaagaggacatggtacctgccctttagcgcccctcattggtgggggagggagcacacctggacatatcacagtacaaggtgtagcagatttctccactggggtgcaaagtagacaccactgaaatgtcactcagtagatgtcatttcagttgggttttgagataagcagaagttaagaacatgaaggaatattttcatgtggagcgtatgtgctgaggaatgaaggcattcatgcgtttgggatacatcaggatgatcactatatctggaacagagtgatatgagataaatctattaagatactcagtagtgtggagattgaagagaagctattggttttggcatcctcaaagttcgtgaaaaccgagtaaagtgtttttggtagagtgttggtggaaggggctggattgcagggagttgaagagtgaatggaaactgagaacagaaaggttagactcttcaggaagtttgtcctgagaaggaaatagagaaggtgcctgaggaagagagggctggggagggatctgtgttgcatcacaagcgcgtggaaggatgtgggtgactttactgtttacaggtggagggaacatagctatggacagggaaactcatgaagaagggagtaggatcagaaacagactggaggataggaaaaggaggggtgccttttctgaagaccagtcgaatggatgcgtgaagctaaaaatgcttagaggtcaagggaaggaagaaaggtaaagtggcccatggccagtgaccgctgttttttcacttactaaatattgagcctctgctctagttcatatctattagtggtcggtaaagtattctgaaaaggttgtctagcttgtgggtgactttatttttttttgaggttggagcaaaagtttaataagtgaaagaagaaagctctctgctgcagagaggggacctggaagagcgttgccctggtgggtcacttgagctttgtgggcaccatgtcactttgacagttggtgtgcactgtcagcttagacactgcccacctcttctgaagcacttgactgtcgactgttccttaaccctcacttccttggcttctgttgacgctcctctcctgtgatactgcacttccctacctgtccctgaagtatcagttgctgtgtctgctctctagctcccctcccattctgcactgcgaccaccttcacgctcatggctgtggctcccatctatgtaacaatgctgatgactttctgtcagggagatccacatcttttcctagctgcaactggatgcctcttgccagatattaacacgacccccaaagaatggcatgcccaaactaaaacacgtccttgtgtccccacctgccagccttctgatgtgttcctcagtgagtggtactcaccaccatttcagtctggactttgctcttttgcttataccccttccagacaccaaggcttgccgattctctcacatcttcctcctttctgcccatcaggacatcactttagtggatgcctctttcacctgggttattgcacttgtttcttaacaggtctcttgtctttagtcatctagccaaccaaacacagccagcccacccaatcctttcttttcacatggactgtcatctttgtatgaaatctgtgctacttttcctgtgtgaaatccttcagtggccctgcatataccccagaatgaagcacagacttttttgcatagtgtgtaagaaagcccatttacggtctgctctgtattcacctgttcagtg

SEQ ID NO: 128503 - DNA, 1024 bp, Homo sapiens
ctcgctcggccggcgggggtcgtggccgtgcaccggcttggccgcctccgccacccgggcagctgccgtcctgtgcggggctgaggagcgctcccttccagcctgtgtccctgcacgtgggggctggcattcgtcttccttgattttcccacttggacgattaattttacggtaccctggtaacaccatcacattacacatttaattttgtgtagtttgggctcacgccaaaggatattgtgggttttccttagtattcctataataatatatctgtttgatgtcacacagttatcagtccgtggtaggaatgcatcttagttgaatatcctcttcaggttaatcttcaaaatatttccttcttaaaagtttagctgtacagttgtgttgccttgggtgtgacatcagtggcccccaccttggaggatggggatccccagtgatcagagttaggcctggaagggcggagactcatatttcgcagatgaacttggatggtgtagaaggaattgtagaaggctgagtgatcttggccttcttgaggttcgtccttgtaacaactttttggaccctttttgccctgtaactttagggtaaagagacttcaaggccgggtttacccctgtaatcccagcactttgggaggccaaggcgggtggatcacctgaggtcatgagttcgagaccagcctggccaacatggtgaagcctcatctctactaaaaatacaaaaattagccgggcgtggtggcgggcgcctgtggtctcagctactcgggaggctgaggcaggagaattgctggaacctgggaggtggaagttgcagtgagccgagatcgcgccactgcactccagcctgggcaacaacagctagactccgtctcaaaaaaaaaaaaaaagccttctatctttgaatttacagagtaaaacagttgctgaacacggagcgatgaagatgagtgcctgtaacagtgttagctttttccagtattgatgattcccccgcccctcttttttttgtttgt

SEQ ID NO: 128504 - DNA, 1250 bp, Homo sapiens
tggcggccaaggttggggagatgatcaacgtttccgtgtccgggccctccctgctggcggcccacggtgccccggacgctgaccccgcgcccaggggccgcagtgctgcgatgagcggccccgagcccggcagcccctaccccaacacctggcatcatcgcctgttgcagaggagcctcgtgctcttctcggttggggtggtcctagccctggtgctcaacctgctgcagatccagaggaatgtcactctcttccccgaggaggtgatcgccaccatcttttcctccgcctggtgggtccctccctgctgcgggacagcagctggtgagtacccctcctggttcttctggaagtaaaaagggtgtcttttcggttgaaagtacttttcagcctataagaaacatgcatttgaaactggaactatccacagattgaaagtgtgcatctccagtcttgggatttagagaaatgaaggaggggtagagaggacctggcacccccgagggcgggttcgggccacagctctctgaagtttgaggaagcacagtgatggagatgaggcagggagataattggctgttcaagcaggtgctgtgccaagctgactgagggcccttccctcctggcgtccgggtacagccccagctgtcatcccgcgccagccgccccggattggccgcctggggaactggtgagcagcgggactgaaaggccattggtcgcggcagcaaacatgctaccctgctggataactgaaaacaaacccgtcacatgggttcaggaggcggttgccaggggagcaacttctcagcacttccttttgccgggtcgctgagtaaactgtggtctgaagccaaaccgcctacaccctgaactgttagagctctgtagattacgttcttaaggaaaagagtaacccccttacggcgtttagattttcgtacacccaagcagtagcatagatgctgtacaacgtaacactgagtcagtctgaactgtggacacggggactgctgggtgtgtgtactagactttcttggctatcattgaaccgcttttatagaaatgttgagttgatcttggctcagcagatcacttactgctcctgtagtcacacagcatttgtttatttaacgagcttgtcgggtgctttctgcaacctcaactctataagctgttgaaatgttaatccaaaagtgagcaccacaagcccctatccttaagcagcttagagtctggtggggaaaaca

SEQ ID NO: 128505 - DNA, 6565 bp, Homo sapiens
tgatcgttccagaagtggccttgggctggggatcaccatagcttttctagctacgctgatcacgcagtttctcgtgtataatggtgtctatcagtaagtgtgtgttttcaaatattggctttggaaagcttacttaactttcattaaaacatccactaagcttagatattttcatattttatttgttttttatatagaatgatacagatttaggcatgaaattctcaaaaatgctgctatccataacttaatgtaacgcaaaggaaaaccaagtagtagcagttacaaccaaacaaatatgaacattcgtaacattggatggttgatatgcgttctgcatatccccactacagagaatctgtgatgtagaattgagccaggtgaaattgactgctaaggtacagtttcttttctcgctccaggtatacatccccagatttcctctatattcgttcttggctcccttgtatatttttctcaggaggcgtcacggtggggaacataggacgacagttagctatggtaagtgaaatgatcatattatcttctaaaacttgcgtctctttaccttgatagaatgactttacatgatacattcaaatttgcgttcatatattctggttcagacttgagtgacaactactgagaaaagcttatatttaaaaaaataggtaatgatacccaggtaattctttgctaaattataaaaattcataatatttgatctagaaaaggaactagagccctcgcactgcccctttgaattgcagatgtggtcagtgttctgaattcttgaaatttctgtagtaagcagtagagaaagtgactggtgtgtgagtgtcccctcctccttcaccatcggaagcagatctggatgacctcatgcagtgatactttgctccctgagcatcagtccaccagtgtttcttttcacaaaatcagagtggatgcagatgatgctggcctcttagtccacagtcaagcaaatcgagcctgaggctgcagagtctgtctcgggccagggcagggactaatgtgggtgggcaaggggacagcctggttcaggcaggcagcacctttctgtggggcaggtggccctgggcatggagaagtggtgatgagagcaccgctgcacgtggccgggtcaccatgtagacggactgtcctgcctgaacattgcatctgttctcagctgcaggagaaagcagtgctaccccgcagagcttctctcacagcccccctgagggagacggaaaggtagtgaactccaggatggctttagcagttctcattagttaaaaattgacatcttagcacttcaatttaaaaacatagaggtggacttttaaatgttattttgagttgactttggcaggctgaaagaaagtaaattaaaaaaaacaacaaaaacctagagctgttgctctcggagataagctctgggaaaacttatcttagtacctcatgctatttttaaaacagtacatttatttttgccagctgatacccttctgtgaggagttgaatttgaagaccacttggctgtttcacaaaaccagaagtaattacaggtagaatttgcagtcttccactggttactgactctctgctgccaaatttctcatgatggagaagaaaggactttgcttgccttttttttttttttttttttttgagacagagctctggagtgcagtggtgccatcatagctcactgtaaccttgagctcccggactcaagcaatcctcccgcttcagcgtcccgagtagctgggattacaggcacatgccaccatacccggctaacttttttgctttttgtggagatgttatctccctgccttgtccaggccgggctcgaactcgtgggctcaagccatcctcccaccttggcctcccaaagcactgggattataggcgtgagcctggccttgctttttttaatattaaaaatctggtcggatggtcccacatggaaatagtatgttgttttcatgcattcgccatcatccccgttaatagtcttcaaaggagagctggcaactccatcattgctttcttgctttgagatttttgtttcggtactctttgggagagaattcctaagaaggtttttagaataaaattgtcctcaaccagattgactaattacacattataactacaacttgaataacatttaaagagttggttatttctgtttgataggttggtgctgttatatgtcaaggctttttaaatcggttttaagaaataagcattattttggtggaggtagaaatttcacaacattcataagttctaaacatctagaaatggttggaggaaacattttcgttttgaagatagtttcattaagtaatccctgctgtgctcctttgcttacagaaaaaaatgttaaagataactcaaaataggatagttggtgtaattataattctccttacttcagctttctcttcatcctttttattctttaagcttgggggaaaatgtttggatgttctcgtatcttaaaactggaggagagaggctgggcgcggtggctcacgcctttaatcccagcactttgggaggctgaggcgggcggatcacgaggtcaggagatcgagaccatcctggctaacacagtgaaaccccgtctgtactaaaaatacaaaaaaaaaaaaaaaatagccaggcgtggtggtgggcacctgtagtcccagctgcttgggatgctgaggcaggagaatggcgtgaacccgggaggcagagcttgcaatgagccgagattgtgccactgcattccagcctgggtgacagagcaagactctgtctcaaaaaaaaaaaaaaaaactggagaagagagatcaccaccttaatccccttccctgctgggctatcacatgaaactgacctctgaggttctaagcctaacccgcctaccactgtttttattcataaatacttaaatccttacctctggatcccaactgttactctttttttcacttcaaaatttgcaaactcatttctatccatcaaaccccggaaatggcccaggggcttcacagtgcagtcccctccctcctgctgcatccgttcctcaggctgtgccccaggttgcattcgtggtgcgtgttttctcccagggcagccttccccacattccactcttgtcatactgttgactcacaaaatggaagtggctgaatgttccagggatagtgtctaagagctattggtttaaggttgaaacctacaccaagtaaggctttgtgaagggagatgacgagagtgaagttgttgacagtctgaaggtgaagagattccgaggctcagttcagcaccgggaccagacccgcccagatccagggtaatttgaggtctgtgtttggtgctgatggttttgcccagtgcactccacaccctctccttcttagctgtctcagttctcttcagatgcctttgttctaacttatgcttccctcccttaagaagaaacatagttacttgcaagaataaccatgctcaaaagttacaagttggctttgcttcaagttatatggtctcctagctttttctatgtggtatttccccccacacatgccgttgtcctttgtgtccgaaaatacagcagaaacatttgttatcagcctgttacggtttttttgtttgctttttgtttgtttttatttttactttttttgagacggagtcttgctttgtcacccagactaaagtgcagtggcacaatcttggctcactgcatttgaaccgtctcccaggttcaaatgattatcctgcctcagcctcccaagtagctgggatcacaggcgcccaccaccgcacctggctaatttttctgtttttagtagagacggggtttcgccacgttggccaggctggtctcgaactcctgacctcaggtgatccacctgcctctgcctcccaaagtgctgggattacaggcatgagccaccgcgcccggcccagcctgtatgtttaaaagaaaatgagtctgtaaccatcatttatagaacttgtagttgttgctgtttgtagcttcaagtcctttctcaagagtaagctgcaaactgccaacagcaatcaagcctgtcctgctgccactgcccggccccactgggccacctggaggcagagtcccgcccacctcagtgtcagcttgggatttgatttgccgttcctgtttttgattgacccaattcagctgctaatgataataatactattattgttattgagggtttacatttgttgggctcttactgctgcacaggaggcattgtgctgagcgtttccattgttagccagtttagtcctcataacacaagtctttgaagtagaaactattattagcccatttttaaaaggggaaattgcagcttaggaagattaaacaacttggccaagtgggtggcagaggtcgacgtggcaccgtgcttctcattagcataccacactgccctttcaacacatagctcgcacctgccttcaccctggaagcaggtttacagcagcctgtgttggtgtctgggttgccatttacaatgtgccaccattaggcaacactgctggaagtccctgtgccacgtgtcaggtccgcccgggctggctgtcgttcgtctctggcgtctttgccaggcctcactgtggcctctgtcgaccagggattctaaaagtccacttcccatttatttatcagcacattagtgaacagggagtcaaatgtgatgaccagttttctttccaggttgctgccaagagtttgctcttttgttttctcaccgcagtttgtatagaaccctcccagtgttcatatctaaaaattggcagtgctttcacatgatcaattcctaaaagcatgtatgtttcctagaaggtcttattgtgtgtgtccccagggtagtaactggcatacctgggtgactcaacccagactcatgactttcttacctgtctgttcagatgagaggctcttgctgttttctggatgagtaatctccgtcattgctgaaggtgaggagctcagctccttcctcttaaagtgagtggagggcaattaagtaacgtgggaagtcacgattctgagggaaaaaaattctgtatggaggtttctcttttgccctttagcagaagctccgtggcctcaggaaggtcatttaatctctctggctttgcttcttcatcagtgaaatactgttctccattaagaatttaccctgaggtgcctggtcatagtagtaactgtagtgtctacctctcagaagctctgtgagggtcagatgaggaagaacatgtagaaaggatttcccaactgtgaagctctgtgtgaattgagggcacacagagcttcagtattacaaagcatgacctatttccaatgtctgtttcaacaaactgctggtaaggtgggttataacacaggcatcagatactaataaaggtttgtggcagaaacctcccttcagataaaggttcaatcccttaaattgcagttagaactttcaggaacctatcataccctaagcatcaccatgctttgataaaattgggtgtttcctttatatagatattaatttagttaaactttcaccaatatcttacacttatataacaggctttatataagggcctcagcagcgtaatttcacctgaggcagagaattatcctaattttgcaggtgagagctgtggctcacggggccagagccatgaagacggtgcaggggagctgggagagctggcctcggtctccagttctctgcacatgtcccacctctcaatcttgttgcttcagtcaaagaaagtgtcaatctttcccatgttaggacctacttaattggtaattaaaatatttatacatttagtgctaattttctctttccttttttttttcctttctacacatagggtgttcctgaaaagccccatagtgattgagtcttcaaaaccaccgattctgagagcaaggaagattttggaagaaaatctgactgtggattatgacaaagattatcttttttcttaagtaatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgattaaaacaagttgccatatttcaaagccttgaactaagactcaattaccaacccgcagttttgtgtcagtgcccaaaggaggtaggttgatggtgcttaacaaacatgaagtatggtgtaataggaataatatttatccaaaagatttttaaaaatagggctgtgtttaaaaaaaaaaacaaaacaagaaaagcagcagtgattatagagaggtcacactctaagtggggtcgcggcgtggccacgcttcacggtcacgctcgtccgtcctgcagtggcgtgtttacatggtcacacgtgtgtgtatcaccagtgggtc

SEQ ID NO: 128506 - DNA, 1605 bp, Homo sapiens
tcttggttcccacactgcgatatattggaattttcacctcagtttatgaagtttatttcgaaatccatagtcatctaagaatgaatacctgtctgccatgtatttcaatcttagtgagccaaaattgtttgtttgttactacagaatagagatgactgttttttgccacagccctatggaatttgcaatctgtgattgccttgtaaaaaggagagtgcatatggcactgcattaaacgtgtggtgtttctagtcaatgatattggtgagcacaatgtattcatttaatggcatagaccataccagacctaatttgcaagtattgggtcttaaacttcaagtgcaatgtatatgaaaaccaatctgagccttgtatctcttaaatatttattttttttaacgtgtgagatgttcgagagaaggttctccattcatttcagtgctgcctggaggaaactcggcaatgatttctttcagttgtgaagttcctttcgtgttacaccctccactgaaccctcaaccttcgaaatactccagttttgtgggtttggtcatttttacttataaatttacctttttgtattttgcaatttacatgtgtttggtttgttttaaattctgtgaaagtggcttgattaaaagactccttttaaatggaagccaccagtcagcagaatggaagcttagaggaacttgcctgtgagcgctggtctttgtgtttggttttgtgatgtaacgatctttgctggggttttttgctttgttttgagggaaatgtcttggagtaaattttaagttcctggagttaatttgttttacaggaattttgttttttaaaaaaataggatcattctgaactttggaatgacccccttatatattttctgaaaatgaaaacagttacatgaaaaaaatttccaatgaagatgtcagcattttatgaaaaaccagaagttattagatgaaagcagcgagtgaatctttaaaacagacttgatcacgcacacacaataagtctttctctccgaaaccggaagtaaatctatatctgttagaaataatgtagccaaaagaatgtaaatttgaggatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcattttttacttttattaaaggttcaaaaccaagtgttgtatttatgtttgctttttaaaaaacagttggggtggtggtctctgtgtaggatgttagaatttgtaatggagaaatattttgcagttcttcaaattttactgaattttgacacaacctcttgggaagtatttgaatcatccttcaatatacacaggacattggttccaggataccccacgtatgcgaaaatctgcatactcaagtctggcacttggccctacggaacctgcgtacactaaaagtcagccctccgtatacgtgggtttcacattcagcaaataaaccatgtttggttggaaaagctccatgtatataagtg

SEQ ID NO: 128507 - DNA, 1030 bp, Homo sapiens
agtcttaggtttccctgtgggccactgttaggttgtgctgcttttgctaatgaacaatgagatagagtagctactcactttagcatcctcctagccaccttggtgccttgtaagtcacatttattgaccaaaaccaaaataaaacaagtcatggggaggaaacaaaaacaaaaacaaaataaaagaaacaaggcaacattatagggtgagagaacgtttctcagagttgatgaaaagctgcctaattctatgtccaaaaaaaaatccctggaaaaacacggggtggggtgtgtaatgcttattaaaataatgaggagagaagacttgtttgaggctgcatggtttcaaattgttcttttatgagatggttggtttgggtctccatgaagacacgtgaacctgttctcataaaaaaaaaaaaaaaaaaaaaaaaaaagaccaaattggctgagatggccagtttattttttgtgatgtggattactatttgctaagaacaagccaaggacaatgaatccattttactgaggagtggagagcgggattgtgctgaagtcccaaacgggaaagatcaatactttatttactaagacaaccctaaaaaaatagagtcgatagctggctgtgcttttatatctgtttcttggcttaggttgatatttattcacatacgtaatcactatatctaaataaaaatgataaactatatatcaagcttaaaattcagattgtcatggaatatgagaaaagtcattcttagatgtgattttgtggtctgttttaaaacttggtacaaatttgtgagctaatgttaaatgtgctgaagctcacgcaagaggatattgtatagtttgataccaagatgcaattaacaatgatactaaaccatcacaatatgaatgcacctgtgacatacaagtgtgttattatgattccctagctataatttaattcccctttatacatttcttaaattcctcagattagttgcttttagagcaagaaaccaagtggataaaaagatcaaata

SEQ ID NO: 128508 - DNA, 1838 bp, Homo sapiens
gtgaaacttctgctaatcatactgagctctaggagtgccgttctgctggtcgtagagaggagtaaagtcacacccaaaggtcaatgtctgcattttatgtttgcatgttgtctttcatgataagaaaaattttgtctcttgtttataccgtgtttgtctccgtttatgattcattttgaaaatctgttggttgacatcatgacaaaccctgcgtttttttataggtgaagctgaggagtacatgaaacttaaattaacctttgcagattttgataaatcaagcttgacaatagaggatttaattctgtattgaggaaaaaagcgaagacatttcataaacaaaatagggatttcataatgtatgctgcttattttataacagtgtatgtgcacatatgcaagcgcagtggctgtctgataagaactggatttgaatcctcaaatacttgattgcctataaatttaaggaaatacatggcaacaaattcaaaatgtggccttctgggtgagatatggctattagtgaaagaaacccactttttatcaggaatgaaattaaaatttttagaaaccacaagtttaaaaacccatctctaaaatttagtggaatgtgtaaaaactaatgaatgctttaatttatagtaaacaataattatattggcctctcaaacaccattctgagtttaagtggcttagaaagttgatttattattgcatcaggtgttaaaagatgacactagtgattgcgttttgtttcgctccaaactcttctggcttgtttgtttttcttctaaacgttttttttttggctcacatttagtgtgttgagtttactactaaataatctaccattcttctacaggaatggaaaaagagttgggacctggtgggaaattatcttttggccacacttaatatacaaagtctagtaacaatcactcccggaaatttctttatctctgttacatttgcattcaatggaatctgactttaatgattaaaaatgtcagggtatggtctacaccagtttctaaaaagagattctcattgtctttggtgacaatcaagtgggtaggatgctacaaatcccccccccaacccccccgacccaaaactctttgccatattgttacttagttgcttaaaaagcacattatgtgtttaaatcattctcctgactcttcagcaggaaacaattcttaaatttaggaaaatttaccaaagctaaggggaagggctttccatgccccctccccacctaaactctgattaaaagttagtgagttaatgtcacttaattacttgggtgcttcttttttgtcttgtctgtggctgcttaagtctgatggctcctacataacccagcgaactcgcacccgagctgacacacgatggaaatagaactgaataataattaacactattttccagtagggtaggacaattgttatttaaaacatagtccctatagctttatttaaacgtatctagttaaggttaatttggcatttaaagtagtaaatcaggaacattctcctaacttggattttcttgggaaatgcactaaacaggacaattattcctgaaaacctagtgaccttcacaggaacatggcgggacctgtgacactaagtaagcttcagtgaaaactgttcacggtcgtaaccgtagaagtgttgccaaatctgtttccatactctctttgatcatcatcaaacattctcaaatgtaggcaatgctaacactaattatagaaattaagaaaatgtgggctcctgtttgtaactaaacggacgtggggaggtgcacctcctgtcactgaggggtgcctttcatgg

SEQ ID NO: 128509 - DNA, 1041 bp, Homo sapiens
gtttttaaagtgtttcaaacaattcagagatgtatgtaggcattcagatagaagcaaaaatgtgatgaacaatatttgaaatattaatttccctattttttcctcataaaggacgtggtctatgacaaacgcagatccactgctacatgggccctctctcagatgctccaggaggactagagagggttccagtaactagtcccagcagtagtcaccccgaataataagatcctggggaaagactgctcccaagtttgtcaatttgacttaatttcaataatcttaactacctttcttcattccttctgcatatttataattggaataaaacttaacactaaccttgagaaaatgcaagctgaaagaataaacctaagataggtgcaattttgcaagtataaaatgaaacctgatgagataattcttaattggcatttgatttttaaaacactgattaagtccttaccactatgaacagcagtactggaagtaaaaggtgtaaaagatactcaaaggtgcaagccaccattgagccgctacgtagtgaagcggggtgagtcctttcaggtaatgtttcttcatgaaacatatttatgggtgttctaaaccactcataagttaaaaaccgagaataaattaatcctagagagagactggacttctcccacccactcaaaaagccctactgttgaagtgagttaatagcacgataacaaggaagagagcttcttcaaactgaacaatttttgctagaaaaagctcaagcaacacatcaatgataaaaactctgataagtgactgaagcaacagagaattcatgcatcttaacacattgggatggtttcagacaactgaagggtgagatgttcgtaccgtagaagactccagatgcactggtgcctaatctaacatacaaggacagccagtttacaaccagaatatgacagtcatactctgctttgtgaaggcgatacttttccttgtgatcttgcccaacagctttgctgtgatagacactccagagtttaaacagtgtcttaa

SEQ ID NO: 128510 - DNA, 1141 bp, Homo sapiens
gggaagagggttaatccaatgcaatgatgtattaaaccaaaagggcgaataaaaatggaccaccttggttacatgatttcctatgtttagctaataaattgttgcaaagtccttcctaacaaagtgccccgccagtgtgcgtctatccacatatgttgttattatgtttctacagtgtgaaactataatagaagagtatgaagatgaaatatcctcacttatcgcccaggagacacactatctagctgacaagctgtgcagtgaaaaatcaggtactgtgtctgatgtaacatgtgctcgctgctcgcacaccctctctctctcactcagccttgcagcgtcttgtttgcagaccgagcctcgctgcctctgcgatccacggctctgacacaggatcccccgtctccgctgaatcagaaacgacagcatgtgagagaaaacagataaacagaaaccacagggctgtgtggccttcctctttgtactttctttcctctatatattaagtgaattcaaacattcttgatttccagttaaggagaaaattcttgttcagaattagaagactccaaagcactttctttttaaaaactttgagagagaggatttttccatcctggaccagggaaggagaccctcacttcatggcttgagtatctgctacagcagcagaaggtgcgatttttattttgtaagaactttctaaagtttttttgtttgtttgtttgtttgtttgtttggggggatgctggatttttttccaggttccattcctgtatctacttcttaaaaaaaatttttttctggctcagagggtggaaaataatagttaattcttaagcatatacacacactcagaagctggaaaaaatgagcagaattttatttataatatacaaagttgaaagcgatggtcactgactctccgctctgttggctgtacgtagaccttctagtcccctaacttggatgcttgtttaatacatttataagaatggagtacacagttgtgcattcttttggatatctttgggaagaaatgagtgagtagatatgaagacaatgatttaaagccagtggggtacttttaaacaatgtggaagtttgagacaattagcattcagcagttgtttacaataaa

SEQ ID NO: 128511 - DNA, 1369 bp, Homo sapiens
tccgttaccaagggcgaggggtgctctttgacccgcgcccggggcggaggtggtggccaaagggtccagctgaatcctcgccgaattccggagggagaggggcgcgcggggacgtgcaccagctgttcccaaagaaagcagccgaggagcccgcctgggagatggggcgcccgtccgtgagccccttcctctcccagccccacgtccaccccagcccgggccatcgcgcggctgcagcgtgggggacgcgcagccaagggcagccccggggagggccagactttgggcctccccaacttctccccgactaaggggatctgaagccagctgagcgcgcgctctctctctcgctctctctccctccctctctctgtctctccctcctttccctctctctgtctctctccccctcctctctctctcctctctctgtctgacaagtagatggataataactgccattttctatgcgtcatgctttttgctacatgctcagtgatttctaaacatgattctatgtagaggtatagtttctagtttgaatgtattttttttctggccactttgaaatatatgcacttttaaaaaactggaatttacgctagccccgtaatgatgtaaagcaggtcgttgttacattgtaataacaatctgcggtaccgtcttctgggcccgtgctagggaagtggcacacgtttgcattcagggagagtgtggcgtttccatgtggactcgccggaaggtctttgaagtaacattaacattaagacaagtttcctcgccctgtctttcttcttagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcggtaagctctcttccttgcagatgaatcgtatgatccagaaacgtgtttttggaactcttttttgttgttttctactcttgttgtggttgagtttcaagacatggaacatcaaaatgcacattaaaatgtcatctgctgactttgttgtcttgctgcttaagtgctcaccatgcgtttagtaacttgacttttgagacacctaaggggttgtggcaatttatggtgatcaatggacacgtctcagtgatactttacggaaggtgctgtgcacaagtcccggggactttaagacagttttgcagaacgttttgcttaaaccattttgctcgtgtggggactccagagtggtcttagtcagtgctggtg

SEQ ID NO: 128512 - DNA, 1056 bp, Homo sapiens
agtgcagtcgtataatcatggctaattgcagccttggactcctgggctcagttgattctcccacttcagcctcctgagtatctgggactgcaggtgtgcaccagcacgcctggctaatttttgtattttttgtggagacagggttttgccaaggtgcccaggcaggaactcgggctcaagtgatctgcccgcctcagcctctcagagtgcaaggattacgtgagccaccatgccttggcatgatacatttcaaaggagtcatttggtattgcagccaagtagtaaggatagagaaatggaattgctatccttactaatagcagagagaatgacaactgttatttattggagactgaaaacaaaaacataaaggcaaaaacatggcattttggggaaggaacaaatagtttaatgagtttcaagatcttctagttccagtgcttccttgtaaaatataaaataaaaaatcagtacacaaatcgtaaaaagcctccaacctagtgagtgcgttatctcacttaagatttacaacagcattcttgggcctgagctaatctgattttataggtgaggtgaaaaaatgggtgcttgtaaattttttgttttctagtcaattcttagaaataaaaagttttaatgggaaatttcaaacacatccagtagtagaataatgaacccacatacccatcacctagcatcaacattctggcaatctgttttcatccccccacctccacttttgtatatttcaaacaaatcctaggctggtaaaattttagagcaagatacactgctgggatgagttaagactttagatactaaaccagttgctttaatttacatttgatagtaaactagccgagaaaagttcagccacctagctgttaagaaagggaagtagactcgaattcaggttttttgacttctagttcagtgttccttccactgtgtcagtatgtagtaaggcaggaaagtatgaagcatggtgcagaaggttttcattcgaaattgtgaaagtgaaacaagttttagtacttcaacaggtaaaatttacct

SEQ ID NO: 128513 - DNA, 1152 bp, Homo sapiens
cctagaattaggtgtgtgcttatatttccgttgctcagcacatctctgcattatctctattttgcttaaatggaatcttagctttccatgatttggaaaagtgtgacgattacaaaaagtattatgaaagtctctaactttttagcatgtcacattttttttctttcatgcagtaaaaaaacactcaaaacccattttataaagaaaacactttaataacatttgaggtttttttttttgaaaacctgttagtgatttttcatgcccaataatgttcaataagttggttttcttggatagctttgtgtttttaaagatgtttcattattaaaaatggctaaagtaaaatgatagttacatatgaaacttttgtaatttaaaatgtcaagtcaggaatccttaaaaaagttgttttagtgtttgaattatttgcattgtgtctattttaacttagtaaaactgacttcaatggactgttctcatagatgatgactttgaccagtttgataagcctggcgcggaacggtcgtggagaagaagagctgctgatgaggactgggacaggtacgtgcaccctgtgcttcacctaactgcctgtgccgatctctctcattctgacacttggctcctgagggatctttactgaacgcagcaccttgactacctggcgctctctcttgagtggggctgtccctcctgagctaaagtgaagcttctccatgcagaaggctgaggtgtgctcctgttccaggcctgtgttgtgtggagggctgccaatagatcataggtcttctgtcctttttctttgtttttgtacagtaatgatactgactttgtggacacccagaaccattactggagtggccttgtgccagagttctttaagctctactttgtactgaatatctggctacactttaacgttttttccattctaatatgtgtagatggtatttcactaattttaactttcattttcctggttaccagtgaagatgaaaatacctgtttaggaatggatgaaaatgacctgtttaggaatacacacaaacacaatttaaaaatccacagtgatgatagatggtagtttgatatagtggttacctctggcaaggagttaataatagaggttagagatgtgttctgggagaa

SEQ ID NO: 128514 - DNA, 1880 bp, Homo sapiens
gtcagggtttcaccatgttggccaggttggtcttgaactcctgacctcaagtgatccatctgccttggcctcccaaagtgttgggattacaggcatgagccactgcgcccagccagaaacttcattttctgtcagttaagcagtccgttttgttatcacacatatctgttctcccttctgcaaataaactgagtatgtatcctgtgttattttatttttatcttattgtggtgtcagtgattaggttgagtcctgtgcgactaagaagtgctaataagattatttttggctatcagaaatactgtaataaagtatacaggtaagtttttataaggtgtaactaccagaaaaagactgcttgtttgttcacctttaagaagaaaagcaagttgatttttctgtctttactttttaagaatgaatatgtgtgaatgacagtgtgtgtgtggctttgactggctttcgtgaagggagtagtaatttacatataccatttatacatataagtaattttaaaaagggaggaacgtgtgaagtagtgtgaataagtagtgagacagtgtgaataacacccccccaacctaatctaagatgctcaaatatatataacctaagaaaacctggaactcttgacagaatagctaggctctctctccttataggtaggagtaccatcaagaacaggagtggggaactgagctgctaacatttattttcatacgtgatctgtactggaaaaaccaaagttttatagtctcatttcaatttaatgattcagttatttaaatcttatttctaaaattacactttttgtgttgtttaaaaaatctttaggttttggatattagcatgttaaatttagtagtaccttaaggatatctttctttttttgtgtattataaggaaatattatttgttcgtaagcttccaccaatggacttcttaccttttctcttttgtgtgagaataaatgtgatcgttacacttggtgtttttacatttaacttgcctgggcacctgaagctgagcccaggagggatccacatgccttgtgtgggatttcttgattatccactggtgaccagaaagccttccgggtggcaaacgttttaatataaggctaggaacaattcagtcagtgtaattttgtgctttttaacaagtctttttatggaagtgacacacattaattatatttcttattttaattagaatcagtcggatttgtcagatgaagagctaaatgatgatcttttgcagagtgataatgaagatgaagaaaatttcaggtactcaatattacctcattataaatgttctttatttaactaaattgataggaactgttatttataattataatggaatgtaattgaataatgtagccttatatctttaacacatgattacattctaaatggaatactagtaataactgtagaagccatatggatgttctgtaaacagagcagctgtttaaaataagcagttcttggccaggcgttgtagctcgtgcctataaacccagcactttgggaggctgaggcaggtggatcacttgaggtcaggagtttgagaccagcctggttaacatggtgaaaccctgtctctactaaaaatacaaaaattagccaggcgtagtggcccgcgcctatagtcccagctacttggagggctgaagcaggagaattgcttgatccacagaggtggaggttgcagtgagccgagattgtgccactgcactccagcctgggagacagagtgaaacgccgtcttaaaaaaaaaaaaacaaaaaacaaaaaatcagtaggtctttcatttaatgatccctgtgagttctgttcagtgcaggttatgaagatttagtatggatatatgct

SEQ ID NO: 128515 - DNA, 2087 bp, Homo sapiens
gcagtttctgtctatttcattttgtaaattagaatgaaatataggctatttgatttcagtcttggacttttgccactcagatgtgtttcatctgtggttgatttaattcatttggtcaaataacctgcagctggtgataagtagaggggctatatgcattgccagtctgtggccggctccatatagcacagttagctctgctgtacgcattaagggtttagggcactggctctgtatagcattttgagtactgttggagttaatgtgcatttgtcagtaactggaataactttttatcagtcatggtttaaatctttgtaacagctatttatataatgatttagtttgagctcctctcttcattgggtgctttttttttttattttcgtcctctctagttctcagggtgttacaattagtctgaatgctacatctggcatggttacatcatttgaactctctgacaacactaacgaccaatctggagaacaggaatctgagtatgaacaagaacaaggagaggatgaactggtttatcacaaatctgatggatcagaattgtatactcaagagtacccagaagaaggacagtatgaaggccacgaagctgagttgacagaagaccaaatagaatatgtggaagagccagaggaggagcagctttacactgatgaagtgttagacatcgagatcaatgaacctttagatgaatttacagtgagtcttttctcctttgtatggccaaagataacctggcttcccatgcataggcttctagactgatttgaaatctatttacctcccctgggagggaggggaaattagaccttattatcactctctgccagtttctttatctgagctatgacaaagtttgtgttgacagcttgtttgaccagaggtaatgctcctttgtcattctggaaggctgcaaagaatcgtgaccttgaggattgtaccctaaggaagaaaacagctttgtgtggtggggatacactgtcaattgttaggagtacttaatgcagagcttttatcctggctttagacaagatctgataaagtccttctaaggcgaaaagattattgacctgctaaagacatctttaaggtgctaatattccagagtgattgatgtcctgttcattcatcctttttgtagatgagaactgtctaaacctgaataaagagattggaggttagtttaggaaatgtcacatataattcgttatctataatcaggaagcaagattgtgctgattttttatttcagaaagatgattttggtaggtagtttttttttttcaaagttgaaccaacaagaaagaaaaaatgtactagtgtaagattctcacctttaaatgactcattatcaaaagagatttgttttttaaaataagcatgtaacgaaatttatgagggaaggatgtgatctcagtagctgtagtagaatcttagggtttttgggaacactatgggggccgagtgaatggggctgttgggatggtgacagaagtatgcaaaattggggccttaaagagcccatttgcaatgggagtagctttgcttttctgtatttacatcttcattcggaggaagcttttgtttcaaaaaaatagtttagaagttgctgaattgtggtcatgtgtatgagtaattttgaaaaggattaattgtttatgtggaacctttgaatatttagttccagtcatgattgtatttaggtgtctcagtagtttttttttttttctagacggactcttggtttgtcgcccaggctggagtgcagtggtgcgatctccactcactgcaacctccaccttctgggttcaaacaattctcctgcctcagcctcctgagtagctgagattacaggcgcccaccatcacgcctggctgatttttgtattttttgtagagatggggtttccccatgttgcccaagctgatctcgaactcttgacctcaagttatccgcccgcctcgtcctcccaaagtgctgggattacaggcatgagcctcggtgcctggccctcaatagttttaagatttaattttttttggttaatatttgctctttggtagatacag

SEQ ID NO: 128516 - DNA, 1084 bp, Homo sapiens
tgtaaagtttaaagttgagcagtagtagttcaatgtctttctgtgagcaatgtcagttcatcttgatacatgtgttctagccgtggtcattcttttcttgctttatgatgatcacaatggtaacatctgaatgatctgaaatggccgcttccttggacaggaggagatacgcagagaattaaattgtgaggtactcttatcttgctcggcaatgggagcctctctctgtcttcggaggctgtcactgaagcccagatgatttattcaccattagactaatgaacacatgagcagattgtgtctctgtgtaccccaatggcattttagtttattaaatgacttgtataactgtgatttttgttctcccttgggttgttaacccccactctaagacttgaactctgaaatgtggatctgttggaacctacctgtaaagccacatggaggggctttggtgcataacagggagtagaatcatgaaaccccagaatgtacagtgggagggtttgctgttccctatgaagaaagcgaggtccagagacatcaataaagctggacgcacagctctgctgtcctttcctgtgaatgttgctggtgctgttcttgagagtgaattgtgatttcatttgaaaatgtgtgctcattatattagtaaggagtgtatattggtttagtcgacaaaatattagaaaatggttgagtgacttttacctttaagtgcaatcagtttatttaaggcctttaaagttaacatagattaagattttattgttctgtaaaaacaatttcaggttgacattttatgtcatgggtagcagatgtttgtttcccagcgagaatccaggggtgtggactgtactgcattgtacactggctgaagatttggattagcatcatttatttgactttatttgaaatctgaatgtcctgctgcccgtgattcatgggtagtgataattgttattctgataggacgctaacagttttttctggaaaataaaatgtgttgtgttcagattgtcttgagagaattgtgggaactaaggtggtttgtcaccttaaatacagctgctttatttggggg

SEQ ID NO: 128517 - DNA, 1491 bp, Homo sapiens
tcacgatttttaaaaagctcctctgtttaattgctgacacttttgttgtcttacattgccacaaaaatagagttgggcatgatttcagcccccttctgctgctgagctcctttttgagagcacataaaccatgtcttttgaaggtggctcttccgtgctgttgatttgcagaggagctgtgtgacagggcacttggagtttgaagcagagcccacggcacttgctctggtggctgggccagcatgatatgctttgtttgcattaacacgcagaggaggttcccctctgtttctgggcctggtgctttgtgctcagtcagctaatcaccatagtaaaactttctacaattattaagcatgaatcataaagacgaaaagtacgtaaaaaaaccaccccaaagctgtatgagaaaaacttgttttctctttaatggctgttaggatgaagaatacttgcaggcttatggtgggcaacaagggctgcaagagcaggaagactgtgtggctgaagatgaattagatgagattactgatgcccaggttgctcctgcaactgaagaggtatttgttcatcttttaaaaagagtaaaaagtttgctgtttccctcccccagacttaaaatgagcatctttttagcattagcgaaagtcgatacgtatctttgaactgtgagtgtatagtgaaaaacttgaactttctaggctccttgggaagtgagttctggtgtgctgtgatttccgcatagcgtgtgccgtttaagtgttagagtgttgtaaatgttttgtggggatgtgggtggaaatagttcagaaatgtgacgtatatgttagtgctttgaaagcagtgtggtaattctttttaattagtaacagttaatttggaccattcaacaaatactgcaaggtttctgtaattaggtgcatttttagtgttgaagaagtaaggatgatgaagcttgaatcctgctttcaaggaaattggagtctaatataggagagaaaaaagacctgtaaatacctgtgatgggaaaacaaaagtaaaacctcccaagagaggctcagagacagtgctaggagctcaccgaggaaaccccgtggggagagaggttcgtggtcgacgaggctttatggaaggaggtgaacctctgaactctgaggtaggtcttgaaagatagattgcatttgtactgagaaaggtggggtgaggcatagagttaaatagttgctgttctcttaccccagaactagctgctgtgggccagacatgcaagccacaaatcattcttcagcctgagaacttcacaagagtttttcttaatacagttttcatcttttgtcaggaggccatgaaaactgatatttactggcttaggccatttactttaggtgttatttcaaggatttagacactcagtccagaaaacatttactttacccttttcccccccagtatgaataatactatgacagtctatgaatgtgtatgctgtgc

SEQ ID NO: 128518 - DNA, 1039 bp, Homo sapiens
aggggaaggtaggtggggtcagagttataaaatgttgagcctttaagttacaataaactcatagaactttagtgttagtttaattaatacattgaatttcactatgatctgtattaaactcaaagcaataagtccagcaggaatttttggaatttgtttattttcagacgtgtaagcagcaatgatgtgtaggactttgtctattaattgcaagcaagaatttgacctttttttttttttttttttttttttttttgaacattaactgttaatgtttaaggttattttctcctggagtcagcttagggtttcatgtggccttttaacaggacattttgcagtattttttacatctgaaatataaacaattaaatattttagcattctttaatatttaattcaaaagaatatgaacttactgtcctttttttgccttgtgtatctgcaatatagggaggtatggaaacattggaacttcaaaaggacatcaaagaagaatcagatgaagaagaagaagatgatgaagaatctggacgattacgtttcaaaactgaaaggaaagaaggaacaattattaggctctcagatgtaactagagagagaaggaacattccagaaactttgggtaacttttttgcctgtctcccatcctcctttactctcatttcaacttcctccatagtattgctgtaattaatcaaagtaggcaaagaaggttgactaggtaattgcggctgccgtccggagagtggccggactttggagtgagtgctgtttatggtactgtaaaactcattctttaaaatcattgctgtttatggatttaaaatgcttgaataaaatgtttaagataattaaaaaaaatttttttttgagtctgtggcctacagctgctcttgtacatgctgtggttcctggctggtcttgaaaaggtggcatggggatggtagctatggggccaggttgacccttcccaagaccctgaggttgtcagggcgaattctggacaagaccggtttatattttgtaccttttagtg

SEQ ID NO: 128519 - DNA, 2514 bp, Homo sapiens
gcaagtcctctccttggaattatgggggaagagtatgagacccttagaggcagagtagctataaacatatacagcttgactagtgaccattctcagaaacaataaaaaagcacttaactggatttttgtagaatgtggttgtttggcaagatgatagggcaggtgaaaccatagttaaaagtacctttttctgttccgtattacttaagaaagcttggtgcttggaaacatgagtttcagataactgtaaagttaggatttttcccaacacaaaggaggatttttctgtccgtcaaaagattggtttcctaaaacagtgaattctcttgttaccttcagtacctccccccaaacaaaagatgaattttacatctgaggaaatatatattgaaaaagagataatgcctcagtatttggtaaactagacatttgaatacatttttacacatcagtttatttgtgtgctcctagagatcaaaataaaaaaacctgaacagtctcaggttctgtgtagaaataattatttgattgtgtaaagctgtttgcctactctgtaatgggattaaaatatcttgccaccagagtacctgttgtcttatatgaggtgtacttttttttttgttttcgctgatattgttagtgttgagaacacttcattctttaagagggagaatcaaatgatgcactggtatccccaatttctgactctaaaagtttacatgtgaaacgagttctcttccaatctaggagggagttttggttacttttagtcttttttcacattcacatctctgtgaaaaacattcatatatatgacagcctcagcagttaaggaacagttttatgcacagttgttgattggtattttgaatgcaggttggattagaagtagaattctgggctttcatctaggttaagatcttaattgactagctttttttgctctatcaggattgtggaaattaaaccttacagaaaaagatttgagtgacagtgttctcggttttcccaaggacgatacagaactacatacctaggaaataaattaattcattacatacagaggatgttgtagggtgtaagtgctgaactccctcctggagctcagttgagccgggctacagagtaggcatgtgtaaggaatggttcactgtgaaaatgccagtcgccatttctgaagatggtgtcactgaccagtgtcccccaattgccagtcctgcaagttgagagctctcttttcgtctaggaggtggcccttggattgccttagaaagcaatgtaagccataaatgaaagactgcatttattttagttagaaagactgcatttatttttaattcattatctgtgagtaggcttccagattattttattccgagtttcattggcacgtgttacatgttcttttttattgctgtagcctaaagaacctgcttgtacacccacagaatattctcttgaaataatatcattaatttcagaggatctgtgggaaagagatttctcggtagtaacaaacaattcagaattgctaatgccagcaatagctcactgttcaagggtttatacttaatggtccttatatttgcagggcctttaaaattttcttgattcagttgtcttttaaaaaaaagtcagactgtcatttgttatttttattttgccaaacaaattgtgtattctatatgtatttcaactattataaaattatttgcatgcaaatatatttttcttaacattttagaaagggacagtgcagtgtaaactttgttacattgaggtatgtatctctttagaatctggacatagttcagaaaacacttaaagggaaattaacatttcagttgaagttacaaatgtaatttccatcctgtcatattttggtgaccttttgtgacagcttgtctcaattggaggaaagcatttttacttgctgattaaagatgtcatttgaaaccattttattactgaggatagtgaaattaatcttgacactcagaaccactagaaaaataattgctgattcactgcgtaaaatgtgtgtgtgaactaatcatgtagtcaagattagaataaaagtctatgctggttaagaagagattaaattttctttcaaatggggtctagttttatttgaaggagagaggggtaccatataaacaatttcaagaaaaatgtgacttagagattttggaggagtttggagatgatgatgggatccaaggtagaaggtagactctggtaatattgaaagcgtacccttggctggggaagaaggcaggagaaggtgtcttggtataatgtactcagtgacatttttagaaaatgtggtgtaagatctgttgtcccaatttagctagtgttgtaaaaggaccatatgtggctaaatcattttcgtttccctttaggaacctagaagaatgtggcatctgaagtttcttagggccagtgcccatgttttctgtatccctaaagcattgggcagagcagtgagcagctgctggacactccaca

SEQ ID NO: 128520 - DNA, 1487 bp, Homo sapiens
ggcaacatggtgaaaccccgtctctattaaaatgcaaaaaaatcagccggcgtggcggtgtgcacctgtgtagtcccagctacttgggaggctgaggcaggagaattgcttgaacctgggaggtggaggttgcagcgagcagagatcacgccactgtgctctagccagggcaacaaagtgagactctgtctcggggggaaaaaggatgggactgcaaaatgccttgtcgtgtgagggcagtggctacgtttcacttcagctgctttttagcctcagtcagcacatatcagtggtctccgatgaaaataatttaaaatttactgttaacacttgcattgtgtcataacggaaagcctgttcttatttatcagatctcactagtgggttgtgtgtgttgctggttgtatcgtacttgccgctgctagttgggtgtttcctgcgggtgaagcacatgctgtggcagagtttcattgtcacatcattctttcctgttctctccctagacctccagtttgggctctcggaaagtaactaacacatacacattttttcacatagagctttcagcagaggccaaggcagcattgcttgaatttgaagaaagggagcgacagcataaacaaggacgctacagctccaggcggggaggacggcgaggaggtccgctgatgtgtcgtggtgtgggggaccagaggagagagagcaccgagaggggcaggatgaaggaccacagacctgcgctgcttcctacacagcctcctgtcgtggtaacttcagattttcttgtagtagccctagaacttcagaacaaatggcagtaagcttttgtgggtatcctagtatacatttctctcttcttagtctgaaatgaaaggttagtagcaggggtaatggctgaagtttctgctttatagtctcatgtgatgttgcatatagtcttagaaattcagcactccagtcatctggtagtaagaaatcatcctgtaccacagatacttccagaggaggaattaatgagcgacctgatgccctaagatgacataagctgttggaccttgctacctaaagcctctagagaggtatttctgagtgcattacatttgagagatgttattacagatagaatttaggcagaagttgtttattttataaaaatatctttacctttttactgtttaccatagattttttccttaaatggcagtttctcagaattattaacatgtcctccatacaaagctttcatagtctgtagtttaggaataaatcatgtacctgtaatttcaattagaatttcgtttgtatttcagagatggcacatctcagaaacaaagacagaaattattgatttttttgttctttttttgtttttgatacagagtctcccctctgttgcccaggctggagtgcagtggcatgatcttggcttactgcaacctacacctcctgggttcaagcgattctcctgcctcaatctctttagtagc

SEQ ID NO: 128521 - DNA, 1087 bp, Homo sapiens
ttttctttaactgcatttttcttcaggttttgttctcgtcctccttttcctcagtggtctccccagcactgttcctcttgctgtcacctactgtttctcagtgagtcttagtctctagcctaacctctttccagctccattttctccatctcccaactgtccctgtacctctccagacacatgtttcacaggccctgaatgtcacttgtttaatcaaacaaacatgatctttccctcagaactctgtggtcttgaattaatgaccatgcattgtggtcactctcagttcaattaaaatttaacttgggtgtccctgtgtctgttagtgtgctgtctgtgggatacaatggtgagtaagatagacaagatccctactctcatgggcaaatgtgcacagatgtgatgagttaaggagggggaaacatactgcattctgggagcatgtgtgctagtggatgtgagctggtaccagaatcttttgaaacgtcttctgtgaggaaggataggtgggccaaagccattcacagattagttttagaattctactcattgttcctctgagatgtcttcttgctctttgtcagactatggcttttccattgattcatctctcaccattccctattagatggtctccttccgtcttctttaccctcgttcatctcacactgctgtgaatgatcattttcctaccaaagagatcattcgtgatcccttattatacgtgttgtctctgtggcatagtaatggatcatttacttggaatttagaagccctccgtaatttggcatcatctcagggaaaatgcttgttaaattagacaactgaataagtagtggtctactgctaattagctgtgtcgtcagtttggttagtgattaaaagcaaaacctgtggaatcagatggcctgaattccagttccggcttttctcctttccagctacttgatcttgtaaaaggaggtcagtaaataggacctagtttataggattgtggggagctaggtcagctgactttctctactgaccgtatagtaggaacttaaaatgtggggaagatttagtccacggcagctgttgcagttgt

SEQ ID NO: 128522 - DNA, 1018 bp, Homo sapiens
tcagcccaggtatttaccacgatttaacacgtatcttcctttaagtcccaagtgctgatgttacagtgaacttggggtatagcgcgtgcagtgcactacttatttctcaaatcattttcccttagagaaaatcatgaaatgtgtattttttaaaatacagtagcggtattgtgtttttaaaaagcccaccagtcttgttgggaaggaaaataaactctaggctacctctcgttgttttacttgtaagccagatcttcgttgagtaaagttatttttttcttttttctactactagattaaacttggttcctgtgaatgtaaatgtaattttgtgaacatttaatgaggatctactttatgtcaagtgctctgcatagtgctgtctctaagctataaaatgaaccaagcatcattaaatgaaacctaacttatgtccttgaagctaattttcatttgagtaaaatttaagaatagtgaagacaacattgttgtggcttagcaaagccgtctggagatttcttattggtggctggaggtgctgcaggctctgtcttggttcttatggatggccgtatgcccctcagtttctatcctggtggttttctgtatttggggttcaatcaatatttgtcaaacctaattttgctttaaaaactgactacacacacgcacacacaaagtgatggaacattgaacttcaaatgtagcaggtggtctgtttgagtcagtgtgcttcttagtacgcaaaaatagatttgaattcagaaatctgtgtgccagttgttatgaaatttgcaattgagcaaatcaaggttcattgtaatctctcctttccccagcttaagtacctttaaaggaattctcattgctcctaggataggtaacattctatccaaagctgtgctcgtagtagtgcatatgtagcttcctcacatcagtcatagttgtgtgtttactcctatttgtgtgatatctggtgaatgtctgtggctaaacacccgtgccagagtcccggtca

SEQ ID NO: 128523 - DNA, 1881 bp, Homo sapiens
acttgggcaacatagcaagaccctgcctctacaaaaaaactagctggatgtggtgtcatgctctgtaagtcctagctactcaggaggctgaggtggaaggatcccttgagccaaggagtttgaggctacaatgagctgattgcgccactgcactccagcctgggtaacagagcaagaccctgtctctctctctctctctctctctctctgtctctctctctctctctctctccctctctcaggaaaagagatccatatcaaagcattatatcagtgaattttcaaattaattaggggtaaaagaccatgtatatgatatgtattctcacttacaaatatattcctcagttactgacatttattgggttcattgtgtcttaattgatgtctttatctagagaagtgacactccctaatgtcaggcaatagtatgctgtggatttccttgtttcacctaaagtcaaaagctacgagattttcagctttggactttctgttgtacatgtttcaataagtgcctaaagtttatgtttttataaagatacaatatttgtgtgttaaacatttctttattattttgtagccaacaatcttaagggtttgtggtgtttatactagtgttcattttgtctattctgtcaatgccatgggtagaacagacttttgtagggagaaggaagggaaatgcactgcggaagagcattttcagtgttagaaaatgttgttgtgtttagagggaacagtgagttagtgataaaatgataggccaaggcattggggttgcaagtgtgtgagaaagaagaatgatacttaaaagttgtgaaatattgactcagtttcaaagaacaaggtgctattaaatgaaaattattttgatgatagttaatagttaattacttctttttggagcagtgaaaaagtggtgaacatttctttacctttatgctgctgcctaggtcaatacggtggtttaaaaaaatctccatgaatacctgaaagaccaactgaaaaaggaagtaattttaatttgtctctaaagagttctagtaacatgtagtttttgaaaaatgttaatctgtaagaatttgcttaaaatttttttatccagaggactctgtgtactattttttctgtagtaatttggtttcttaaaacatttcacatttttctgttaagtcaggaattgctgattgaatttctttttcttttaaagtgaagcagcttcatagctgcagcttacagtcctgttaaatagcaaagatgagcatctttaaaaagataaatgtcatgacatttagtgttttggattaatgggaaataggccaataattgcatggatttcaataagcttaaaaataatattcttgcgttataatgacattaaaacattgacttaatttctagttgctgcgttttgatttttgatcatttaatattgcagaatcacctgttgtgtaacagtttttatgttaatatgtgtggtcatgtcttgtgtaaggatattttggttaatggtggactgcatagacagcagtgtttccatgagattataatagtgtattttattgtaaccttttctagggttggatatgtttacatccacagatacttagcattgtgtgacagttgcctacagtattcagtacagtaacatgctgcgctggtatgtagccttggagctactagtgtgtactatacaggctaggtgtgtagaaagcgctaccatctaggtgcgcgtgtgtgtgtgtgtgtgtgtgattacaatacactctgtggtgttcgcatgatggaatcacctaaggatgcgtgtcagaatgtatcctgtcattaaggatgcatgactctgtgtgtgtgtgtgtgtgtgtgtgtgtgtgtgtagaa

SEQ ID NO: 128524 - DNA, 1040 bp, Homo sapiens
tattttccagttctgatttctgtttataaaatgtgtagtacatagttctgaagtgaatccatgttttaaaaaacactcaggtgatttgttttcttgactacaagaattgataagatactccttttgtgtctcaaagactgtgttaatatttacttaagcatctttcttgtatctagatatttctatagcaatagacaggaattaatagacacgtaactttagaaaatacttttgggtggtagtcactttccctttaccagtggcttattttttgatgtatagattatctctgtctttttggtccctgaataaatacataaatgaattcaggaaaaatacgttgactgttctgttgccaggtgctactctagtcctggaaatacagcagtgaacagaagagacaaattcttttccttcaaggagcttatactcagtcgagggagattagcatacatttatttgtggggttgtgttctcaagcaccatcagcaaatgtgtgacttgtcgtgcattaaaagaaactgggaaacaatgtattgctctgaaaataaaaggccacagtcattgcccttgtcctccattaaatacatataagaagcttttgtaattttgtttttaggaaagggagacacagtgtggctagtggtcagggtttttgcctccattaaatatatataagaggcttttgtaatttggcttttaggaaagagagacacaatgtggctagtggtcagtggtcagggctcttgcctccattaaatatatatgagactttgtaatttggtttttagaaaaagagacacagtgtggtcagtggtcagggttctcgcctgtcagttttcttttggtattgtcttcttttcacccttgagcttcagtcatgtcacttagctgcttggaatctcagttttcctgatatttgcctctttctttcttaaagtaaacattgcaactaaagtgctgtgaacagtaagaaaagatttctaaatctgagaagagggtgctttataacctgggtttcatttgttagaataatggta

SEQ ID NO: 128525 - DNA, 1039 bp, Homo sapiens
ttgttgctgttgttcctaatttttcagtaggcacagaatgtagtgagtgtgaacaatcaatgcagctcagtctttacctggctttagttgaggccgtcttctcccacaagcctcagtctcctcatctggtaaaggagggtcggccagggcggcctgtgcagaaggctggcacctggagggcgtgtcagccttagtgaaatgcatgtggagtgctctgaagcagtgcagcgagttaacttgtccaatagcaatgtcatgaagaatggctttagagaagaatttaggcaagtcatgctttcttagtttcataaaaaccagtcaacactggttttaccttttaatcagttcatttttttcagttagattttcttctgatatattattgtagcagttgtaatgtattgtttaccaaattggaagtacaaagttgaaatattaacatacaatgaactcttattagaacacgagtgacttttggttttaaaatcaatatgtgaaaaaataatgtagatttacaaactggatcggaatagtttagaaagaagtctttggtaaaagttttatcatacttctagtgtatatagccagctcctaactcagtatgtgtaactgatttggttcagaaaaatgaagtcacacattcataataacagggctacctaataggggaagttgcctttcaggcatcctgctggcacatctggcgatcacttccttccatgatagttgatttaggcgaacttctaaaggattcttccatggagttatttcaaaaagatgccttgagtgaaatggaacctgtaggtcaccgtagtataaatggaatgtcttgatttattttcttttaattttctctctctatataaaggggaccaggattatatatatttttttactttttagaagaaagatcttctatttgttttgcttagctaaatgtgacttattttcgtatgttcacccctcttgatgatgatataataaagggtgaatctgcttatttggaggtcttttcaagtatttcagctgctgttctgaa

SEQ ID NO: 128526 - DNA, 1007 bp, Homo sapiens
tattcctgtgttttgaggcagtggccccttgggtcctgtgaatatgtccccagccgtctgcttccccgatgcccatgtcccttgtgcccactatccccctggacgccatgtcttgctctgtatgcctacccttgtaaacagcctctcacccaccttcatttttgcagtttgaaatctgccctagatgtgatattagagaacagaggtggtcggaattgcttccaggacgacaagtaatccctgagtgagggctggcaccgggcactcaagctccagggcaccagccgactcctcagctgtgcttttgtcttaagttcctaattcttaaggtttatttagggaaagtaagatggtgaaatagctgaattctagatagattaaatcctgttacattattttacacggagtctgtggatatggatgatttttaaagaatattattacaattctttaaaaatgcttaactttttatacattttccctattggatgctttttattgaaagttactggagtttttcaaagatttttttgtatcgacttgaagaatggtttggaacttggaatattaaaggcgttccttatataccattaatattccaatactgcaatcggcaacattttgattctgaggagagtgcatgagttcaaggtcagagagattgacttgtgctgttcattataaccaattattctgtgacaaatgagtttgagatcaggctgaaaattctgcacgaaaaatcaatagttctaatcagagcctttcaggtcatttacaccccaccttttgttggtttgtcagagaagagccagataaaacctgtgtgacagcaggcctccctactgctgccattcctgtttgaaacatattttgatatcttaaatgaatagtttaattggtttcaaacttgtaaatgagtggaaatttacattatttcatttttaatattctgataagattttccaaattagctttagctgtgtggtttttttccccctccccagagg

SEQ ID NO: 128527 - DNA, 1728 bp, Homo sapiens
gtttgcatcttggttttcattttgcatctctgtaaccttggttgcctggcctcaatgaatcccagtttcctcatcagtacaatgagaaccaactctcctcccaggatccttgtaaggattaaacgtcataatcatgtaaagttagtggtacagtgcttgagtatgtgataataactcaataaatgttaccacccttttagttgaaggaaaaagaaaatggttttttttttttttggagtggctgtttatattgatctttaagaaaatgaaagcaaataccaattcagctgctttattctaatcaagttaatgaaaattttaagaatttggcagcaaattaagtaaacagtcctttattctgttggccacacagagaaatgggagcagcacagaatgcccccgcaggaaagccagctgtccaattgtgatgctcttgtattttatttttaaaaggctgtcaaaatgctgcatgccgaaggtcccagtttatttgtgggatcatgcatttatggctttggactgcatttgtaaatttcttcccttcctaccttctcaaaagttactcccacttttggaatgatatgtatatacctgatccgttttgtggagcttggggaggtgggaaagggaatgttttaatataattttagttttaagaacagtaggagaaactctcatacgttctttatcagattcaccagttgtttacattttgtcaagtttgctttatcctggtctgtctttttgttcatttgcatgcacaaaaaccttctttcccaaacctttgagagtaggttggagacatggtgtgttatgattcagcacacagatactctcttacaaaaccatatttgtacattatcaaaaataaaaattgttgtgcactgatactatcatcttatccatagtacatattcagattttattcactggaccaattatgtcctctgtagctaacccccacctttcagggtccagccaggatcatgcattatattcatagtgtcccctaaatctgctgtttcttgcccttgaccttttgaaagagcagagggaatgcccttcaatttgggttattttatgattcatcctgatcggtttcaggttgtccatatttggcaggaacaccccagaggggatatcgggtccttcttagtgcattcagttgggaggtttgtccaatattgacaagattaactttgatggggcggcgggtgggtaaaagtgatgtttgccaagtctctcctctgtaatgttacagttttaccctttgtaattagtaaagtaatttataggaagatactttgagacgattgggactatgtaaatatcccatttctgatcaaattttcactattgttagcaggcactgaagtttttctaatgccaacactcctgtatttgttagctgtcatgctcctgctgtgataatttacacttctccttcatctatttgttcatttatttatgtcagtgtgggtgtatgaattgttactttatgcaatgaactgtcactgtcattatttatgttgattttagaattgtaccagattgaccagtgagagcccctttaaactggtttctgtgtcctttgatttgttgccattactcttggaacatgtcctcactttctggtgcaagaagatgttcgagctcaccttgttctttctctgtatgggctctggaattggtcctgcttcttggaagctccaggtccttagagtggag

SEQ ID NO: 128528 - DNA, 1002 bp, Homo sapiens
aactttctgcctttctctgtgatggactgggaggccacttttgcattctgcccgaactccccaacaggattcgggtaggccatctggaaacctagtgccgtccatcaccaccctgccttctgcgcttcaccgctgtcctaggctacattgggcacatatgttctctctgactttctaatctggagaaagtgtgggaaagttcagcagtttcctcttctttaaaagttccttgagcagtagttttgaacccttggcagcttttaaaaataataatgcttaggcccgccttagaccagcagaatcatacttggggagtgcctgggtcctcagtcacaattgtgttttgtttcttttgaaaagcttgcagacgatggaaatgtgcagccacggctgaatttctggttgcagaatctgcctgggagggtttcagggtagcaaatgtagtctctgccagcggagtcaggtacatgatgctgtggcttgttgtgactgtaaggtggacttagcactgtgcacagcaggtcctgcttaaaccagcctatactacactaggagaaatgggggctctgggactctcaggacaggatccaaattctgaactgtcatttgcagcaagtttctcagccctgacgggtgcctgatctacacagaatgatgatgacacagagtgcccaccgagcacaagcgtgtggcccctggagaggtgcaggcttcgtcagctccctcctcttcctccgcctacacttaaacttgctggatatagttgtctcatttagctattaaaacattctctgatagtggatagaaaactacagaaaatcctgtagctcatggtatattttaatggattctaagttatttgttcacttttatatcttagtgactatcgaagaagctcaggcttgaaactctgaatgtatttcctttgttgtcaccaggccatcatgcacggacgaggcagaggagtggccggtcccatgggccgggggcgcctgatgccaa

SEQ ID NO: 128529 - DNA, 1065 bp, Homo sapiens
tgccacctgtggtgcccattgttgccattgccacgcaccgtgcgtcccgtggtgggatctggtgtgtctgggggcagagcactttggaaataagacatttttggatgcacagagtacatgtcagagttctgaggagtccaaagtgctttctttcaagaatctcttacagcctctagcttcatgggtggatttggaaacatgttaacactagggttgatacgggtaattaatgtacatgttttagatctccatctgctgttgacagttcctaaaaatgaatagatgaaaactcttccagaaacatacatgttacttgggtttaattgctgccatcttcattactggcttcctggggagataggtttcatttttattggtgtgtagtaatggaaagttaacccaaagccttggcttctgtttgtgatagagcgggctccctagtggtgcagttaggaatacttcatcagctattagaagcgtacagtgtatgtttaaggatatttcaaaacaattgatcataatctggattaatttgcaggaacacggtagacactagagcattttagatggattaaaatgtggttatcctaatctgagattctcaaaataaatggtgatggagaattctggtccagtaactgtgtagcagtgagtccagatgaaaaaaccctgagcctagtctgttgtgagccacagatgggtgcgcttggcgaggcctcacgtgtgtggcccagtgtcctgctggtcctcctgtctttggggcgatctgcacttccctgtgggcagaagggttgcactgttgttttcatatgtcacctgctacttttgtggactttgcttcatcctgtgtagtcttgatcattttcttgaatatttttgagtgtgatcgagttgtcaagatccatacctgaacagcaagtactgtttgcttctcacagcattgagtgaggctcagagcctacattgtgagaatatgcttggagtcattgccaaaccagctaatttctgtcttgtcttttaaattgaattttgcattttgtaccgtgggtttgtatagacctctta

SEQ ID NO: 128530 - DNA, 1588 bp, Homo sapiens
cggtctcccagagcaggttggggcagctgatggggccagatgatgggaggccttaacactaggcttggaagatgtaactgttgctgttgggaatgatttagtaaagcactgttttggagtagattatctagataagtaagacaaattgccagggagctagaaaggaaaatcaattagtgtgttccaaatgtccgcctggactcattttgtgttaaaactaataatgcttaaatatatatattcatattttttattgtcatttacaactgatcttaaagtgtttgttttcttcctctagagtttacagatgcttcctcagcaacggaaagccatagctaagttcaaggagccagcccacgcattagcatttcagcagaaattccacaggtgaccagtgtgttctgtgcttgtggtgataagggggcgggagcaaggccctccttcctgtgccctcccatccatcatggtagcaagcgtgtgtccccacctgttcctgtagaaggacactagggcacaaagcgcagacggtgatcctgtcatgaggcgcgcgtccttttgtctggtggagaattgccccttgtgttttaatagatcttcccggggaatctgcctttttatatgatgcgtttttattaaacaggacccaccgggctcttttagtttcctcccaccttggtaggttgattgccgatgtgcagggttagtgtcgatcgtttctttaaattttcacaggcatatgatagatttgtcccacataaatgtggccctgatcgtggagtgagtcctaacaagagagcctgaccttaggctgtacacacactgtggaatttcttcaagggagctgccggccggcgcagaacccccaggagcacaggtctctccgggccgctgtcctgcgtaactgttctccagagcgccagccagccacgggcctgattccagaggagccgaactgacaggacacagcaggctggagttggtgttagattgcttcacattctcttgtcaccaccaagaactccaagtttttcgttttgttttgttttcaaagtgcttacaatgcatgtagacattgttctttgtggtctgactctatgatcgatcacagtgacttagattcaggaaagaacattaacgtcacaagttctaagtagttttcacagcaaagaatatttgataatggttgcacttatcttcagtgcaggttagaagagtcttctcaaccaagcttaactcgagttgtcttctcagccctcaaaaggctcttgtacaaaatgtagattaaaatttgggtgattgttgattgacctttgcataccctggaaagccagggtgtgagtggggtggttgggagtggtgccagttgaacagcagattctgcttcttgtcactgtttcaaaagcgtcaactctgtgttcctagtttcgatgaactccccattcatttttaacacacttcccagataaggcaatgtgctggacaggcacacggcatggccctcggctagagcagggtctgtgatggcctcacctggcagccctctggcctagttcccaccacacatgaggtggtggaatggcctgaaggt

SEQ ID NO: 128531 - DNA, 1132 bp, Homo sapiens
gaacagacctgtttttttcctttttaaatgcagtaaggtggcctgtttatcactggctctgtgatacatgacattctttgggaatttggtggccactgcttcagtcacctctgtttttctgaaggctgttccagcagggctgccctgttcatcagcggatgttcactctggcctgccgttccccgtggcatgcggggtgagggtggctttcttccagccccaaatgagacgagtctgtgtcatcattgaaactgcttttcgtaattgcgggtaggttcctgtaggtgagacatattctccataaagctactgtagtagaattcattctgggcaaacactgaaaaaagtgccttacagtatttctgctcatgaaagagtttcactattttggatatattctaaagtggacctgagctatttgagcaaataatgatagggcatactcagacattttagctaccttttatacctacgatttcatgtcacatttactaatagaattaagggaaatagaagcccgttctttcttactgcccctggagggagcatggcgctagggctctcagcctcctagaaggaagggactaaggagacgggcacagacttgcgtcatctcgtttccacagttgacgttttatattactttctcaaattaagttaccaaaacaaactgaagagctgaagcaggtcttccagaccctgcgatcctttctgtagcagtgattctaaagtggcgtttgctgtgtgcttgagagtaacactgcacgctgcaggggctgttgcagcagtcagtcccaggaagccacagcgcttgtaggatctgctaggaccctgcagctgtgctgccgccacctctgctccagagtgtcccagccaaccctcggaagatgggattgccagtcagccctgcctcaccatgcctgcaggaggctgtccagggagcaggtctgtgtgcccatcagcaggttcccatggctgtcactgcccactcatttccacagttagatacggatgtgttgatgtatttcgtctagtttatttggctcagtccacagctgcgttggagtggtgactttggtagcccttgagctctaattaagagagatccaaaccactcagtacccactgggca

SEQ ID NO: 128532 - DNA, 1080 bp, Homo sapiens
ggccacgtttgttaaatccttatactgatattcttctaaagagtaaatctcatcatttttccagacaaattttgaggggtttctctgttttgtggacaggcagcagcctccgtaggcacccgcaccctgccttgctggaggagatgggatggggcgggaggtggcttcaccataactatttttaatatgggtcattcttagcatgatttgtaaaggtctcaggcaaacagttgttgaagcttgcttctgtggcatttctgaattgtggcagagcttagatcctgcacccaggggtctttttttcaaacagcatcttgctcagttctgtgaacagaaggctttgttactgaaggaggtggaagaggagtttagggtgaaaaggaggaagggatggacagacccaggtgaggagaggcctggggattggggaagctgtcatctcagtgttaataatcaacttgcttctaacacactggcttatcaggggaggtcatccagtccggtcggtggagttgagagcccttgggccagggtgtttggcggcacaggggcatccgctggatggcctggaggagtgggggaggggaacgtcttcactgggtggtgatcagctgggacagttcaggtagggcaggtgagggacccccgaggccctggagccttgtcctgggatgggtttgaagaactcatcactcatcacttgttttcttttggcttttgttgtttttgttttgttctgtttgttttgttttgtatttctttgttattttattgggaaggtaagcggaatgtgctcatagaccatcagacgcttgtcgaaggcaggtcctagtcatgtaattgcacaggacaaggaggtcagcgtgtgtgatggcagcatgctgtgccggcacatcgtggagtcctagaaactctctagtccctgcggctgttcccctcctctgctctctccctggagaggactgccagctcttaagaaacattcctggtgcggtgtctgcagtgccctttgtgggtgacttcaggcttcccgctttcgtggtgctcttcctgggattcgtttttttattaccctccctc

SEQ ID NO: 128533 - DNA, 1162 bp, Homo sapiens
tttcagttaactttttcagctatttttaaagtttgtgaatggagtgttattttggacattcttaaatatgaattctccaaaggcatttagccttgacttaatattaaatcctaaggattttatgtaaggtttttttgcaacctatttaattttttttaaatgcctaacttctgaggtgcataagcccgtggtttgtgtactggaactaaagcggaactcactgattcatattggatccccaggtataccttctgctggtagcatatggctggaaaaggccgtttgcctcacacattgtaacctgccttggctagaaaatgcttttaatgtctcaactctctcttttctgtgtcatgttttggtaggaaatctttaagattggcggacggaacaggtattttagtgagacacttctgagtacttgctttttcctttgacttctaaccaactaaaagagaaggaggtcttcatgttgatattttgcttggttttattttactgattttaaaaggtatatagaaaaatgtaggcctttaaaaagaaacagcatgtagttttttattttaatatgttccatagagtggataggcagacaggtactattgtaatgtattctgtatttaataatttaatatactctagaaagtagacctcatgcattcttttagcatgattttcttttaaactgcttttcattttaagggcacccgtggcggaagctggttttgcaaggactgtgtaagctgtatgcgttctagctgtatgcgttctgtagtcttttcttaggtgggtaacattttcaataacgcgcgcacagcacacaggggtgccctgagccgaaggagcaaaaaaagccaccgctcgtttctataatccagctttgcttttcacaggcgtgggatccaggatggtgtcctctgtgaggacttgaactctggggctttaattccactgtttaattttcaggtaccacagcagcaaagcacagagtgtgacctttttcatgtctgagctgattctgtttgctccacgtgcctgcttcttgctactgttcatttagtaatgggatcacctcaccatgccatgctctgggctctccctctctgtccatttctgttttgctttcctggctaaacccatctaccattcttaacactggtag

SEQ ID NO: 128534 - DNA, 1116 bp, Homo sapiens
tttgattggagagagtaactttttaattctgttgttttgcagtttggctctgtaggagtgagtggcgattcaaagatgccggcgtcccgcagtgtgcggttcgtgcccttaaccacccgcttctttgtttcccgcccctctgctttcgcaggagctcttgtgcttgagttcagtgttagtggtagcgtggctcactccacttggaggtggcggccgtctgaccgtgtgttactgctttgccgacggggcctcccggccctgatgcgtgtacactctgcgggctgcaccgggtggctctggttgggggcgaagctgtgttgactgggagagcgttggaaattgagacatggagagatgacgggagtgcgtttctctgggtttgatctccatcctgttttctcccagacacaccacacctaccttgggggaatgccgttgcctgttccacccctttgttcacttcgcgttaactgctgtggtaactttttcaggatctgtgtgaagaatggtaatgacgtagttgaaaggaaaatgtactgttgtgtgtttcatttgtgtgatttcgtaccaaaaaaatgtgtttgaactatattgtatgtaatttggaagtcgtgttaataaaaccctgcagtttccactctggttccgtagccttcattttgtctgggcgctcaggtcgggccacagctcatcttacctgtgtgtccgagacggtgcttccgcacctctgtaaggggccggggtcgggggctgccctcacgctccccagattggccgctgggttgcagcccgcggctttcacgcagctctctcattagtgggccacgaaggtcaagggcagccgccgcctccttgcctgcattctgggcgctgcatgactccgaactgaccaggcagacggcatcaaagtatgctccttttggttgggggtgggggagttagtctttttaattttttaaagcattatagataatttttacaagttttcttcagaagagacttgtattccagcatggcaataagagactgaaggtggggaagctcagtctccagtgacgccgttcttccaaggtggcgtgttcttgccgtgtgcaggcctcgctggaggttgggatc

SEQ ID NO: 128535 - DNA, 1144 bp, Homo sapiens
caggaagttgcctgggaggaggcaggaaacactgactaggcagatgcagacggggttacctgggattcagattgtgggggttcccctggaattctggggtcaccctcagataaggatgcgacagaaagcagttgaatccactgtgtgtgtttgtgggggcactgacttgcttcctggatgtttaccctgctgctgctggtgggacatgggatttaaagagggggaactggcacagatgacgatggtggcatcccccaagaagctgcgccaagtggaggccgaggggcaatttcaaggtgacttctgcagagggcggggctgacctctaacctcctccagtctggaaggatgctctgcttggagtctggttgtcgccatggagggacagcttctatccagggccctaactgtagcgtgggttggggggactctttcgagagggtggggcgaggacgctggccccactgctgcggcgctttaaggggacgtgacaaattgcgcaacaggaaaagtcctgtgtatctggcagcaataaaacccagtaatatggttgtagagttcaacatgcaacaactgggggtggggtagggctgggggccgccctggtaacaggtcagtgcctgcatgtttgtgggcctgccagcagttaaaaaaaaaagtcggaagggcagagtttgagtgaggtcatcttgaggattgaacgcgttttacatgaaaatcaatcagtaaaccagggtcagtgtagagctatgatgtgaggcccgttgcgcgcaggcgcacaccaccaacacgcacagggacccccatgcaagccccccaccccaccgcagctccctcccctggggctgtgccgaagaagctttaaacagcttcccaggagggcagccagggagagggcggcagggtgaggatgacctggcccccagctctgtgagctgcgccacttgggcaggcatggaggaccccgggcagggagacccgggtccagccgggccgcgacgggaggtggctgcgcgagtgaggggcggaggccgagggttgctggagttggcgcccccgccccttgcgccctcctccggcccgggctccgcgcggcctcggctggcggcctctcctccgcccgcgctgggcgggattgtcgcag

SEQ ID NO: 128536 - DNA, 1009 bp, Homo sapiens
aagactgaaaagcactggagtgcagaatcgagatggctggtgggtgggagtggagaatcagccactgacagagagtcaggggagctgacgctgacgtacctttaactttggagtgcgtcatgtgattgatttctcctagtaatttgtgatttcagtttttttaggttaaaaataaaatgaatttgcaacagtttaacgttcaccaacagtgagaatggagatgccacttagaaatgtagctgctggtttcacatgttattcccagacttaaaaactgttgttccccagatcattaagaatttgccatattcaatcttattaattgccacacattttgctttgtaagatttccagtttctaaaattcaaacctcagagttgcatacacatagaagtatggaaggggtgatgaggtgaacgcatgtgaacagactcaggggtggcttcccatactacgcagaaaaacctggcatgcctggaatttcactacattacaaagctagtctctcactcagaggggccttgataaagtcattgttcattctggctttggaatttatttttaatggccgtattactaggaaacctatagacaccgatgaatctgaagctggtccttatttagtacacatttttagttctgaagaacttttggaaatataaaggacaaatgtaaggagaaaatgaagcctgagttgagaacctgagacccacagttatgtttttattttaaatatcttaatctgatttctagaagcttaacaagcctcattttacttataatcttacgttaaaatttttataggtacttaaaggaaagcagttcaattttctcttttttactgaaacatatgtttgtttcttggtgaaaacaatacaattctgtttctatcattggaaaaatgacattttcacatgttatgcccagattaaactagataaacttgttaatagtatactattatgctagatgaaaagagtcttttctaaaggcatctgaggatgatgat

SEQ ID NO: 128537 - DNA, 1084 bp, Homo sapiens
ccttcctttcctgtgtgaatcttatggtctggccaaacttgttgactcagttcagtgaatcactgttagatttttctgtttccttgactgcacatgaatgactggtgggatccatgtgtcccaggtacctgggctggaggtgacctctcttctctgagctctcacagggcgctgctgctcctttcattccacacacgtcagctgcccagtgttaactttttcctgtgtgcactgcttatctccttgaatgagtgccttagattcagggaagcaccaattcatctttgtaaggcccttagcattcaagaaattttgactttaggtttgcaacagatgagaaatgagagcaaatatatgcctcaaatgtacatattccaaaggagtgcagtagaaatcctttttgggggaactaagaaaaaacactgcctacctaaaatgattttcaagttactttcagcgtcaaaattcagtaaaacgtcaactttagcttataatcataacattgacattagcttattaataaatatactgaaagtccttccatagacatttatgacaaatttaaacagtgaactgggatgaatattcttacagctttgagtattcagaagttagcaagggtggtacttttagaagtcaaatcaacatttattaactattgtagttaattcaaagtactatcctatgggcagctactattagatatttttaattgtcagattcttccgtgtgcagctttctttattcctttatttactccctcgctttttatgtgggttagatgaccttagtaactgaaagggcaagaactgtcaaaaacaaatgacaactgacttctagtttttaaacaagtggttgatattatgaattttacagaaacagacaaaatacctaaacattttcaattttacaaagaatgaatgtcttagtgtaatttttccttttaagcctcacatatcagatacttgataaactaaataagagtttgagttattgatatgtaaaacaattactggtcatttacaagtaacaagctggctaaacatttaaaaaaaatatactaacaaaagcacccaggtgaact

SEQ ID NO: 128538 - DNA, 1036 bp, Homo sapiens
atgacaggacaaggggtgagctgagggtggtcggtgggaaccacggcaaggcctgtgtgctgtctcctcccggctccctccgtctttggagacgagggtgcctctcacaggagggtcctgtgacccactttaggggtggggagaggtcagacggtccctcctgcagctgtcatttctcaaattcctttgggaaggaatgttttttccttaaaatattcagtatgccaaggtgccgtattttggggtagtgtgttctggactccatcagataggggttcttgtggtcatctgtccagattatctggatttatagttaagtaaaatagacatatatctatttccctaaaaagtattattcgaagacagagacgaggaaggttaccaaaatagatggtcaggctcgagagcgcttccctgcaacctccaccgagctcaggtgtgagcttacccgcccccgcctcctcctcagttcacagaaatcagccaccgcatcctgtgctcatacaacaccaacattgaagagctctttgcagaaatcgatcagtgcttggccataaatcgaagtgttcttcagcagttggaagaaaaatgtggccatgagatcacagaagaggaatgggagaaaatccaagtgcaggtaggtttggctggcagcctggcaaccagcagactcagctgcagctgcagaggctgtggggagtggcatgtggggggaggtcgaggactcactttggggagcctaggagtgtcaggcccggggtgcagccgtggaggctgtgggggtggcatgtcgggggaggtcgaggactcactttgggaagcctaggagtgtcagtcccggggtaaccgctgccctagctgcccctgcacctgtggtaggactttcctcatgggctttagggtgacggcaaaggtcccttcagtttgaaattctggaagttcctgttggatgttgcttatcacaggtgggttactaaccctttccacagttcccaggagtaacagagtatatgtgtgtgtatatatatatgtatat

SEQ ID NO: 128539 - DNA, 1341 bp, Homo sapiens
tgggttataagaaattgatctaccaataactgcacaacagagaaagaaaatatccatttcttaattcaacattcatcagaataattactgccctctataaaactgaaatggaattaaactataaatacccttaagttttagccatgataatatttaagatggaaaaaacaaaagaacaaataaaccccacatataaatgcttataaaccaaatatgaaatcactttttgtacaacttttaatttctaagacatttaaaaagtcacactaaaagtatctcatagaaacaaagactaacaatttgtaaacaaaacaatctgtaaacaaaaatcaattactagtgtgtccaaatgttatttttaaaagttaacattataccagttttttcaagtttaaaaagtcggtgctgcatctatgttcacattaaaaaaaaaaacttgtaagaattctgcctttatgcattaaataacgtgctaccaacaaaactagcacataagagcctgtaaatgatgaaaacctgtgtccctggcagacgaggtcatcactgaggctgcagggagggccatgggcacccagcagatggggaggccgcactgccgctgagagcaggtacacgtgcgcctttaacacatctgagagcaaaacgcgagaggctccgtccatctctactaaccagcaccttagtgcagcaatttaaggagctaacattagtgtgtatgtgtgtacaaatttcatgtaaagcctcatatttagaggtctatttttacagagaatgtacataaagctacgtaaatagtaaatctaagaagtatcttggaaaatcagtaaaaattaatacaaatgttataatctgaaaacttataattgtaaaataatttatttaagtattgcagaaccaattaataagaatctgcaagttttccccaagaaactctggaaccatagtgcctaatgccctttaaaatcgatactaaaggagagagaataaaaggactgcttgatgtgacagtcactggtgcatccctatccagtcagaaacaaaactgtagctccagaattgacctgatgatgagcatctgcagctctgccttccagggtctatctcctctctttcactggcgtgcaggaactgcagtaaaatgaggacccccagagcgactgtccttaccaggactcagaacgtttggcctccgtattctggcatccatttctggagttcgtcatataaagcagcctccgacctagctccaatggaagcacctgcatttggagtcagtctctccagaggcagatgcttgggcatgtgctcaggaagagcctcgaggaaccgtgattacgcagc

SEQ ID NO: 128540 - DNA, 3478 bp, Homo sapiens
tgcattttaaaatgcaagtgggaacgtatctgtctcgggttaggttccctgagaagcacacttcagatgggaatctgcttgccaggaagaggtttattagccgggttgggacaacggaagaggaaggggctgtgcagagggaggaactgtgccgtgatgcagtcacactggaagcctccgctggccctcggggatgttgtgacttcgatggcccttcagagctccactgaactgagaagaagggacaggctcttaggaccctcacgtgctgtcctggaaggggcaggacttccgccttgcagcagtcttcagcttaggccatccccaaagggaggttgccagtagggagaagaaatcattcattcctcaaggggatctggccagcacctcacagctttccaaataacacttagctttgtaaatctcctcttctccctaccctaaccctttcccagccactcagcaatatatcatttctcaccattttcttaatttttttgcagggcttcataaacttcacttaccaaatacttcaagggattcagaaacagccaagccttctgtaaatgggcatcagaaagcactgtgagacgcacagacggcgtcttctgccaccaagagacccgagaactccagattcacgacattcctgtcccatgtagaagcatttccattcaaccgtggcccctcttcagaacctagacctatcagtgccatttttttttcataatctacgaagaacttggctatggctgatcttttttaaatttaactttctgatggaccctgtagtttccagttaagtgcagattccttacagacatatagaacagcgcattcttctgtagacatttgctcatgttggtaaatacaatcacccatatgaaaaaattgttttcacctgatatgaaaatgttagaaaaggcaaactccgggacttctaaagatttacttaaatcccattatgtactttattcagaatgtagaagctgacttgaaaggcatccttggtactaagtgaagcttattcagaaaatgcatttttcaaatgcaatggcaactgcttgtagatatcatttttgcagtgtatgttggagctgtaatggttgcaattatgtttcttatttccttaaaagcaaaaagcgtagtttctgatttatgttatagaatgatactgattagactttgagccaaggggaaaatactaaattcttttaaacctggagccttagagagccacaggaatatcttctgttgtacagtctaataagctgtggtaggaagtatcatgtaatcacagtttaatgacagtttatgtatatatataattcagtattccctctgataacatagttgccagtgtttaatacacttgtaacttggatttttaccttataggctatatgtatactcagttttttaaagcatttttttcagagatcacttaattccccatgcttctgcaatgcatataaaaactataaatgccgagtggtagaaactcctctttcttcatagtcctcaggctttggttacatttgcatatgccatttgaagcctccagcttttaccagtttaacatccaaagttcacagcatcagcattcatggtgtaagaacagttttgcagtataacacgatctgataatcattcagttattaaattgtaaataattattgggatggtttcttggctttaagtccactgaataaaaactatgaaattgcactctgtgtcaaccatccactaggatagaataccgaaatctgtgcatgcaaaaataggagatgggcccatttgcacacaattcgtagttatgcagtctgctatataaatatgttcacatgcactgtgtgtatgaaaatagatggtctgtgttcagacaaaagtaaaacatttttttcaaattgttacatttaaaggttttctgggagaaatttatgaaacgcaggctgtgtctatttgacatcagaaatttccactttaaaccaaaataataagaaactttaatctgtatatttacaacctttgttgagtacacttcccccttatttatacgtctgcatttccttccgagcttcacatctttctaaaatgcagcttggttttaaaataaaagaacattcattttgtgattctaaacaagcttcagtaaataccaccagtatagtactggtgaatttctcagcataaaatcgacatacctaaaaagttaataaaattcagctcttttccaatttcattgttatgcctattgaagtattaattgccaggtttgatttttagtgaagcttggagtccatactttgagcagaccaagtgaagggaagaacagaaagaaactcaggagtagagtaatatcacttctcacttacaccactttcaggcacatccaaagagttcctagatacttggaaaatgtctgaaaatttttaagtaaaatactaaacttttcagtgtttagctcaactttttgttcatttggaagtttctctccatccgaggacttaagccagttttggatttgtaagccctgagtacaatacacttcctggaggcatcctcactgctgttgaagcaaaggatatgcatggggtggaaggacggcttcgaacctgggactcatatgccttgagaacaaatagattgttacagccttgggctgctgcgtaatcacggttcctcgaggctcttcctgagcacatgcccaagcatctgcctctggagagactgactccaaatgcaggtgcttccattggagctaggtcggaggctgctttatatgacgaactccagaaatggatgccagaatacggaggccaaacgttctgagtcctggtaaggacagtcgctctgggggtcctcattttactgcagttcctgcacgccagtgaaagagaggagatagaccctggaaggcagagctgcagatgctcatcatcaggtcaattctggagctacagttttgtttctgactggatagggatgcaccagtgactgtcacatcaagcagtccttttattctctctcctttagtatcgattttaaagggcattaggcactatggttccagagtttcttggggaaaacttgcagattcttattaattggttctgcaatacttaaataaattattttacaattataagttttcagattataacatttgtattaatttttactgattttccaagatacttcttagatttactatttacgtagctttatgtacattctctgtaaaaatagacctctaaatatgaggctttacatgaaatttgtacacacatacacactaatgttagctccttaaattgctgcactaaggtgctggttagtagagatggacggagcctctcgcgttttgctctcagatgtgttaaaggcgcacgtgtacctgctctcagcggcagtgcggcctccccatctgctgggtgcccatggccctccctgcagcctcagtgatgacctcgtctgc

SEQ ID NO: 128541 - DNA, 1045 bp, Homo sapiens
agaatgtaggttctataagaacaggaactttgtttcacccctataatcccagtgcccagaataatgtcttatacacacttaatatgtataatataaatgaataaataaggtaatttccttccattaaaaattgttaatctgagtttaatgcttataggcttgtagggtaaaaagacaaagcaggaaatacagtaggatgatctaatatatgcattgaagttacttaaattcacctatacacatttgtaaaagtatttttacttaaaaatagtttaaatagtcattctattaaatgagcacatggccaggtccagtatttactggaaaaaaatacatgaatggtaggatttttctgaccactgacagataaataaatcacatcattcaggtgtcggtcaagagacagataatgggaatgtcaacattcttcaaggaaaaaaggatagagcatttgggggccatataaaatttaaactacaaagaattagaataagtaataacaatcgtctataaaattgtataaataaaattatgtaccttgtattttaagggtgatttaaggatttttatgggtgatctcaagaataactttgactatactcaattttacattatcagttgacctttgagctgaactctaatcctccctccaatgcaatggcataatctactacagatagcctctacaaaagcagcttagagagacaacagaaaaaccaaatacaaacattgtcataaaaacaggagatctcaaaagtagctcttctgtagccacttctacccaggacaaatgtgtttgaaattaaaagacagtaatataccaaaatatttttttaaggtagataattaatgaaaacatacaataaaatagcttttttaaaaaggttaaaatgcagacaccagaagagtacacagcatatgtcacacatggttatgagatgatgacaacaatcttggctacagtttctcagctattcatattaataaaactttactttgttaaaaggaatacatatctaattataagttttatttttcaaataca

SEQ ID NO: 128542 - DNA, 2005 bp, Homo sapiens
ggtaagtttcagtgagaaattttcacttaaagatccatgtttttaaaaactgtctttactgaacttatttaacatttactcataaagattacctttgaaatacagtgtttcttcctacattattttacacttttacttctatactttatgtataggggcataccaagacaaatacttttatcaaataatgactacttattttttaaacacttaaaagcattctttctccaaacaacgggctggtttttgttgtattttgtttttactgacacatctataagttaggctttcgagtcctctagtgaggaaactgcattaaactaatttttctatttaaaagcttttgagcgtttataatttagtatggtttaaaaaattgaaaatttgtaaattattttaagctgctttgtgtccacaaaatagaggtgaacgcagtgtaatctctgagaacacactctgattcaaaggacacccttgagagttcctacttgcctgtcattcatttctgtcattttcttattgtttcagtttacggagaatttgataatcttttaaaagaaaaacagatttttgctttgtcattgaaatagttgagtaagtcttcccttagttgtcttttataaaatgctattgtagaccatattctgagttcttcactaaatattatttcagacaaaagtttccattaagcatttctatctaattctctagacttaggttttgacttaagagtgcacacgaatgattggaaaattttgatcattaaattttagctacttgctcataacaaaaattgctggtaactttgagttgcttttgcattagctctcatattgcctccattatttattgaagacttacagataccagggatgcaggctgtgcaaagaaagtagaagctttgtagttatcttcataattcttacaaaggatttcatgtttgtaatagaaaacaaaaagtataaatgtaaagggaccactgttccataagctaataaaaaactggtgtgtgtaatagtcttatttcttttgtgtttgctttataggacttgtaattgttttgacatctgcttatgtgaatcttgaaaatgccaaaagtatgctctttagcaacctgatttgatgttaaatgttatcatttatattatgacagtctattaaataatttctgttatatttcagccaacctatcattttaatacttaggaaactcattcactgtactattatttaagattgattgctaatcattaatatataccgattttatggaagaaaattacatgctgagtatagttttaacacaaagaaaacaaactaatggtaaaatttactttttgaaggccaacaaattaaattccagagtagtttgccatagagataaataaaaagaaaaaaaagaaagatggaacaattaaaatgcagctaacaaatgcctggacccagctgtccaaacaggattaatggagtgcattagggtacagtgagtcatgtggtgctttgcaaaatatcaacacgcactgcattacatgttatgcccagtggcattgaatagatgaaaagaaataaatacgttaaacagattcatagaggcttttcacagtattaaaaaagcaaatttctagactaaaagaaaaagctttattttagcattatgggaaatgcaaactagagagttactttgtaattcctctattaaccctttagaattgagtctttgattttaagaagataaaatatagggaattgtcatgaatattatcctagtgtataacaggattttgatttaccagctgaaaagcttataagactagaatagaggatgtatttaagcaatcagattccaagctgtgacatttttcagtctttcttgtcgcctctctcaaggaaaccctgaccttagtgtggtctcctttgctcctgtgaaatcagccagcagcgtcccatcacttacaatggaatgagaaatgcagtaacaagaaaaatcatattttatctctatata

SEQ ID NO: 128543 - DNA, 1103 bp, Homo sapiens
tagttacattatttttcagttctagattttctgtttattttttatagatttaaatttacttgcaaaattttccatttatcacttattttattgaatatgttaatcatttattttaaagcatctttctgataaatccaatacatggatcacctggaggtctgtttccattgtctttttttttccctctttttccatttatttatttatttatgaaatggagtttcgctcttgttgcccaggctggagtgcagtggcctgatctcagtccactgcaacctccacctcatggttcaagtgattctcttgcctcagcctcccgagtaactgggattacaggtgcatgccaccatgcctggctaattttttgtatttttagtagagacggggttttaccatgttggccaggctggtctcaaactcttgacctcgtgattggcctgccttggccttccaagtcctgggattacaggcgtgagccaccgtgcctggcctctttttcccatatctggtaatgtttaattgaatgccagatatttcttatacaaaactatagaaactctgcatggtgttttcttctttttgggaggatgtacttttgcttctggtagacagttacggtagggacgtatcagtctaatccattaggcttgagatcattcaaggccaggcttcagtctttatgacgaccggtccatttccactttgtccttccttcatactaggatatagcttttcattggtcctaattgaaagcctagttcattagttattgactatgacctcattttcttaatgaattttagtttttacctctcaagaaacatgagcctgacagaagctttgcttggcttctcagcctcatagttgcatctttctgttgttcttcttggcctcttagccactggtgtcttgaagggaaagtggcactgtctgccaggttcacttctttgcccttttcttttctgtatgatcatagcctctcaagttttgactgcattggtagccccaaatgccaatgtctgtcctcttggctctgttgagtttgctgaaaggtttgctttagaatcattgccttttacccattgatttctcaccctcttggg

SEQ ID NO: 128544 - DNA, 1038 bp, Homo sapiens
aacttttgacctgcccaaaatcattaataaagactatcttacagtttggggagaggataagtttacatttattcactttttttggttttatatatatacaaaatgacttttcaaaggttcacaggttcaaagatgttgctccattgccttctcacttgcattatttccaacaagtcatctgtcatacttatcttttaatgtgtcttttttctgtatctgcttttaagatgtctttattgttgattttgaacaatttgattgtgatacgcctcagagtagttttcttcatgcttcttagagctaggaggttatagttttcaactaatttggaaattttttgaccattacttctccaaatattttttcttttcccctcatgcttcccttttcagggactccagttacatgtattttaggctatagctgaaggatgttcctttatttttcagtttttttcttgctgtatttcattttgattagcgtctatagctgtgtcttcactttcaccaatcttgtgcatgtctaatctgcctttaatctcatctagtggtttttgctttttttttgtttttctaccatctgcagttttcatctctgggggcctgtttgggcctgttttgtatcttctattatgtctctaacacgttcaatctgtgtcctccctctttgtgaaaatatagaatatagttatgacaacacttacaatgtttttgtctgctacttctaacatttgtgttagttcttgatatgttttgattgattgatttttttacctcataatcactggtattttcgtgcttctttgcatgcctggaaacttttgattagaaaataggtattttgaattttaccttgtcaggtgagattttacccttgttgggtgcctcacttatagtatttctttttgttttgttttgttttgttttttaagacagagtctcactctgtcgcccaggctagagtgcaatggtgcgatctcaactcactgcaacctccgcctccccggctcatgtgatcctcccacttcagcctcctgag

SEQ ID NO: 128545 - DNA, 1052 bp, Homo sapiens
tcactttggtgtggggtaagttactcagaaaagcatccctgtagggctaggactgtgtgatgctgatattataatgaaaagtatatctaagtatgagtattaaaaatgtgaaagtaaccattgaactgccaaattaacatgggcaaaaaggataaactaaagtttcactagctgggaaagaagaaaatgaagaaataaagaacaaatataatgagcagaaattacagagttacataaaaagagaaagagcaccagtcttcctgtcaacttgaggatggcagtacttttagtcccttgatgtcactgttgagctgctggaaaatcctctttgaagtttgctctgtgtctaaacttctcattatatgaaattatttcctcatttttaagctactttgagtttagttttctgattcagtatatagtgtcctaatagatacacccccttttacggatgaaaacactgaggttcagagaggcataaacctaaaaagatgagaagttgagaggagaaaatcacaataaaattttggaatttagaagacctgagaaaatttagcggacttaagtaaccagtttcacagacccaaggaagctaaatcgtaagtcatttgtgcttgatttataaatttataccccagaatccccaaaagtcccaaaaagtggcaccaccagacgaagtagagtgagctacttcataagagaattgattggaaatcctgtttatataatggtttgattgccacatcttttcgctccatccaaggtaccaattttctaaaggtttgtatcatgaagggatgttgaattttatcaaatgcttttcagtatcaaatgaaatgatcatatggtttttgtccttcattccattgatatgatgtatcacattggttgatttgaatatgttgaaccacccttgcatctcggataaatccaacttcatcatgaatgatctttttaatgtgttgttgaattcggtttgctagtattttgttgaggacttttgcatcaatattcatcagagatgttggtctgtagtttgctttctttgatgt

SEQ ID NO: 128546 - DNA, 1710 bp, Homo sapiens
aaatgaggaatgcttaggaataatgaactatagaatgagttaaatatcatatattttatgaaatatatatatagagagagttattctataaaaatgatccaaattggctgggtgcagtggctcacgcctgtaatcccaacactttgggaggctgaggtgggcagatcacctgaggtaaggagttcaagaccagcctggccaacatggtgaaacaccgtctctactaaaaatacaaaaattagctgggcgtggtggcatgcgcatgtaatcccagctactcgggaggctgaggcaggagaatcacttgaacctgggcagcagaggtcgcaatgagccgagatcatgccagtgcactacagcctgggcaacagagcaagactccgcctcaataaagaaaaaaaaatccaaatttgtgtagtagaagatgaatttaatatacccgagctactttctcaactacaacttagataggtgatggtattcccaatagtagcttatataaacataaaagtttaaaaattatcttaacatcttatctagtttagatctagtagcttatatctaaagtagaaaaaagccaaaccattgttttaattgtacctagcattatataatgttcctaaagttgattatttaacaatttctatcttgcagtcattagtaatgaaagcatatttgcattttcacagttttgttggatctcaaaagtctcacattactaggtcaatagccatatttttgtggatatgtcagaagtaaaaagaaactattattttaataattattagcattgcaagtggaatagacatagatacagagttttcgagtatatgggctgactctctcctttgtagatagtaacagtgttagttcatgctgaaatagatacattagagatttgaatgtcctggcttcagttttcaaatgctttctggagtttgcctaatcagcattggctctgtggtgtacagtaagtagtgtttgcttagagagatggaaactgtttgctctgtgaattattaggagatttgggctttaacaacaaagttgtttgcctaagtgattagaaataatttatagtatttgagtgacctcacattctttgtgatagagatcactttggtcaaatttaaagtaataagtataatcaaatttttaaagagcttcttggataatattttctaatcaaacttttttttggttatatggtaaattaaaagttaaatgtaacatcaatctgtttatgttagaggtatctacttccaaatagtactcattatgagactaagtttaggacactgaattgtttagggagataattgtatttcatcaattatttgaagggcttgcagatctaattggaaatttgtatttgtttttaaaaatacattttatattttaagttaaatacttagtacctctccttttatatatgaaggctgtcttatatattaagaaagttgtaaggacagcttagttattgaataaatactggactttgggaaattctgttatcttggaagcaaaatatttttaataccacactagtttttcagcttaagaataaagctgggaaaagttgccttcagctattagttttcctgaatccaaagagacgggtggggcaggatcaaaaatacttacttgatcaaagttattggctctgaagttattcttacctatgtaagaaagatgaaaggtgttgttttt

SEQ ID NO: 128547 - DNA, 1016 bp, Homo sapiens
tcttctttccttttttgcttattacggatcttaattaagcactagatattgtgtagatgaattaagacgctgagtctcgagatcataggctagttgcctgaagaagaagagaaaaaaggacaagaatttgtaagttttcatctagtgcttaactacttgaaaaaaaggaatagagaggaaggagttctgtgtttctgagacaggagggagccccagagcacctgtcgtttggctaagacagcgcctccctcatgtccctgttgtcatggcaggagtagagagatgtccacagagctcactgtgatctcggcaggcggccttccccttccccacagcacacagcctcccctctgccgtctgctttgggactgtcaggactaatgggtacattgtgtccatcactcctctttatcatggtcagcacatggagcccagaacatccaggttccttgcgccctgtgtctctatacatcccatttctgacctgattttccactttcctctagcttctgaaactttctgcttgtgccatttggaactgagaattaactcatgaacaaaacccctgtatcttcaactgccactttcttgctcaaagaaacttggcacacattcctgccacccgctcatgtgatggctcgcttctacccacatccctcatttggctggtcctggagtttgagtaggtgccctcctgttcccttttactactctccagcactttggatctcatgtcatcagaccatgacctagtcctgtcatttgctcacctcccaggccttttctgctcccttctggaggatttttgctcctcgtttctaatccttctctgattctgtgcctttttcgtggtgatttggtgtctgtgtgcatgtccttcccatcactccaggacactccttgcctgtccctgtggttgtctgcctcacccgctcgtgcctgtgacataacccatccaagttcttttgcataatcttacaatcaagcatcctactctccacctaccacttctcctt

SEQ ID NO: 128548 - DNA, 1778 bp, Homo sapiens
gtttttgttaattggtttctgttcttcaaattccgtggagacattttttctccctccagacaggttttgctaaagggttacttcttggttttctattttagatctttttattgtacaatttagaaattatatggcttaataaactaaaataggcaattacaatgtttacatgaggtacagtcagcctctatcttatcgtaagatagactgactatcttaatgtgcagtattttggatttattaaaatatatttacttttttttaatagatctctgggagttctatctaccctatttatattcctgtatatcattgatgggatgtttgttacttctctgtaagtatttttcagacttgatattaagagaaaagtagagttgtccttattctggaaaattcagggaagttttctgatgagatttcttaactatttggattttttttgagttcgccttaactatttttattcaaaataaattttgataaatggaaactttgaaataataagatgcttttattgttctctaaggaaagcttcttctactgggttgtagagtgagacagacggacagacacacacacacacacacacacacactcacactcacacactttcacacactcatatacagtcatacttacatacactgacacacaaaccatgtgcacactcatacacacatgctatagcctcacccccatacctgtcataatgctagattctacttttaaatggaaatggtagaattatgtatgataagtttgtggttttttaaaagtttgttttgttttacttgaagcatcacagcctatctcagggataagtagataaatgtagtttaaaggacttaagactatggttgtcacctttagatattcttgtttgtttctcagtcctattaatacttgaaatttaacctgttctttgctaatttttctttattttaagcaaaagtatttattattattcaactgctagaatcttgaatattattctaagcctttttttgttgtcacatatctttcataactaattacacctatcctgctcacatggcccctctagcttctttattgatgatggtgaagagttctctgacaaaacactgacaatctcagttggagagaagaatgttcttaaaatgataatccttgaatttcccttatttttacagtctagttgtttatctctttctccaagctctataatgtcgctttctgtcttttggtgatcttatttctgcagtgtgtacaccagttggcctttctcgtatgttcacagtgatgggtcagttgctagtgaagccaacagtaagtatttaattataaatcattttgtttattaaataaatgtgtttacatttgattgtctttgatattgtgagctagcatttagaaatagaagaagaatatgttttgtatgtttatcactcaaattgttgttttattaagttttttttttttttttgagacagagtcttgctctgtcgcccaggctggagtgcagtggtgcgatctcggctcactgcaggctccgccccctgggttcacacctttctcctgcctcagcctcccgagtagctgggactacaggcccctgccaccttgcccggctaatttttttgtatttttagtagagacggggtttcactgtgttaggcagggtggtctcaatctcctgacctcgttatctgcccacctcggcctcccaaagtgctgggattacaggcgtgagccaccgcacttggcctattaagttttttgtttaatagaacttt

SEQ ID NO: 128549 - DNA, 1057 bp, Homo sapiens
ggtggcaggagagagaatgagtgccagcgggggacatgccagacgcttataaaaccatcagatctcatgagaactcactcaatatcatgagaacagcatgggggaaaccacccctatgattcagttacctcccactgggtccttcccacgacacatggggattatgggaattacaattcgagatgagatttgggtggggacacaggcaaaccatatcagcatcttaaatagtttgaaagttgtgaagtggaagttcaaaggactcttcagtaaagtagtagtgtgttttgtgactattcacatttcatctcctgtgattaatagctacttactatgagatctcatgtgttaaaatacaagcctaattcattctggttcactggcctcccatgctatgaacacttaaggtgagctgactctcagatttgaggaagtgttttaaacttgccaaatgcagccttgtggtaagtctgcgatattgttgaaggactagtaagaaaaagtcacttcacctcagaggttatcatttagggctaggtatacctctccatgcttttaggacgttttctttcctttctattgaatttgaagaactggggtgccgtgattttaatgcatcctattcctgcaattcagaaactagaaagtaatacttaggacaaaattgaaataagtgtatgttttggaattttataactcatatttttatgttaaatgtggaatgagataacataatttattgagaaatatggatgtatttataattttgttggttgtgttagataattgtaggttagtgcattgcagtacaaaatatcaatatgatgctttaacttataggtgcagattcaatcattgggtgattttttggggagtaaaagcggtttctttttttgtcttatcctgcagtttttaagttttaaaagtctggcctttagtttggtcctgaagtcagaatttgttttacatttaaaacaaagttgtgcataatgattatattattatattcttgtctcatggattaatgaaaattctatataatgtgaagaaaagcatc

SEQ ID NO: 128550 - DNA, 1007 bp, Homo sapiens
tgcgcacaccttgcccattgatagaggaagactgtcagccttagctctgggcagaagaaagtctcccctgcgagctcatctgtaggcgctgacttcccaagagtttgcggctaatattactatagatacctgtattgttggaaaatcctaagccaagaaaatagcattaaagttgattaaaaatgttatgtataatttaatcattttaatcaaatatatattaggtaaattttgattagaaagggtatatatataaagatataattaaggctggttttagaaagttgatttattataatttaagattcataatatatatgtttgacttggtcctacttaaccatgtcacatgctgtttaattttctttaaattaattgtgtgagaaaactcaggacttgataacaaacattatataagcaggcccaaacaaaacctgattttgttttctgctagcttttctacatttttacacttcaactaaactcttagtaatttgatagttggtttcactcttcaagtgttatcattccttcaaagttgggatgaataatatagtctattctattttggctactttgtccttgagttttgcaaagatctaatattttcgtctacctgtagctaattttgtgaggtggttaaaaagagaaaatctaagttattttctctctgtattactattcagttattctagagcaatttatacaataacgttacccttacctatgatttcttaatattcttacctattattaaacgtatttttgaacttcttgactataagcttgtagcactgggaatcactgctaacctttttcttcttttttcccctccctccttccttccttccctccttcccttcccttcctccttcctccttcctccttcctccttctcttcccttcctccttccttcccttcccttccctacctccttcctttcctccctccttccttccttccttccctcccggcctcattccttctttccctccttcacagcctc

SEQ ID NO: 128551 - DNA, 2040 bp, Homo sapiens
atggatcagaatgattattttgaaaatactctattctgataatgctgtgatacttcagcttccttttggaattgttttactgtaaaggtgtggttataaccatgtaaagtgagcatttgaaacatcaaatctgggcgtatgggaactcagaaagaaataggaaagtattattttgaggaaaagagtaaatacatttatttcatttaaaaatcattagaggttataaaaattttgaattgaaaatcatttagttcaggaaatgacattaattttgtcactgttcttaatacagttggatctaggagggcactaaattatggctttatagtatctgttactgttaagtaacagctttttttaaaaacatcactcagtttccatatacactgtaatggtatactttgaattgaaccctatatagtatgttcatctttgcctctcagtattgaaaaatgataaatttctatacttaaaggctagattgtctctttatttgcataacagtggcaaaaaatgtgaactttggaattcagaatacctggacttcaatcttcactcttcttactgactgtgacttagggcatatttcattgtgtccacatttataaaatgagtctaacagtacctgtctaccagggttgctgagggatttagtagcctcacctaaaaggttggtaaagtacccaagacacattttaaatagcagttattattaggtgcttaaatgcaccaactatgttaaagctgatgatgaaacatcaggagaacttgtgtaggattactttttatatctaacagcaaagtgacatgaaaaattacattggtattgacatattcagcttttattttattttttgaaataggatctgttttagaacagtataggttgtaaaaaaataggtatttgtttaatagataactaaacttcaaacccttttatatgatgattaaattactaactaatgtctcataatgtttgatagttcaggcctctgtttaaatgaagaaaagctttggcagagaggaaacagaaagttaccaagtacagattttaaagtaattatactttaaattaaactggctgtaatactactccaatactcatgaaacagttttatagaaatagtcattgttaattagagtatcttttctaaaagtttttggggggaatagaaaactactcacccttggttggaataaactttatttgaaaggaaaattaaatgtcagatttagtgctactagagagcttcttaagtcattaggataccacaggcctgcaggacaagagctcaccagagaggctaggggttgaattgttacaatcttagatttatttggcacttaagctcatatttattcatgtataaaatcatttattcagtgggtcacaatgttgatctttgatctatgaaacgtttgtcaatatataactgaaccttggtacattaatttacagtccatttatttgtcatttagtataccagaaatagaagttgtgtatttatacacatcaaaggcagtaagattgtttgatagtttgacgttaggtaatattttagcctgtgataaatctacttttctttaaaacttaagtcactaacatgatacgacttaaatatttattggtttgcacattttacgttaaagaaaggaaattctcatcgagaaagacaaggttgtattgttctgaagtgactgaattctaaagcaaccgaaacattaaaaaatatgtatgtgaatgtgtcttcttttagggattaaaaataagatcagcaggcaaaaacggaaaaaataaggacacactaacagtagaaaaagttaggattcaatatattgaaatgatcagttttatggaaaacatttattctattcgtagcacagaggaagaagaaattttaagttgttttataatgctagatttatttatttatttatttttagagacagagtcctgctctgtcacccaggctggagtgcaatggcgagatcttggctcgctgcacctccatctcccgggttcaagtgattctcctgcct

SEQ ID NO: 128552 - DNA, 1071 bp, Homo sapiens
tatccctaaatggcatatggccccactctactcccatggattcccctgggcaatcgatgttcaaacagcttcttgcatattgtgccgagatgcggaaattggccactggccatgggcggatgcagagcttgaattgaaaatcaaattaagcagaattctctacttagtttttaattaaaccactatgttaattcaaacaggacatattaggcctggggggttgactatgtccttttaagggccttcaatagctttgcttctctcttcttaccgtggcagcggtgtgtgtttctattttattaggaccatctccttgctattcccttactttataattctgaagtgtaagagcatagaaatggttttgataaagtaaaagtttttttttagtaagcagctaacttttatcttggaatttagacttattattagcagttaaatgtttaccaaatttagattattttgctgtcacctatgtgtattgagctttaggtatgttcataggtatttgaaagtgactccgtttacatcttaatttttcaactgataaaaaggttccatttggtgatttttgttttgttttgcagtaagcctgctttttctgcagtatgtggctcttagggctcagggaacatcttaaggcagccatcactgctgtgcttatcatacctcagattggctgtatgatttatctccctcctccactccagaaaagacctccaggttatctggattaatatcagagatgttttctgattttgtaaggaactctggaggtataacctctggccagtgtttaaatggtagttaggcatatatttgttttatattatatcttaacatcttattttgaataaaaatgtcaggaggaaaaaaaattcagcaacttaatgaaagtgggagaaaatatctccatatgattgttatgtaaaatttatgacagattaattcataaacccaagatttttctgggagtaaatttctattgtacttaactttaatgcctatgtttgatttgaagtcatagcataaaaggtaacataagcaacatcctgaccaattatccaaacc

SEQ ID NO: 128553 - DNA, 1001 bp, Homo sapiens
ttttaatttacatatggtagttttattaatcaggattttgttaattgaaacatcccattctctatataccatactacttgatttaatgagatttaaatttggatctatgctgaaacaaatacagtgctttttgaaaattgtttctgttcaataattgccttttaagtttatattgtgtttatagttttaataaattaatgacgcattttgttagaagataaaggaatattaataccttaaacatttttgcagatgaacaagaagatgaagatgccatcgtcaacaggatttcgtatgtattttaaagttcagttgttctgtttctgattctgaagtcatcaattctcaaaatccaattctaatttttggatagaagtatggaaaatattcacccagcacattacaatagctttatcatattaattttagaaagcacatgtaagcaaatatgtgtggataatccaatctcctattggaatttgcatatttaaggagctgacagattttatcctcaggggattaaatgaggaaatggccttaatttaattgcttggtcataagaaagaagactcttggctgtttgaacagtctgctgagaagactatgatgctcttgaaccgagcagcggacatctcctctggttagctgaacctgcctgctgtgagcaggaacatgggcccagaccgtcctgtaggttccttatgtacaccggtgagatatgatagggaggtcctgtaattttattgaagtatcaaactgaatggaaagcagcgaattcctttctgttagtttttgcttgtttaaatgtgaaattgcacagatgcacctatgtaggaaagttctgtattccaggatttttttattgatacattaaaattcttttgaaatttcaagtttatagaaaaggtggaagtagaacacaaagttttttttactccaactgtttagaagtcgctcatctgatgcttcatttcctcaggatacttttatgtataattcca

SEQ ID NO: 128554 - DNA, 2488 bp, Homo sapiens
tgtaacgagatctcctgttgacccatccttttttgtcggtctggcattccccagatctgatagaaattcaattgaaattaaacaattaacctgattaaaaaatgggcggctgggcacagtggctcacacctgtaatcccagcactttaggaggctgacacaggtggatcacctgtggtcaggagttcgagaccagcctgaccaacatggtgaaaccccgtctctactaaaaatacaaaattagccaggtgtggtggtgtgagcctgtagtcccagccacttgggaggctgaggcaggagaatcacttgaacctgggaggtggaggttgcaatgagccaagatcgcgccattgcactccagtctgaacaacaagagtgaaactctgtccaaaaaaaaaaaaaaaaaaaagcaaaggactagaatagatatttctcaaaagaagacatacagatggccaataggtatatgaaaatgtgttcaacatcactaatcatcagggacatataagtcaaaaccaccatgacctatcacctcacatctgttagggtggctgtaatcaaaaacacaaaagataacaagggttgatgaagatgtggcgagaagggaacccttgtacattgttggtgggaatgcaaattagtatggccgttataaaaaacagtgtggggattcctcaaaaaattaaaaatagagctgccatatgacccagcagtacttctgctgggtatatatccaaaagaaatgaaatcaatgtgttgaagagatacctgccctcccatgttcatgacagcactgttcacaatagtgaagttgttgaatcaacctaagtgtctgccagcagatgagtggatcaagaaaatgtagtgtatatacacaagggaatactattcagctgtaaaaaagaaagaatcttgtcctttgcagcaagatggatgaacctggaagacattaattatgttaagtaaaataagccagacacagaaagacaaatacttcatgatctcacttagatgtgaaatttaaaaatgttgaacttttggaaacagtgagtagaatgatggttgccagggactaggggtgggggcttggagagatgttggtcaaagggtacaaaatttcagttaggtaggaggaataagttcaaaatctattgtataacatgaagactataataaataacaatgtattatattttgaaaatcactaagtagattttaagtgttctcatcacaaaaaattataaatatttgaggtaatgagtatgctaattagcttgattgagccattccacaatgtatcttattttaaaacattttgtacacagtaaatatgtataacttctatttgtcaattaaaaaagcaaaattaggctggttgcagtggcccatgcctgtaatcccagcagtttgggaggctcaagtgggcagatcacttgaggtcaggagttcgagaccagcctggccaacatggtaaaaccccatctttgccaaaaaatacaagaattagccaggcatggtgttgcctacctgtattcccagttactcggcaggctgagatgggagaatcgcttgaatctgggaggcggaggttgcaatgagccaatattgtgccactgtactcctgcctgagcaacagagtgagatcctgtctcagaaaaaaaaaaaaaaaagcaaaattaaaaatacagaatttaatgatatcttaaagaagtcttttcttcaactgccttttattttgatatggggtatatctattgaataattatttcccacctacattgatttgtgattccatttgtatgttaaatttttatatagtggaaaatgtttaatgtatctgtcaatttttggtgctggcacattctttaaatgaattgaagcttttgataatgttttaatatttggttgtgttagtagtttccagttgactttatttttcagagttgtcagtggtgatggtctgattcttcacatttccacatgattttgaaaaacattggatcaagttacggaaagaaaagtctccattgggctttttttttttttcaaatggtattaaatggggctaattgactagttcatataaattaatattttattaacacttttttttttttttttgagatggagtctcactcttgttgcccaggctagagtgcgatggtgtgatcttggttcattgcaacctccgcctcctgcgttgaagagattctcctgcctcagcatctcgagtagctgggattgcaggtgcaccgccaccatgccctgctaatattttttttttttgtattttttagtagagacagggtttcatcatgttggccaggctggtctcaaactcctgacctcagatgatccacccgccttggcctcccaaggtgctggggttacaggtgtgagccaccatgcccagcctatgttttattaaaactttaatgagtaaaatgtccagcattttaactttttagtagtttaaatccttttttcct

SEQ ID NO: 128555 - DNA, 1291 bp, Homo sapiens
cttcttttttctcttgcatcaataatttttctctctactggattattcatataatcatttgtaatgcttttcattttttaaaaaaacacgtcacaatcccttcacattttctttgctcctctttataatcaaactcctggaaagttctgtgtacttgcatttctgtttccaactattcttctttcttaatctgcctcagggttttacctccactactccatcaagataactcttgtcaaggtcaccagtgacctccatggtgctaaatccagctgttaattcccagtcctcatctttcttggcctgtcagcagtgtttgacactgtcgatgattccattttcctaaataaactttcttcatgtggctttcaagacatctagtctcttggtttgcctcctcccttgctgactgctgcttctcagtcagcttttgtgaatccttctgccaagctgatttctaaatatttgagagctctaggtctctattctcagacttctcttctctggctatacttactccctgggatggaaatctcgtctagtctcaggactttaaatatcatctgcagatgattctaaggttttaaaaaatttatggcctggccctttcttctgaatggtacagatttttatccaactgcccatccagcctcttgacctgagtgaattatatgtatgtcagattcaacagtgttaagctatacttatttctccctcaaaactactcctcttctaatctttcctgagtcctgaaatggcaactctgtctttccagtttctcaggcaaagaaccttatatttattctagcaaatcttatcatgtctgctttcaaaacgtgcccagaattccatgtcttctgagcacctccttgcacaggtccgagtggctgctctcggcttcctgcagttctttgttgcctgctctccttgcctctgtcctggcccttttccagtttcttttctttttcttttttttttttttttttttgagaccgagtcttgctcagtcgcccaggctggagtgcagtggcacgatctcggctcattgcaacctctgcctcccaggttcacgccattctcctgcctcagccccccgagtagctaggactacagacgcccgccacgacgcccggctaattttttttttttgtatttttagtagagacggggtttcaccatgttagtcaggatggtctcgatctcctgacctcgtgatccacccgcctcggcctcccaaagtgctgggattacaggagtgagccaccgcgcccggcctccagtttattttctg

SEQ ID NO: 128556 - DNA, 1053 bp, Homo sapiens
gcccttcccttcccgcggggagggctgcggtgcgcgccgcgctctgggaccccaggggcttcctctctgggcgggtgtgcggctcgcgcctcggggtgtggacggcggccccgccagtgcgcgcccccgcgctccgccgccaggccaggtaggcaggtggatgcgcaggcgtcccggagagcctgggtgggcccggcgggtccgggaagggccgggctgcgcggagcccgcccgcctctcgcgtttggacccggccggttaccttgtcccggtcaacacctcctgccctcctggcgcctcacgtttccatccctctttcatctcccccagcccccacgtgggttgagttcgaaaccttaccgtttgggatgagaatattggttatttttgggagtgaggacctcagcaaaagtccattttgctatggaagcaacttcttagggaagcagcttcttttttggcccatgttccatgtgtgctgttggcaggagtcaggaagcggacttgaccttggaaagtctactttgatgtttttatcttttcatgatgctctagaatgtattgtaattgggtttatctgtgttttcataactgttgtaaaatatgtcaattttttatgtttatatttacgcctctcctaagttgtctacgattcagtcacacttggtttgaggtgaaaaaattctgctttagaattatctaatttgtgtactcactgatcttgaaaattgagaatcactttggaagtcatactttgaataaagaggacatataaagtctgagctggtggaatttgagttagtggaatttggtacacatttagttgtaatttttataattgaagctaaaatacacagagataagttcatgtaatcatacatgtacccttcagatcatttcatactaaacacgcctgtgtactcctgaatccaccaggagtttgagactggtcagcctgggcaacatagtgaatccccatctctaccattataaaaaaataaataaataaacacaattttactaggatcccagagactgattcctttccctctt

SEQ ID NO: 128557 - DNA, 1812 bp, Homo sapiens
agacataggtgtgtttttaacatcatttttaacagttttatttttccaaggagtcagaatggctgctggccaaacagtgccccttggttgttgattttaacaagaggaaggtgcccttgcgtccaggctggggcactctggccggctgctctgggttgccgagggatgccttgttggaatgccctgccttgtggcactttgttaatttagaaagtgccagttctgtgtgttgaaggagaaaggaaggtttctaggaataacataatcttttttctgtgtggttctttcaggtcggtgcccactttctggaggcagtggtgaggaagttcgatgccatctataaatacggaagcgaagggaaagagtgtgacaacctgttcaccgtcattgcccatttatacaacttccacgtggtacagtctctcctcatcttcgacattttgaaaaaactgattggaactttcaccgaaaaagatattgaactgatcttgttaatgctgaaaaacgtgggtttttcattgaggaaagatgatgctttatcacttaaggaattgatcactgaagcccagaccaaagccagcggggcaggcagcgagtttcaggaccagaccagggtacgcgtgcgacgcttgatctgcttcctaagtccctaaagctcacaaactggccagaacctaaaaatcagtatctggggtaaatattacacttgctttcctagtgatttctgttttttctgtctcatcctgttttctggctttaatatgtgaatggaccttattcctttaccagaaaaatattttgtgaatttaaaaactgatttatttaacattcatccgttaaaaaatgcttaccgaggaggccacaggacatggggctctagggtcagcctgggttggactttgggctctgccacttgacagcagcataacctgggtcttctgagcctcagtttccccctctgtaaaacagggactgatcacagctcccacattgtgtgccgttcagatgatgagatgtgtggaaccgcgtgttcctgggaagccgtttggggaagaacccgaaaagggttagtttgagagcctggagggggcatcacaagagaaaaaggcagagttcaggtctctggtcccttgttaattactgcagggaattgagggttttatcctagaggcatctgaagggttccagcaggtgaatgacaggttggagttttccttctgatggtcactttgactccaaggcagaaagaggcatgaggtggtcgaagtcaggaggagttttgcaggagctggggagtaggtggtggcaaatgttgggatcgtggcagtgggtgtggacatgggcgtcagaagtgaccagacctcatgtggattgggatgaagggaaggagggctcagggtcacccatcaggggcacaggggaccgtgcaggaggagatgaggatttaggacaggcacctccatttttgaaagactgggttagctgtgaacagagtgggctgaagggatatggggctgctctcgtagagggggtcctgggagccatggaaatgggtggacttgcctggcagcaggtgggctgtgaagaggaccttcaggttaaggagcactgacgtctagctgcaggcaggagggagagctggcaggtgagaaggaaatgaggatggtcccaggagccagggaacactagtgtccccaggaagaattcacgcccgtgtgggatgctgaggaccagcaagaggaggaagggatttgcattttgggctgaattgtgacggcggtcctgactggcttatcctggtccccggagaag

SEQ ID NO: 128558 - DNA, 1783 bp, Homo sapiens
attacaaggccagtggtaggagagaggatgtccagagcaggtcgcggggggccagggtgggagcaggagcgtagtagaggccggggtggccgagtaggtgtggacggtgcggaagggtgaggcgtgtggcgagcagaagggaaaagagatctctggggagtttgggttcccacttgacgttgggggacacatttccattttgaagtattatgtagccctgagtaagcggctgagactagtttagactgtctctacctaaaggctgtcctgactttgtatcgtggcggtggcggccatgtgcatcaggtgtggtagatttcttgccaacttgaatgggccgtttagactgtttgaaatgatggactttccattttttcatttttcttgaagattcggtttatgctagagacgatgttggccctgaagaacaatgacatgcgcaaaattccaggctatgaccccgagcccgtggagaagctgaggaaactgcagagagctttggtgagtcaaggaactttcaattctgttttgctcagagcttccgtgtcggcatgagcctgtcatgaaaatcaagaaatagtcagacctgcacgtcagggtggtgtctggtgagtgagagtgctcagaggcagagtgaacgcggctcggttttcctcaggggctgtcccagtggtctgggcgtgctcgtgcagaatgtccgtgtgtggggaagcccatgttgggcgagcgtcctctttgcctcaccccgggtgctaaacttgggctgcaccattggatcatccgatgctttcagagaaggccaagtccccatccggaccaaggaaattgggatgacgtaggtcctttgactctctctgacatgcagccaggatggagactggggcagcctccctgttggagtgagtctttcagcccctgtcatctcaagtccaaatcattgctgacccaggctcttccaggcatgtgctcacctgccactgagcctgaggcagctctgttactctctcctgttgggacagctttccaaacacagcgtgtttggggtgatggactctcaaacacaaaacactgagtttaccgctagttttggcatttttccaaacaggctaaccgtcccaattgccagtgacccattccagtattcatgcaccagaaatgtcatggtcaaaaacaaaaagccaccggtgatggaaggacggaatatgaaccaattaaaagcatttcattagctcttctctcttcatcaggtccgcaacgccggctcaggttctgagacgcagcttcgcgtctcctgggacagtgtcttgagtgcggagcagacgggtcgctggtggattgtggggtccgcctggagtggggccccgatgatcgacaacagtcaccatacgcacctgcagaagcagcttgtggggacggtagggacacccatgctcaaggctgccaggcagaggcacccccctgtgtggtgtgtggtcctggctttacctggagcagctctcttactgttcttgaatggtcactgaaatgtacaaggtttatctggaggccttacagaaattgctattaatattacattgtgatataattattccatttctgttgtatctttttattggactttaaaagatctaaaagttgaatggcacggggcaggggagcgcatgaggacctgaacgctcacggggcaggagtccgttgctgagacccctcaggctgccccccgggctgtgcattctaggctacaggctatggatttcacattgtggaaattcaagcccatttt

SEQ ID NO: 128559 - DNA, 1656 bp, Homo sapiens
ctagggcagagatatatatggattagtcttctagaagtaaattttatatatatatatatatatatatatatatatatatatatatatatagttttaattaggggatgggtacttttgggaatggaggtaatttatggttcagttctagatactgaatttctgattcataaggtgtatgacccgggaattccacttacactgctgagttgttctcaacggtggctgtggccggccacacctctgccagcagtgtgtaggaattcccaaggcccacatccttgccaacaggtgttcatttcttagctctggaaatagcttcttaaatcgggtagagtgggggaaggggggagattaatttttactctaattaactatattacaaatcattgaaaaagttggctaaatcagtgtaactttatttttctccatgtcctgaccattaggtagttgaattcagtgaattggacaaacccagagtccgttttttacgaaaagtattaagtatcctattaatggaaacagaagttgaagacctcagtttaattttcacaaggtatgtgccccaccctttccgacgagacatggaagagaaatgaagagattgttttcacttgtgttgatttacaaacacaaggttgtactatacgtgtagcttaatcttttcggttttatttttaagctggtatgcattagatctggggaatagaaacttgtctgctagcaaactaacaatgattgttaataataaaatatgttaagaagttcttaattgagaattttatttttaaaagaaactggttatgtctcactatgcgagatacccaggattgagatctaggagaggccagctcagccctgacatgtgtttatacgattcctttccagagtatctgacaacccaaagctgggggtgttacgtgagggtttgaagcttttcatcagccacttcttgctaaagaacgcacaggcccacagaagcgccgacgaagccaacgtgctgagagagaaagctgaccttgcaacgaagtgtctgcaaggaaaagcttccctgagaatgtagtcagggaaggaaggagggcaggtggccctttgactgtaaaatgtccttggtaaacccaaaggcttattctgttgcctgcgtgtgaatgtttggtagagctatatcattgtctgttaatgtattatattttgagattttttttgatctaaggttttattgtttgtatttcaagccattttcaaataactatcttgggggtgagaggagaaggagggagggaaaaggggtcaggcacactggacagggttctctaagcagtgaggctggtgtgtatgattgtcttaaaattttttaatagatatggccgagcgtgatggctcacccctgtaatcccagcactttgtgaggccaaggtgggcggatcacttgaggccaggaatttgaaaccagcctgggcaaaaccctgtctctactaaaaatataaaaattagccaggcatgatggcacatgctggtaatagcagctactgaggtggctgaggcacaagaattgcttggaccctggaggtagaggctgcagtgagccaagattgtaccactgtactccagcctgggctggacagtgagacttttgacagtgagactgtcaaaaaaaaa

SEQ ID NO: 128560 - DNA, 1004 bp, Homo sapiens
gacagggtctctctctctctcgcccaggcagtgcagtggcttgatgttggctcactgcaacctccacccacaccccgcaagttcaagtgatcctcccatctcagcctctcgaatagctgggactaccgatgtgtgccaccacgctcggctaatttttgtatttttttgtagagacagggtttcaccatgttggccaggctggtcttgaactggacctcaggtgatctgcctgcctcagcctcccaaagttacagacgtgaaccactgtgcctggctggaaaatgcacatacctctaaataaaaccgacttagaatatttacttcttaaccatcttttgattaggtttgattaaatgtgcattgccactaaaggaaatttggggtattatgtaaattagcaaactattaaattttcattgagagttgtatattttatgttttgctgtttcagatatggctgtatcagaacttaattaaacacagctctctgtttgtcaagcagttggatggatctgagagacttacatgcttatttcagataaaaagattgatgagcctctgttgcaggtaaaattctattgtaagtcagtaacgtatataatgtattgatcaccttgtctaggggaacaccttttgacttttattttcagagacagtggcttttccatactttttttttttttttttttttgaggtcatggacttctgtatatattacaatttttactgtaggtgattcaggccggcatgaggtataaatgaagacacatattcagtatctttcagatgactttttctttcacggatgcctttgaattatcttgtgaatgatggccatcctggttactggagaatggaaggccagccaaaagaggactcctgatgtgtgagaatgattccattccataggggtctccaccaaaatgcagtttgaaagccccatctttagaatacacctttcatcaggctttttattatttatgtaggaacgcagcataagccac

SEQ ID NO: 128561 - DNA, 1058 bp, Homo sapiens
taggaccagaaatatatcattgttctatttgggggatattgcaggcgtggaaagtctcaaaagcatctttaaggagatgagatgcactgttaaagagattcgtatctgagtttaattaaatgcagcttcttggtacaattcatggattataatacttcttacagtgttttgtaatctttaatttttcgtgttcatttctccactgtccatttttcttgtctgtgaacttagtgccagcataccgtttggcacataacgagaattcttttaaaaactgtctgaatgactgaatgttagttggatgatttccctgtctatctgtaagatgtccctattttcagagataatcttgtactggaatagtttcttaaccattgtcactgagagtaacttggggaaactggtgacattttgccatcctgtaagtgtgtgaatacttttttcatttttacaggttgctgcaaaactgtaatgatgacagtttgaatgttgcacttccaatgagaatgcttgaagtattttcgtctgagaatacttacttgcctgttttacaagatgctagctatgtggtgtcagtgattgaacaaattttgcactacatgattcacaatggtaagtagtaggcaggatcagaactgtggctcagcatcctgatggggagtgagcagaggccagcctgctgctgtgagcctgtgccctcagtctcaatgtcagagcggtactggtgtcccagacgccttgtgctccatccacaggtgcccaccagagtcccagattccaaaatctgtccttggctccacccactctgaaaattcagaaacatgctactctctttgcctttttcttttgcttggaagtgaaccaaaattgacatatgctttcatcagttgtcccgtcatccaagattggtgtctgcagtgcagctgccggtccttcacctgaccaggaagggctcttaccacctcctggtcattctgagtgaatgggaaaggtaatgccaccaatgtatgagttgaacatcactccaagagccttatgaaaaagtaaattttgttaaa

SEQ ID NO: 128562 - DNA, 1033 bp, Homo sapiens
tgaaagttgtggaatttgatctttttaaaaactaataattaaaagtggttcattgtgttagttgacatatatactgttttaagactaagcgtttgagaatttgtatttgttttctaaaattgtaaggaagatatttaagaaatatgcattatttgaaatgtgtcccaatatacgaaatgcttaaaaatcttacacagaaactgccgcttctagcatcttctgtggtacagcagttgtttactttctaacagtcgataaaattttagccttttaaattatagtattaccattatttgtattgttattgcacattctgtgccatgaagctttttaacatttgcaacagaacctttgtcatgttgtcagtctattcagtaagtacattgttagttatgttagtcacttttttaaaaaagtctctgtgtattttttaaaattcttgatgtatttttatctttttagtttcatagcaaaagagctttcaagctttcatatgagtttcactagttatcagtatacactaggttagacttggggtagttacaaagtaggtctaatgataaagtactgagtatgcattgtttggtgatcttcactcaaatacgaagctgtgtaggactgtttcaaaaactagcccatgcagatggattgtttttaatgtgctaccaaatacgcttgtatatgatgagatactcaaaaattgcacctgaaccttcttattctataaaaatggagtaaatgattctgaaagaatatatgatttggatcattcttgatacccagagttatgttcactgcctcccacccagagttcctatcagaagcgtaggctggatattttaagaggttctgaaagttgtttcagtttacgtataagctgcctttaaacagttaacttcttcagttcccagattgtggtctccaaatacatcatctcctctaaaaggagcttaagagtttctggagaaaaggctgattgtagggcgggatgcaggactgccagtgaccctggggctcaggagcctcctaaagc

SEQ ID NO: 128563 - DNA, 1751 bp, Homo sapiens
ggggttgggtgcgggggggtatatagagtctcgctctgtcactaggctggagtgcagtggctccatctcagctcactgcaacctccgcctcccgggttcaagtgattctcctgcctcagcctcctgagtagctgggactacaggtgcacgccaccacacccagctaatttttgtatttttagtagagacggggtttcactatgttggccaggatggtctcaatctcttgacctcgtgatccacccgcctcggcttcccacagtgctgggattacaggcttgagcccctgtgcccagcccaaactgtttttcttactctctcactcaacactgaaaaattctgtgagcagaaatgtggggttttttttcccacacaccaagcaattcttcagtggacaccaactaggtattctacaattcagttcaattctgatgccgtccacccggagataatgtcagatcccatcatctgagggcttagtcctgcaagactacacccacttcagaggccgattacaagtagtaggttgtcacctatacttctgaccaacctgcaaaaatgggggttcctcagcccctccttgggattggtaattgactaagacagttcacagaactcgggaagtcgaggtgtgcgggaatggggagcttccatgccttctccaggcactccacactctcggcacctccctgtgttgagctcattgtgtcttcctgttgagttttatggtgcttcttctccagtgtccctcccacagacagccccttggaagttggtgcgtggggctgaaagttccaaccctctgatcacttggtttttctggtgaaaagccccattctgagtcccctagatggcctcaccataagtcacctcaagtatgatcacaaagggctggctatgaataacaagagactctttatctttcaagaaattacaagagttgtaggtgctttctgacatgaacggggacaaaatctaaatatgtttcctattataacacagttagaattttaaaaataagatctggtcagaaatgcctctctgcgtgtgaggaaaaatggcgtcttcgttttccattttaaaaaataatgtttaactaaaatacgttttaactgattgttttgcaaaggggccctctctgaggaagggctgctggtgtatttgcgggtgctgcagaccttcctctctcagttaccagtctctcctgccagcgcgagctgtcacgactcagccagtgactctgaggaggagagtgaagaagccgacaagccctcaagcccggtaagccccgtgccctgcatctggggggctgcgatgcaggcagccccgtcggatcttctagctttctgtccacccgtagtttcagttacacaagtcagaccctcaagcagcctttgcagagaagccccgtcagccccactaccacagtttctagtgatgggaaagtctctcccaccgctttgttagcacgttcatggaagtgtaaatggagacacatagctttgtgtttggttttttaggcaaaataggatcatactatatgttaacttagttattaggaaatattttctggaagtgaaattgttgggtcaaaaagatcctttttaccctatcctgtgaacaccgggtagtgtcttccattaattcctgctgattttatagaggataaatgttatttacttaaaaattactttcaagttcttatctcttttcttccttactattgagtttacagtatattttcagggaat

SEQ ID NO: 128564 - DNA, 1050 bp, Homo sapiens
aatgcatcactgccctgggctgaggtttactagagaaccgcttccaaaaggtgtttaatgggtgaaggaactttctgtgtaggcttgattttatgagtacagcacctatttcctctaagaaactactctaggaattttatttatggcttaaacatattaggttctagtatttagaaagagcaagtaggcttactctaactgttacagattttaactgctttcaattttgatttttttaaaaaagtatttgaaagatgattagtatattcccaggctgataactcattcacaggccctcactgattaatattagtcccttttattttcagagttaggatttgccatttaatttctgtttaacactgattgtcagggtgtacaaatgaatgtggagacctttgtaccctgacatggaaagatttccgagacagatgcgtacatgaaaaccgggaagacacaggacagtatgtagaagaaccggcttttcctataagaaggatggaaaaaataggaatatatattcatattgcataaagaaacttggaagcatatacaagaaactcatgaaagtgaacactcgtgtctgaatatgccgaggaagctggggctggagcagaagtgctcttctgagtacactatttttatatcacttttaagttttggattaggtgaatgacttaatattttaaaattggttaagtaataaatgaattgccagctccttttctgagaggaaattttagatatattaccattggacgtggaaatttggatttaacatttttaatatccactattttaaaatatgattaaatattcactggctatattttaagggggcaaaaaataaaggctctactgcagtatcagacaactaaaataagaaagtaggctaccaaagatagcctgttagaaaagtgcttggctttcatctggcatacgtggggtttttagtgggtactgtttcagagtttcattgactgcatttgtgaccctacttacatgtagatgaggcctgcggtgcccactcagccccgcggcattcctggc

SEQ ID NO: 128565 - DNA, 1007 bp, Homo sapiens
tgcaacctccacctccaaggttcaagcgattctcctgcctcagcctcctgagcagctgggattacaggcatgcgccaccacacctagcaaatttttgtatttttagtagagacggggtttcaccatgttgaccaggctggtctcgaacccctgacctcaggtggttacccaccttggcctcccaaagtgctaggattacaggcgtgagcacctggcccagaaatttatttttaaaagtttaatagtttgttttattattgcttattgagtgatttagtaaatattctgtcagggttagcttgaaatacaaattttaaaatgtgtattttaaatgtgtatttctgaaaatggtatttcagaaatatgtatacattcacatggaaagatgttaattataatcttagtgacaaactcttagaacctgtaggaagaactcatttttgtttctatgtctacacacaagggtctggatggatttatagcagggtattaactgatgatttctgggtagataagatgccatgtggctaacattcttttgccttgttttgttttaataacattttttaaaaactcaatttctcaactgaagagaaaataagcaaataataccttttcaaattattttgaaagttcgtatttttcgtagcttttttcttactcttttttccgtatgactgttgcgtattcttagcaaataaaactccacaaaggcaagaaaaaacgttaacactcttatcaggcatatggtaaggattttaaatatctcagagatagggtatctattatcattttctaatacagcttcccttttcaacagtatagtctttttcagagtgaattttttttatttttattttattttattttatttttttgagtctgagtcttgttctgtcacccaggctggagtgtaatggtgtgatctcggctcactgcaacctcagcctctcaggttcaggcaattctcctgcctcagcctcctgaatagctgggattacaggcgc

SEQ ID NO: 128566 - DNA, 1041 bp, Homo sapiens
gcttttgtcaagctatctatttaattgaaagaagttaattgaatgaaaatgatcaactaagcttgtattaatattgctaatggaactttcttcttggccatgtttggagaaagatgtcaagctagactttaggaagggcccattaatgcttgcacttaacctgatgggctaattaaggaatgcttattcatcctccaagtccacgagagtctctctccagcccgttctgcctggttttacaacacatttctcttaggagcatgagcattagcagcagcagccgtaactgataatgttttgattgcactgaatacagtcctaatgcatcgttgaatttataatttgggcagattgatgtaatatatgtttgcacaatttattttaattacctatttctgtattcctaagtaaactgggacggtcacatggtaagcctttactatatcctttcttaaagattgacaaatttgcaatttttctatgttaaaaaataagcagtctcacctatttaaaacttataattcttacataagcttttcctggatgtgggtgttaacggtagcatatttgttttcctttcaatatttgattaaaccctggggtctttgttaataaagctttccatgatgtgcaatatcaggtgttgtgtatgatatcagataatttcactgttttatggcatctgttgagagtttcataatttccatgacaggcttatctttagtatgtagaaatctctgaacttaataatgccatataagatattttccaccctggccttattttgttttggttaagcgttaaatgaaaagtttgtacagaatttttttatgcctcaaaatgactccctgccactttattcatcattgaaagttttaagagttagggcaaggccgggtgtggtggctcacgcctataatcccagcactttgggaggccaaggcgggtggatcacgaggtcaggagtttgagaccagcctggccaagatggtgaaaccccatctctactaaagatacaaaaaattagctgggcgtgatgta

SEQ ID NO: 128567 - DNA, 1902 bp, Homo sapiens
tttattgcacttcagaacctggaaattgtatgctaagtatgctttgtattttgctttttaaagaactaactcatctggtttcaggactagatctactgtagaaagaaaaaaaaaaattaactcagttgtttggttttagttaccagattttacatatcacatttaagataaaaaagatacttttattttatgttatgatgcaatttagtctttcagttgcccttcaaaacttggactatatgtacttaattttttggttgcaatactatatctaaatatccgtcatctccatacagaaatgtcacaatttaggattaatagccttgtcatctaatttatatatacatttgtgataatatagctagtgcgtaagaatatttccccaaggtcagttaagcaagattttcttatgatcatcattgccatgaactctcaaacatagcgatcttgtgaaaacagtgcctgttaatttacaatgtttaccttgaacagttgtcaagtgtgatttttataaggagttggtatgtttctaagcagttatctacttgatctttttaatattggggttaagggaaacctgcttacagcatcacctatttttcattcaaatggcacataatagagcatgtgtaacagttgtgtacctttgtggggtttttttgttttttgtttttctttttgagacagggtttcgttctgttgcccaagctggagtacagtggctcgatctcactgcaacctccaccccccaggctcaagtgattctttcacctcggcctcctgagtagctgggactacaggcatgtgccaccacacccggctaatttttgtattttttgtagagatagggtttcaccatgttacccaggctggtcttgaactcctaggctcgagtgatctgcctgcctcggcctcccaaaatgctaggattacaggtgtgagccaccacgcccggcagtgtgtgcatttctgaataaatttattagtacttgaataatgtattagtttctgcatttatttaatgtaacgttttgatctggcgtggaagaacatgagaggaggcacaagagttaacacatcagatggacataatgctattgtatttcagaacttaaaatccactaaaatttgtatattcagctagatacagctagttgttccagtgtttgctatcttacttcatataacttaccacactggttctcaagtcgtaactacctatcagagtcatctgggggagcagttgaaaactcgactggctccacctcagactaattgaattggagtcagtgatggcggcacgcctgtggtgggcttgtcttagtgctccaggtgattctaaaatgcagcaaaggttaagagccacaggcctaaccctgcagataactcactttgagcacatttagtcactttatgtgatttggcatggttgcctctacaaactttccctttttggtgctagatacttgtagagcagttgagtttgtgattctgaaagtgaatgtggaaaaaaggaatgtgttaaggtgtttcgagatcacaaaatggatccagtcaaattttcatgtttatatttttcattaaaacttaggagaaaaatagttgatatgaaggagggaaaaatgttctcagttgaattttaaggtttggtatttgatattctaaataagtattttgggaattggtccgggactagtcatgccatatttagcaaataaaaagacaggtcacctagttaaaattgaattacggataaatcacaattactttaaaaaatgtagttatgtcccatgcaatattgtggacatactttaaagaaagcaatattttggacatacttctactaaaaatgtattatttgatataaataaatataaacatattatttgatgtttattaaac

SEQ ID NO: 128568 - DNA, 1615 bp, Homo sapiens
agataaacatgtcatcggagtttgttgtacgcatccttagatcactcaggtattaagctcggtccccagtagtcatcttctctgccctctccctcctcccaccctcccccttcaagtagatcccagtgtctgttctttccttctttgtgttcatgggttcttatcatgtagctcccgccaaatttgtgtttcaaagcttaatcgccacctccgttgtaacttaaaaattatcatgtacatgtgtttgtgttgttctgcacatatttgttggcagataactgctttgtatacattattgtgatggcaaaaagaagcccttttctgtgagcgggtttggtgtccggctcgacctgggttcctgcaccaccgctgtgtgctcctcctcgagtgaatgtatggctcactgtgcattgtgctgccgagctcacgtgtgtgacgcggatatgttctttcttttcaggttatcaccaatctagtgaaaatgttgaagtccagagacacgaggagaaatttttgtcctccaaaccactggctgtcagaacaagaagatattaaagcagataaggtgttattgaaagatctttttaatatttatcattaaaaaatacattcagcttgtgtctttctggagagaagaattaagcactttaaaattatttattttatgactcatatgactaaatagtaatgataaaccttattactaactcttacgccaacttcttaatggaacatatagcagtatcattgacttaaaatgatattctgagttattaatcctcaattttcctttttaacctgagattatattaaagccttaatgattctttgtgaggttgaaaaatattttgcttttattagtattaatatatgtctagtatttaaaagagatagatcttatacctaatttttgtgattttttttttttgagacggaatcttgctatgtttgcccgtggtggtctcaaactcccagcctgaagtgatcttcctaccttggcctcccaaagtgctgggattacagacgtaagccaccacaccagtcctttatccttgattttctaaaagaacagagacaaatttgaatattactaatacctacatctaaagcagattcagtagtatgatacgttagtaaaaaatttaagtggccaggcgcggtggctcacgcctgtaatcccagcacttggggaagccgacgggcagatcacttaaagccaggagtttgagaccagcctggccaacatggcgaaaccctgtatctctattgaaaatacaaaaatcagccgggcgtggtggcagacgcctgtaatcccagctactcgggaggctaaggcaggagaatcacttgaacctgggagacagaggttgcagtgagctgagactgtgccattgcactccagcctgggtgataagagcgaaattccgtctcaaaaaaagaaagaaaaatgaaagaaaatacaaatattagccgggcatggtaagtgtccccctgtagtcccagctactcaggaggctaaggtatgagaatcccttgtgccctggaggcggaggttgcagtgagccaagatcgtgccactgcactgcagcctgggtgacagagcgagattctgtct

SEQ ID NO: 128569 - DNA, 1164 bp, Homo sapiens
cgcctcagcctgggattacaggcataagctgccatccccagctccttgaaatgagttttaagaggccaagttacgatttattgttggaaaggaatgggatatgtgtttattcatgaaatactgcctggggcctactgtgtatacagccttctcccaggcaccatctcatgcacacacgcctggtctgggaggaactttgttgccatagtaggagggaaagggcacgaaggtggtcgggggtggccagggcaccgcccactgctggatctggctgcattcgggcctcaccgccagtgctagggctagctgtgcacttgagacgtgctagacagctggagtggaagtgtagtccttgattaggacatctttaatattcgatcaagttatgtgttcggggagctactgtgctgatcctgcactgtgcatggctcatgggtctgcctgaggcggggatgtgttcatggaactggatttagataaatgagttaatcaggatgatttcaagaatcttcaccttaagaattgtcagtgggaatgcaggggaaagtacaagtgaactaattaaggttttaaaatgtgttttagtgggtttggagtccccgccgctgtctgtgtctgaggaaagacagcttgctgtcctgacagagttgccttttgtggttccatttgaggaacgagtaaaggtatgcaatttggcttctttattgtcactacgtatcatattagtgttaagaaattaacacacacccaccagagaaatctctaaaggtgcctagtgcctggctgattacataacatacttttctcattaggctgaaatagctaagaatgatttataaaacccaaccagatacctctttttacaaactgaaagtattttcttagttacaactgattgaaagccagtaaacactatagatttcttataatgagggtctaacgtcatttttctctattaaattttgcattatttggccaggtacagtggctcatgcctgtaatcccagcactttgggaggccgaggcaggtggatcgagcccatgagtttaagaccagcctgggaaacatagtgaaaccctgtctctacaaagaatacaaaagttagttgggcgtggtggcatgtacctgtagtcccagctacttgggatgctgaggtaggagga

SEQ ID NO: 128570 - DNA, 1282 bp, Homo sapiens
ccctgtctctactaaaaatacaaaaatttgctgggcatggtatgcgcacttgtaatcccagctgctcgcgaggctgaggcaggagaatcgcttgaacccaggaggcggaggttgcagtgagctgagatcgtgccattcattgcgctccagcctgggcgatagagtgaaactccgtctcgaaaaaaaagaaagaaagatgaggtatatctcctgccccctaggagtttagagttagttacacaagcccctagtggtcccagtgactgaagggactttgtttttcaattccaacttactaattctgaagcacaattattaaatagcgtgttgctattagtatacattcttattttatgtttcttttttgttttttaaattatatggttaatatgatatgaaataattaaaattatctgcttgctcagttaggatggctttaaagcaagacatcatctcttatatagtttttagattaagttataaatgttcactttagagctgcctgaagattgatagagatgcatttgaaaagcattatttttttattgattcttaatgtagtaaattactgaagttatttggcggcaaacagaaatggtctgtgatgtggttcacatttattctgatagagccacaatttgcattaattgcgtcgcgactgcactcacttatattaaaaggcttctactataattaatcctttttatttcaaatcattttggcacaatttctagctataaacattcataaaagacagacagttgaaaaattcgttacaggtcttttccatatacctattgctatttttttcatgacaagtagttattgatatgcttctaggaacaagcgtggtacagctggctgagaaggccagtgtgaaaaatgctaagtggattattttgcataaaaaataggcagtttttgaagttgtataattaacctgtgtttagaaaataccttgatttatgcttacatttgtatctcagttgcatacattatggaaatttaatttataatccatttagctgatgcaatcatagtttttagtgccatcatttattagtgcttgtatattaaatgctctgaaggtttaaacctgcctcatgtaaaaaatggtacctatgcatttacattttatgagtcacagtgggatttctgtttaaaattcaggtagttctgatatatttaactagtttcactggtttattgttactaatgcagaaatggcaaacagtgaccttatatattgaacatcaaatgatttacacttccagtttacttt

SEQ ID NO: 128571 - DNA, 1048 bp, Homo sapiens
caaatcctaataccccatcctgtgggcacggccttgtttggaaatagggtccaatagctgcgaggccttgtttggaaatagggtccaatagctgcgaggcgtgagttcatgtggttttcagtctcgcagtgtgtgatcatttgccgtagccaccttgggagactaacaaacctgcagttcctgaaggattcaccatccttctgttgaggaggagcatttgttggcttctgtctcacaagaaggatctgtctcttcataattccacgatttcgctcctaggtggtctgttccagagttctctgcatgcttagtgcgtgcattgaatgcctgcacgggatcctggagcacagtacctgcccactgaatatcagcttccatcttcggtactatgaggagaaaatacctgctctcttaggattgggtttaatatcaagttgagcatatggctctttgtttgtagaaggcttgtatattcgatgctaacgttgtcactgttctcttttgaaggctctctatgagaacatgctggtggagctgccctttgcaggcttctttctttccaagttgcttggaaccagtgccgacgtggacattcaccacctcgcctccctagaccctgaggtgtataagaatttgctctttctgaagagctacgaagacgatgtggaggagcttgggctgaacttcactgtggtgaacaatgacctgggagaggcgcaggtgaggggtcaggaggaggattcacatacctgtatagcaagtagcagcatctccttgtgtgtggaagtccatttgtgttacagcgtttgacttccgcacattttagttagaatgactgtggctgtgagttagacgtcgaagcatatagctccaaagcaccttagccctggcgtctgagctgagtgcagttcctgctcccacgcatgaagcctgttcctgcccggcagcccctcctgcggagctccactctcgaggctgcggcccaggcttgctgcttgtctggctcttcccggtgctgggggtggccgttcagcagcttcccggcagg

SEQ ID NO: 128572 - DNA, 1054 bp, Homo sapiens
cacctgcagtcccggcgtggtggcgtacacctgcagtcccggcgtggtggcgtacacctgcagtcccatctacgtcgggtgctgaggcaggagaatcactggaggtgggagacggaggtcgtgagatctcagtgagccgagatcatgccactgcactccagcctgggcgacaggagtgaaaccctgtctctaaatagataaatatatacatacacaacgtacatgggcaaaaaaaaccagatgtttaacatagaagatagataaatggccagtaagcaaataagcacacaataacgatgttcagcatcattagtcattatagaaaaatgccacttacatccaaatgagataaccccacatacccactagctgtctactggtgcaagtgagagctttttgaggaaatggaaatgttctaaaactggattgtgctgatggttgcaaaactctaaacttacaaaaaatcatttttacatataacctgtgtgtatccatgcgtatgtatctcttatctgtagtttgcattgtcctacatctgaagtctaatctttatgtaaaagcaaataatgcctaaggtcacgttgtccccatgatcgggtcataagtttaaggaaatgaaatcagtctgacctttcctttgccaagagattgtcttcggttgttttcattacccatctgcactgagggcttgcacctttaataatctcagctatgccagtaaataggtttaaaatattatattcattttggtgccaattaatgcacttaagacattttattggtgttatttctgtagtatattaacaatgagggaacaatatacagcaattattttaggtttagggagcactttactagattaaaagctgtaagtggcagacattacatttcagaatagtggtctcatcatatagtgagattggttgttagccatggtattaatatcagaatgataataagttagaaggaaagatgataaaattaatttagccaccaaatcatgctgggaaaacacccagctgtgttagtactagacacccattgtctgtcatgt

SEQ ID NO: 128573 - DNA, 1078 bp, Homo sapiens
accctccttaagttgctctccccttctcgtactttgcccatcgcctccacataattggcggtgggtggggtgggggcggggggaggcagagaattccgcttttgcatttacaatcggtccttcatatctgtgggttctgtccacatccatggcttcaaccaattgcagattttaaatatttgaggaaaaagcaatggttgtgtctgcactgaatgtgtgctaagcaatatagtgtcacagccatttacacagcctcggcatgagatgggattgtaccagtgctctagagatcatggaagtgcacagcacgtacacaggtgatacacacatgccacgccgttttagagaagggacttgaggatccatggactttagtttccgtgggtgtctggaccaatccctgtgggtcctgaagggtgggtgtgctttgcatttcataaagcatgtgttcattttgccataggaggctattctgcagaccatcctgttattaaggtcttctggagagttgtggaagggttcactgatgaagaaaagcgcaaactgctgaagtttgtaacaagctgctctcgaccccctctcttggggtttaaggtacacaactttcatgacatttgctttaaagaccacttcataataagaaaggcagcagaacattcagtagggttaaatgaagtccttttacatacacttttgtttttatcttcagctagatttttaattaagtactggttatgatgtatatattttggtgctagttttatttggggttgctttttttgtttgttcacaataacctagtcatatgatagttacacattgtggttatgattgcctgtgaacaaaccgtacatttggagggactatttgcaatattaataatgtctcataaatctgtaacacatcttgggctttttgctactgaactgaagcaggtacaacgtagagatgttgatggagtgtatatgctactgagccttattttaccacttctggaaattaatgttgatcttacgtaatttggcttatttttagcaattaaaattgcctcaggcagatggatcatttgaagtcagga

SEQ ID NO: 128574 - DNA, 1036 bp, Homo sapiens
tctcagaaatcctgacctcaggtgatccacccgttgtggcctcccaaaatgctgggattacagtcatgagccactgctcctggtcacgtaatttttaaatataattttagctgtatcttgtgttcagttttctaggctacctttttcactcaacattacatcaggatcatttttcctcatgttattctttgagatatttttaatgggcttgtagtgtcccatcatgtgatttaccagtttactttctgttttttagttgtttacagctcttccttcgttgtgatgctgtgaacctcttgtgcataaattatcatgtgcatctctaattatttcttagagtacagtcccaggagttgtgaatgtgggtgaagcccctgctcctgctgccaggcccacctctcagagagtttcgtgtacacgtgtgcagggaagggctgacctagctaggtctctgaaacccgtgccagatactaaatctgcacaggctgcgacagtgagcagactgagggcgatctgtgccttattgtcttcctgttggaagagaacacataaatcacgtatctcaaatgtgaggcaaatagctaatggtgtttgtgtatacgaggaaggtggagtcaccggttcttcgtggccatcagaggaccgacacgcccataggtctcatgcattaagtctgcgttgagcaatccctaacacggtttttgcctacagatacatttgcacaactgtgaaaaccaggtacgtattcattgcatcattttttgtaaaaagctgagagaagtgcccagcaacacgtcgtgccgcgcgtgtgcatggaacaccatatagcctcaccattaataggcaagatgagcgagacccattatcagatgagaaaagcacggcacggaatactgtgtccaatgtgctcaccgtctcaattttaaacctaaaggagggagaacattttctcatgcgtgcatttcatctctgggagcacttaagacgctgaagcgttggttgccagtgggaatgggaactgggtatctgtgataca

SEQ ID NO: 128575 - DNA, 1053 bp, Homo sapiens
cggtggctcacgcctgtaatcccagcactttgggaggcagaggtgggcagatcacaaagtcaggagttcaagaccatcctggccaacgtggtgaaaccccttatctaggaaaaatccaaaaattagccaggcatggtggcaggcacctgtaatcccagctacttgggagactgaggcaggagaatcgcttgaacctgggaggcagaggttgcagtgagctgagatggcgccattgccctccagcctgggcgacagagctagactccatctcaaagaaaacaaacaacaacaacaaagcaaatgtggtttcgggaaaatgtgactgcaatggtaactttactgattggagcaggcacattttgtgtactttgtattaaaactcatgtaatgccatgcttgttacagtgacatcttgcacacatgctgtttttcaggagttgtatcccgcattttgtattcacaacggaggctccgaccttgagcggctccccacagccagcacctgcatgaacctgctgaagctccccgagttctatgacgagacacttttgcgaagtaaacttctctatgcgattgaatgtgccgctggctttgagctgagctgaagctgatgctggggtcagacccctacagagaaccagtgcttccttcgtcagcagcgcctccccagacccacgaggatactcacactgcacgcctgaggctctcctaagctccttctttcattctgccattcctccctcccttccttttttaaatgatttttattacggtgtggtcacttatttagatggacattgcttttcaaataacttaaaataacacgttatgtgccatgtggctactttagtaatattgccaagaagagcacagtttttacactagtggcatctcagtgaaattaaccaaagatgaagctttggctttgctggtgagatcagagccctcctgagcaggcagcgccactccagggttcagacagggctgcacaggcggcagagatacagggtctgagggctgagacgccatggggccgctgctgcttatgtggtt

SEQ ID NO: 128576 - DNA, 1028 bp, Homo sapiens
ctcttcttcctctttgaaaatttaagttacagcttgaaaaattaaaataataaagggtttaatgtatttttttctttgttatgtatggccttaattaacttgcttttgccctcagaagagacagtggtaagggcatgggtgcgagtgtcttggaaacgttgtttcccattgaacaaccaattggtgtgtgaatttgccacatcatattcctggtaaaatcattaagcaccatagtactgttggcaagacctttcatccgtaaacattgtgtgtgaggactgttgttgagagtttgcggaaaggcacctctagagcaagactgcggaggcctttgctgaggagagaatggttttgttaagggagacagtgctgttatagctgctgtttgattgtaggaaaatggatttctcatcagtggcatctcagtcctgatgcctggtcctaggcgttggtgtatgtcttgggcacagtttgggtcaggcacttttgttagctgtctcctgttagagtcttctcaaccactgggacttcctgagtggtgcactgggtgacctgagaggtcaggattaaacatgtactcctgtagttgtttttgtcttttgacttattgaaagggaaacacattgtatgtttacctccttcattgcctggagcttgggtgaagaaactgaacaccacctgcaactcgaggagggaaagagaagagtagttgtgtctacagataatacaggggagaaacgtggagctcctgcctgccgcaggcacgaagaagcataatcactctcatatctggtaggtcttgggccttttgcatggtgcagttcttcagtgtgtctcaaatggggattcaaagaggttgttcttacaccttattatgggctggctggcttgaagagagcccctttctgagggaggaaggacagtcagtggcctcaagcattttcagggaaactgaagctgagcaggcgatttccgattaggggaccgggagactggcgtgctcatcgtttaagtgcatttgctgtaat

SEQ ID NO: 128577 - DNA, 2798 bp, Homo sapiens
ccccttcttaacattattattaaacaggccgtttctcaacatgattattaaacaggaccttcttaacattattattaaatgggccctttcttaacattatgattaaacaggtcctttcttaacattatgattattattttaattcaaaggggaagggtcccttagtgactgaattgtagctaatttttgttttccttggggaaaataatctgatacaccaagccatagagcaattacttgtaaagaaggtatagagatctaattagatgtgagtgaataagtgagtttttacccctagtccaaggagagaggtgctagtcttactgaagcgctttactgttaaatgctccattttacatgcagacctattttaagaccaggtaccctgtgtttcccatgattagtgtggcagtgatacttgttcattccgttcttataggtgttctagatgacttccattttcaggctctcaggatttacacactggggaagctgctgctccatggctgctatatgtatgtagtcactgagcagcctgctgacggtatgtttaatgtagatgggtgtggatgcagagccagagggatttccgcttattcatgatgtagttcaggggtcaacaccctggtctgtggcctgttacgaactggcctgttgggaacaggaggtgagcggcgcgcaggcaggcaagcattactgcctgagccccacctcctatcagctcagtggcagcattggagtctcataagggcacaaaccctattgtgaactgcacacgcgagggacctaggttgcgcattcctcatcagaatccagtatctgaaaccatccccctaccccaacccatcacccactgtgtggaagaattgtcttccatgaaaccagtccctggtggcaaaaaggttggggaccgctgttgacaaatcatatttactagacctggtgtactttccacgtgacgaaaaagtagtttaaaatgtgctgtaagatatttccgagctgcactttacatttatcagaatgcagaacccctgctgtacttcagacctccctcatgataggtggggaagggtgaaggggtgccggatgttggacacatggtatgcaggtctgtgcctgagcaccaggcagtgctcactgtcacactgtggccaaggagacttgggcctggggcctgcggtgtggaacccgtcctttacagaagaagccctcccaggagaggtcgcggaggcggattctaacaccagcctggaaggaatgctgcctctgaattggaggggtacaatcaaaactgctgaggctaggtgactgtcgaaatttccagaatgtggagcacatgcaaatgagctcttgtcgaaatgttaattggaaaatattaataggcagtggacttatttgaattaggatgctctctttattttattattagaggaccctattgctcagtgaaatgatgttctgagataggaaagaaagggtacctgataatagtgccttttgatcccattagtcacagcaggcattacatctgggaaaagcctgtgggtttaacttcacattttatttatattcttggaaaaccaaagcgaacctttaaggtttccagagaggccttttattttagcagtgcagcaagtttttcctttgtaaagcatcactgtggtacgaatgatgctctgtagcaatagaggaggagtcctgtggtatgtagaaccaaggaaagcagacttcttgcaggaaaaatgagtgcattgaggatagtaacctgactttctgacctgtgattaaattatgatagtagtcagtcattttactctcccagggtttgaggaagtggccggtgaggacttggagcctagtgaggagttagtagagctgcccagggtggaggaggccacagaggacagccctggtgaagagaacagtgaggccttggatgtgttgatatccagcaaggacctggcactgtctagtgaggacgaggcctgcacaggatgtaactggggcctgggcgagcccttcagcgaggagctggggctcatatccagcgaggacggggccagccctggggacgtagaggagctcggcgaggagtgcgaggagccgctgagtgaggaggagcacagcgggccagagctggggcgctgccggcaccaccataaagtgtcaaggagctgcccgagtgggactgacttaaaacagtgtatctagaataaaatggtttcctctagtgccttgatactgtccttggtcagacgacctcagctgccttggagatagaactgaagaagcaagagagggaggtggcagccctgaagcacaggccgggcgtctcgtaggctctttccctagaagccagagcacagaccctgaagacagccttgagtttgatccgtaccacaaaccgggggcttaaactaccaaaatgtaccatctcccagtcctggaggctggccatgtgagacccaggtattgcagggctggttgcttctgaggctgagatgtgtcccgtcttgctccaggcccttccccagctgttcttctccctacatttgcagacggatggcccatccgatgttgacatcatctcctttgtgtctgtctctgtgtccattggatttaatgttttagagacagatttcactgtgttgcttaggctggcctccaaccgctaggctcaagcagtcttccttcctcagcctcccaagtaactgatcacaggcatgagccactgtgcccagccacaagttccccctttttataaggacatcatttatattggcttagtgcccactgta

SEQ ID NO: 128578 - DNA, 1114 bp, Homo sapiens
taggaccattttttttttgtctttaaaattgttgtaaatctctgtatgcactttgcttttttattaaacgtactccaaggtgagtcttgactctttagtgtaggacaagattgtacactaacaccagcatggacctgcttttcattgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttgctttaaaaaaaaaaaaaaagaaaataaatgcgaatgtgttggtgcattcttcctgagtgggatctggagcttttttgtgtctgtgtatgatttgtgcctgggcttctagtgtcactttaatagcgtttcgtgctgttcattcaggtggatgccgcacctcagttacatgtagacattttcttcagtatatttgaagtatatgaagattttcatattgtaagttgtgatttagcaattgatcaaacatttaattatggtaacatttctacaggagagggaagaaaccattgtataatttttcactcttaaagtatgttctagtttgatgtaagatcacttacggatccgggcgcggtagctcaacgcctgtaatcccagcactttgggaggctgaggcgggtggatcacctgaggtcaggagtttgagaccagcctgaccaagatggtgaaacccctgtctctactaaaaatagaaaaattagctgggtgtggtggcaggcgcctgtaatcccagctactctggaggctgaggcagaagaattgcttgaacccgggaggtggacgttgcagtgagctgagatcgtgccattgcactccagcctgggagacagagcaagccttcatctcaaaaaaaaaaaaaaatcactttgggacagtcaaggtcttttgtttctcagtttgtaatatcttt

SEQ ID NO: 128579 - DNA, 2188 bp, Homo sapiens
actttcctcaataagaaatgggactttctcacgctggatggcacagagctggcaaacatgaggccagtccacaccaaggctttgcctgcagaaaggctgcactgtggccagcgggggaagcggaggagacacctgtggacaccctccccacaggtgggcacacctttgcgcaggcccagtgtgcgttctgaaggagagcccagggtggggttccgggactgaggtgcagccgtgtccagggtgggcttctagctctgccgctgggcggaactggggtaggtcccagggtggggttccaggactgaggtgcagccgtgcccagggtgggcttctagctctgccgctgggcagaactggggtagtcccagggtgggcttttagctctgccgctgggcggaactcgggtaggtgggagtcctcacttctctgcagggtggtgaagctctctgggtagtgtgagcagttctcaacgtgcaccttggaaagcgcccgttttgaggtttagctgtggccaagatagatgacttcattttgttgctttttgttcttaacatggggagatatttagaaaacatgtttggctcttgctggggaagcagtgctgttccgtacagtgttttacaagccgtgtttccttaggattgaaagaaggtggcaagaggaagaagcagaagcagagagaggagtcgaagaagaagaagtcgaccaaaggcaatcactagaccggacttgaggcacgcggtgcacccccagacgctggcgctccaccgtgctcggcatgcggtcgtgcacacgcgctaggtagcagcgtcggtcaggactgtctcgaggccacactcgctcggcaggattatgcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggctactcaaccactccgcatgctgctggaatatttctggctttagaagtacaggagggcgcagatggctaactgagtaacattcatgaaatgaggctttctgtggcggcgtagtgtttggaattagaaggtaattcagtagagtgtaacttagagaatattgcaagtgacacattgaatcctgcccgtcagggcaccttttcctcagagcaatccggccacacgaatagaaggctgtcgtgaatcacatcagatgtaaaatcattccttctgtttactcttttaattttcatcctttgcaggtagtgcaaattcaacttcaaatatggtgtaggttttgctagattccatatttttttcttggatttttgctaattatttttagcaaaaaatttttgctcagtggcactctccctagtgtccatgggttagggccatgctggggaaaacgggccggtatttacacacgcgcaaaacacccagagacggcacaaggaggttgaactcatgtttcagttcgcgaacattgactccttacgaaagtcacttcattctaactagatgcgcccacttccggtcattatttcgtttgcatgatgtattgcttcttcacgttttgtttttattgagcacggagtagaattccagggctgccttgacttcttccctgcatgctccctcccagtgactttccttccctttcacatgaggatctgccgttcatgttgctttctcctttgtcctcttggacttgagggcattgtgaaaagctttgctgtgatttaaaaatgccagcaattttaatctagcagtgttgaagctgggaattttttggcgcaatccatgtagcagtgacccaggcttgggagccagaaacaagtgtgacctgggattttatttaacacaactgttgccaaagagttggctttgtttatttggttttggcggggagaggagtggtatttgatgctttctgtggacaatgtaaccctaaacacatcatgtattttaaatgccacctacataaataaaacataagcatattgaatacagctcgcctgctgtcctttgtaagcgccagtaagttgcaccgttaagactgactagaaataaaagcaattcttcaacattacgattacaaaggatgaaagtggtgttttgcaggcagaagccttgc

SEQ ID NO: 128580 - DNA, 1082 bp, Homo sapiens
actaatacccagaatctacaaggaactcacccagctcaacagcaacaaaaataatctgatttaaaaatgggcaaatttcagcaggtcatggactaaaaaaataaaaaataagaaaaatgggcaaacgatcagagtagatgtttctcagaagaagacctaccagtggccagaaagtatatgagaaaagacccaacatcactcaggaaaatgctaatttaaaaccataatgagataccaccccacatctgctagaatggtttttatcagaaaggcagaagatcacagaggcggggaggtggagaaaagagagccgtgtgcactctcggagggaaaagagggccgtgtgcactgtcggagagaaaagagggccgtgtgcactgtcgcagggaaaagagggccgtgtgcactctcggagggaaaagaaggccgtgtgcactgtggcagggaaaagagggccgtgtgcaccgtctgagggaaaagagggccgtgtgcactgtcgcagggaaaagagggccgtgtgtactgtcggagggaaaagagggccgtgtgcagtgtcgcagggaaaagagggccgtgtgcagtgtcgcagggaaaagagggccgtgtgcagtgtcggaaggaaaagtgggcagtgcgcactgtgggagggaaaagagggccatgtgcactgtcggagggaatgtgagtgaggatgcctgctatggagagcccctggagtttcctgaaaacactaaaaatagagccaccttgggatccagcagtcccactgctgggcatacgccccaaagaaaggaaatccgtatatcgaagatgtatctgcacatccctattcattgcagcactacttacaatggccgagatttggaatcaacctcagtgcccatcaacagacgaacggataagaaaaatgtggtgcgtaggcacagtggatactgttcagccagagaagaaaggaatcctgtcatttcagccgcatggatgagcctggaggaattggggaaatcagccaggtgcaggaagacaaacaccccaggatctcacacatctgtgggagctaaaaaagccgaactcaaggcggtggt

SEQ ID NO: 128581 - DNA, 1064 bp, Homo sapiens
actaacttccattttatgactgactcatattccatggcatggatggaccgcactttgtggattcatttgtgtattaatggacagtgccgttgtttccggctttgggctgttgtgagtaatcctgctgtgaatgtggatgtgagggtgtccacccacatccctggatatgtccctggggcggaatcgccacatcgaccgtaattctcttatctcttggctgtttgattacagccatcccagtggatgtgagtggatctcaatgtggttttagcatgcatctccctaacaactagtgatgttgaacatcttttaatggcttattggccatttgtatatcaacttgagcaaaacagacatttcaagtcccttgcccatttctgaagtgggctgtttgtattttttgttgttgaattctaagagttctttatatattctgaatactactcccttatcagctatgtaatttgcaagtattttctcccattacatcggggttttttactcttttgatagtgtctttgttacacaaaagtgttcaattttgatgaagtccagtttactttttaaaaaatatttttcttgtgactcacacctgtaatcccagcactttgggaggccaaggcgggtggatcacctgaggtcaggagttcgagaccagcctggccaacgtggcaaaacccagtctctactaaaaatacaaacattagccaggtgtggtggcagatgctactcaggaggctgaggcaggagaatcacttgaacccgggaggcggaggttgcagtgacctgagatcgcaccattgcgctccagcctgggcaacaagaaagaaactccatctcaaaaatatatttttttttcttgtgcttttagtatcatacccaagatatattggccaaatccaaggtcacaaagaccttctgctatctgttcttagatttcctcctatattctcttaacttttaagggcaggcccaagtagtagatggaaagttgcctgtgggaagcgagaggggccatggagcagagagcctgctgcctcgagcgtgtgcgggagcatgtggtc

SEQ ID NO: 128582 - DNA, 1138 bp, Homo sapiens
taattgttcattgcaggcaagtacaacttttaatggattaagaagttttggctacctcaaaaactaatctatgcaattaaatacagaagcttaactttctaattgcttaataaatataactaactggcacttctaaaggaaaccaaaaatataaacttacttttctatgccatttgggtaaatacaattgggcgttgcttgtattatgtctgtataaactgcacatggcttgcttttttttttttttttttttaactctgttgcccacgctgcagtgcaatggcgtggtctcgtcaggctcactgcaacctccacctcccgggatcaagcgattgcgcccgccaccacgcccggctaattttttttgtatttttagtagagacgaggtttcaccatttggtcaggctggtcttgaactcctgacctcaaatgatccaccgacctcggcctcccaacgtgctgggattacaggcgtgagccaccgcgcgaggcctcacatggaatattttctagcagcccacggtgcagtgtcctgccttctactcacccgtgagcatgtcctgccaccttgcttgttcttaaaccctgtggtcccatgacacagaaacatcgagacaatggtttcagcctgttgcattgtctcaaccaccaggacgtccagcagaggctcagaaccctctgcagatggtgagaaatgcttggggccagttatgtacagggacgaaatctgtcattacaggaggtacagccacctccagtttatcatgtgggttcaggcctctgggtaaaaattcagtgactcatatccctaagtacgttaaaaccacaccagtaagaatagattttacgcaaagaaaactcaacctaatagtactgtctctgctggacttcatacccaactccttttggtgaagaactcatattccatttttctagaactgtcttatagaatgttcttcctgcctggaataaaaaggaaacctgtctccaaagaacaaacaccaaatctgtcaaatccaatcaagaagcatgtgtgttttgtgtgtgcattcctgtctatgagagaggaggatgaaaatagattacggtttgttatccttacagagtagagtagaacatcttttttacccacaaatgt

SEQ ID NO: 128583 - DNA, 1077 bp, Homo sapiens
tgtcccttttttgggtgtacttggtctcatgaggaaaaaatgagcaacccctggtgactggtgggtgtggacccagaagctgagcttagtctctgcgtagagtggaccacgaggtgtgaaacacagcaggaagctggaggagcagaactgaggtcattcccatttgcaagattcagaggctgagccatggccagtaaactcctctgccaaaggcaaaaggcctttcaaagcaaagccactcaccatttggtctgatagttgagcctgcttgattctacacgtgcacacgtgtgcacatacgtgctcacgtcacacacatgcgtgcagtctcatgcacacacacatggtctttactgagctggagggcttcccacccccatgctggggtgcacccctgaggcctggtatccattctgtcatcaggagccctcgatgctttacagcctgagtcaggaatggaaaattgtagaagtagacataagtgggtctgttttccaacctctttattctccagggaccaagaatgttcaaggcactctggcatacaagtgctgttgcctctaaggagttcaccattgccttccccgcctctccccaaagccttcgcaccactgtgtgccccggaaaaacaacaacaaacacctctaacagaaacggtgacacggccctggaggccgttgctggttgtgcctgtgtctgagcccgcccatttttgggcatcagcctcgtgtttcacagaccagagggcagcacagatcaagtgcgtcctggctaggctgtggccgcggcccatctgcaggtgggcacgccgagtccagtccctgcaactgctccttcagctcccgtggtgccctccagactgggcattcacactcccatcagaagggccttgttctggtaactcctcagggaataggaagagaggaggagaaagctctgtggtttgggctccgccgtattcaagcatccctcccctcatgctcactggacactcacctcccctctccttccacagccaccctgcccctcctggcttcaaaggtttgtagcaaagcaccggttgatggaatgtttact

SEQ ID NO: 128584 - DNA, 1049 bp, Homo sapiens
gccgacatcgcagctaaatctacaatcaaaagagttatgtggttacatctacctttcttcttcattcatatttaattacctgttggttattgagtcacgcaaatgccacaaggtcttactcatccttacaaactcaaggtcgccaagctgcacacactgggccgctgtggctgaaggtgcatagtcgcggatcataaacagagccatcttcgtgattgttaggctgagtctggatcttaaatagaagattttcctttaagtgaagtggctggaaggattggaccttctgtccggccaagatctgtttgccaaaaatgtgtcagtgcccccaggccaggctgtgcaggggaggcccttgggcccctgcaagcaggcgctgtggaggggcaggtctcggggcttcctgcttggcaccactgccggttaaccccttcagcaggctcgtgtggcccacaggcctcactctggggtgttcaccgtctgaccaggagagttttgttccgggtgaggatgcaccctttgtgtttaccgaggattataaatcagggaaatttcaaaacatgatggggctggcctccagctttctctcagaggaggctcatgttgttgattttgctttataaattatcttttgctcaaataaaatgctctcgagatcatagctctgtatttttggcgggtgtaggcggacagggtcttgctctgtcaccagggttggagtgcattggtgcaatcatagctcactgcagcctcatcctcctgggctcaagtgatcctcccacctcggcctctcaagtagctgggagtacaggtgcacgccaccacacctagctaattatttttttggagatggggtctcactatgttgcccaggctggtctcaaactcctgggctcaagggatcctcccacctacttcccaaagtgctgggattacaggcgtgagccaccacgcccgactaccgttctgtattttaaactcaccacacagaatggtacttagagtattcgtagtggcgatggccatttctgtcactggctgacaggagc

SEQ ID NO: 128585 - DNA, 1097 bp, Homo sapiens
tgcacgctcactggatgaggaatgcaggcgttttggtctgctggggtgaaagcctttgcggtacaacatgcttttacataatattgtaacttaatactccattaaagtggtactaacaggatttcacaggcaacttgtgactttcaacctgaatgctggccttcaggatgagtcatcaagctgcaaaccaccctggtgacggctcttgcctcttgacggacaggtccccagccaggtggccttgtggggagtctgcggccacagtgccttccgggagtgcccccgccccctgccctgagttgctgccagtgggctggctgcctggtttccatgctcacacttccattgggtagttaaattgcccctcactggggcctggttcacatcagaaatgagcccattaaaaacagatgctttctccatggatccgccccatcctcagtcagagtcccagcatccgccgcacctgcctgtcccttctcccttctcccctttattgtattttcactgaaggctgagaggagccagtctccacacggtgggccacttgcgattcccacagccccgtccgcactgcactgtttgtcttgttgctggaaactcaggtgactccttgtgcctgagggggcagctgaccccaggccaggagagcagggtgtgtgtggggaccagggagcggggctgtggggccacagggctttagttctccaggactgctggctctgtggtgactgctccccatccctgctgtcatccgcagccccctgcgccccgaggaaggaaggcggctggtggaggacgtcgcccgcctcctgcaggtgcccagcagtgcgttcgctgacgtggagtaagtacggggccctggggtttctgtttggctcctgttgcttggtcgcagagactgggtgggagggaaggagctgcgagcccatggctcttgttaattacatgagggaacctgtttagagaagtgaaaggtgatttcagcagctttggtaagttatttagaggcagtggaaaccagtgtttaaggggaaggatgaaaatctcctgaaggacagtgtcgctgcagccaagtgtcaaacctttggtgctgt

SEQ ID NO: 128586 - DNA, 1061 bp, Homo sapiens
ttcgcttcccaatttattttcttttaaatacttaaaacatttggtttttaagctatttatagccaacctttttttaaaaattaatgtttaaaatgtttttttccccccaatctatcatggttgactgttagacagttggatggctgtgtggttttcaaagctgaggtcaagtttgaatgagctcatttcagatcactctagattttctgaggctgacagtgtccttgggacaccatgtttggggaatgtgtttttgcagtttacgaagcacccgctgctcagagagccgggaaacctttccttctcttttcttggagtctagttgccatggagattgtcactaaattatggacgagggagaggcgagccggcacttggaggtctctgatacgcaggcttctcaatcagggtgcacagacacagcagaggccgtgcagaggctgcagcttgccctcccggctgtcctgggcgtggatgtagcctcccgaaacagctcgtcagaggggtttattcagagaacggaagtgtgcttatggcaggaagagcttcaagggttctcacatatgtttacagctgctctttctccttagcaggactctgagtggctgcagtgtttagagaaatctgccaaatcctgatttaattttggttcatttgctaacaggattggaggagataggaaattgatcttggggaccgtgaagctgctgaggttcagccacgaccaggagtttggagggataatgtctgtgcgtggccataccattttgaaaagcacaaaaccttttatcattaaagcagaaatatcgaaccaaacgtggattctaaagattatgcatacaacaaacacatgtctttcggtgcgtgggtaaaacccataactaatttcaggcctaatctcagtggctcagcagtgcagtgtgggcaaatgcttaaccaccagcatttgcagcatttgggacctgatttgcagccgggttctctagtgtaaggcccccgccccgccgccactgctgcctcccagttactgacgcagtgtcactgaaggtggagttgggagg

SEQ ID NO: 128587 - DNA, 1023 bp, Homo sapiens
aggccgctgccaggtcccttggtcataggctctcagcagaggggctgagcgctgtctcctgctgccccctgctgccccccaagccctgtccgcaagccacagtcagggatgggcaatcaggcctggcaggagctgccagggctgcctccctcttgtcagagacagatctgggaggagccttcctcctccctctctccctcttccttttgtctttgaaattgcaatcacagctttcatttgagccttgggccacagaagccagatgccctgaccgcagggctgcctgagatgagggtctgggggtctctgtcctcccacgcccagcctggcagaggcagccccgcctccgggctgaggcgctttaatctctcacttttcaggctgattcctagaataggggttcttaatgtggaaatggctttctattcctgcctggatgccgccctggtttaacacgttgttttcgatccgatggaaacatttagaaaacctcagtggggtgtggggactccttggtcccaagggtctgtgctgccaggaggggatgctgagattggggggtagctatggcccaggcaatgcccacctgccagcaggcaggcgcttcactcttaccccccctgcagtgggcagggcgcatcctcatttacatctgagaatgcaagggagaagggaggctttgccaggtgcatggctttgtgtttgctgcagaggaggtggggttggagcctgggcaccctgctctctctccagaatgttaaaaatgaggatgatgtttaaaaagagcatctcttcaaacactgcaccttccttttctatgatgatgcgttcgttcctaggaaaaaatgtgatttaacataaccccagagcctcaggctgtcgtaagccctagcgttttctgcagggagaggtgggaaacatggctttgacaggaatcacatctgggatgggctctggcattgaaacccacggtggtgagactgccactgctgcaggtgacatctgtcatcaaaggacctgctc

SEQ ID NO: 128588 - DNA, 3246 bp, Homo sapiens
tgtctcactgaataaacactttcgtttatcttttttttttttttgtcatattgagacaggatgtcgctctgtcacccaggctggagtgccatgatacatggctcactacagcctcaaattcctgggctgaagtgatcctcctgcctcagtctcccaagtagctgggactacaggtatgcaccaccatgcccagctaattttaaaattttgttagagaggcagggtcttgtcatgttgactagcctgatcttgaactcctgacctcaagcattcctcttgcctcagcctcccagagcgctgggattacaggtgtgaaccaccacgcccaacacacttatgtttataataatagattattcataattattgtagacatttcaacagttaataaaaataattcttttgaatttctagaaagtttttcttaggtgttgaagaaaacccaaagcaatgtaatttacaagtaagtagcctagtctctgtttacaacttgctgatttggaacttttttaggtttctgacgtagaagagcttacccctccagagcatctttctgatcttccaccattttcaaggtgtttaataggaataataataaagtcttcgaatgtggtcaggtaatcactttctctttactgtcctgaaatgctcatcgtggctgtaagcgctcagcagcttttgttctattccttttacactcaagtttttcaaagctacattcttttctatgagaaaaatgtttcatataattttttctccattttatcagtaattagaaatatttacattaaacttacacagagaaaaattctaactttctgtaaagaatattcatctaaatagtctctggttagttatgcttctcataacttaaattcagttaagggagaatatagaatgttaatgtttagtaaaatacttcttaccaagtgtgctttcaaaacacttgacaaggttaaataccggtgccattttcgttgaatacgcagctgctactcattttccagtccatatgtcacttgatcagaattacagggtttgctgtggtgcatgcagggctgacaggttacagagggaattgctttgcagatgtctggtacctgtcgaattttaatagcagatacattcaatgaaaacttttaaaagcaccatctttagcagctatgagtcatctttcaacaacatattaaatcttttttgtgtgcattgagggtatacagagtagcctttttcactcagcacagcatccctgttcccagcagcatcctctggttttaatatctcactgtacaatctggcacactctccatgaaaagcatggggtgagttcagtcaccttcccacgtcccctgcaaactggggtttgtggttgtggttgaaccttggctgtacttctgctataatgtattagggtctatatgatacagtaattttgatgtttgttgatttttttgcaggtcatttttggatgaattaaaggcatgtgtggcttctaatgatattgaaggcattgtgtgcctcacggctgctgtgcatattatcctggttattaatgcaggttggttacattcccctctgtcatctggaaggtggctggtgcacctcacaggtgctgtcatgggattccggggatcagcccctgcacttggctactcctggccagctcaggtgtcccccagcctttccactccctgccttctcatgtgctggacacagtgctgtccacctgggcttcctctccttagcccaccctgcatctgtttttatatcagcttgctcactcttcagtggtggaggtcctgttcattttcacctgttgccactaggtccatttaagtgttcctgtctgtgcctcggcattgaatttctgttgatttgatgtgttacctgtatcttaaaatctgaatttattttggttgatgacggatattttggtgttaatatttgacctatctactatttctcgtaagccttagccttgcctattctgaatatcccaaccagttcaagtagtactgggaaaataattggagatatgtataagatgcttagctcagtataaaatgtagtaacatccctgcagggtgactgcctttacctttctgtattatttgctcagttttactaacgttgaaattattttcagagatgatacattgtagatagggagtgcttctattgaaacaaactctccctgtaagcctaaatggataggatatctgcagattgataagaatactccttaactggtttgacccaggttgggcataagaaaagacttccctcagggactcccctgcattgagatcaccaccaggaggatgttgaggatggatgttggatgctgccaggtgccttgcccttaatacatccttaactacctgcgatagttaaacaggggaaggactctgaaacaggattggtttgctggcatggacataatccttcctctcatggcttcatggggtgaggtccatttgaagtcttcttcccagtaaacgtttgtttgatctttacaacatccctaaagaagggagaattactattccgcgggtcagtatgtaggttacctcaaagggaaggatagggaggcccagcttagggaagttgtaccacatgtgtaccagagtgtttgtctttgtgtagtgatgttaaagtcttttctgtcttttaatataattttcccaggtaaacataaaagctcaaaagtgagggaggttgcagccactgttcacagaaaactaaagacattcatggaaattactttggaagaggatagcattgaaaggtaaaggagagatattcaccagatgtgatcatctaaaactgctcattcttctttggatctgcatgaggttgtattttcatttctgctacttacacccaggtggttaggagactggggactctaaggagagaaatgtttctgttggcaaagacctttagcttacgtttaatttacttgctaattctgtcttcaaaaacaaaacaaaagtgtcatttgcaaaattctactgtagaaaagtgagggcatacaaacttattttatttagttttaaaatcagacattatttttggtggttgctgcattattgaaaccatgggcgtttcccaaggatagacacctagcggacaaatacccacatggggatgtgcggtccctccagagcctctgagatgtgtgtaatttcccccttgctggacagcccattgctacgcacagcctgcaggctaccagtgtattcg

SEQ ID NO: 128589 - DNA, 2293 bp, Homo sapiens
acctacacagatgcatcagccctggctgtgctgttcacgctcgggtgacacgcagtgttgtgtgggaggtccctgctggcgaggtgcactgagagagatggagtccgtgtgggagtcccccatggtggatacactgagagggagatggtgacccctgtgcatgggctggaggcaggaagggcaggagctccagctgttagattctacccaatggtcttagaacaggatcccaagagttcaggttgaccagacggcaggacaggaagcagaggactgattgctctgggttctgagcgcataattgttaagttcacagagttttccaaataaaatatacctttcttttgaaagatgctaattttgatacttgtagagtggcagacatcttgtcaggtgaaatgctaatttctgtcatgagttacctccctgtcctatgttaaccttctccaggttggaaacgagagtcacagaccttgaaggggcccgtggcttccctttgctggttgaaagctgatgtgaagtgagattgttgtataagcacttcatataaaaacctgtctgccagatttgcttcatcctaaaaacaatgtcatgtcagttctcgtaccacgtgatgttgttatcagagagagccattactttttctaggtagtagcttaaaaatatcaatgagctattattttttaatgaagactttaaaaaatgcttaaatgggaggctatttatgaaatattgaagactcggtgtcctttgctgatagaggtcattgaaggttgttggccatactttttctagtctagttcaatttgagttcatttgaaatgttcctgtttttgatgaatttgtttcaagtgcctgtgatcttttatgtaatttgtgccaaaacctttaggtttcccatcagacctgtgtagctttagtcagaatacattgcctcatagctgatgccttattttaatgtattgatgttttgcctctctccctccttattcctgagggtttttcttggctttggggaaagaatatcatcagggcagttcccagtgggctttggtcccgtctatcatcttctggccgtggtgcataggaggtttgagtcagcctgggagtggaatgtagtgggcactggtagcaggcaaacaagatcagtgactccttgagtcctgggggaggatagtaagaatacttattttaaagtgtttttttgtttttttcaaaaccatggtttttagtcattaaaagtgacgtatgtgttttcttgtagctgctttattctgttcagaggcctcttcatgagttcattactgctgttcagtctcggcacacagacacccctgtgcaccggggtgtactttctactctgatcgctgggcctgtggttgagataagtcaccagctacggaaggtgaagtgctttaatcctgaaactgctgtgcctcttattgatgacacaagatggtgtttctactagcagtacattctctacgtttctcaaagtattttttaagaattttcaaacttgagtgagtggtgcactttcctagcagctacacctcagagtttgatagctagttagtattttagactcgtgactattgtgaaacatataccaaggatattatcactcttgattaaaacagaaatatagtccttacatttgaacatgcttttatgctacattcaggagatttaaatgagttgataagtttcttaaggttattttccctcctaaaaggatagaagtagttgtaatcagtggtgagcagaatacaagactactctaggagtgcttttgtggaatagttcacatatctttgcatgttatattattagcctcccccacctttttttcatttctaagctaggatgttcaaccttctaatgtcagtttagactgggcgcagtggctcatgcctgtaatcccagcactttgggaggtggaggcaggtggatcatgaggtcaggagtttgagaccagcctggccaacatgatgaaactctgtctctactaaagatacaaaaaattagctgggcatggtggcacgcacctgtaatcccagctgctcgggggctgaggcagtcttgaacccgggaggcggaggttgcagtgagctgagatcacgccattggactccagcctgggcaacagggcgagactccgtctcaaagaaaaaaaaatgtagctaatatcagtttaaacagacaagttattcattattactgactatcttattttcctaccggtagctgtagatgaattgaagatgattattaatacagaagttattagtct

SEQ ID NO: 128590 - DNA, 1100 bp, Homo sapiens
tcatccatcatttgtttaacagatctaaagtttaagagtaaatattaaatagaccaatattatttgcttcagcttttttgtttaattattattattatttttttttttatttttttttttttgagaccaagtctttctctgttgcccaggctggagtggagtgcagtggtgcgaccttggctcactgcaacctccacctctaggttcaagcaattctcatgcctcagcctcctgagtagctgggattacaggtgcccaccaccatgcctggctaatttttgtatttttagtagaggtgaggtttcactgtcttggccaggctggtctcaaactcaagtgatccacccaccttggcctttcaaggtgctgggattacaggcgtgagccaccatacccagcctgtttaattctttataattcacttctgttgtgaaaacagcattttatacttaagcttaatgattgcaacagtcaaaattatttattttttaaacttcacttatcatttaggaattattttcccgtaaggaccaaatctacttttattatttaaaaaatttactttttggaggagctaattataactagaattctagatctccagtgtagccagtttcattgtataggtatatctgttctcttaaaaataaaacagaaccaacaacactgttctctaattcaggtgttgagggaaccacactgctgaacttctgtatgttcacatgtgcaatgaacacaatttttagtttagtgactaatacactattactgttattgaagatatcagttttaacttaaatgggacaaacgtcatacttatttatttattttggttagaatttaggttaacctgatcaacctggcttttggtattggctcaccaaataccaaagtgtaataatctcttttttgttaccattttatacatgtgttaagtgagaaatgtgtaatgatttcaacaaacttgtgtgattagaaaactgatatattccaattttctttctagtgaagggatttttttatgtttcattacttcttgacattctgaaagagataactggaagttccttgattcagaaaacagattcagatgaagaagt

SEQ ID NO: 128591 - DNA, 1003 bp, Homo sapiens
tagggtcatttatcagcaaattatccaggttagaagtcttaagacacagaaaactttctctttaccaagtttgttatgtttcaggatttcattttctactttagagtggtaattttagacattagtgttattcttaaaaacttacagggacatttatctaactttctagtttatctttttgcaaagcgtaaactgcatactttcagtgtaattttatacattacatataagaggtgttcgattatgtttgtggaattacataaaatatgtctctagatttcttacaaaaacaagaattaatgtatctttatgaaaattcctttataaaacatctttataaaaatctgctttataagataactagcacatggataggagaagctttgtgaggctggatttactccctttttaaaaatggcctttgttgctaagctgtgtctgtctcttacagacctacctgactgtgtgtaaagatgttgttatggtaggccttggtgaccatcagtttcagatgcaactcttacagcggagtcttggaatcatgcaaacaggtacagtcagggctgttttagagcaataaatactcagaaccagtccttccctccctccctcctttactgtgtagctcagaactctcacttttaagtgactgattataatgcaacctggcatatcccaaaaaagggatttgttaggtggttcagcccggaaattaagaggtgtttctgtgtcagacatgactacatccagagtttgtgacagggtccttgggattctgcctgtccttgtggtcagctttgttgccaggctgactttccctgtggattgggctagtggctatttcctggcatctgtgtgggaaaccatcacctttttgctctgctctggtcatgtgctcctgtggatgggggcgtgagtcagacattattgggtggtaccccaccaggacccccggaagttgctgttaccacagggaaagggttagcacagggtgacccatggc

SEQ ID NO: 128592 - DNA, 1531 bp, Homo sapiens
atttttaattacatttgtggcttttgtgtctcataatatttttcattagagctctacaatgttggtgattatctcaataaaaattatttttattcatatttgtggaagaaaaaggaatattttgatgctaaacaaaaattgttcttcaaaagtagaaactcttgctctagaatctgacagatggcacagaaacagaaggatgagggctttgtgtggctgctgtgccctgcttcttcagtgtccagagctggtctcaggtcttgtggtgggatgcagctgagcagcaattgtgggaaactgtatttattcctgcattggagagcatggaagtgctaatataataacaagggcttatgcaccgtcagattttagcttcttggttttcctcaccttttgacaaagttggggagtctccgttgaaatactcagtccgattttccgtctgacattttcagctgtggtgtgatttccacgctgagaagccgggaggagggcgctgtggacaagagctactgcactttgttggattgcctctgctcctgggggcaggtggggcacattctggagcttgttgacaactggctgcccacagagcatgcccaggccaaggtaggttgacatcatgtttccttaaaattaggtgagtgaggataactgtgtattagaaattacatgcttttctagggacgtgtgttttcattatcagtttctctctctcttctttcagagcaacacagcttctaaaggtagggtgcagatccatgacacacgcccagtcaaacctgaattggcattggtctacattgagtatctgctgactcatccaaagaaccgcgagtgcttgctctctgctcctcggaagaaacttaaccatcttttgaaagcccttgaaacgtcaaaggtaactctgtgccctgagagttgagtggtttcctatgattgtgggggtgacaaatcaaagtgtgaagctttcatatttacagtgctatacaagtgttctggctggaacagaattgagagtgatcatgtcacctcattcagttggtacaaggcatggagcctggccagggcaaggttgggagtcaagtcccagttgacacgtgttcagaaatctcacatttgtgttgcacctgctagggcgctaggactcaggaggatggccccagtgtctcagaacacaccctctgcaggagatgtgtcacataccctttcatgtggacactcactccctgcagtccttggcagttttttctgggaatgtttggagagcatttcctgggaacccatcatgctcccagctgtcccacggaggccgtcatctcttcctctcctccaggagccagccctctgaacaccctgttacgctgccctcaagtgtgactgtaccagaagcaaagccccagcagagtggagccaggcagatggggaggacggggcctggtcatgaggcagggaggggacgggtggtgctgcgtgcagggcaagggctgtggacggtgagctgaggctgctcacctggctgtacattttc

SEQ ID NO: 128593 - DNA, 1039 bp, Homo sapiens
ggaaagcagccttcaccattcccctccccctgcatcgagatttgtggtgaaaagtgatgtcttttaataaaacagaagatacagtgaaagaaaaggcatgttttttaatagggtgttatgttcccagatggagacaatagttgatacgttttcctttttagaggagttttcttcatgtaaactgtttctttaaaggatgtagagtcagtttggaatttatatcgtggtgggcatttaaaaataaatttacctccctagaagattctaaagtggagagtagaagacgtgaaagtaagacggatgttctctacatttttgctttagagctctaattctgagatgctgttaccttttagtagttgctatgattagatcctttcacaataaaattatttttatcttaggttctggacaaaacactgtcagtaaacgatgttgcatgcatggcaggtttactagaaatcattgtgattctctggaaaagtattgacagaagtatggaaaataataaagaggccaaactttacacgattaacaagtttgcctctgtgcttccagagtatctgaaagtatttaaggtaagtcttgaactatacttgtaagcaaggtatattaaggttacgtttgtttagaatttaacaaaagttctcaaacatgtttacctccctggatctgtgttctcatctgtaaaatgagagggttggattagtgtttaccttgcagtatagtttctttctgttgcccctcttgagggtggagatcttgtgtctctgtctgcttccatatcctcagcacccagagaaacgtcttgggtaagcacatgattcttctgcctccgatggtcagcgacattatttcagaatctaatttgatttgcaggggtttaagaaagagtttcgtgaacatggaggtacagtagtactcaagttctgtgggcagttaggtacccgaaggcacccagtaagcaaatatgtccctgaagtatttgagttgtgtgtgttgttggggcaaacagttgtgtgtgtgatttcttttttaa

SEQ ID NO: 128594 - DNA, 1532 bp, Homo sapiens
gctgtgggcgtccatgatgatctgggcaggcttgtgtcagagaaggagtcaactgtggatgggacaggcagccccagggattcaggagtgatgccccagcctcttagataggagatggagtgtccacgtcaaaaacgttgtatatatttttactcacttttcacattaatgggccaaaagttaaggtactttaagaaattaaaaaatattaattgacaatcatagctatcattggagagtttactgtatgttaatcatggtgttaagtaattttaattaaacctcttagcaccctaatacttgggtgccttatataacagtacttttaaaaatatagatttattaattctaatttctctacagaaagtcacagattttggtgtagtcattcgaagtgaatttttttaaatataaaaattagttccttttttggttgtgcttgaaatttttcttaagctgtttccagggttacaggcacaattgattatttccttctgcatatgtgctttttgcacagttttggaaaatatgtcccatggagcacattctggttcgtctggaaactgattctcgacctgtgtctcggcgcctggtgagcctcatctttaattctttcctgcctgtgaatcagccggaggaggtctggtgcgagcgctgtgtcaccctggtgcagatgaaccacgccgctgccaggaggttctatcagtacgcccacgaacacaccgcctgcaccaacataggtagggagtgctgttatttctcagttcttgttatgttttcccccaaaagcataatacaaattacagagttcagtatttgtcaatttaataagcttcatactttaatgcatttctgaatgatttcccttaaaatagtacttttgactaattgggattataatttcactatcagatagttaattttgtagaagaaacacatccattaattcttgtttatcctaaacatttcagcaaagctgattcacgttattcgtcattgcttaaatgcctgtatccagagggcagtgagagagcctccagaggacgaggaggaagaggacggaagggagaaggagaatgtgactgtgagtagaacagggccaggccgggcagatagtgcctcagtggcatcactcccatgggccattatgttaggaatattcctatgttttctttgttcctttagtattgttaattaaacaagttattttggaaggtcataaataacatttgtgaaagaattgctatatgtcctttgtagttcattttggagctcaggtaggacttaatacagaagaaaaattcttaccagtcacatcttgtcccagattttctttaccttaaatgtctctgtatttcagttcaatcctggatgtagcatggctggattggattctgggtactcccatatttttgaaagtataatttattaaagggacaatttcttcagaatccaaagcaaccaattatattagaagaaaataacgtttaagacttagacaaacttgttacttataagcattatcttaagct

SEQ ID NO: 128595 - DNA, 1036 bp, Homo sapiens
gcagagttcttggacttggtgcctttggagaccatgtgaccagtagttattctgtgtttctttcaactcaaaaattctctaaaatttagctgagagagagcattaaagatttcttttataattgctttaatcttatttgaacaaaacaatggatggaccaaatagcagtggttggacctatactggttcattaaaagtatgccttttatatgaaatagttctagaaaaagtggtattttccataggtatatttatttcactagtagttctaataaagatggaaccgaatgttttctttaatgaagttttcctacctgaacctttcattggcatgttctgattttgaattgtttatctttctctctgttgcagtgtctgccaatgattttggacaacaaactgagccacccattgttagagcagctccttccagctctcagatacagtctccacgacaattcggagaaagtgagggtagcttttgtggacatgctgttgaagatcaaagctgtgagggctgctaaggtaggatgaatagggcttttttacttatgacatgaaatagggacatgtgttcatcaaacagaaagaaagtagttttaattccacattttaaactgataactgatatgatttgaccagttatctctgtcaaaaatgttattttgtgtttttcatcaaaggttctagaaatattatcaatgtgttttctttctgaaagacattaatgtaagcacccctgccttccattgtattttcgtcatgtatgaaggttttcagtgagatatttggtgtaatatttggatacttggcacctggtgagcacttctggagagtgtctagtatgagccaccccccacccccacccccctgccccacacagagtgaaggagggagacacctgctttatgaggagagtgtctagtatgagccaccccccacccccacccccctgccccacacagagtgaaggagggagacacccactttatgagagatgtgcgttttgatgttttataaactactgaagtgattg

SEQ ID NO: 128596 - DNA, 1016 bp, Homo sapiens
ataattaaagtgttactttgggaacactgtacttaagccttcgtatgttaactctttgggattctgagatactcttcttttattattataggccagaaactctgaagttcgatcaaatgctgcattgttgtttgttgaagcatttcctattagggatccaaaccttcatgctattgaaatggatagtgaaatccagaaacagtttgaagagctctatgtacgtacttcaggtggtcaagcttcttacagatatcagctttgtccaggctgtggcatgtactgcttgtgtgtgtccccacctcccctgtaaccgccagagctctgctcccacatggcatggtttctaaacctggactgttcttcagagagatgccacttctccctggggccttctataacagcgtggacctgtggtgtctttttctacttttgggacatttaattatttattactatgtgtggttttaaacattttatgcatatgcctgttgtttccccaatggagaggtggtgtcatatggtgggtaaagcacatgctctggtgtcagccccctgctctctggggtcagagtccaccactctcacttaataggtatgtggctttgggcaagtcacttaacttctctgtgtctttctctgtaagtgtgattgcgatattgcctatcctaaaggtgttgggtagcataatgagcaaacactggttatatttcagggcaagcctacaaataatgcctgtggcaggtgatttttcagatgaggtgctaggatgttaagatgcggcatttatttccaaggagtattgtggattcttttcatctacttagtctgtatttcctaacacagcttacttaagcagtgcatactatctactgtcctaagtagtaaagttttaggaaacaatgacaacaaagtgctgttgtaatgctgttgcctgtggtgcttctgaagtgctcccttttttctttttcttttctaacttatggaaaacctgacatgcagaaagttaaagtaatagt

SEQ ID NO: 128597 - DNA, 1051 bp, Homo sapiens
tctatgaagcaagtgtactgttgatatcaaagtttgatagtattgtacacaaaaagcaaactatagactaatgtcacttatcaccatcaatacaaactacaaaataataatcagaaaaaaataatccccatactgcagctcttctagggttaagttgatacaagctcacttaaagtgtaggctgttcttttacagcctgtttaatctttcaaaattttcatgtttcactaataaagtttagccccaaaaggtgtgaatagagaagtaaggcaaaattaattgttgttagggacatgaggctacaaagaattttgggaagattctgactggaaaagaagtgagtaggaaaagaagaatgaaagctacaagaatgatcattttctgattttttcataagttttgggaggaacttgatacctaaattaatctcatacagtgaggggtcactaagtgtgacacctccttgttacaaagttatgaaacagttaccacatgttggtaataaagaggttagttaatgttttggaacaagcgtgagctcttagaaccattcaggaatctccccttttccattttatcctgaaggtcagaggtttaaacgagtctttttttgaggttatgtggctgttggcagaatagcagaaactagaacccaaaccattttatagcccaaggccattaatctttttatttcagccgtagattctttcttgtgattgactgcatttactactgtcctatatccattgaagttactcctgctgaagaattgtcatgacatgtggatgccagccagagcctacttgtggtggagagaacaattctccctgttgctctttccaaatgccattttattttatttatttatttttttgttaatgccttccttttcctttttttggtccttaggttctgagttactttcaccatcaaaagaaagttcggcagggagtggaagagatgctttatagattatataagcccatcctttggagaggattaaaggtatacatttcaaatagtttatccgtgtttggaatgtactacttgt

SEQ ID NO: 128598 - DNA, 1006 bp, Homo sapiens
cacatatagtgtcacaactatttccataacattgacactgtattaagtattataagtaatctagagatgatttaaagtgtgcaggagtgcataggttatatgcagatactactccactttatatgaggaatttgagcatccgcagattctggtctctgagggaggtcctagaactgatcccccatggataccaagggatgactgtgtaatattgaagtaattttacctgtttcttttgtctgtttttaatgcagccactagaaaatttaaaattgcatctgtggcttgcattcagtttctattggatagtgccgttcagggacttcaagtcacctcttttagttacattatttttgagaatttgaagatattttctttgattatgggtaactctggtgaatacatagtatttatgttatgaagatagggctatgtaatccacaatcccaactcaacatccagatacccttttggacaaaaaagtgtgtttgttttcccttatatttttcttataccaggttctcaatcattttatttttctctgagaataaaatttttactctaggtcagaaaggagcctctcacaaccctgtgttctatcctgacttttcattcctctttggagagcaggccctgcactgatgggcagagggaggaacctgcagagtggacagaggctgccccatgtctgggtttacttccatcctctctgctcctctgcacaacttacacttgatttgtattgccaaggtttatcactgacttctagaaaataaaaaataggctgggcgtggtagctcacgcctgtaatcccagcactttgggaggccgaggagggtggatcacctgaggtcaggagtttgagaccagcctggccaacatggcgagaccctgtctctacagaaaaataaacaaaataaaaactatttgactagatgtatacaaaattggtatcaacaatgtgtatttctcagtctcactccattcctctctgccctccctctct

SEQ ID NO: 128599 - DNA, 1936 bp, Homo sapiens
ggaaattctagcttgacaaacacttagccttttaactatatgagtcctcagttttctcatctataaatgagaaggtgaaatgaactgggatattcaactccattcccacccacctatgctagatttaaagctttctttcatttgagactatggaaccatccatgacagagccagaatgagatgtttatggacccatggttactgtctgtggtctccatctctgcacctgtggcccttgaggacagaggcgctcagtgtagcggctgctcggccctgggggaggtggcttgtgtggctcctggctgtgcaggccccgcagacagctcaactcgtgcatgtgctctcagtgataattacatgtgcctcgtttttagcaatagcaatgtttagcttactagacgttcaaataattgtttgttatttggcactttttatttggttgcaatgtaaacattctatccttttttatttctagggaagaagatttcttagttgtctcttcaactggaatatcaacttcatcaaaatgatccacgggaccattaaaaaccagttacagggattacaaaagtaagtgttaaaagtactgaagattttgtgctgtcttaatctggttttgaaagattccatttggtctgacttcttaagttatagtaatggattagaagctttagaaatacgttatttattatgtaccattggatcactgggtagctttttccttttataggaaatcattcttttccagtattgaccactgaaattaaggttttaatttgtggtagttctttaaatagttaaaatagtttccagttgaaccttagcctcgctcgtaataaagccatgtccatggtactttgaatgcaatgtgtgctttttggttgaacgtggcctggccagggtggcttctcggaagagcctgtggaatctgcaggagcagcagggaacgttgcagtcatgactctgccactccctgcgtgatggagatgtcaagtgtgtgcttgtcgtttgccaggcacaaggcagagtacttcatttgctccagcactgagtacttagtctccattttaaaatttaatcctcacaactctcttttgagataggctttgctttctaaatttcccagtgtcaggcaactgtataagtaccaagttgggatctgattctggatctctgattgcaaagctcctgttgtatactagattgctttttcatatttcctcatcttcagaatatttgagttgaactaatagatttctaagcttatgattcttaagttgatactggtattttagggcttcttgtacctcaggaattggtagcgtgaaaagtccaacgtgactccaagtcgacaatttatttatatttaaatatttttgactttagaattttgttctggacttatgcactcatagtttcacagaaaatagtaaagttttgggtaagccttgactgagaaggatgaaatagttcgtcacttcagtttcctttcccaaaaccttctccgttttctactttttgctacaggtagataacctatttctatagatgatttgcaaagcactagtttaaactgagtttcttcttcactatggttggagagtagctgaaatgatacatgttgaaagaataattcttaaaatttgcattaaaactattttgatctttttatataggtctttgatggtatacattgcagaaatttatttcagagcttggaaaaaggcttcagggaaaatactggaggtattttcatttttttaaatgttaacacttatttttattatattttagttactaaataagtagtcaaagaagggttatttaagatccatgtttatgcactctgtcaaaataaagccaaataatgaaaatctatttgatgggcaatccagtcacttgctaagatgtgtggtttgtgggaggtaggactgtg

SEQ ID NO: 128600 - DNA, 1962 bp, Homo sapiens
tgttgcccaggctggtctcaaactcctgtgctcaagtgatcctcccaccttgccctggcaaagtgctgggattacaggcatgagccattgtgtctggcctaattagtttaatttaagctccattcagatgttatagatggtgagatgggcagtactcagcaactaactgctatttacaggtttttcagggaagtctgacttactggaccaatgatcaagaacttgttgagaagaaaatacctgattatgtgattaccattgctagatagtgtcaacttaactaagaatttgtgacactgaattttttcttaaagtatgttgtgaacgtgatctgaggagtgattattgactcctaggggagttttactgtattgaaatttaaatgatggtacttttcaagttttaacaaaactgtaaaactagttattaatttagtctaagttaatgaaaatatttgattatgaaatatataaaattttagttacaaaagatgtaaaaatatcttaatgatttttaagaaaacttttcacataccctcatccttcactgtgcgagtgtaattagtttgttgtgacaaagtatctcatcaagcttcttattcttagcatcacttggatttatgtatgttttatagtacattgttttattctgaattcttgagttgaaatacagtgtcttattaaaaagtcaccccaatcataatgaaaatagcttccaaatgctttgtgaattttactatcagtttatttgtatggtctgcaaataactagtgaaatgattagtgctaacactgtagttgctatcaacttcccagttaattcaggaatgttatattagtgtaatgacattcagatacctacagattataattatgagcattagtatcattaatctaattattgagcttttctgttaataaaagcactgcagtttttgtattcattatggtaattgctttgactgtttttcacctctgagccaaaatttgaggctggcacattgagggatagtagtggattattgattggtcagtagacctgtcttggctctggtgttaacagagataccattggtgttgttacactgaggtttggttagcctcagcatctgcctttctaaaattggtgatacgatttctctgagacttccagttccaaaaatctcttttctattatgtctgttgagggtctttttataacaatcgtcaaacagttttttaattaacattatttgcattttataactaatgtatataaatctttggcaagttaaacataactaatattatttgcttagcaaagctttaaataatatataaagtcatgatactctaaactgttgactctgaagtaataagaatttgccttactaattggaaaattactgtgctgtattttaggtattttatatgcattacctgagtctgaacgaaaactacagagttctattcaggatttgtgtgttacctggtgggagaaaggcctgcctgccaaggaagacacaggaaagacagcctttgtcatgttactaaggaggagtctggagactaagacagtatgctcactttttatttttttaaagacagggtctctctctattgcccagatggagtgcagtggcatgatcatagctcactgcagcctcaaactcctgggctcgagcaatcctcctgcctcagcctctcaagtagctgagacttcaggagtgcaccacctagctaggactttatttttaaacgtcttcctaacattctaaacctgcgctattcaacgtagtagccacttgccacagaaagctgtttaaatttaaagttaaaaataatgaaaaattcagttcctcagttgcattagtcacattttagtagctctacagtgaaatgtggctaatgtctactgcactagacagttcagatgtataaaatcttcatcatcgaggaagttcttaaacttgctggatttttaa

SEQ ID NO: 128601 - DNA, 2667 bp, Homo sapiens
caattgttcatgattgaatgtcgggtctataggtagatcaagatactgtctaaggtcaaacatttgagagctggtctgtgtttgcatgtgattgacaggcaaaggcttaaggaaaatggagaggagaattgaaggggaggagggtcaaggaaacgaggaaagagagtagatagaagtgaacaagcggaggtggaaaaagctagatgaaaaatgaaggagcgctaagaagaggagaaaacaaacaccagggcaggagaggagctaggagagcaggaagagaggatggggggatggagggcttatgaggttatctttactctagttcctccatcttactgtgttttttatgaccccgacagttttgaagagtgcaagtggctcttttgtggtatagccttcaatttgcatctgttgaggatctgattaaattttagtgtgcattttggcaggaactgcttagcagtgttaggtcctcggcgctgtcaagacaggaagcgcatggcatggtctgtccgtccctgtgtgggtaggtgtccgccaggtctcttctgggaacctgcctctgtgggaaagtggtgacactgtaatgtcctgctgctcaccaggcttccacccacttgtttcagcatctcccgataattcctgccagagtccataattattgtgatggctataaaacagtgattttctaaccctgtattgcatctatgtttattcactgacattctagagcatgcaggtgctattaattaatgatttgatatttattatcagtatgctgtcattgattttttctttttagagacgggctcttgctatgttgcccaggctggagtgtaatggtacaatcacagctcactgcagccctctctcccagagtggttggcttggcctcgtttatgcttatttcattcaactggttataattaatcactgtcactgttttggtgctcacattgttccaaatttggctatagggagtccctttaattggattctatgcccttttgatgagggccgctatttgcttcatcaaagagtacgtgaggtcatctcagataagaggaaatgggtttagagggttgttggaggagatctgaaatcatcttgttggctggtgggagagaatgatattgaggaatgagtagaaggtggtgttgagggcccacttggggctggaatctgtggccacagtattattattgccattgttattgaactttagcctacttttgtaatctaattctaggtatggagatggtggacatttgggtcccttttagggagggttttgctaagtgggtgaaattttaaaaactctgaagattaggatgctaggaaagaataggtggagaatccctgtgcttcttcccttttaggaatggattttgaatactgcaaccaaactcttgaacttgtaatgaagttaacacttaacttttcttttgatgacattatgaaaaggatatgattaattttttgtatttgaaatgtgacacttgctatttatgttacagaaagaggcctctgatcctttcagcctaaatgaattactagatgaattatcaaggaaacagaaagaagaattatggcaaaggctgaagaatttattgacagatgtgttgttagaaagcccagtggatgggtggcaggtagtggaagcccagggtgaagacaatatggaaaccgaacatggctcaaaaatggtagtatttgtttttcaaaaataagaaacgtttttctcttttttttgtcaaaaaataacttcactgtgtatcattgaattttacattaagacagattttgaagttagaagtcaagaattttagaagtttagtctgttgtagttttattcacttttcaaccctactgttattaatctaatactaaatattgctgttcttttaggatgatttacttttattcaactttaattctttttagaataagctagaattgtggcttgatttttagaaaatttgtaactgaaatttctgctaaaaactgattttaagttgatgattttaattcactcatgctttgatttttcatttatagagaaaaagcatagaaataatttatgcaattacatctgtgattcttgcttctgtgtctgtaataaatgaaagtgagaactacgaagccctactggaatgtgttattatattaaatggtgagttgattttgttataaatggcatatttagaagtgggtgttgaaatacttgtttttgtttctgtttttatttattcattcatttatttattttttttgagacggagtttcgctcttgttgcctaggcaggagtgcaatggcgcgatctcagctcaccgcaacctccgcctcccgggttcaagcgattctcttgcctcagcctccctagtagctgggattacaggcattcaccaccacgcccgcctaattttgtatttttagtagagacagggtttctccatgttggtcaggctagtctcaaactcctgacctcaggtgatccacccgtctcagcctcccacgtggctggcctgaaatgatactttgtaaaaggaaactagttgttttcatgagcattgttgaatttagtagcagaagttgtataaaggtatagctttgcagtcaagttctttttcttcagctagaataggagcatacttacataagagttg

SEQ ID NO: 128602 - DNA, 2207 bp, Homo sapiens
cgtagttcatagttcagccatttgagttgaggaatgagatgaccagacttcactgttaacttatttcgggagtcattaaactgaggttatttttgctttgttcaatttggacattaaaatctagtattatatgtttaagatgactctctgtccccataattattggcaataattttccatattgctctatttataatggtgcaggtggttttcatttatttttaaagtgagggggctcctactgcaaatgtgttccatcatttgctattacctcatctttaggttgatgttttttcagtagggcaccagtagcaccaggtattgtgaatgcgaaatagaatttcctggaaaaacacaggcaggatggagggtatacaaagtcccctgagctctcattatcccgaaggggtgggaggagggtgctgtggttgagcatgcctaatgcatagtctaacaagatcccaggtgacccccggggccactgttttccatctcactttgaataacaagatgacactaacagtgggatttttttgatggaggaatggcctttagaaagggagcatcttcagaatctgcagctgggatcagattgttcttttgttgaatcaactcagctctgccgagccagcatcttgctaaggtactaaaaagggagagatggtggtgagcttcctaaggctatttggatttctccctccttagttggtaattttattaacaattgttgataaaatatcattaatatcatgttattcacatccccagtaaaggaaataagtaaattgtttttcagatattatagcgtgttttatgtcagaatgtttttagaaactgtctgccatacgtggttgaggaattttcttgcagttcttggatgttaatatcaaattaaatcttacaggaaaagatatatttgcaagtgtttcagtatgattgtgttttccattagggttacaaaataaatgccatttgaacagtgccatctgtcatggaaaaacgtgagacgtttgtacaagccgtgtctaaggagctggttggagagtttttgcaatttgttcaacttgatgtaagtttcatgttttagttttgttgtgatttttgactgtgaatatgaaatatgttctaaagtcattatgtccccaaaagaaacatagttatctcagtgaatccttagcgaccaatgtttatttgaaagaagaaaacaaaaccctttatactcaaatctacctgctggtgggctacgctaagatgtaaaagataaacagaagttaaccagtcaaagagggatgttgggggaaaggacccatctaacaaagaaggtcactctgaagactagagaaggtttgttgtgtttgaacttgaagttcagcaggaaggcagaagatgaggctgggggctaggctacacgagtctttaccattttaaggaattcagactttatcttgagaacggtgggtgcttgaagcagggagcgagctgtaggcaagggaggaagagaacaaaagagaaggagagagaactagtggacaaaatagaggtaaggagaaaaatatggtttgccttttggaaatattcctctgactacaagtgagaaatatgtcaaagggacatatttaaggctaacctcttaggttgtgctcttcaaaatgatggttgaattaggaactggaaatgggaagctgcttggtagtgaagtgatggcactattggactgattggatatggatatggtggggaagggcccaggcgtctgactgtgtagtaccattcagcaagctcatgaacgtgggaagagggcagattcaagggagaatgtggctccattttggaggtaccagatgactggtggtgggatgtgcaccagcggatggccagtagtcagacatgcacgtctggataccaggggaaagggctgagctagagacaggttgggcatggaagcctaagtcatgggaatgcctgcagttatctctgtagagtttcagataaaagggcctaggacacatctctgaggaagccagcattggaggcactgactctgaaatacgaaagtatctttggggcaggagacccttggcacacttgtctcacttgttcttattatgtggtgaaaatcaaattagtgacaaagaattagaggaatctaataatgaatttgttactggcaacatttaagaaatcatttttctttataagagaaatga

SEQ ID NO: 128603 - DNA, 1048 bp, Homo sapiens
gccccgcgtgcgcgttccgtagtgcccggtagggcactgggcttagctgctcgaggccgcgccctaagaggcggggcatagacaggaagaagactggcgggcatgtgggcggggcatgatctggaggcggggcgggccgggcgtgtgggcgaggcccgaggctcgcggcgccccagctctcgcgagagcggcgcctgatgacgaccgggagggcggggcccgtctggggcgccggcgggtgcgtttgaatctggtccgagcgcgggaaacggcgggtccccgagcccaggtaagagctgcggtgccgagccgggattgggttcagagcaggggctgggaagtagcagggatcgggcgggaagcccctcctcggctggtcggggtcccagcctcccctcccctaaggaggcggccgacctgcgtgcgggcagtgctgcctctgacggaactggacggaactggcgaccccgggccatcccccctacccagctcagcgacgcccgtccttcttgtccgtgtcggaggaaaatcccagccccgggcgcgggcactgccctcagagagcgaccccccagccctgagcatgggcaccgtcctcagagagtgtcccctcagtcctgggcatgggcactgccctcagagagcgacctcctctgtcctgggcatgggaactgccctcagagagtgtcccctcagtcctgggcatgggcactaccctcagagagcgaccccctcagtcctgagcatgggcactgccctcagagagcgtcccctcagtcctgggcatgggcactaccctcagagagcgaccccctcagtcctgagcatgggcactgccctcagagagcgaccccctcagtcctgggcatgggcactgccctcagagagcgtcccctcagtcctgggcatgggcactaccctcagagagcgaccccctcagtcctgagcatgggcactgccctcagagagcgtcccctcagtcctgggcatgggcactgccctcagagagcgaccccctctgtcctgggcatgggaactgccctcagag

SEQ ID NO: 128604 - DNA, 1157 bp, Homo sapiens
tactcaaaggagaacaagataaaccatcgagggcaaacgttttcaaccatggctgcccatgaaaactacttcagctgctttaaaaatactaaaggctaggcttcctggccaactcaatcaaatcgatcaattcaaccggggattccctgggcattctttttttttagacagagtctcacactgtcgcccaggctggagtgcaatggcgcaatctcggctcactgcaagctccacctcccaggttcacgccattctcccatctcagcctcctgagtagctgggactacaggcgcccgccatcacacccggctaatttttttgtatttttagtagagacgggttttcactgtgttagccaggatggtcttgatctcctgacctcgtgatcctcccgcctcggcctcccaaagtgctcggattacaggcgtgagccaccacacccggcctgcattcatattttttaacctccccaagtgatcctaatgcacaggttagaagaaactgatctcagaaaacatgtaaaaagaggaaacgtgaatgactcgagtataaaatcaataaagctgaggttcctgctccaggctgaacctgaaacagctgagaatcggactgcgcgatgagtggctcctcagcacctgcccaagccaggcgttaacgcgggacaatcactgtcctcttaaagctcatagcatgactgagaaagtggacacaacccaagtgtccatcaacagacaaatggagaaacacagtgtggtcttttcccacaatagaatatgactcagctgtagaaggaatgaggctctgacacccctacagtgcagatgacccttgaaacatcatgctcagtgagagaagccagacacggaggtcacggattgtaggactccatttatatggaaggtccacatgactgtaaaatccacagaggcaggaagcagattaggtgttgccagagactgaggagagggcgtggggagtgactactaatggctgtggttttggggtgacgaaaattatctaaaattagatagtggtgatggttgcacaaccttgtgggtttactaaggccacacagttgtatgcttaaaagggtaaattttatggtataaaactgtatctcaataaagctgttattaaaaattcacggctgggcgcgg

SEQ ID NO: 128605 - DNA, 1119 bp, Homo sapiens
gactggtcatggtggctcaggcctgtgggtggatcacctgaggtcagcagttcgagaccagcctggccaacatggcaaaacactgtctctactaaaatacaaaaattagctgggtgtggtggtgggcacctgtaatcccagctactcgggaggctgaggcgggagaatcacttgaacctgggaggcagaggttgcagtgagccgagatcacgccatcacactccagcctgggcaacggagcaaaactccatctcaaaaagaaattaatttactaaaaataaataaataaaaatttaccagcaagagtatgaatagagaggagccaaggtggggattcggatctggtgagctgaggggaaggggatgcagtgctggtggcaccaggcacagtcaagcccatatccatgggtctggcctcagggacaacgtgagccagagtcctgggtggtgccacagggcagaaagatgttataaaggcttcctaagggtcgtggtatctaaacagactcgagaacactcactgtcaatcctgaacacaacttaaaatcgccgagttcttaaaaccaaaaaacctagccctaccccagaccaattaagtcagaatcgctggcggtgggctggacagagtgattccattgtgtagccagagtgtaggtttgaatgctgccgggggcttgaagctggaagggagaggggcctgccaggcagagggcggcatgtgagtgccaggcaaacacgggcattgccagcatagactggcaaggggtgaaacaagctggaaacaggaactgtcgccggggttcacaccaggaagttggggtttattcaatgggtggtggaatctctctgaagttttttttttttttttttttttttttgagacggagtctcgctctgtcgcccaggctggagtgcagtgccgcaatctcggctcactgcaagttctgcctcccgggttctcgccattctcctacctcagcttcccgagtagctgggactacaggcgcccgctgccatgcccagctaattttttgttgttgttgtatttttagtagagacgggatttcatcatgttagccaggatggtctcgatctcctgacctcgtgatccacccgcct

SEQ ID NO: 128606 - DNA, 1056 bp, Homo sapiens
agtggagcccttgcgcttttcctcgtagccgctcggcatttcacaccaggcacttcctttctccttgactgtgggcctttgacaccgggcacttcctttctccttgactgtgggccatccttcttggcctctgtagcgccttcctctgtattttccttgcacatttttggccattttccaacactgtcttcaccttcaaccagactcaataattggcataatgtgggttttggttctgatcactttttatttttatgtggtgttcttaataccatcaataccctggtttccagatgtatgtcactgatacagatgttgtctgagctcaggaccagttcatcccactgcatccccgtcctctgtgtcacatggacacctcaaggcacaccctttgtccatctgtctgtccatcatccgtcttggtgctggagctgagacctggacagcaccagccacctcccactgcctcagcccatgtgcagacaccaagtccttgagctctaactggagaatgtagccacctcaactctgtcccctcagtccaagccaccgtccctctccatttctcaatctttctcccctgcctgctccattttccatacaacaggagaatctttcagacacagatcactcccactcagctgtgttccactgttcaagagcaagagcatttcctgacttctgcagctgagtgtttcttcttcctctgggaccctcacccactgtacctcaatcaatgcctctcagttccacagacggcccctacacattcccactcaacacccccaggcatgctcctccccgcaagcacctccacacctgctcggaactccccaacatctccacactgctcccccgagcacctccacacttgctcctcccccccagcacctccacacttgctcctccccccccagcacctccacacttgctcctcccccccagcacctccacacttgcccctctccccagcacctccatacctgctccaacgcccccacctccacacttgctcctccccgccagcacatcctcacttgcccctcttccacagca

SEQ ID NO: 128607 - DNA, 3428 bp, Homo sapiens
ctcttgggcttaagagatcctcccatcttggcctcccaaagtgctgggattacagacgggagccagtgcccccagcccagcctactttaactgcttttttaacaacccacaggtattggttgctctggcatctgaagaacttgccaaaggctggacccagtggtgagtgtccctgctgcagacagagaaccccagtgtgtagctaaaaacgctttccccgcccagtgggtagtgtcccccacagacagtggtggaacccgacacgtatctgataggcttttcctacttggtcctgtatccgtcaccaccttcctgtcactgtctttctcaggtatgacctcacggaagatgggacgaggcctcaggcgatgacatagccgcagcaggcaggaggcgtcctcttcagcgtagctctccacctctacccggaacacaccctctcacagacgtaccaatgttatttttataatttcatggatttagttatacataccttaatagttttataaaattgttgacatttcaggcaaatttggccaatattatcattgaattttctgtgttggatttcctctaggatttcgccagttcctacaacgtgcagtagggcggcggtagctcttgtgtctgtggactctgctcagctgtgtccgtaggagtcggatgtgtctgtgctttattatggccttgtttatatatcactgaggtatactatgccatgtaaatagactattttttataatctttacatgctggtttaaattcagaaggaaatagatcaaggaaatatatatattttcttctaaaacttattaaattcgtgtgacaaataatcattttcatcttggcagcaaaaagttctcagtgacctattttgtggtgtttctttttgaaaagaaaagctgaaatattattaaatgctagtatgtttctgcccattatgaaagatgaaataaagtattcaaaatattaacattttcataaatataaggatgtattattgagaagtaagttgaagggcttataaggaaaaatgttttataactgagtaatatattaagagaattgtcatggttcataaatcacattatgctaatctgaaatttcttacataaaaatgaagtgtcttatgtttattttaattgctgttgtaacttactcatgaaacagtatacagacaccttgtacttttcctcaactgtaagagcagactttcaatgttagcaattaagctgttgtcaaacaatcagtcatgagctttgttaattttcaatgttttcccagcctataaaaaaaggaaggtacacgttgtccttttaaaggttgtgaggtagattggagtgagtagacaggatattgcattaaaaattgaaagctcgatctcattattgtcaggaacccccagtgtgacctcacacataggatgtgggacctttgagccgatgtgcactggccaccaccagggttgggggcgccacagctgcgagcccggcccctgctgttctcagcagccacttcccaggctgcctcactttatgccatgactgaccttaatattgggatattgttatgcaatttttatcctgtttagactgttaaaagcaggtttctgtacttaagagtcccccagacctcctgtgaggtgaggctctgttgcagtgtcgtaggctgtgtgtgtctgtaaagaaagaatgcacatatgtagacgattaagtgtatattataagctatatgctgaaaatggcttccatagccatgagaacatcttaaaactatgtgtaaatatattaaggaaagtatagctttgtaatttaaattggagcttttagcttgtttcatggaactatacaacttgtgggtaactcacatgaccaaacaaaccaaagtgcctgtgacggggcgggtggcgtctacccaccctcccttctagcagattcttattttgtttgaatttataaacaaggctggtggctgtctacccaccctcccttctagcagattttgattttgtttcaatttataacttacactttgaaccatgggtttacttataatggagtctgtagcttcacagcatatttcatgtaatcataaagaccagtatattccctcctgctgaatgacatgcgactgtaaagcctctttataaaccatttccaatgttagtatataggattatttgggaagcgtatcaatacctttatagacaaatacgaacatgtatgcacacaaaacatttaactatggtatttatggaagacaggtaacaacattaaatctagttgctttcccttagtattagatttgttgagggttttttaaaaatcaggtctgttgaaagtcttctgtcataatctataaagcagcagcactcatggaaattgtagcatgccagtaatttttaccaacatcccatacatctgagttctgcagtccagtgtgtaatccgctccatgtgtattttgcttaatggaatgctttatttaagcacttaggcagagtagacacaattaaaggtacaaagcccagaggaagtggtagagcagcaccgtgcctgccctgaggcagtggagtcagtagcgctgtccccagggccttgagtgcctggaggtgcttggcctccagtagctgcctccattctcttttaaaaaaagggggtgattctgaggcactgaagtgcctcccagatgtggaggagtgaagccaccatcgaggccacactcagcactccaggatcccagcgatgtcagacactcttgagttgtcaaaacgttaattttcagttttaaataatcagtttatctaagaaaagggaattttaacttttctaccttgagccaagccaatgaagggaaaattaattaacttagtaaatttgaagtgcagctctgttagctcgtacatgtgggttcttatcctgatcctgtgccttaaagtaggaaggtgtttccaagttcagattaaaatagaagcagctggccgggtgcggtggctcacgcctgtaatcccagcactttgggaggccgaggcgggcggatgacctgaggtcaggagttcaagaccagcctggccaacatggagaaaccccatctttactaaaaatacaaaaattagccgggcgtggtggtggagcgcacgcctgtagtcccagctactcgggaggctgaggcaggagaattgcttgaacccaggaggcggaggttgcagtgagccaagatcgcaccactgcactccagcctgggcaacagagtgagactccgtctcaaaaaataaataaaatagaagcagccttgtaactgtatttaccatgataatatattctgcacggtaagaattccttttacagacattctttatcaagaggtcggcccttctttttcaggcacataagccaaatgcaggcctgtgtgtagctgtgtgttttttct

SEQ ID NO: 128608 - DNA, 1062 bp, Homo sapiens
tgaaaaagaagggccgacctcttgataaagaatgtctgtaaaaggaattcttaccgtgcagaatatattatcatggtaaatacagttacaaggctgcttctattttatttattttttgagacggagtctcactctgttgcccaggctggagtgcagtggtgcgatcttggctcactgcaacctccgcctcctgggttcaagcaattctcctgcctcagcctcccgagtagctgggactacaggcgtgcgctccaccaccacgcccggctaatttttgtatttttagtaaagatggggtttctccatgttggccaggctggtcttgaactcctgacctcaggtcatccgcccgcctcggcctcccaaagtgctgggattacaggcgtgagccaccgcacccggccagctgcttctattttaatctgaacttggaaacaccttcctactttaaggcacaggatcaggataagaacccacatgtacgagctaacagagctgcacttcaaatttactaagttaattaattttcccttcattggcttggctcaaggtagaaaagttaaaattcccttttcttagataaactgattatttaaaactgaaaattaacgttttgacaactcaagagtgtctgacatcgctgggatcctggagtgctgagtgtggcctcgatggtggcttcactcctccacatctgggaggcacttcagtgcctcagaatcaccccctttttttaaaagagaatggaggcagctactggaggccaagcacctccaggcactcaaggccctggggacagcgctactgactccactgcctcagggcaggcacggtgctgctctaccacttcctctgggctttgtacctttaattgtgtctactctgcctaagtgcttaaataaagcattccattaagcaaaatacacatggagcggattacacactggactgcagaactcagatgtatgggatgttggtaaaaattactggcatgctacaatttccatgagtgctgctgctttatagattatgacagaagactttcaacagacctgattttta

SEQ ID NO: 128609 - DNA, 1024 bp, Homo sapiens
ttttctaacagctcagaagcacctttgcctccgtttctgttactattttcttattattcaacacacctcttataacaccacacagggagaactatttcaaaggtcaattttgtttcttccaccaagaggaaaaggttaacatctgaagcttgtgataactacagacaactttttcctccgtatctaaagaaacccttaacacacacctatgagtcatggggcttaaataaggagccaacacagacatccgaagacaaacaaaagagactgagcaacagggatgggatccaactacgtgaaagagcaggtctgtcctcacacaacggggaggccagggcttctccagtggccgcagcgaggcccgcgggccagctctgcgtctgtcttcctggcagaggcccaggcacacagcagcgtcccggcgctgcctcctgtctttcctactgtgaaacctattactccatcacgttctaatctttaatgactaaatcctagaaaatggcaggttttatttccaaagtccgagatgcagtgagcaaaacggcaacacaacctgaagtgctttcagttaacctaagattaggcctccctccccaaagcatgccggcctcatgctctgctgcgttaaacgactctcccccagcgtggggtggggggcgcttgctctgctggtgagaaacaacatggtggcacttagttacttttccagctgcctcagcctttgccgcagctcctgggtggcgatgggcagcgagatgtccgaggcgatgctgggggtcggctccttgactgagatgtggcctggggaggccaggaggctggaggagcttctgcccaggtcgtgcagcccctgagggccggcctcagggggctgggccttttcttccataccaggcttatcactgcccccaatgactggtgtggatggagctgtgttgctgccaccagggcctggagacccagacatatgagatttgatggatgttttcctcccctctttggacacagagggacgtttgacttg

SEQ ID NO: 128610 - DNA, 1069 bp, Homo sapiens
aggagcttgtggtgtagtgcgcgatggtcacccctgtgaagagctacagcactctggcctgtgcagcttagcaggtcctcatctctgggaaaaaagtggtatttgtatcacagaagtgacattttggttacctaaactttcctttaaaaaaaaatttttttttgagctaagttttaaagaaatttttgcaggtaaagacatcccaggctgttccagtattaggatgttaccagtgtcaccaagtttaatttttatgtttatgtccacctctaggtgctccatctcgaaaagcgagaaaggcctccagaccaccaacactcagctcaagtcaaacgtccctctgtgtccaaagaggggaggaaaacatccatcaaatctcatatgtctgggtctccaggccctggtggcagcaacacagctccatccacaccagtcattgggggcagtgataagcctggtatggaagaaaaggcccagccccctgaggccggccctcaggggctgcacgacctgggcagaagctcctccagcctcctggcctccccaggccacatctcagtcaaggagccgacccccagcatcgcctcggacatctcgctgcccatcgccacccaggagctgcggcaaaggctgaggcagctggaaaagtaactaagtgccaccatgttgtttctcaccagcagagcaagcgccccccaccccacgctgggggagagtcgtttaacgcagcagagcatgaggccggcatgctttggggagggaggcctaatcttaggttaactgaaagcacttcaggttgtgttgccgttttgctcactgcatctcggactttggaaataaaacctgccattttctaggatttagtcattaaagattagaacgtgatggagtaataggtttcacagtaggaaagacaggaggcagcgccgggacgctgctgtgtgcctgggcctctgccaggaagacagacgcagagctggcccgcgggcctcgctgcggccactggagaagccctggcctccccgttgtgtgaggacagacctgctctttcacgtagttggatcccatc

SEQ ID NO: 128611 - DNA, 1081 bp, Homo sapiens
attgtctgtggacctttctacatttgtttgtttgtttttgaaacagttttgtcacccaggctggagtgcagtggcgcgatatcagctcactgcagccgcctcctcccaggttcaagcgattctcatgcctcagcctcttgagtggctgggactacaggtgcgcgccaccatgcccaactaattttttgtatttttagtagagatgaggtttcaccatgttggccaggctggtctcgaacccctggcctcaggtgatctgagcctcccaaagtgctgaaattacaggcgtgagccaccccacctggcccctttctacattttctaagttcctatctctgaggacaaagggtcaggagcgtagacaacgtagaaaggttctgcagacatgatcctagttatgccagtgtttccaccctgtgttttgcaggtcagagacgagcagcaccagtgttccctggggaacctgaaggtccccctcagccagctgctcaccagtgaggacatgactgtgagccagcgcttccagctcagtaactcgggtccaaacagcaccatcaagatgaagattgccctgcgggtatcgtgtcgtcctgcagtgaacaccataggggatggggaggcgggtgctggcagggatactcatgggccccgggcatgaggccggtgaagaaagctctgtgtcggctgcagctctgggccgcaggagggcgccggtgcagggaggagatattgttgctgggtatcagagggttccggggagaagacaaaggctgggactcagccatagaacaggccacgtttccaggttgcccgagcaggcccacggctactcaaacagtgctttcctgtgaacccagcaaccttaccgttatcctttggcccagaaagtgttactgttggtatcaacaaggttttctcctaagtcttaacttttcaaaggttgttcagaagagagaatttaataaaactccacgagacagtagaacttacaggaaaaaaatattttttgtccaaaatcacgattcatttgtaaatagctaaggaaatattgaaagtaaaactggcaaacatatggggaaat

SEQ ID NO: 128612 - DNA, 1049 bp, Homo sapiens
ctccagcctggcgacagagcaagactctgtcccccctaccaaaaaaaaataaaaaataaaaaaaaaaagaaagaaattgcccgaagttacaggtcatcactcactgaattgtgaacagtttaagagacgtgcccaagtgctcaccctcctcagttcggaggagctattacgttggtgcaaaagtcattacagaaccgaggccaggccacgcacacgaagcctttatctgtgggcgcacaggttggggcctcatgacaaactctaaaggctttagaccgtctcgttatcttttcaacacatccaccatcaatacataatagtgcatacctgcaaatacatgtcttggaatttaattaaggtcaacctaagcttctagttttttgttttatttattttctttttatttttcattctaagcttctaaacacataaaatgagtagcccttttccacagaaaatatcagagctaataatttggatatttcttctagattcgatacaaaaccaatgaacctgtgtgggaggaaaacttcactttcttcattcacaatcccaagcgccaggaccttgaagttgaggtattttatttgcattttttaaccaatttattgacaaataattgactttttaaagtatacaatttgctgagttgtgacccgtgtatacacctggggatccatcgccagaatcaggacaattggtagatctctctgtaacccgggcctcccctagccccaggcaaacacagacctgcctttggtcactgtagattactgttcacattttccaggattttatacaaatagaattatgcggtatgtcctctagttgtctatattctctggtgataattattctgaggtttacctgtgttgttgcagatacccacagtttgtctttttttattgttgagtagtagttatggatataccacaatttgctcatccatttacctgtgagtaagacattgataaaagattgggttctttccggtttagacctattacatataaatctgctgtgaatatcacatacaagactgtgtgtac

SEQ ID NO: 128613 - DNA, 3633 bp, Homo sapiens
aggtgcgtctcagcggcggttccaggacctgacctggcctgagagggacttgggcggctgtggcccattcattgtgcttcaaataaaacctttaattatgattggtattttaggggtttattcagcatagaatagtaaatagaaccctttcctaaagccccactcttgtatttgtgaaatcacaagggatcaagagggtgggggtagtaaaagaatattaatcataggggataaggagctgtcttttgatatgcatagattaaaggttcattctaagatgaagtcttgggcataaagaattttatacgtggcattttggttgtttgtgtaattctggtggttttgtttaaagatttttgtttgtttattcccataaattttcatgtctttaaccttacataaacttcattgcatgttttattaacccttggcatattcgttttcttctgacttgaaagagtaacccattagaatttaaccccgatgtcttgaagaagactgcagttcagagagctttaaaggtaaactgttttcccttcaggtcacagagttaatgaaaacatattgaaagagatgatactttgtctcataagtttattggcaaattacctcccatatttatgtagtaattaattgtctagtggaagagaccctacttttgttatccaataattagtagttagaacaattaaagtcaactttgaaggtaaattttataaagtactagtatgataaattagattattttcctgttggctttaggcaactctctctaaggtgatttaagtatctattttaattggatttgaatttgtgaaaattgtgatatagacgttctacttaaaatcttaactgatgtttaaatcatgacttaaagggtatgccttgtgaactgtgaatatacatttaaatatcacctcttccaatatgttgagttagggtcatctctgagtcaacaccttcatggcttctggtgctgctgggtttgggtgatctcttgagaagctttcaatttcattaaatgaggtctattgaaaactaagctccactccctaaaatatgacatccacgtgtgtgctctggcaaattgttaaaaagttttcttatgatttaatgttttattattttttctttaatttctttgaatattttaggcttaaattttagggagaggtggggaattttaaatgaaattatttaaagaaaattctatctattctaaagaaacaggaactgtttttaaccagtctcatctggaaaaaatgagttagatttcaaaagtgcaggagactggcagagtctgctttatattgtggtatttgcgaacccccacttcgtcctgcaccaaggagataagttgtgggttactaggggttactcctgtggagtactagttagcacagtagttgaaataactgtgccctccagaacattgaaaggaattacatcaacactcttctttgctatctgagaacataacgttaaggctgaaggccctgaaatcagactgtgtttaaattgcaacccaactgctcagcaagcagtgtgacctccaacaagacacttcgtccactctgttgtgttatttgtagaatggaaggagtagtatcctcttcatgaaattatcgaatacattaaataaaagaatacgtatgaaagtgcccagtgtagctaggataatatatattataattgttatattattaaattagctcacctagtttccaaaaatgcccattttgtaaacatgcaaactgaggttcagatagatgcaatatttaggtctcaataatcaagggataaacagagctgaggtttaagttcaagacaatctgacttaacgcttatatttttattatactttgtccctttgacttgtgctgatggattttgaatattgcatcatagaggaaaacttaatgatttaaccttatttcataggattgaaaacatcatccattttaagatacatcattattttatgaaccaataagattttaaatgccgctaagttttgacagtgtttattttatacttagagaattttaggataaacagttttatcatgtcactgacaggtatacctaaacagaaaatggaagcgaaataaattggttagggcagtgacaactctcactactgccaacctcccccaaaaaggtatatattatcgatttaagattcattctgttttcagagatgttagaaaattggggaaaaaaaagtatatgttttaaaattgacaaggtgcagtcaatttctaggaacaggtgaccactttttcagagatgaagtgtttatattaattaaggagcacttggtttctgtatctaataatagaactgacttagaagtagcagtaggtgatgtccctctaaagtccgggggttctggcctggggatctgccacgagctacctgtggctccagcccgaggggacacagcctcctgtggggccagaacttagttacttggccatgcctgactgcaagggaggttagccaacaaaatctgtatttacagaggacttgtgctcagctaaaacttgggaatctaatattaaaggaaaaaggagaaaattaacttaggggggaaattagtattctcttccacagtaatctgtagccttggaaacttttttcaacagtacttattttgcagaattcattcacatcagaaagatgaaccagaaaatagattattgcagtaggtttgaactaataatatttcttccaataatgataggattttgacacctatttctgacactgctgtattgttgagtcttgactctaaaattatttaactcaaaaacatttttgtgaccttctaattaatttccactaacacagatatttaactgcatcttcttgtggggctaagttataaataaacctcatgtcacacgtatctgctgctttactattttctcctatcaactatctgtgctagtgtgtacttcttaccgtttttcctagtcctgaattttttcttcatatttatatctgcttaatttaatatgattctaaactgatgattattcttccagtcaaaattatttagcagctggtaagcaagatttgatatgtgaaagcttaaaaatgctcaaacagaagacgctaagttgagaacataaaaccgtgtatctgacactctgtactatttttattcccgccagagaaatattctgaattttacgttcttttacatttgtcttttaatgatttttggttttcattaattgcactttattcattttcgttatccttgtaaataaaagaactttcgaaaagtgtgattaacattaagaatttttagaagattcagttttccaaagtagttggctttaaaaataccagactctaacctttaaaatttgtgtgcaaatgaaagttttgtagttatggtttggggtgtgtgtagcttatgttttcccattaaattgttcccagatattcccttaaatatcagagataaataaaaatgactactaatataagccagtaatttcatttttagttaagacccatttaaaatgtgtttatttattttgtctgttttctgtttgttttgggtagtcagggaagaaaataagcagcaacccaaatcctgttgtccagatgtcagttgggc

SEQ ID NO: 128614 - DNA, 1074 bp, Homo sapiens
atcctaaaattctctaagtataaaataaacactgtcaaaacttagcggcatttaaaatcttattggttcataaaataatgatgtatcttaaaatggatgatgttttcaatcctatgaaataaggttaaatcattaagttttcctctatgatgcaatattcaaaatccatcagcacaagtcaaagggacaaagtataataaaaatataagcgttaagtcagattgtcttgaacttaaacctcagctctgtttatcccttgattattgagacctaaatattgcatctatctgaacctcagtttgcatgtttacaaaatgggcatttttggaaactaggtgagctaatttaataatataacaattataatatatattatcctagctacactgggcactttcatacgtattcttttatttaatgtattcgataatttcatgaagaggatactactccttccattctacaaataacacaacagagtggacgaagtgtcttgttggaggtcacactgcttgctgagcagttgggttgcaatttaaacacagtctgatttcagggccttcagccttaacgttatgttctcagatagcaaagaagagtgttgatgtaattcctttcaatgttctggagggcacagttatttcaactactgtgctaactagtactccacaggagtaacccctagtaacccacaacttatctccttggtgcaggacgaagtgggggttcgcaaataccacaatataaagcagactctgccagtctcctgcacttttgaaatctaactcattttttccagatgagactggttaaaaacagttcctgtttctttagaatagatagaattttctttaaataatttcatttaaaattccccacctctccctaaaatttaagcctaaaatattcaaagaaattaaagaaaaaataataaaacattaaatcataagaaaactttttaacaatttgccagagcacacacgtggatgtcatattttagggagtggagcttagttttcaatagacctcatttaatgaaattgaaagcttctcaagagatcacccaaacccagc

SEQ ID NO: 128615 - DNA, 1744 bp, Homo sapiens
tagacaagaaggcaaagaagcgtttaactcacttcttgacacacatcctggacctcagttatcggcctctcgatcccctgtagtcttgccttgccgtggtcagactacgcttcatagttcacgatatgcacgcccttggcttcctccagcaccttccacgttctgagaactgtgcatttccttgagctttgcacagaaatgaagtaaatacttgtgcacccgtgcattttatttaaagttacctacaattaagatatgattgatcacttatatttcatactgggaggatgtgattgtactctttgttgtatgtaattgtatataattgcactgtttatttcaatgaagctttcttgaccgattttaacttcttagaagaattcttacatttctcttatttaccttagcctttgatcagtcttccagtctaaagtctgtgactttacctgttacaatttcaatttggaaaaagttatttcattaagtatttaatctttccacagaatttctatacagtagaattgtttgcttttagccatggtaatgtttgttgtaaaggcttccataatgcctgatggaagtgaatttgttttctattttagggtagagagaatagtatcagtgaattgactacaaaaggttaggcctctttagaactgtgtgtgttgtcacattaaattgaaatttgaataatgtcacataagcaaaaaaaacaaaaaacaaaaaaaaaaaaacccagagagactgtattgatcttctgttaaaagggcactttgtgcatggaatgtgctgtggccatcagaagcaaaggatctttgcagagccgcggggtgcctggcgcgggattaaggggcgtcccgcgggctctaggatcctttggctctggattaaggggcgtcccgcgagctctgggatcctttggcgctggattaaggggcgtcccgcgagctctgggatcctttggctctgcctctcactgtctgtggtgctcctggtgctctcattgaccacaatccaccgttctctgctttctcccctggctccactgccctaagggcatctacgagggaaactttgggtgtggctacttaaaagagaggcgagcgtcgggactagtgttttgtgaaaataccgcctcagtctatagagcactatttgtgagtcctccggggttctttctttctttgtctgtttggaaactgccagaatgtggactggaacttctaatgcagttggctggcggtggactgatgttgcatgcttttattttcttgcatgattttaactattgtgtatttattttgtgcttgttttgtgaaatgtaacactgttgtaacattggagagcatctgaccatgagatgaacaaccctggctagtagagaagtggtcctccattcctcaactgctactggctcgttgaaaaaaacctctcctgaggagaaatgaagccataatgattaaaattcattttcttgtggttcatctcaatgtgagatgtaaatttttttgtaaagtttcacaaaactgttttaaaatctatcccctcctttttttttttttttttttttttttaatttgagatggagttttgctcttcttgcccaggctggagtgcaatggcatggtctcggctcactgcaacctccacctcccatgttcaagtgattctcctgcctcagcctcccgagtagctgggattacaggcacccaccacgacgcctggctaatttttgtatttttag

SEQ ID NO: 128616 - DNA, 2685 bp, Homo sapiens
ttactcactgtagcaccaggatctagtacagctgggtggcctgtgtcaccagcctccttgagataagcatggtactgtgctgggtcctctgcattcggcgtccctctgccaggagcgcgctctggggctgcgtggggctgtctgtcctcgtgtctctgtggaggggttgtccctccagaagcccatctgttctcctctgagccagcctcacctgggcactgctgccttgccctgctcttgtttgtctcagcacctgcttctcctatacacacttgcatttccccgctgctgggatgtactcggcaccagaagagggtctttattccctcggcactcccaattctcgagacggggttaggtgcgtagctatcttccatgccagttaaacaagccagccaagggtctaaacttcagtttgttcttcttttcagggtgttctaaggatacattttattgaagctcaggatcttcaggggaaagacacttaccttaagggacttgtcaagggaaagtcagacccctatggaatcattagagttggcaaccaaatcttccaaagcagagtcatcaaggagaacctcagtccaaagtggaatgaagtctatgaggtggggtgtcgtgtctgctgtgttgctggggtggtgggctgagccctgagcgggatggccaagctctcattccagcacagtcacgtgggagtgtggctcatttaggccatcatttaaatgttccttgtttaatttcccatctttaaaaagtgtcgtaccttctctccttactacacaacattcttgtcatgccaacaagtaatgttttaaaccttaattacataatgctatcatactgaatgatcagcaaaatatttttcataatgtgagtagcttgtatttctaagtataaaatgttacgtgtggttattaatgcagtaaacacaaaaatgaggttagttatatacctccttgcaagcttttttttaaattaggacatcttcacatgtcaatgaatagagatctacgtgatttttaataaccattccatcgaatagacgccttcatctgtttacccagagaggcctaggctattcaggtcagcattacaaacaatgctgtacaagtagaatgtgagtgtctcttcactcagccaagttttccccagataaagctctttaaagtgaaattgctggatcaaaagttacacatttttaaaggactgaaatatctttgtagaattacccttcaggacagtcgtgtgatttatactccaccagtttttaaaggactgacgtatgtgtagaattacccttcagaacagtcgtacggtttatacttcaccgtacgactcctctcccccactcctttgtgagtctggtctcttgccagtttcttaccctgagtggtgctaagcagataactcgtggttattccaagatagcatctgagtggagccacttcaggactagagggatgtgtcctggatctttggtctgtctcatgccttgcaccaagcttgtgggtgacgtatcatgaccttgttggagtgattgaacttgatctattgagacgcaatccaggatccctagaaacaagcacggtagactgttactgtgtggcaggtgtttcagtgacctcccgtcctcaagaggtgtgtgtgacttgacaataaaaaaataagtgtcctaaaagaatttactggctgggtgcggtggctcacactggtaatcccaacgctttgggaggccgaggtgggtggatcatttaaggtcaggagtttgagaccagcctggccaacatggtgaaaccccatctctactaaaaatacagaaattagccgggcatggtggcacatgcctgtaatcccagctacttgggaggctgaggcaggagaatcgcttgaacccaggaggcggaggttgcagtgagccaagattgtgccactgcactccaacctgggagatagagcgagactccatctccagaaataaataaataaataaataaataaataaggatttaccaccagagaaaagtacctggtcatatttactacaatcatcatatcatactcagtgtatgactatattagtaaaaatgcacttaactactaaccattgatgttttaggctttagtgtatgaacatcctggacaagaattagagattgagctctttgatgaagacccagacaaggatgactttttaggaaggtaaataaagcccattgtggttattggaggagggcatggggtcagtctttttgtttaataatcaaaagtatgttttaaaatacatttgtatacttgttgtctattcattaaatggttcttagatataacaattgtttcaccttggatttcttaaaacatttttattcctaaaagtttcacatttaagagaagtgagtcttctagatctgtgctgtctattacagcaggcactagccttaagttaattaaagttaaataaattaaaaactatctgagtggcactctctttgtttacaaggcttaaagctacatgcagaacctgccgccgtattgagttctagtggacagttctattccagattgcaaaaatgggttttttaagttttttgagttgctggattaatttttgtcaggatatagtaattcacattgggaaaataaatactggtttgttcacttcaattgaacaactagtatagcttt

SEQ ID NO: 128617 - DNA, 1046 bp, Homo sapiens
attgtgttttaataagcggctctaagctgagtgttgaagtcgtaagaagggtgaaaattatgattaaatatccgttatgttttgataagcgtctctaagctgagtgttgaaggtttaagaagggtgaagattatggtggaaacaaaatacgggtgatgagtagtcgtggttccgaaggacacacagggaaatagtgactcccaagaaagtaaccacttcaatagacgcttctgtggagacctaggggagcagcatccacatccacagttcggggacatgcagggtgtagtggggtgaggaggcgcagtgaggggagccccgccagggagctccgtcagagctgctgtggcctccgaggccaggagtctgtgtgtgagaaaggtgggtgggtcctgcctctgcgtggtgaacacacagccagtgtctgctggctgaagccctccgaatctctgtggaagtattaactgtctgaataactgacctgttcataagtagagtagtgttacatatggtttttcttttggggatttaaaaaattttttcccatattaaactgaaaagtccttgaggtgctgggtcatcacacgtggatactgtcttgcagtgggtggttgggcattatttgttgaacgctgacgattatcacggtctcagaatttatttgtaattatgtatgttaataattttagcatctaaaacattacgggcgagaagcaaagtactttcgcaacttcacaattcaggtaaaggtgttatacagcaacgaaacttaggtttataaatgtgtttaaaagtgctgccacatatgcattatttaattctcacgtttaccctaaagaataggacatatatatatgtttgtttgtttaaatagagatgaggggtctcgctctgtgttgcccaggctagtctctagctcctgggctcaaacagtcctcccacgttagcctccccaaagtgtagggattacaggcgtaaggcaccgtgcccggccaaaaaagatatattaaaagtacatctttgaccaggcgtggtggcttacgcct

SEQ ID NO: 128618 - DNA, 2034 bp, Homo sapiens
gtttttggtgaggtatgtgaaaaggacattttcatacactttggttgggaatgtaaatggatacagtatttttggagggcaggtaggtaccatctattgacattaaaaatgaacataagcctttgaccccaaaatctcactttttgaatgctagtctgcatatgtatatgagaacatgtatgtaaaaagatattccctgactcattatttgtaattacaataaagaaaagttgtcaaaattctaagtatccatccataggagagtgggtaaataaattatttcatgattttactagcaaaaactgtgacattatcaaaaaacaaaaagaggcaggtctccacgtaccaccaaagaaaaatgtccttggtatattacgaaggatgaagggtgtgggtctgtgttgtgtactaacccattttgtctacaaagaaacaagcctgtgtgcacctgattcaataattggaaattgtttggaacttaatattttgcccttgttttaaaacagcttttagaaattaactggacaggactgacgaatcttctggatgtccctggattgaagtaagtctcgtgtctggtcccggaggcttagcgttcgagggcgtgttgtgcattttggatgtcttgacaatagtgtgagaatggttaagacctgcgtctgccaggtgaatgggtgccttctccacaggctgtcgtgagaaacaagcagagggtacaggggctttgttctgcctgccgggagctgctgggaggcgatgggccagggcgggagggctctggagtgccagctgaggacgcagtcttcatttgcgtttgttcaccacaaggtgtcttcctggccttggcatgttcgaaaagtagaggtcttttaatattttgtaaaaacagtttgcaaatttttttttttaatcttctcagaaacaataaaggaaactttaaaaggaaatgctttccagggtctctccagcctatggctaccccaccctttctgccttttttttttttttaacttttattccattcctttttgaaatgggttggggacagtgtggacttctggacttcgccagaactcttgagtgtgagaggtgaggaacttgaagttccgtatcatttcactgggagtcccttcattattccgtagtgatctagtgtctaaaacaggagaaaaatgttccataacaagcatctgaggccctggagggtgcatccctgcttagagacaaggagtcattctagttgccgtggtgccattacctgaaacagtgcgtggggctgtgggtggcagacctgttggtcacctccaaataggaagttttgaaattacagcctctaaatgcttttgctggctttaccgttttatttgaaagttaaaacatatcacctgtgggttaaagttatatgtttctagtggatattttctagtgtgatttgttttccctaaaatagtttagaaaattatgaaacttggtttcagactatttttttattctcatatatttgtttatgcctctgaaatggcctttctaaagagttttgtttcattattagggaaaaattaggactttaattatctgaagcacagtcatcatgaaagtcctttttaggtgctgtggtttactggatgcagaaaaatgctgtgatctttaaaagatctgcggaaagaaagcacaactttaaaagattggttaaagagttcattaagattctggttgcaagcaacaaacctgacttaagtggtcttaagtaggtaaataagtaagtttctttttttttttttgagatggaatctcactctgttgcccaggctggagtgcagtgttacagtctcagctcactgcaagcaccacctcccaggttcaagcaattctccctgcctcagcctcccaagtagctgggattacaggtgcgcgccaccacacctggctaatttttgtatttttttagtagagatggggtttcgccatgttggccaggctggtcttgaactcctgagctcaggtgatctgcctgcctcggcctcccaaagtgct

SEQ ID NO: 128619 - DNA, 1009 bp, Homo sapiens
aaggcagagtcagtcaatgcagcaaacttcactgttgtcttaccctaaccttcagcaaccaccaccccggtcagtcagcaaccatcagcactgaggcaaaaccctctaccagccagattatgacgcgctgaaggcttatgtgatcgttagcattttttagcaataaaatgttttaaaataaaggtatgtacatttttaaaaagatataatgctattgcacacttaagtatgccttgggaaaccaaaaaatgtgtgtgactcacatgttgcaatattccctttactgcactgctctagaacccagcccacaatatctccgaggcatgcctgtataggaaaaattctttatttctttgttaaatagcatctttgaattgtattctctttcctgttcttttaactacaatggcctcatctaattgtatttagaagcttacctgccactttccttgacacagccatcctttcctgaagttcatgtggcccctgtgtctcacagctctgcggatggagcagtcaccagtgggtgtcctctgatggtgcgctgtgtgaggtgcttgcattttaacctgagtcaaatgcaagattctgtgctatatctttgatatgttcttacttcctgatgtagatttgtgatcagaagtaacaaccttcagaactaaatgatagaatcctgttgtgatgcccttttaaatcttcgtttcctcatgacaggtatttttgtatgaccagaatattttgctgtggcagggagtacctgttcctttttaagttgtgtaagagaaaagagaaaggaaaatgagctcttaagtcagtgtttataaatatattcatatgatttagaatgtagaggtttagccaggtgggttcaatgggtggactagggaaaaacatttattttaagggggaggtaaagcataggttgatactgatgtttgcaatccagtttgaagattagttgcctattttttccttcctaatattttatatttatatctcatttctgtta

SEQ ID NO: 128620 - DNA, 1054 bp, Homo sapiens
tgctttaagcaaatggggataaaaaggagacgaatttatttaaaacataaaaatagcatatattgatgtctcatgacgtgtacaggggactgcagttgagtctcaggaacagaacggaaccaggaattcgaaagccttcgtgactctctccacctctgctcgctttcctctccctctgagactagcttcatctggttctgcagtccacatgtggaatagcatgtctgccagcacttcagagaaagccttgcgtcttcctgcatccttggcctctccctttggcctcccagagtactgggattacaggcttgtgagccattccagctgggtcagataccgacccctggaccagctgggggtaggagggttgcagtgtttgaacagggctccctgaagcccattcttaacagccttgcagatgaggctgcagtgaattccagagtcagggccacaggcacatccacagactcagaccacacgttagtaactgggagtttttgcagtatttatcctgctcttttccccgactttctgggatctgtggtttgatgtttatattattttggacagtcttgcccacccccagtagagggggtacagaggagcttcctgttgtcctggtccatcctgggtcttggggccagagctctcccagagaccctcctcctcctccctgtgccttgtgtctttggcgggtcttttgcaggagagggtctgcacctgccccagcaatagaggtctctaccagcctgggacattgtcctaccatgtccttaagggacctctccccagctgcagtgggttctcaaggtgcttccctcccccatggcttctgtcccttaaggtggaaggtggggcggggcttcctttgtgcccttctacagtggcagctgcctcctcccgggctcctccccatgggaagtgtcctccctggggtcgtctttgcacaccggggatgcaggtgccaccacgtgatgtgcacacctctgtggttctctgactcacccacacttggcctgtggcctttcattaggatcttgctggagtcgtctca

SEQ ID NO: 128621 - DNA, 1388 bp, Homo sapiens
tgttatagaggcctagggcactgtgagatttatcatgattgggaagcaaggtgtgaaatttatttgtgtgaaataaaattaaactttttaatgtttaaacatcagatttataaggtaagaaaactacattgcatcaaaagactgcttcagaagttgcagtttgttattcgcatcttcttttgaacatggacatttatatttagttaagtgttttatatataagaccaacaacaaccacagccattgattgattgattgagagtattcctcccaacgtcatagcagtgttggatctgataacagcctgcacacctggagcagtaaaatactataatttgatgggccacattttagggtttttacctacaatctgatttggttgctttactatcattttattcagattatacatcttgcaggtctataatgattaagagaatagttcatttcacttacatcatgtaatgcagaattttttgttagttttgtaggaaattgtgagattgatttggagatcaaacgatatttttgtagagctggtgtgaaaagtatccaggtaagttttttgtttttttgttttaatttgacagttttctaaagttctctaagctgtattcaaaaataaaattaggaagtttttttagcttggaatttttttgacgttcagtttttagctgtaggtcatagttgagataaataagaagtcacatgctcaaaagttactaagattcgcatgcaaactccttgcgttaagcggccctgcagaatgttttctattacatattttggtttcctgtttgagtttagattcatggtaccatgcgggtgatcctggaaccgttgattggagatatgcccttagttggagctttgtctatcttcttccttaggaaaccagtaagtcaatatttatttcatttttattttcccatttggtggcaaaaatacatacccgtggaagaatatataaagtggagaaacaaaattttatcaactcaccgttgtccctttctgttgtgtgaatcctgtgggagttttttgtatttctttgtgccttaactgagagcttatctcttgataaacagctctctttcctgattataaaaatgttacaaaaatttggaaacatggacttcttcagaagggtgggtcttagctcacattttattcaccacctcactgaatatgatttatagatatttgctcatttaatcctcatgactctaaagctaaatgttaacattgttttctcttactgttcagaaactgagattttgaaagtcttatttttccaagtcacacaattaataagagcctgtatacagatccagtttagtctgatacagagctcatgttcctgaacactttgttgagaagactcatctgta

SEQ ID NO: 128622 - DNA, 1064 bp, Homo sapiens
aagtcttaagaaatgaaaaattatgagacataaagaataaatgaaaggaagttatgtttcaaacatggtagtaaggatggagtagagggaaagggtcaagttagatgtgaagagacgagagtaagaagcttgaaaagagcacatacgtattgttacatgtgctgacaacagcaatcatacccagtgcttattaactgctgtgggcaaggcatgcactgctgtcttgacatttattttgtcacctaatttcacagtaatcttatgaaacagaggcccttgttttctgcagctcacgggaggaaggtgaggaacaggtgttaaatagctgaaaatcaagccacactctgttatgaaggcagaattttaattcctgttgtagtctgaaatttaaagcttgttctgtttgtctctatggtatgttacacggtttgatttttttttttaacctctgtatcttaaaataagctacttcttatttcagcccctcaggatcaatggtgttaaggtatacactgaaaatgtagacaaaaggcaaattattttggaccttcagattaggtaagtttttatttgttatatttgtgttatggttaatggcgtgtaatgtcacttagctgtacctgtaaggtggaggatacagtgagcacacgtcttacctgctgttgattggaattcgactaaattcttgttagacatccaaatattatttaccttctgggtctcagtttctaacagccttgatcattgccattcataaaatatgttaaataagaagttaaagacactgcaaaaaaagaaaactatggaccaatattctttatgaacattgataaaatccttaacaaaatactagcaaactgaattcggcagcatattaaaaagattttacaccatgaccaagtaggatttattcccagaatgcaaagataattcagcatacaaaaatttgtcgatgtaacacaccacattaaaaggaaggaaaaaaccaaatcgtgattatctcagttgatggagaaaaagcatttaacaaaattcaataccctttcatgataaaaacactgaat

SEQ ID NO: 128623 - DNA, 1117 bp, Homo sapiens
gattacaggcatgaaccaccgcgcccagccttttttgttttttaaagagaggcggttctcgctgtgttccccaggcttgaactcttgggctcaactcttgggctcaagcgaaccacctacgtgagtctcccaagtagctgggattacagttgcatgccaccatgctcagggctgtgaggaagattcttgaagagtttttatagagattaataagggcaatttttcattactatttttatttatttgaaaatattatctcttcataggataaagtctgactctatcctgcttttactattgccaataaatgctgattgtatggctgctatggataatactgtcacggataatactacttaactgttctgacagttggtcttttattaccctcatacttggattattgagaattaaagcatattagcttccttggttatgttgttctgtacttttgtatacaaactttctctggggagagctttcttcccattgcccttctgggaagttcaggaaaatttaactctagcaaaaatatggtatgtatagtctaagaactaaatgaacagaagaaaataatgcactgtgatctcatgtaaagaaagggcaaatatttttttattctcagtgttaatcattgacttaatactttaataaaatattgtgaagacttgtaactgaaaatagttggcatagctaattcaggagccacaatttagctattttaaacaagtgcttcttcagcacctgaatccgagtggtcatgtggttgaggaagtgttggagtcctcatcgtagctgcagataggatgaggatgctgcttgggtttcttgttcacacccacactgcggctgagacacagaagggaaaggatgtgaccgttgttgcttcagttctgtggtctgagaacctccttcagttagaacattaatgccccaagatggctaaaaataaagcagtaaatatcaggtttttagtttaagctaaaaaatagatttaaatttaggatatatgcaatccatcagcctgtatgttgtggatttagtaaaatttctacttaagattaatattattatcattctacatttaaggatgggagggtatagagctaggactgaa

SEQ ID NO: 128624 - DNA, 1081 bp, Homo sapiens
gacagtgattatgttgacagttttagagagattttaaaaatatcttttaaattatacttatgtatctattttgtgatatttattaaaagtgtaatatactttattttcataataaaaccagcaggttgcatggtctcgaagtgtgcctgaaattctgctgcgcggcaggggtggtgggggtggtcaaagcacatcaataatagaagaaactatgaataagaaaagttaagatttcagtattacttgcactttgggtttgtttttgtttttttttttttctagagatgagttcttaccgcgttgtccaggctggtctcaaacttttggcctcgaggcatcctcccacttagacttcctaaagtgtggggattacaggtgtgagccaccatgcctggccaatattactagtaccttgatttttaccatacatacattggtgcttggggtttctgaactttggactggtattttgccttgaacaagatgtatctgtacatcccaaaggctgtacttgttttcatagtgtgtcgttgacaaccgtgaattcatggcagagtggaaacataggaaaacatgaattaaggagatactaatttcctcacctcacctttgtatatattcactgacagcttttcttcttactgagtaaaaactgaagctggatatggaaatgagataagagtattaatactttgagaaactatatgtactgttcctgattgaggctattaggatgtgacagatggctctcacttaactgtgataattctgtaagtttggtcctacagctttaatataaacagtgttgttattcttcacttcttttcccatgaacagttatgttccaactgcttaggggaaaggcctggcaggctggatgaattgaggacagggctttttgttgtttaagtgtctaccctgtggtaatgggccctggaccattagactaccctgggtgaagaagagaagatttatttatttattatttcatttatttatttatttttgagacggagtctcactctgttgcccaggatgaagggcagtggcatggtctcggctcaccgcaacctctgcctcc

SEQ ID NO: 128625 - DNA, 1026 bp, Homo sapiens
ccccgcgcgatgacgtcagtatccaccccgcccgctcccggtgacgtgccagccccaggcccacgccgctcccgccccgcgtgatgacgccaccgtcccgggcggaggcgggcgtgcggcggagccgcgtcccctcagaggggcgctggcgcggggctgagccgcccgggatcagcgcgagcacccagcccgcctcggccgggagggcagcgcggcactgcggggcgatgagcggcgcccggggcgagggcccggaggcgggcgccggcggggctgggggccgcgcggcgcctgagaaccccgggggcgtgctgagcgtggagctgcccgggctgctggcgcagctggcgcggagcttcgcgctgctgctgcccgtgtacgcgctgggctacctggggctcagcttcagctgggttctcctcgcgctcgcgctgctcgcctggtgtcgccgcagccgcggcctcaaggccctgcgcctgtgccgcgcgctggcgctgctggaagacgaggagcgcgtcgtgcgcctgggggtgcgcgcctgcgacctgcccgcctgggtgagtgcagacccctgcccgtcccgacccctgaccaccagtcccgatctcccctcgtccaggcaggcactcccctccccgcgacctgccgcctgggtgagtgcagaccccagccctgccccggctcccgccttcgtagtcccccacccaccccggtccaggcaggcgcttcccttccgcctgggcgagtgcagaccccagccccggcccccgggccggttcctgcgacctgccaacctaggtgagtgcagaccccgccccgccccccggccccgactcccagcctgctggcgacctgcccgctagggcgagtgcagaccccagccccgccccggcctccggcccactccctgcgaacctgtccgcctggggccgccgcccgctgctcgccgctcccgccctagtcctgagtgctccgtgccctccctccgtccaagtcgggcgtccccttctccgcttccccgcccgc

SEQ ID NO: 128626 - DNA, 1049 bp, Homo sapiens
cttatatatagtaatttgatgtcctttttattctttttattaatcctaatactcaatatctggctaggttgatttaggtcaagctgttacctgtaaaatgcttgctatacttctactaatacttaccaatatgatgtaattaaatgattttataatttaactcatatttaagtgcagtgcataaaaagatgtatacataggtatctataaaaatacatacactttcacattctcagcacaaatgtttgcacgtgatgatagttgataggtcttctgtatatggttctgtattgtgtgatttatttttagagaaataaaggtagcagtttatataaatttaccttcaaaaacattaaaatcagggaactataaatatctttcttagctgtaataaggacattgtctgttttaagttataaagtgtcatgttttgttcagtatgagggataattgaaagtcagtttgtcttaaagggttccaaaagattattattgtttgcaggactatgaagatgactttgaggtttgtgatggtgatgatgatgaaagcagtaatgaacctgagtcaagagaaaaactggaagaacttcctctagctcaaaaaaaggaaatacaagaaattcaaagagctattaatgcagaaaatgaaaggattggcgagttatctttgaaactgtttcagaagcgaggtagaacagaatttgaaaaggagcccaggacaggtaaacaaatcaatgctactaatggtgtccgtgctcttagggctctgtgtactgagccctcacagatgctgtcacacacaggcctactctaataaggtgggtggagcagtaacatcttccacatgctggtggtgccatgcccttgcagctaccacataggaggcccctgaagacttgagcacgagcccatccagaattctcttacacagagaagttgcacgtcactttctgctcagcacccaggccttaggttagctgagggtgccgtggccccactcagtgagcactgatgctcctgttctccagagggagctgaggatgctgtggc

SEQ ID NO: 128627 - DNA, 1086 bp, Homo sapiens
gggcaccacttgccaggcgaggataggagcagggagggttgggagcagcccagtgtgttccagtgaggacaggctgagcttgtggtgcctgtggagatgcccaggagctaggggcctccatagcagaaaccccagatggaggtaaggatttgggagtcgtcaaccaagaggtggcatttgcagtcctgaatgtggacagaaagagaaaattggaaaggaggctgatagcatggccacatgctgactttgatgatgtgggtgtggcagatggagcaactgtgggcatctctctgttacaaatacataggccatataaaggaaaaaataaaactaagtatagtttttaaaaggaaaggaaaatctctaaatgccataaacaggagagagcttaaagttagtgtcataagcttttgagctgctatgtgatggcttggaggctgggtgtgaagcccaggctgtctcagaccttctgagctgtctctggggcttgagccccatgcagaaccaggcgacgcattgggtttgcctgaggcaaggaggtagaactgagacccctgcacaggactctggaactcactgctcctgcagtgatagggaaattcagaaagccgcaccacagccaagggaagacagaggagcttggaagagcttgaaatcctaagctgagtgggtgtgtgggaacccacaagctgagatgttagcatcacagttctagaccagtggcctcagtgggttcatagttaaagtagacgcaaaaccccctggtgggtaaagatatgtttgcaaattggggctcacaggtttcttatgagaagcagtctgctgcagatgagctcacaactacaagcatgaagaaatagtctaccttggtgcaaaaagtaggagtcacacactaagaacttgagacagttgtacaatctaaaagaaatttctagaaatgaaactgttatctctgaaatttacaaccaagtgaatggttacatagcagattagatatagctgaagaaagaattagggaacagaaggataactctgaaaaaattatcaagagtgtagtagcagaagaaaatagaaacagagtggcta

SEQ ID NO: 128628 - DNA, 1067 bp, Homo sapiens
ccttaattctggcccactctctctcatctattctaagcttcaaccaaactgaactacttagagttgctgaacatgaatacatttcattttcggttgcttctaacttctggcaaagagagaatacttgtttggaataatattccctattccacactccctgacccctgcttgtttttcaggtatgagctagaatgtcacctctggtaaacctttcatgggatacgcagtattaggccagtaaaaccacgtttacttaccccatttgatcactttagtacacagtactgtgttattgtcactgtcaccaatgtcgagccaacgtttaattaatgagcagacatttaaatgttaagaactttaatctttaaaattaataaatgttctaagtgaaaagaaacttttatgaattatatatactttttaacataatttaactttttcataggagaactatgccatttttgggtcaggactggagatctcctggatggagttggattaagacagaagatggctggaagagatgtgaatcttgtagtcagaaacttgaaagagagaataaccgttgtaacatcagtcacagcatgtaagttacagctgagcagaaccatgccatttgccagtttagcatgtatggccttacctatttttcaagtccctgcaaagctccataacttttgagacttgcccacccagaaggctggtgtgaagagacaagttgtttagctaaaaaatgaggctagtagattgcctaatattcatacacagatgctttcgtctttttttttttaatttaaaacatttaatcctcacaataattgggagagaggtattatttttaatcccacattatagctgaggaacctgaggaaattgaaatgcacagttttggtggcatatatcagaaatgtagtaatagtggcttacacaagacaaatcagtttttctcccttgaaagcctgagttggcatgatgactttgctcgtaacattgtcaaggggccaagcacagtctgtcttgtcgctctgccatcccaagagtgcagccttacctgcatggtccaaaac

SEQ ID NO: 128629 - DNA, 1029 bp, Homo sapiens
cttcattattgaatatttctccatcttcactatttaagatactgaaataaagacacattctattaaaatattttttcagggagatcttcatttggcttttcttttgtaaaaggatataaatacttcaaagtgacagactgtgggcttgaaatcacaagggtaatgtctaatacatttttgtttcattttgagaaataagatgtatcctggttctttgagaatattgtaccagaaagtgctgaacatgttttagaatctctgaagggtcttgatatacttatccaaggtagtttcaaacatcaaaatgccttattaaaacagagatttttttaaaaaacaactattaaaactccagaaaaaagatggtaagaatatgatgatacccaatactgaccaatgacttgctgtataccttccccatgctgagtaaccactcaacatttctgtttactccctatataagggtttacctgaagttaattattactgcactgaacatgtttttattaagcaccaaccaaatacactgttaacacatttaactggaaccaggtgaagtgacatgtatatttttactatttaaatacatttaattaaaagcttttcttcttcgtgaaacaagaaaatcaaatcataaggcaataactaaacaatgggaacaccttttactttttaaaaaaacacctgtaaatagtaatccacatcctcaaaactaacgctgtgtaaaatttttattttccacacactgataacagattttcagtgtaaagtgaggaaggaagctctgtggagacaagctggttggtggaggcatgtgagagtggtgctcaaatccaaggaactaaaattgcttatttgccggtcatcgttctttgacaagaaaattgtacacaagcccctttccactcaccagtattcacttttattaaaaaaaaaaagctgactttgccaaatgagtcactttctcactgtcagaacagacttaaacagcggtgccaacagttgtaaatcatcaagacaagcaaagca

SEQ ID NO: 128630 - DNA, 1154 bp, Homo sapiens
aagaccattaaatatttcatctgctctgttgccatactgattacagaacagaggatcccatccaagctagcatatgcaggaaaggaggatcttcttgtgaggctgtggggatgctccctggaatgctaggaaccaggacctaacaaggctgagagggaccagaactaggactgggtgctggtgtccctgcaccacgtcatgtctccataccctcacctggtacagagcaagtgcctgctgcttgtccatgctggctggtgtctcaccgcttccgaggttacatgctgtggttctaggtccgcacatgctctttgtggtctgctctgtgaatcagatttaatttcctgttgtaagatgggtggtgaccttggaaagtgcctgctgcaccatcgtgtggaatatcagctgtgatggatttcagattataatctatatcaaaatgagtgtttcctttccccagagttcccaggaaaatgttttccacatagcaggcagtcagtcaacatatttggatgttttaaatgagtatattttgttgagttgtgcacccgtcagggcgattggggttggcgcacagaagcacatgagcctctgagtgtatcggctgtcagagacaaaggtgctatgactccagctgctttctctaggacatctcaagtcacctgtttggaatttgagaccaatcatctcatgttttctattatttttttctagcttatctctacaactttgacatgaaaatctgtagattttaaatatttcaaatatggaggatgaagatggagtttaaaatgacttctgaaacctagtgtgctaatctatacaaaccaatataggataagggtatatcatggaagaaaaacatctaagagaatagcagcagtgtttacagtactgaaaataaattgtttcattttcttccttcagttcttggacctgtgggtctaaacaccagttttttttggtgttttgggttcttggcatccgtgctcccagcctgaaagctgcccgtggtcacatccagcacttgccttcagccctctccatcccaatgctggttttcagaagcaccttcttgctaccgaagcacctctcccagccctgatccttgtggttgagcatacttccagcctgggcagtgcatggctgctctg

SEQ ID NO: 128631 - DNA, 1183 bp, Homo sapiens
ttgtctttgtcattacttcagcaggttgtaaaaaatgtcagttaacggtgtctcaggtatacataaacagcttaaattattagcattgctataattttactatactctcatctaaatctaaaatcagtcttcaaaataaaaacaaattgtcctttgccaaaaatttttttaatcgcacaattaattgacattaactgccaattctttttggctaattgactaattttaacttctgtgttgcttttccagaggcatggctattgcaccttgggagaagcctttaatcggttagacttctcaagtgcaattcaagatatccgaaggttcaattatgtggtcaaagtaagtgttctatttcaaaaactactttgatgactcttttgaacaactatattttgaagattgtaagtgtacaacgttgaagatgcttttggcagcttgaaggtgtgcctgtttgctgcgtattaatcaaaaaacagaagggaacaagttcaggagaaaacagtgaggttggaggatttctccagtattggtggcagaggttgcagagcctcagtgggagcaaacactcatctgccctgtggctctgtggttgctgaggatgccacaaggtggtcccttgggggttgtaccacgtacctacatactgtgtcagtgatagaacggtcgtgggatctttacctgatgatttcacaaatgttttctgcttcgtgtttttcacaaggaatgaggcttgtgtcgcagaggaagaagtagctaatagaaaacaggaatttcatacaaaatagaattccacaaaagccttattgcattaatgatacccttttggaagaaatttttatcttgggccacactcaaaaagaaaggatcttagccatatattccatttattgtttgcttttgtccaaagattaattactatgtggtttatgcaccttcattctattatggataaaatagaagctatagtttatgaagctattaattttgtgtttctaatggttctgtgagacattggaaaaatgttgcttttaattgcttttaggcatttaaaagtgctactgggaggaccaaaaatttagggagttaaataattgtaagccttagataatattatttgttcagtttgcttctgagcagaatttccagggctgcttatgtaactactacttacaactcctgt

SEQ ID NO: 128632 - DNA, 1047 bp, Homo sapiens
catgttgccctcatggtgcattggattcatctaggcagcagcgccacatccacagacgctgcccttctccaggtgcgtcttgatgcagtagaggagtactgacctcctgatgctgacgcacacctgtcgcatggggaggtgcagcagtagggcctcacccaggaacagcctggttctgtcacgctgtgcagccctctcttgctctcctcctccagccttccccacggtggtggatgcaggccccttgacaccttgcgacgcatgacatggagagctctttttgtgttaccatgttttgaagcattcattccagcttgactcttcagttactgtgtgaacaaacattggccatcttctcagtgagttgctgttgtgttttcctttcagcaagtgaacaatggcctcaccctcagtgaccttcctctgcacatgctgaacaacatcctataccggttctcagacggatgggacatcatcaccttaggccaggtgacccccacgttgtatatgcttagtgaagacagacagctgtggaagaagctttgtcagtaccattttgctgaaaagcaggtgagtgggatgcagcagtctcccctcaggctgggagtttatagactctgcctgggggccataccctataaactcacctggagagaaagaatggctgagtattttctacttttaaagaaccaggaacaatcagagtttattgagattgctgtgggttctctcctatagaatgtaaggtttatttttcatattgaatagaaccatgactctaaaaataacccaaaactgaacagcaaagcaagaactgagttcttttctctcctgttgataacgaggtgcatagagtccctggctcactgccttttctcctgatttgatgaatcagattccagttcttttgaccaagctgcacatccttgaaaagtcaggtgccctctgtgtgcctcagtctctcagcactcggtagatgccgctcctgagtgtccacagcccctcccccctgccttgtgtgctgcacttgggagtgcacgtggggca

SEQ ID NO: 128633 - DNA, 1699 bp, Homo sapiens
ggctgcaccatttcacattcccccagcagtgtgtgaggtctcttgattctccacccctccccagtgcttctcattatttcactttttgattaaagccattctagtgggcaggaagtgggtctcattccatttccctgatgactggattctagagcatcttttcatgaggttatcgtccatttctgagacttatttagataaatgtctttgcatgtcctttgaccattttttaaactgggttatttgtctttttattattgagttgtaagtgttctttatctattctagatataagtctgttatcacatatgatgtgtgtagcttattttaatttaataatacattatggacattattctggattggagtatttaagtctgtttaacagctgcttggtattccattatacaggcataacacaatttatttgatttgtcacttattgatttaacccaagtgagtttaatttcaaataattgttttatgtactacactgcctttgaaaaataatttcagatagacctggaggccattattctaagtaaaataacttaggaatggaaaaccaaatatcatatgttctcagttataagtgggaggtaagccacgggtacacaaaggcattcagagaggtataatacacattggagactcagaagagggaagggtaggaggagggtgagggatgaaacactacatgttgggtcactgcatacttctccagtgatgggagcacaaaaatcccagacttcagcactgtacaattcatccatgtaaccaaaacccacttgtaaccctaaagctattgaagtttaaaaaaagaaattaaaaactaaaataaaatgaaaaagttttacacctaatattatgttttgaaagtcatcttatgcggattctgaatggagttttgtttgtttagttttgtagacatttgatcctttcagaaaaaggtcatattgaatggaagttgatgtactttgcacttcagaaacattacccagcgaaggagcagtacggagacacactgcatttctgtcggcactgcagcattctcttttggaaggtactgatttaaatgcactcttggaatttcaggattaaattttggtgaaacaaactaatcacctatattttaagtataagactaaaaagcggaaaatactgtttgttataagtaagttaaggagatatattttaccaaatattggggtaggggaacagatgttcattcaatgtgtagcttaaaccagaaacgctgaaaaccaaaatgcttctcctttttgcagaagttagcatgcaggagggcgttgcaggcggattgcagccagtgacctttcctggcagcagctccagattccctgctggcccccagcctgaggttgaaggctggagtgtgacccctctgcccatctgaggacaagtgcaccttcctcgtttccccagacttagccctcggccctttatgtccccaccgactctgcagggccaggaccagcttaggcttcatttctcaaagccacattcttagaaaaaaagtgtccatagagaagtcctagattttaaaatctgcatttttctcattcatatgatcagaacttaacaagactatcgttacttatctgcaagtctcatcccttcatccagttacttcctgttctcaccatccagactgtgtgtctaaatagaatgtttttcacag

SEQ ID NO: 128634 - DNA, 1004 bp, Homo sapiens
ttacttttgcatccatctagctaaatctataatctgtgtcaatcacttatacctatcaatcatccgtatctattcacctgtcctctatgtctgtcttctctcagtctacatccatctagccttctgtcaatcatctacttttttttttaatagaacaagaagtttacttatcaagtcttgaaagggggacatgtttcaattggtgttcaaacaaaaattccagcttgtattagaaccttgaaatggtgaagttgtggaggttttctttgttccataatacagagacaagttcataatttttagtataacagctaagttgacaaattctaagtttcctcaggtaaatagtcataactgtccttttccctagagaagtgcttgctgggatagtaaaaacatacaccatttcatgacttctgcaaatactttccagcggaagtcagtgtaggtttgtttttggctaacatggtcttgctgcgcaggaatgtaaacactgtgtttgaaactctggaaatcacgtgtgtggggagatggggacgcttcccatgttgtggggagctctgtggctgtgatggctgcagttgccgtgcctctgttggaacgctaagtgcctgcaactcacgtcaatcatagaattgtgacgcacagttggcaaaatagttctttatgctatttctcaaaatttgaggacaaacccagattgggattggaatatgcactgtaaatcaaatttttcttatctacaaagactaatgtaaaaatgattttttcttctgtgcctgattaaattaactgtggtttttaatataaatatttattggtgtgctttgggagaaaaattatcttttcttgaaagaagttatcaaagcaaatttattatcttcacaagttaatgggagaatgtggttttgattctgggtgtttgaattgtgtaaacacacagcttccttgtgtgaagagagttgtcctgtgctccttctactgtactttttttattttttaat

SEQ ID NO: 128635 - DNA, 1030 bp, Homo sapiens
gaacacgtgcagggattgtacatttgattgccttattgcagaaatattcacctatcagtccatgttttgcagaaactggagatgtgaatttatgatgctctcccataatacagcagtaatgatttgcagtttctcacaaaatgattttcatgctgctctgtgttgtagttctgtttcagaacttccgtacctttttcttgtatgtagcacgtataaatgcagctgtcatgcagttcttttcttttgctagaaaattagtcaggaggtaagatgaatcttccaaagttatgttaaattttgtttaacttgacaaattaaactttgttcttattaaacaaatacgtaaacaaatactggaaaagcaaagcttatatttgggagtaaaatgtatcttaaaatgcatgttcatcttttgctgagggaggaatagcttcttgtatgtccactggatagtaacagtggttcttttttggaattttatttttacctcttttgaacttctaaatcggtccctttattttcttaaaacatttgctctcttttttgtttacagattaaagaagtatggatcaattttagtcagttgataatttcatttaggaaacattgtcttgctcattatagagagttaagactgtgcataaaatactgaagtgcctcttttttattaggctcatatgtttgttcttgcaaagcgagatgcctattgtgattggtgttagatctgtaagaagctgtgttttttccacaagaataatcgacgaccggtttgagagcatctctcgcgttctttttctgtctgcttactgtccttgacaatgtgatcctgcacagtatcaggtgccagttatgcgtccctggaaggttggctcttatcagcaagtcctgcagatatctcttagataaaagtggtttgaaagaaaaggtatatttttcttttttgtttaaaagtaaaataaaacctccagttacactgtgcattcccctcacgtaaaaacaagacaaaaaccctttcctgagttgctcggca

SEQ ID NO: 128636 - DNA, 1036 bp, Homo sapiens
ggacagacacatggcccttcgtgctctggcggagctgtgacttcaccttcatccttcatctgtagaggatgggtaaaccggttccctggttgtcaggcgacctgctaatacatcagcatctggaaggagagggcctgggcactggtgttcttaacaatgttcccaggtgatgctcgcggacagtcagggtgaagagtagtttaggatctttcttccctagctgtcgcttgctaccatttcctttttatagtagatggtgttctgaattcttatttttgttgagtaaattacctactaaatgcttgaccttaccttgctgtgttaatccaattgaaaacctatttgataaattgaatagatttcccttgtttcttaatctagaccctggattctcatagatctgatttgctcaaaatcttgagtaccaccttcctattgccttgaggttctctcttgtgtgataatacttctttcttgtcagaactagttctttgcttatgtattgccaagtggtgtcctaaaatgtggcttttacacacttcattaacaacatatagtgactaatttttccttaattttaatatttgaaacttttcatatagacttgtgttagttttctaaacaattttttaaaattttaaagaattttatgtttgtaaaatggataaagcttgaggccctaagacctgggtcaccaacacctaactctttcatctcctatagaactaacttacgattaaaagaagagttgaaggcagagaagaaatctggattttgggacaatttggttttaaaacagaatatacagtctaaaaaaccagatgaaattgaaggttgggagcctccaaaacttgctcttgaagacatatcggctgaccctgaggacaccgtgggtggccacccatcctggtcaggctgggaggatgacgccaagggctcgaccaagtacaccagcctggccagctctgccaacagctccaggtggagcctgcgcgcggcagggaggctggtgagcatccgacggcagagtaaaggc

SEQ ID NO: 128637 - DNA, 1390 bp, Homo sapiens
gacgggccaggggaggcgtctcaccagacagacgtgtagacgggccaggggaggcgtctcaccagacagacgtgtagacgggccaggggaggcgtctcaccagacagaggtgtagacgggccaggggaggcgtctcaccagacagaggtgtagatgggccaggggaggcgtctcaccagacagaggtgtagacgggccaggtttccacagtcgttcatgcagtggtattttgtgctgagctctgttctgattctctcttctggtagcttctcatctcccagatatgtcattctgtgtggaagcgtaggtttgagaccttccttaagagaggaaagcttatctttagtttatagaaataaaaacaaaactgtatttccaagcaaaactgactttatgtaggtgtctccagagatgcagcttcagctgccctcgcagatgccgctgaggagctgctggaccgccttgcgtcacacagcatgctgccctcagacgtgtccatcctgtaccacatgaaaacgctgctgctcctgcaagatactgagagattgaagcatgctctggaaatgttcccagaacattgcacgatgcctcctggtaagtaccgtacgatttattcaaggtcctgcttaagatactctcatcgaggtttgcctctgaaagacttacacgccaccaaaacagcaatgagttggaaaatatgacactgcacatatggcatgggagaatagagtcccagagagaaacaggcttcctgcatctctgcttgatataaaaatatttcacataatatatgcagaaatgcatgtgcagtctaagtttccggacttgggagctgtcaactcttggagccaaattttcctaagtttaaatagaaatgaattcatttcttcctcttttccttctcctctactgctgtggtagatggtaaatttttgcttacctccaactctctggtaccttattgaacccctgacgtggtgatgacgacttttattttctgccaccttcaccgggcatccttttcatgcaaactgttgtgtgctggagcagctgtgctcatgtcttcccaatgccgtgtgcggtgacacaagctgtggtgagggtattcaggccacagaaacctgcaaatgctgaaaatcagaaattcaggctgttgagccattcacctgcacaccactgagtgcagagcagcccacctggcccagggctggcgtcccagaggaggagtggaggagggtccgtggcacccgtcagtggcacctatcccagaggaggagtgaaggtgggtccgtggcacccgtcccagagaaggagtgaaggaggctctgcagattttgtggagggagtttcagagtaagtgtcgggagtggtttctgtccgtagaaaccac

SEQ ID NO: 128638 - DNA, 1105 bp, Homo sapiens
tttgggagcccgaggcaggtggatcacttgagaccaggagtttgagacaaccctggccaacatggcgaaaccccgtctctactgaaaataaaaaaaattagctgggcatggtggtgcttgcctgtactcccagctactggagaggcagtggtaccggaatcacttgaacctgggaggcagaggttgcagtgagccgagattgttccactgcactccagcctgtgcagcaaagtaagagtctgtgtcaggaaaaaaaaaaaaaaaaaaaaagcaacaacttgtacatccttcaaaacacaccatatattatgattgtcgcatctgtgagtgtatgtactgctaatttatattacgttagtcctaggatctttgatggtaaagttgagaatcaccgaagtaaatagtgtaaactctttttctactaaaactacaagatcctgatggaaaatttatttagcctaatatgtttgttatggtttcattgtactgaaaattgttatatttgaatttttttaacagatcaggatcctcatgaccagccaaagagaagaagaattaggaagcataaatcaaagaaaaaatttaaaaatcccaataatgttcttatagaacaagcagaattagagaaacagcagagtctgttacaggagaaatctcagcgacagcacacagatggcaccacaataagcaaaaataaaaaaaggaaactgaaaaagaaacagcaaattaaaaggaagaaagcagccggcttggcagcaaaggctgctggtgtcagtttcatgtaccagcccgaggacagcagcaatgaaggggaaggcgtgggagaggcttgtgaggaggatggtgtggacaccagcgaggaagacccgacactggccggggaggaagacgttaaagataccagggaggaagatggtgcggacgctagcgaggaagacctgacacgggccaggcaggaagagggtgcggacgccagtgaggaagatccgacaccggccggggaggaagacgttaaagacgccagggaggaggacggtgtggacaccattgaggaagacctgacacgggccggggaggaagacggtaaagacaccagggaggagga

SEQ ID NO: 128639 - DNA, 2024 bp, Homo sapiens
gagccaacactgcttcccagacaggctgtgtcaggactgagctacagcagtgttcttacaggaagtggaaagatacttgcaccacatagacaggcatttctcttcacaagctgcttcttgaggacacgtgtccaggagcccttgaggagtcactcctttcctgttgcccgggcccccttgccaccttctccaggcgccagtgacttgaaatggtaaagttgggaaaaagacagcaaagcccaccctctaattgtgtttcctacctttgttcttcaaaatgaaagagaaaatgcccagagcaagccccaagcacagccttgcagctgcagagccgatggagcctccagggccctcaggagccagaggccaggagaagcaaggatgggacccctctctctctgaccctccaaggtcagtgtgggaacacggcacacaagaaggaagagcctttgagcttttttggttgcagttttaagcacagaggtgagaactggagctggaaaaataacggccaacgttgttgtcgtggtctctcttggaagcactcaggtcactggctttcattttgaacacgtggggcccacacgtcaactcccaggaagctgcagaggaaagtgctgtttgtttttgcctttgctgtgcctggcaccaggccccctgggcattcacactcaggaccttgcgcagccctgctctgcgccggggcatccccacagcaacttggatcggccgcccagggccttgtcgcccaggcaggggtggcatacctggtgcttagccctcagtctggcccctcctggctgcccggcctctgagacttggtttccaccctcccggaggccatctaggcccccgcagcggcacttgctgcgcccttgggtctgccggtcccggttccaacaggctgagggcctgccctttgtcttgtcctgggtacctggctactgccttgtgataaatggagatttagtgctcactgaccatatcaattagggcctgtgtgtattttttatgaagacaggcagacctgtgcccaaaagccaggacaggaagacctaagtaccagcagtttgtctcagtctgtcttgtctgtgttctttgggtaatctctgaatgtgacaagcacagactgtgggtgcttttgggctcacagcttgtcaggaacaggtggaaggagacgggctgtgggaagtcttgaatggcattgtgttggatgtggttctgggacctctgccacctgggttaatgggtcttggctctagacagaaacatgcacgtactcctcctcttgttgacgtggggttgcgtcttgctctccagaagccagtaaacctctggcctgttagtgacagaacaacccactatagattgtgccagaagaaagttgtcctttttggcagagtctccatggaaaatgctacacagccacatttagcaggcgaactcacttatctggcaggacgctcttctgctcacggtcctggcgcgtcgtaggaacactgccctacatgaatttacagagtctattacagtgatgtggacattcctctgggcagctgggataagcacgttgtgctcaaaataccgcttacgtccgtcttctcctgtgtagaccgcattacaggactctggacccagctgaccactgtggggacgctgggcaccttcccagcagcacgacagtgtgtccctatgccacggtgccggaaacaagtccagccatgtaatttttagaagaaaatgtccgcagtgcccccaacatgcctcttccctgggttttccagtggcacacagtgctggcagcttgcatggtggtgcaccttcctgctcctgccagacacctccaggaggagacaaggggtgtgggggcaccgccagcatctgaaagcctcgttcagggaacacaggaattgatcagtccgttaggttttggaaatgcttaccttacatcaagtcaagatcataggtgaggccaggcgcagtggctcacgcctgtaattccagcactttgggaggccaaggca

SEQ ID NO: 128640 - DNA, 1335 bp, Homo sapiens
agggactcctcgtgtgatgataaagggtgtgtcgtgcaaactgtttatattttgctgctttatactcatgaattagttatgtttttgtattgtgttacaaaaacccagaagtttgcataataagtaatttcatgtgaattcaaacaatcatgggcagttcctttttcttggctgggtgtgtagctgacctgcttttctggcacaatacttgacatattaaaatcagtatttatgacagtggttaggttttattgagctctttgatttcatgtcttgaatgaatttagagaaacaatgccgatgtaatcaaggcaaataaatgactgcattttgtgatatttaccagttcctgttattttcctcctgtgttgcagacactggctctgagaccccgactgcccgacggctctacactgccagcgggcctcctgagggctacgtcccctgttggccggagcccagcagctgtgggagccccgagaacgcctccagcggggatgacacagaaggtaaaatgctgggtgggaggaaaggtagacatctttgcagataagctcgtatttcccaattttctggtattgtaatacctttatctaaattcatacttggggggtgggtgagcatgttgttacactgtataatgaaccacatggtgtacctttgtattttatagccgtgaaaagtgatgcttaaaagacttgtaatgacaggaaaaaagacttcatatggaggagattgaaagtgggaatatgactatagcccatgtttgttaatgctttaggagtaccctggaactaaatacatattaaataccattaaataattgttaacagtacttgtcttggtttagcaaaatattattttcttgattttccaagtttttcagaatttctgacattgtacatcaaatctgtaatcaaggaaataccttatttcgaatgtcttttggaaaaaattattataattcctattgttgttgcatgtcgtacgaatgaaagaatatacaatattctcttaatacggttgactgttgagcatggaaaagctgaagttgcccatatactttttaccttaaaagggaaatagttgtttttcacttcacgttgatcttttttaaggtgcacaagaggaatttagagttttcaaataaaagttgtacctagatgatttgtaacaatataaactaagaaactctatattataaacattaattaatttgaatatcaacaaaatgtggtttttgactgcttttgtctttctggcttcctaaattaaaggatcagaaaccataaaaacaaaaatgagataactaaggaataatggattcatcctttc

SEQ ID NO: 128641 - DNA, 1069 bp, Homo sapiens
tctcattcttcacattcccaaataagctgtacacgtattttctctgaaagtcacacttttccaacagacaccagtttataagggtgatagcaaaagttttgaaattttagagaatcacgaatgatcattattttaatctcttccagcaccaggagtcgcatacccaactgttagattttaaattcagcaactgcatttaggaagagtttagaattgaataggttcacttccagtggtcaaactttgtttctttgtgagctacatatatttacagtttttcctaagtgtgtaatttccatagaacactttactgaaagattttattggtatttggctgtgtcttttatttgaaatagcaagtgtaggcagcagtcctttctgagaattataccgaagtgacttaattcccctgtgaaagggactcatttctgctgggtgttgcggcatgtgaatttcagacggggtgttttttctgggccttggccttttgttgttgtgtctctctttttctcggtgctgattgcttggcctgcttcgtcatttatttgttttcctgcaggttttttttttcgattggcattaaacactccgtcctctgcctttttattttccggtgattgctttttgatgggcactagagtttcaagttaaaacttgctcttgctgctggaaggggagcacgttgatgaggtgtgggaaggagaatggaaccagcctcaggcttctgacagacacggagtcgtcgtgactgcaaggcattttcatttgggccatgcagcatcgggggctccgggagctcctgctgcaccagctggtccagctctgtttttgtgggttccttttgttttcaacacattgtgaattaaacagaaaagaggcttttaacctctaacttgatttttgtcagcctctatctagagctcataagcgtacacacacttaggtaaaaacacattggatcaaaaacgagcatttcaacaaaccaaaaatgacaaatgcttcactgtgtcctggttattctggagggaaaaaacctttcgtttatgttctgcttttggtattagtcgcg

SEQ ID NO: 128642 - DNA, 1035 bp, Homo sapiens
agagcaggccacaccctctgcccctccccacccaaacctccagatgttaccaagattttacagaacagcatcaaacatcaggaaagcatccaggcagtcgcagggaaatcctgagggtaccgtgaaaggcagaagtcagttcggagtctcggaggggccgtgacagaagaattctcccaggagcgagtggccagatgacaagctcagagcagggacacaaagtccaagcgggatcccgggaccagagtcagctcatcaccggggagcccggtcgtgaattcacctgcttgctaaactctacctggaacccccaaagctgtgctcacactggacacctgttctcactggacacctgctctcactggacgcctgctctcactggacagctgctctcactggacagctgctctcactggacgcctgctctcactggacgcctgctctcactggacagctgctctcactggacgcctgctctcactggatgcctgctctcactggacgcctgctctcactggacagctgctctcactggacgcctgctctcactggacgcctgctctcactggacgcctgctctcactggacgcctgttctcactggacagctgctctcactggacgcctgctctcactggacgcctgctctcactggacgcctgctctcaccggacagctgctctcaccggacgcctgctctcaccggacgcctgttctcaccggacgcctgctctcactggacgcctgctctcactggacgcctgttctcactggacgcctgctctcactggacgcctgctctcactggacgcctgctctcactggacgcctgttctcactggacacctgctctcactggacgcctgctctcactggacgcctgctctcactggacacctgctccatgacggacctgtgagtctccgatgcacaattttccactgcagttgaaagggcaacatgcggccttatgtcagtgcacactgcacacatctgtcctttgcatgctttatttggtccagatttggtgcatttt

SEQ ID NO: 128643 - DNA, 1050 bp, Homo sapiens
caaggccaaggatgtgggcttccaggccacaggtgtgattgagggcatggctgaaggtgaaaggcgacaaggacccgtgtggcgaccaggaccaggcgtgtgcatgtcaggaagggtattttatttcatcttaattttgagaaatgctcaggatttcaatagaaaagcagaagaaaggccaggggtgggggctgagaaacagcagaggcccaaaaggtcaggctgtggagaatgtgagtggtacagccctggtgaggtgtacacatggcagacgaggggatgcgctctccctgcggtcggaagctgttctcttggggttcaggtgatgccaggtggcaccttccctgcacccgtgtgtgcgtgggcagctgctgggccacaggatgggagcctcgcctggggagggctgatcgcaggactgttccatctcagagagcgtgaggccggcctcgagagcctccgggattcagaaggtggctggttctgggagtagaggatgggtggtgtggacaggaagatctaatttaaatgataaataggacccttgagaaagaagaatcccatgacaaagagacaaagagaattctaaaagacactgtggagtgcaaagcacgccaggatcccagccagcccaggacggggagggcctgggagagattctcactgcctggggatacaaagcctgcatcccagccagccgaggagggggaggaccttgggagagcttccactgctgcagggaagccgggctagtgactggggccgcatccacaggtgtctgggggctgcgccacacagagcatggaggtgatgctttcctgtaacactgcacgtaagtgtgcatgagtcagtgccgagaaagccccttttgccccttaggatggccactgtcaaaaccgcagataatagcaagtgttgggaggatgtggaggaattgggtcctgggtgttgctgctgggaatggaagatggggcagatgctgtggaaaatggtgtatggagattcatcaaaaactcgagacggaaccaccttgtgacccagccgttcccc

SEQ ID NO: 128644 - DNA, 1262 bp, Homo sapiens
gatgggcttttataaccatgcacgtttagttctagactgttttctgattgtgtagactgggtacagtgtgattcttagtgaaagacagtgagacaggcacggctgtgtctgtgccacgctgtgtctgtgccccgctgtgtctgcatcgatcctgaacaggtgtacttggtgttcaccgcagtcttctgtgttgttgtctttgtgaacaagactgtggtgataccttgtggataaaatacgagttgctgtggatttgtttctgggaagacaattgtgttaacccaccctgttattcaacttaagttcttaactaagataatgttgttccatccttttcttttatagctttttagacatagaggcacgtagacatatacgggtaagacaaactagcttgaattgaagacaaactgatatagttatgagctattggagacatcaaagcatattttttgagttattggaaagatctaaacattattttttaaacattcaaatctgaagactgagctttcagtgctgtagggttttttgttgctgttgttgtttgtttattttgaaacagggtctcactgtgttgcccaggctggagtgcagtggtgcgatcagaactcactgcagcctcaagttcctgggctcaagtgatcctcccttcttggcctcccaaagtgcatggattataagcatcagctactgtgtctggccaaaaagctttgctctattttgagagtaaaaagtacttggcatctaaaaatacattattatttgacccgaaatggaaagacttgacattgtaattgaaactggtttaatgtattaggaaggagttgtgcacataatatggtaggactggtaggaaggaaaaacagccgtcctgtcctaggtgccctcatggtgctggggtagctgagacagagctgccgacatcaggccgcgacgggcaggatgcttgtgctttctgatgttctcagtctttcttgtttgcctaaagtactaggttttgggcagcgtgagtggggaagggaagctggtggagtctgtgagtcccccctgctgatgagctcccccactgctgatgagctccaaggaaaggcaagtcctgctgggcagtgttcatttgctgccaccatccacccagttaacatcaggttggccttgagaatagagtccactgttcacactggggtcctgagaataggagaggctgcgccagtacaggatggggccccggtgtgcccgggatccgtccggccgagaagcag

SEQ ID NO: 128645 - DNA, 1253 bp, Homo sapiens
cctgagggcagccccaggcccctcctttccctgtccctgtgcagaaccctggaggggagagatgagagtgttccggcattaacagaaaaccttggaaactgcagctttcaagaaaacactaaggcccagaggaggacggttaactacgcccgttctgttgtaactggatgtgaagtagaaaggctggaggttgttttgatgtggcctcataagggttaagtggattagtcattcgaggcttggtataaagagtctgaactaagagtctaaagatgcactttcctattccggatctttcaaataatgattaagccacgcaaaatgttctaaaatagattctcattttcccaatttaaatgtaaaacaaagtaaaccaggctttttaggtttacatgtttgcctttttagaaaagagcagccccacatttcaatacggttgtgcaccatatcccggtgttgtgttccatgaggacctgctccccgtgttgtgttccgtgaggacctgctccccgtgttgtgttcggtgaggacctgctcccggtgttgtgttccgtgaggacctgctccccgtgttgtgttcggtgaggacctgctccccatgttgtgttcggtgaggacctgctcccggtgttgtgttcggtgaggacctgctcccggtgttgtgttccatgaggacctgctcctggtgttgtgttcggtgaggacctgcccccggtgttgtgttccgtgaggacctgctcccggtgttgtgttctgtgagggcctgcagggaacagtggtcccatggaattatacagcccagtccttactgcagtttttctatgtttagctgggcttagatgtacagaccctcgccactgtgttccagctgcctgcaggactcagcgcggtcacatgctgtgtgggtgtgtagcccagaagcaacaagctgcaccacacagcctgggtgtgcggcaggctcaatcgccgggtttgtataacacattctgatgttcccaccatgaccagattggccaacaacacgtttcccagaacctgtccctggtgttaagagatatgagattgatttagctacttggtattttatatacttacgagcgtgtgtcagaaatattgaagcatagaacttagtgactttttatgagggtcctaaaatatccaacatgcaaatcagtctctgttaagagattaaaagctcattgtaaagtgttggaagtctgttctttactagtttttggctgatggaaataagc

SEQ ID NO: 128646 - DNA, 1770 bp, Homo sapiens
gaggtgggcagatcacttgagatcaggagttcagagaccagcctggccaacagggtgaaaccctgtctctactaaaaatacaaaaattagctaggcgtggtggcatatgcctgtaatcccagctactcagaggccaaggcaggagaatcggcagaaaaatcgcttgaaccggggggtggaggttgcagtgagcagagattatgccactgcactccagcctgggtgacagggcaagactctgtctcaaaaatagataaaaatgataagttctctgtcttcttcattgaaggtgtggcaggaatgtggtttggtttccttgggtctgtctttgttgagttcaggactctgctgtgtcctgtggacagtaatgatggggaggccgtgctgcctggaaaaggcagctttctcctggggagggactgaggggcttttacgtgggggctgggtcatgacttccaaagcagatgtgggagtgacagggagtgttcaactgagattagagaaaggtgttcgtttcaactgagcgttgaaagttgaatactttttaaattaacttatttttaaattctgtaactggattccccaacaaaattgaatttgggctaaagaaacccaattggacctgatttattttatgcttgataaagcatttcaagcattattttatgcttaaaaactcacgggcacgtgaatcagaactcttgaattccacacagctgatggttagaagagagcctatattattaaaaaaagaaaaatgtaatccagaatgttggtgttgtggtcaaataggatctttcttatattattaatgggaactcagacagccataacctttataagagattacaccaattctagaatatttttcctgtggacatactcaaagacatgggtaagtattagcaaaaatttggaaacaaccttcaggttctaacatagaggaatgagaaaatgaattatgtacccaaaacttggcaacaaaaatcatagtcttcaagaatatttaataacatgagtaaagtgcttaacatataaaaatgactgaaaaaaatgactcaaggctgaatactaatgatatttatacaaaagcttgatgcttatgtttagattttagatgctttctttgtttctctaaattttgaaaaatattttcaaaaatttctgaaatgaactcattataatttttaagcatgctataaagattgtatatggaaaaatttgcaaataagtaagcttattttttgtttaagaatgacttggagaaatacatctcaaggtatttttctgctttttagatgattcagaagtgtccatattctgcctacgtatataagtttttttttttgctatgaaattgccattttagacaatcgtttttcctaagaaatctttggaaagtaaatttgcattttatttaaggatttgaagatctttaaggttctgagaggttgctatacagttttttgtgtgtattaattgtataataaaattatgcatcataaggtggttcaccaacagaatgaagggttatacagttaatttttttctgaagaaaaaaagtacgacacagaagccatgagttctgagcatcacatgcctcataattttaaatgttagagaaaatgagttgataggcttagcatatcccttgaacgtagagatttgcaagaaagaagctagatgcagtgttcgcacacagagattagaagggaagccagtgttcccttatggcttcgatagatatttgtgaattatttgggtctagta

SEQ ID NO: 128647 - DNA, 1035 bp, Homo sapiens
gttattagaaactcagaccgatgggtgttattatcaccttccagaaaatgccaagaccctggaaccttttaactcctctgatatcttcctgctctgtgtttagccacagatacgaattctgtatgtatgtttaaggtcagtaagacatcagtgttattgttttgtgtggttgatatttagatttagtgacccacatattcacctttctttgctcttcatttcttcacttatttccttgttttttctggggttgttttgttcctccctgaagagctcccctaatttttgctttagtgtgaatctcttcgaagaaaattctctcaatttttgtttgcctagaaatgtcttcatttcggcttttgatgaaaaagatgttttctcagctctagaactgtaagttggcagttatctgtttcagccttttaaagctgtcattacactgtcttctgccttccctgtttttattaggaagccagggcatggtatcattgcttaaatcttacgtttctttggcttcttataatattttctctttgcctttggtttttaaaagttttaccctgctgtcctaggcatggctttgtatccatgtgttctgtgtagagctgaaggctgaagaatcttctatctgggaatgcaggactgtgccagatttgtcttttatacttaaaattccccttgggacagagacgaggatttgtcatcatgcctcattcctatgaatctactgtggcttctagaaaatccaaggagagaagggtggtgtccatgccctgttgacaggattggacactgctcaacttggaggttattctaatgctagagaaagaaaaacaaaatggatgaatataacactttcttccatgtaataatggacatagaagtgagagcatacatgtcagactcaaaaacatagatgagttcttaaaaactgaaaaaaagtgttatgtgagaatctgaaaaactaaatatcattatttgaaatatattaaacaccacttctcaaataagtttttctgactttaaaaataagac

SEQ ID NO: 128648 - DNA, 1080 bp, Homo sapiens
gagctccagccaaggccccgggctgtgtccaccacgcagggctgcagccgctgggtggttcctgtgtgtgccctttcttcccggggctccaggagagctgccagggcccctttatctcccggctccatcggctgctactgcgcacccctccccgggttggtgtcaggagggagggcgggtgctgcggaggccgactccatgcagaagccagagatagcatgcgctcggcttcacagacctcaaagctgcctctccaaaaatatgtgcataaatgtagagtagcctccatagataaaatgctctatgaatttacacaggagatgctgcagtttcctcttttctaggagattaaaataaggcaccttgtgccagaaaacactgggctgggcgtttgctgttcacgtgtggagctcggggaatgagccggttctcagcgggctgcgtgtggtgagggttcaggttcacgtacacaaaaccatcagacagatttctccatctgtgtcaattagcacagatcagtgtggtcttctcctaatttaagtgagactctgcactaatgatgatgaatccacagtgtatccaggttaagtcttgtctacattgtgaatcttttttaatgggtgttccttggggaagaattcattgaaagggtccgtgctgctgtgagtacgcttgctgtgtgttcagcttgctgggtgattttaaacatatgtaacctgtgatgaagatgaactgtggggaaagccctgaatctgtggtcagttttgacgcatattttggttcgcgttggacgagaggtgcggaaccacagtctctgatccatgtctgagtgagccgcctcgtgaggcttccagtccctcctgggggcactgagtggggacagccatggccaggggggccaagttgaacccagtgtgcctgtgggctcagcgctgagggctggtcacagatcccacccttgcaggtctcagtctgcctctcccttccctgaaatcagtgcctcccacaggcaccatggtgaagccggcgtctcccctgccctgggggaaccccgggcacatccaggactccgctctgtcc

SEQ ID NO: 128649 - DNA, 1108 bp, Homo sapiens
tgcttcgtgcagacgctgatcagatcaggagcgcgtctctgccgcttccttgaagaaatgattcctgagctggggcttaaagcacagctaggactcaggcagaaactcaaggaagaaactgcgggccgacgagcagcagccgtagaggcatggaggtgcgagaatttcaggaagactggctgggagcgggtgggagcgagagggcagctgggccgtctggtggggccgggtcactggggtttgcaaccccacagaggacggcagtcttcactcctctggctcttgcacagagccgagacgaggctcttggtcgggcgggcttagggtcaggctgcctttttagcaagaatgtcctgcaggcaggatggagagtgggtgggaagtcctgccaggcccctggaggctgaggaggcacccaggtgagcacttaaaatggtttcagccccgaggggtgacacaggtgagggccggcggggtcgagggtgacacaggtgaggaccggcggggtcgagggtgacacaggtgaggaccggcgggttcgagggtgacacaggtgagggccggcggggtcgagggtgacacaggtgaggaccggcggggtcgagggtgacacaggtgagggccggcggggtcgagggtgacacaggtgagggccggcggggtcgagggtgacacaggtgaggaccggcgggttggagggtgacacaggtgagggccggcggggtcgagggtgacacaggtgagggccggcggggtcgagggtgacacaggtgagggccggcggggtcgagggtgacacaggtgaggaccggcgggttggagggtgacacaggtgagggccggcggggtcgagggtgacacaggtgagggccggcggggtcgagggtgacacaggtgaggaccggcgggttggagggtgacacaggtgaggaccggcggggtcgagggtgacacaggtgagggccggcggggtcgagggtgacacaggtgaggaccggcgggttggagggtgacacaggtgagggccggcggggtcgagggtgacacaggtgaggaccggcgggttcgagggtgacacaggtgaggaccggcgggttcgagggtgaca

SEQ ID NO: 128650 - DNA, 1121 bp, Homo sapiens
ctggaccgctctagctttagtttcattttctttcctcctatactgtcagtggatgttaccttggtatgtttatgcacccttgtaagttcattaagaataaggtacagaattaaatattttgtagtttaatgtttgcgttactggggtagtgatgtgtccttgtttctatcgagtcaacacaaaatgaatgatctttcttttagattgaagatggatacgtgacaatcccagggaccgctgcactgacttcatttccttagacaagacacagtgtagggcccggcccgtgttggccccaggactcctttggaatatagctgtggacaatgaatcctgcgagcgatgggggcacatcagagagcatttttgacctggactatgcatcctgggggatccgctccacgctgatggtcgctggctttgtcttctacttgggcgtctttgtggtctgccaccagctgtcctcttccctgaatgccacttaccgttctttggtggccagagagaaggtcttctgggacctggcggccacgcgtgcagtctttggtgttcagagcacagccgcaggcctgtgggctctgctgggggaccctgtgctgcatgccgacaaggcgcgtggccagcagaactggtgctggtttcacatcacgacagcaacgggattcttttgctttgaaaatgttgcagtccacctgtccaacttgatcttccggacatttgacttgtttctggttatccaccatctctttgcctttcttgggtttcttggctgcttggtcaatctccaagctggccactatctagctatgaccacgttgctcctggagatgagcacgccctttacctgcgtttcctggatgctcttaaaggtaagtgcatgcatcagcagaagatgacatgtgcctcacgcatttaatcactggctacaatgtcctggacgctgccataaactcaacagcaggctggattgcagcacacacattcagttacaaactcattttagttgaatgcaatattctggttttgtttatttatttatttattttgagacggattctggctctcgtccaggctggaggcaattttcttaattttaagtcttttaggctttctcttcctta

SEQ ID NO: 128651 - DNA, 1125 bp, Homo sapiens
ccctggggaggaaattcttttgctttgaaatgaatttgttttgtttggtaagtaaggtagcaaatacctttttgtgatgtgaagaatgaattttggcagtttcgcattgacttgtgcatttgtcttctctccatgcaggcgggctggtccgagtctctgttttggaagctcaaccagtggctgatgattcacatgtttcactgccgcatggttctaacctaccacatgtggtgggtgtgtttctggcactgggacggcctggtcagcagcctgtatctgcctcatttgacactgttccttgtcggactggctctgcttacgctaatcattaatccatattggacccataagaagactcagcagcttctcaatccggtggactggaacttcgcacagccagaagccaagagcaggccagaaggcaacgggcagctgctgcggaagaagaggccatagctgctccagccggggctccggggcggcagcagagctggcacaccgattctgggaagccccgcgaatgatggcttttgaattaatgaggcagtgaatgttttgtgtttacttctaagggaaatactaactttctttcgcattagtattaattttgaagtagctacaaagtatttttaagaaattataattttatgactgtctggcaggctctgtcagtttagccgcgccggaccgtgtcaagcatctaggagaggagtccatggtgtccaggcatcggggcgtcacacctgttgaggagtggggtggctttgaatgctggaaatggcttcatagtgaagtgcctcccacagggcgggtgggtcagcgttgactctttccagctgcacactcatatgccgtgtgtcttattcagaagtcacattcttttcagttggagagaattgggctaagatagaaaataacatgatttgttccttattaaagcttcccagcgtatgaaattctaagctgggtggggtggctcacacccgacgtaatcccagcacgttgggaggccgaggcaggtggatcacttgaggccaggagttcgagaccagcctggtcaagatggtgaaaccccatctctactaaaattacaaaaattagccgggtgtcgtggcacacacctgt

SEQ ID NO: 128652 - DNA, 1969 bp, Homo sapiens
tcctctctgtccatgggatccgattgtcggaagcattgatgccatctggcgtggaggccgtccaccgtggggactgtgcagcgtgggggccatctggcatgggggctgtctgatgtgggggacatccagcttggaagctgtctggcgtggatgccgtccagtgtggttgctgtctggcatggaagctgtctggtgtggggactgtccagcgtggaaggtgtctggagtggaaggtgtttgatgtggggaccatccagtgtggggctgtctggtgtgggggccatctggcatggaagctgtctggcgtggggactctctggcgtgggggccatctggcgtggatgccgtccgatgtggggactgtccagcgtggaagctgtctggtgtggaagctgtccgatatggggactgtctggtgtggaagctgtctggtgtggggagtgtctggtgtggggactgtctggtgtggaaactgtctggtatggggactgtccggtgtggggacagtctggtgtggggactgtctgatgtggggactgttttgtgtggggactgcctggtgtggaagctgtctggtgtggggactgtccgctgtgggtactgtctggtgtggaagctgtctggtgtgggtactgtccggtgtggggactgtctggtgtggggactgtctggtgtagggactgtctggtgtggggactgtctggtgtggaagctgtctggtgtgggactgtctgctgtggggactgtctgctgtggaagctgtctggtgtggggagtgtctggtgtggaagctgtctggtgtggggactgtctggtgtggaaactgtctggtgtggggactgtccggtgtggaagctgtccgatatggggactgtctggtgtggaagctgtctggtgtggggagtgtctggtgtggaagctgtctggtgtgggactgtctgctgtggggactgtctggtgtggaagctgtctggtgtggggactgtccgctgtgggtactgtctggtgtggaaactggtgtggggactgtccggtgtggggactgtctggtgtggggactgtccggtgtggaagctgtctggtgtggaagctgtctggtgtggggactgtctggtgtgggtactgtctggtgtggggactgtcttgtgtggaagctgtctggtgtggggactgtctggtgtggaagctgtctggtgtggggactgtctggtgtggaaactgtctggtgtggggactgtccggtgtggggactgtccggtgtggggactgtctggtgtggggactgtccggtgtggaagctgtctggtgtggaagctgtctggtgtggggactgtctggtgtggaagctgtccgatatggggactgtcctgtgtggaagctgtccgatatggggactgtctggtgtggaagctgtctggtgtggggactgtccggtgtggaatctgtccggtgtggggactgtcctgtgtggaagctgtctggtgtggggactgtccggtgtgcaagctgtccgatatggggactgtctggtgtggaagctgtccgatatggggactgtctggtgtggaagctgtctggtgtggggactgtccggtgtggaatctgtccggtgtggggactgtcctgtgtggaagctgtctggtgtggggactgtctggtgtggaagctgtccgatatggggactgtctggtgtggaagctgtccgatatggggactgtctggtgtggaagctgtctggtgtggggactgtctggtgtggaagctgtccggtgtggggactgtccggtgtggaagctgtccggtgtgggtactgtcctgtgtggaagctgtccggtgtggggactgtccggtgtggaatctgtccggtgtggggactgtccggtgtggaagctgtctgatatggggactgtctggtgtggaagctgtccgatatggggactgtctgatgtggaagctgtctggtttgggg

SEQ ID NO: 128653 - DNA, 1071 bp, Homo sapiens
gcgagcgcatttccaacacgcggctccagcttccgtacaattcagagtaaacctaaaggcattctttctccctttaagttggctgagccagcccccctccaggtggccagatctgcagtcccacctgcggcttcaaaggctgaaagatttttagctagatttacttgttttttttaatttttaaaggaaaagcaagattactttcctgattatgcctctcattatccactggctcactaatttctatgttactgtttcatatgatcaacttacaaggtagaaccatcttagttacctcctgattattaaactgcctcctggaagttttcattctggtttcaattatgacgttgttaaaacaaagatcttagtgtaattagatgattccgctgtgtgcctattaaagcaggatcgttacaggattaaattattgtcttggctgtttgctaacagttttatttccgaggtaaaatttgtctgatttttttctcattactcatttttattacccagatggcagtgaattggaataactatatttggaaatatgatctctaaactagcagtctctgaacattatctaagaggagtagaaatctttactgtggttgcagatagtaaatgctattaaaagaaagagcgtctgtaatactggagcttgacaacagcagcagataaggaattttcctgaatttttatttcctgctagtgtggggacaggagtggtggctggatgtcaggggagagttcgggtttgttggtctcattttctgtcttatgtggctgaggaagcggttgtctgtatgtttttgatgcagtcatatgtcatagtttggacgttctcttgcagggagggcaccgctagtcaatgagtggaacctcgatttaaaggtctttttatgaaacggattttcatgtgaagcgtgtaactcttacagatatttgagtaaacctcaggctcattgttggtgtcctgtgtggtcatctcatacagcacggttttgcttacagaacttgccttcttttttatgaaacggtttcactttcacagaaccccagtgttgcacgtga

SEQ ID NO: 128654 - DNA, 1554 bp, Homo sapiens
ttcttatttctggaagtctgtgtgccaccgttgtatttttttgtgcgtcagaacgtcaacttcataagcttaaaatactcgtcagagagccatatagaagtgtgtaattgaacacaaaatcatagaataagtttgacctggaaaccataaaactccttcctagtgacattttacagctggtccatttaaagagacatccttcattcccaataaattattctgccctaaaaataatgcttatgctttggtaaggtgctgttagctaccttacagccctcattgtctactagttgggacaaagaacgaaaaagtaaaaaataaaaaaaaaactacccttataaaccaactttttgaataatcatgacatcatcggcgactgtggccctgtaaaatttaaattgcactaggttttgttggtcactgtttaaagtgtttctccccgtttattgcagatccagaggaagcaatttacgatgacgttccaagggaaaactcagactctgaaccaggtttgattttgtctggaattgatttgaggagattcagctcagcagcctttccctctggatgccaaagtgactatttagtggacggcccagacgttttctgtattcatgttttgtatgttgcttctagaatggcttattgatgtgtggtggaatattggtgtttgtgcacatatgtgtgtgtgcttataacccttgaaatagggcagtttaatcttacttatcccaagcaaacagaggagtaaaggtacagaaaatgccggcaaagaggtaggaaacacagaggctgagaagcagcaatgtatatcgaataaatgacatcagtgagaaagtagagagaatcaggcaaaggtaatagtcaaagaaataactaagaattctctacaattaaagaaaaacataaattctcagattttagacatagagattcaaagcaagatgaattacacgttgatccatacctaggccgatgcaatggaggccgcggagcaccaggcccagggtgaatctcccgagagcaactggagagaaaacatggctgcctacacaggaaccgctattccactgacccacaggctgggggcgggttctcaaagcgaagaaggacgtggctcttttaacctgagcggccacgtccagcaaagtacagtcctttagaaagggcgatgggccgcaggaggcagagcgggggagcttgctgcccatagaatctaaggaaatagttaatgatgcactcgctgcagggaagagcacactgaaccacggaggaggtgacaggggcccggagggagtggggagcccgggaagtgtcgggcgtgtggagagtcgataccagcaccgctcaagacagcgctgatagtgccgattgagtttcagatgcagccggagccccagccagtgccgactgaagaggagggtgaccgttcatgccgtgtgttctgaagttctgaagtcggcatttttcagggggaggatcttgttaccgattttttttttttttttttttttttttgctatggattggtccagtttgcgttttatgggtaac

SEQ ID NO: 128655 - DNA, 1078 bp, Homo sapiens
aggcgatgtcttcgtggcttcggtaattaagctgggacacctggatgtccatggggctctccatgcacctgtcctctcttcccttcttaggctgatgttttgcccctgatctcctgcaagctgacaagtgtgcagttctctctaaaggccaggctgaagttgcaatgccctggccaagcgtgtgcgctagggaaatgataaatggatctttaccagggaggccaaggcgttagaaaggcagacactggacagaagctgtatctgaggacatttaacaatatgcactttatcgagtcttggatgccccattagacgatttgctgaagctttttgttgttgaacaaggatgccgtgtgtttggcaatgttgtaaaattgccgtttttaagccctcacacaggttctcttcctgatctaggtgtcactttctgggtgcagaattatctgtgcctgggaaaaatagaaaacacgtgatgggaaaattcctagatgttttctcaaacttttgcccttggctgtagcttctgttgtgtagatacaggctttcggccctatgctgtgacacaggaatatgatgttgcaacagcttgcctgaacacttcctggcaggagaaagggttagctgcctggaaaccactggtggtttctgcactggcagtttcgagtcattttatcctcactccgtgtatgaatcatacttattgtatattggttggattctacctagatgtagaggattatgagtgaaacagattggtttctgtaattatttgagactatgatgctatcaaagggatataagcttgcaagttttgaaaaaagtgttcctcttcttaaatgaatgttataataataatacgtgaaatgttttcctatatagtttgtatatgtacttgatgaggtctataaatgctttgaataaatatggaaacaaaattctttcaaagatatttgcataataccgtttatggatccttaaaaaaagagaaatattggatatttattttgttattggattttttttctggctgttttatatattaggttcaaccttatcactgttctttaaatacctacct

SEQ ID NO: 128656 - DNA, 1829 bp, Homo sapiens
ccatatctaaaaaaagaaaaaaaaaatagctgggcacagtggcatgcacctatatagtctgagctacgtgggaggctgaggccagaggattgctcgagcctgggaggtccaggctgtggtgagctgttattgaggtgctgcactctagcctgggtgatggagcaaaaccctgtttcaaaaaaaaaaaaaattcacaaacattttttgtcttcacctatgcatgggctaagctgcattgagcgtgaaaagagatgcaggacccagaaggcggcagttcatttgccaggctacatttcagcttgatgcttacataactacttgtctgcagcagtactctgaatttatgtgggctttcccgtattcactgaaggccctggctcacagggagatggtaatttgtatgaactgtgttaagttattgcatctaatattcattattgctaaaaatcattattgctacaaatcattgttttgtcattaggagtagtttcttacgttacaatgacattcagtaatgtaactgtgcgaactttatggtaatacactttaagccacatattttccccatttctccaagtggtttatgtaggaacgtttataagcagcaaattgtattcagttatattcttgacatggttcatgttatttaaaatcatgctccctgtggcacttgaacctccgaatacacatggggcacggagcaagcccagaggcccaggaagaggggatgatgcttcgcactgaatgtcacccacatgcctcatcgttcccgtgcacttggcagggacattcagggaggcgggtgtctcgctggttgctcagagctgggcagcagcgtaggtttagaatcaaaagacagcacagaccaccggggctgaggactctgtttttcttgtgggctgagttgttataagtattggccgggtgcagtggctcacgcctgtaatcccagctctttgggaggccgaggtgggtggatcacgtgaggtcaggagttccggaccagcctaaccaacatgacaaaaccccgtctctactaaaaatacaaaaagaaacaaattagctgggtgtggtggtgcacacctgtggtcccagctactcgagaggctgaggcacgagaatcaattgaacccaggaggtggaggttgcagtgagttgagattgtgcggctgcactccagcctgggtaacagagcgaggcttggtctcagaacaaacaaacaaaaaaggtagtgtgacttctacatcgcataccattgtcttggttcatacaaagcgtctttctgaagaactgatggttttgctttggctcagtgaagtaaaatatggcctacctttaagaagttaagatagtcatttaactatgcttaattaggtttacttggggaaaagtaaaattacaaaacaattccttgcattcctcaccgttcctggttaatgtagtgtttaaatcgcgggagggccaactgcggtgaaagtctgtgaggaaggaggcggatgttcagcgcagtcacggggaacataggaacgatttccgtaaagcgctcagtttggaaaagtcaccctgagactccataccagacttctcctcatctttttcttttccgggtaaactgaactgtggtccctgggctgtgttttgaatgtccagcttctcagcagtggaagccgatacctcattcgatcagatgatatgatagaaacagtttacaacgacagaggagagattgttaaaaccaaagaacgccgagtcttcatgttaaatgatgtgttaatgtgtgccaccgtcagctcacggtaagtgcataaattctctatagtagtcctacc

SEQ ID NO: 128657 - DNA, 1102 bp, Homo sapiens
tctgagcctgtgggcccgtcgtgggatttagtgaggaagtatttgaacattacttcctgtagtacacaggaagccctctgtgaggggtagagcaattctcacttgggcaaatagaccccgggacacgcgtcgttcctctaacccaagtcatcgaagacaaaccatttctattcccttaaaaaaaaaaaaaaactttaggaaagatcattggggaactcattttcatggtagatgaccccagttattggaaatgtggttcagattaaatgtcatttctaagtgcctcttactaatagctgttatgtcaacggtgtctaaaaaatacaaaagggacaaaacatgaatcaaactcaaattgtgagacattctttaactcaccagcatcctccaaaaatgtcagggtcgcgaaagaggaagattgagaaactcccccagactggaggagatttcagggacgtgaccaccgaacgcagtgcgagtccctgggctgaatccgggactaggaaatgacattcatgtgaaagcggtgaggtttgaagacggtctgtaggtcagtcaggagtgccgtgtcattgtggtgtcccggatttgacggtcatgatacgcttgcgtcagatgttatcctctgaggaagccaggcctgggcattcaggaggcagctctttgcaacttttccatctaaaattatttccaaataagtgttagaaaaggaaaaaccactaaatgcttgaaaatgtccactttttaaaagttctagattcacccctcaacttaaaaattatttagtatttgagtcttttcttccctcaagtattggagtaaatatggctttacctttgtattctttttttttctttttgcttattttgtagacaaagtttacatggggccaggacaactgtatcaagatttacaaaacttgttgcatgacttaaatgtaattggccaaatcactcagctgataggaaaccttaaaggaaactatcaggtaacaattgaagcaattggatttaagattctgcctttacttataagtcattgtaagtatgtgattatatctccaagttctaccagaagtgagaattcattttgactttaaaaa

SEQ ID NO: 128658 - DNA, 1086 bp, Homo sapiens
ggcggtgcacaggactcctctgggagaggctggggtgggacagggaaggggagaggcacaggccatcacaggctgtacttgatgcctgcagggccagccctcccatctgaagcgccctgagctgccggatttcagtgtgctgatgggatctaaagattaagataccaaaggttgaatctccttaggtgttcacttctaaaaagctaacttctgagagttgtacttttaaactttcatcctccctattttaatctttggtaggtaatgaacctgtaatttctgtgtttatacattggaagtaagtcatccatttaagacgttatgtagtctaggagcctcttagctctgttttatatgtgagcgtttgattttattccattttagattgaatgtgctgcttataaccctgaaccttacctaaataatgaaagccagccagattcattttccacggcacatggtttcctgtgggtaagatgtgtttatttggttttggtacaagttcacagagaatcaacgttcatggtcggtgtgatgagagactgagatgtgaattgctcagtagagagttggcggtggcgtatcccagagtgtacttagaaacatgaaaacttctttgaaagggagctgatcacttttggaaaagatttacagttcttaggaatgcaaatatttgtttcttttccttttcatctaaaacatttaccagataaagttgagtccagagacaactaactaataagagaataattttaatatgtttttccattttggtgtcaacattgcatggattttttttcttgttccaagactggctttttccagtggaaacttagcagttaaaattaatttgttccaaatgaaatattgcatctgaaattaggctggaattgcagtagacgttcctggttcttgcaaaccagaggacattcttgaagctgtgtggtcccaggctctcccctctctggtttcctgtgttccctccctgcagcctcagactcgccctccagggctccactgtgcttttccaaactctcatcctttcctcccaggcgtcctgtgcagcacgccactgcctctcacttc

SEQ ID NO: 128659 - DNA, 1092 bp, Homo sapiens
tgcttcaacgtggaatctcgcatcctgtgcatgctgtacgttcccgtcgaggagaagcgcagagagcctggggcacccccggaccccgagaccccggccgtgagagcttctgatgtccccacgatctgtgtagggacggaggagggaaggtagggcatgctcactgcgttacagagaattagcaagctctgcccatggagggcgtggtggggagcctgtcctggaaagagtccttgactttgactcaggagtagcccgtgcaggaattaggggataccaggggaaatttttagggtcattgcactttgaaataactagtgaattgggcccatggaaattattctaggaaactcttaaagagaagtggtatttctttaaaggggacagtttggctgtttgccactgaaatgtctcatttatattaatggttttgaaaaggacattccccccttatattttggaataaaacagccatattctatgtcatgatcatactgaattgctgacaccatttaaaggagagttaaaatgattttcctgatgtgaagttccaagatacacagtaggaagaactaagttttttcatatatcccagaatttcccttttaaaaataaagaaatcaaggtggttgcaaattttttaaaagtactggcaagtgtccctaggaatggagaaggaagggcaagagggaagagttgaaatgtttgtgtttatgttaacaggcaccctcgttcttgttacaacgagcaaatatatttattagcttgtatttttctcttaaagcatttccatttataaaagcagtcaaggctccaagaaagtgagacttcagcactttttcactcctgagaagtccacagtcatgagcctggcttgcacgtctcagagcctgtacgctggcctggtcaacggggcagtcgccagctacgccagagccccaggtgaggcgggtctcacggcctcctggccggtccttggggttcactcaggggactgtgcatccggtttagcctccccacctccccaccggcctcctgcctcccgcccctgtgcctccgcccctgcgctcgtcacccttgcccaaggcccgg

SEQ ID NO: 128660 - DNA, 1114 bp, Homo sapiens
tatgatattactctgggtttatatgaaacgtcatttcggtccatcatcagaagccaagcaacgcattactaatgcagttaaaatgatggaaacactgaggcagtgattcagttgaatgtagagttggatttatgttgagtaaaacgttcttgatccttttttaaaagtgaataggttagaaggatttatcgcacacataagtcttttatggataaatattgccattttaatgattcatttttcaactgaacatcacaatttcctgcatcgatttaattaaacattgaaaatgctgctttcggttaaagttacatgtcgtaatggtgcgtatcccttctcattttcagtgtatgatgatatgattttggcaatgagtagagtctgtggtaagtaaatgccttttaattttcaagtcatttggggtgctgaaatcactatttcctgacacgggaagtcactgctgcaaaagagggcaccatggagctgtggtgcgtgttctgtgggaggccctggatggaagggcagggtggtgatctgctgccgatgaagctttttaaaggacttccctcagttttgtctggagtttgagttttactttaagaaactcaggttgggcgtcctgattagccacttcttccatcctgtcttaggttaattggcatgactgctttgtatataattgctatgagcagctttttacatatgttgaatagccgtaatgaatttttaaacctctcactttgcgtcgtacacattaaaccatatgttatctttacaaataaatgcccagaggtgggattgctggatcacatgtcagttcagcttgtttttggaggaaactccacactcttttctatagtggctatattaatttacatgccaccaatcatgcacaagtgttcctttctctgcttgccagtgttttatcttttgtctttttgataatagccattctaacaggtgtgagatgatatctcactgcagttttaatttgcatttccctgatgattagagatgttcagtatttttcaagtatctgttggccatttttctgtcttcttttgagaaatatctgttcagatcctttgcccatttttaatgggttatttgtttt

SEQ ID NO: 128661 - DNA, 1050 bp, Homo sapiens
ataatccatagtgtttggatgcacgaggactcagatcaagcaaacgcctgagcacggcatgcagctggctgaaaaagtaatgctcggaaatgagaagagcaagctctggaacagaaggctgcagtgtcaaccagctgctgtgtcacccagctacagtgtcacccagctgtactgtcacccagttgcggtggcagctagctatagtgtcacccagctacacagtcatccagcttcagggccaccaagctacactgtcacctagctacactgtcactcagctacagtgtcatctagctgcactgttacccaacttagtgtcacccagctacactgtcacccagctagagtgtcatccagctacagtatcacccatctgcactgtcacctagcttcactgtcacccagctgtagtgtcatccagctctactgtcacccagctacactgtcaaccaggtacagtgtcacccagctgcactgttatgcagctgtgctgtcacccagctacactgtcacccagctgccctgtcacccacctatactgtcacccagctgcactgtcacacagctgtgctgtcaaccagctacactgtcacccagctgtagtgtcatccagctgcactgtcacccagctacagtgtcacgcagctgcactgtcacgcagctgtgctgtcacccagctgccctgttacccagctccactgttaacactgtcacccagctccactgtcacccagctgcactgttacccagctacactgtcacccagctgtggtgtcatctagctgcactgtcacccagctgcagtgtcacccagctacagtgccaaccagctgcaccatcacacagctgcactgtcacccagctagtgttacccagctacagcatcggccagctgcagtgtcacctagctagtgtcacccagctgcattgtcaaccagctgtagctgcagctcaacaagcccagtggagagcaactacccttcccatgggaattaagttataaatattttacacattaaagacatgttttaagcaagttcttaagctcag

SEQ ID NO: 128662 - DNA, 1064 bp, Homo sapiens
tctgccttggaaggtgaacacatgaagccagagagaccaaggaacagaattttaaaactcacttaattttaatacatttaaaaaccactactttattctattactgggaaactttcaagtgtgtttggaaaaaacgtggatatgtatatctacttttgcaattgcaacttccatgacaactaattaccaaaaaagtatttctaatgctgtatgtttacaggaagtagaagaaatgaagataaaagtcttataatttatacatttttgaaaattttaacatacgttcaaataatattttatatatagtaacatgtttttaaaaatatgggtactaggaaagtacaattatatttatggcttacacggtattgctatagagctgtgctcatctagacaaggttagcattttgtgagctgattcacacaagccttaaaatttatttacaaagttattatcaacataggtttaccttcaaacagtacccatttttcccagcatagctgcagtctcaagttctaacagtgttgatatgcaaatgtgggcactgtaaacaatttgcttgtatattttaatttttctgtgaaatgtggaggatatactgaaacagtgatgtatgcaagtgctcagattggtatccggtcgcacatttcggtactaaaatttaattgtcagattctagacaactgaagaaaacatgtcgtgtctattcaattattatttattagaaattattttttcagaacgtggtaacatatccactctctttcaaagcttattatatactacattataaaaacgtgctaatatcaaatactgcaatatacaaagctaactatatgcctaaagagagaaagtaacctttgattggcctatgcttgcttaagaaataggccatggtaaaatcttcttttaagcgtacttctaaataattcagaatatttacatttgaagtgtacggtgtaatgaagagagcatacaaaacagagttatttattttcaacgcgttagttaacgctcagcgttctagctatgagttcactgtgttctaggctgggaaggaagc

SEQ ID NO: 128663 - DNA, 1606 bp, Homo sapiens
cgacagctgaggtactgaacactggtaaaaaattgtatgagggtaaaacaaaagaagtctacgaaaagtcctcctgcagtccaaggacaagattacagcaggaaatgtagctagaaagaatcacctggaaggaaaagctgcaatctcaaagaaaatcaccagttgtatttttcagttattataggaagcaggtattaaaactgccttcaccagaaaatgtggggagacagctttcattgcaccccagtgcgaaatgattccaattgaatgggtttgcagaagaatagcaactggttcttttctcaaaagaaatcctggtgtcaaggaaggatataagtttacccacctaaagtggagttgtttttcaaggatgctgccaataatgacccacagtggtctgaggaacagctgattgctgcaaaattttgcttcgctggacttgttacaggccagactgaattggatatcatgagtcatgctacacaggctatatttgaaatgctggagaaatcctggttgccccagaattgtacactggttgatatgaagattgaatttggtgttgatgtaaccacaaagaaattgttcttgctgatgtaattgacaatgattcctggagactctggccatcaggagatcgaagccaacagaaagacaaacagtgttatcgggatctcaaagaagtaactcctgaagggctccaaatggtaaagaaaaactttgagtgggttgcagagaaagtagagttgcttttgaaatcagaaagtcagtgcagggttgtagtgttgatgggctctacttctgatcttggtcactgtgaaaaaatcaagaaggcctgtggaaattttggcattccatgtgaactttgagtaacatctgcgcataaaggaccagatgaaactctgagggttaaagctgagtatgaaagggatggcattcctactgtatttgtggcagtggcaggcagaagtaatggtttgggaccagtgatgtctgggaacactgcatatccagttatcacctgtcctcccctcacaccagactggggagctcaggatgtgtggtcttctctttgactacccagggtcttggctgttcaaccacactttctccagaaggatcagctcaatttactgctcagatatttggggtagacaaccatttagtatggagcaaactgtgagcaagcattttgaacacatgtatttccttgaagcaggctgacaagaaaatcagagaatgtaatttataagaaacaatgccattgaaatttttaggggaaaaactacaaatttctaatttagctgaaggaaaatcaagcaatatgaaaaggtaattataaattagagaacacaaataaaatgtattagtgaatcaatgcttctctagatccatactaataaacatgaaaacctaaaaaaaataaaaaaaaataaagggaaactatcatgcttaacttaacatgacatctgcttttgaaacattttatacattttaaatttatgacacagaaactctccctgctccttcctgactccagggcaggcacatgcccagtgttttcaggtgttggaggttggcagcatatgagaaggacagactgtag

SEQ ID NO: 128664 - DNA, 1035 bp, Homo sapiens
ttagccaggcatggtggtgcactgtagttccagctacttgggaggctgaggcaggagaatcacttgaacccaggaggtggaggttgcaatgagctgagatcacgccactgcactccagcctggcaacagcaagactctgtctccaaaacaaacaaacaaaaaaatttttattattctgtgaaaatagacttaactaaatcaatagatgctgaagcattttttaaaaagcatatcagctacattatgattaaatcaagttactgtcaactcacttgcttttcagttaggtaaaactgataaaaaacaacaatgtgtgtgcatgcacttctgtgtgttttacaggaaacataaaaattttaacagaatgtatatgtatttcacaaagaatttctagaattgtgtcagtagataaatatacaaatgaatcactagtgaaattatagtgctgaaacataatggacaaaacaaaaattctggttctgattgtaggcaaaaatgcttggaccagattagcacattgtcataattcttttctctacttggagcttttatggaagtcattggtgggtaaacttttaaatttcttcctctatgacttgaagtaactttgatgtgcatcacataatatttgatggaaacatctatgttaggttaccaagatggcaaaatattttgtttaatatcaaaattcagcaagtatagtcagcttattttggaacatttttatgttttatagaagttttcctggctgggcgtggtggcccatgcctgtaatcccagcactttgggaggccgaggtaggtggatcacctgaggtcaggagtttgtgagcagcctgactaacatggtgaaaccccatgtctactaaatacaaaaatatcagctgggcatggtggcgcatgcctgtaattggagctgcttgagaggctgagacaggaaaattgcttgtacctgggaggtggaggttgcaatgagccgaaattgtgccattgcactctagcctgggcaacaagagcaaaactgtgtctcaaaaaa

SEQ ID NO: 128665 - DNA, 1033 bp, Homo sapiens
gcagtcccaccctctgtgcacctggaagagcccaggagaggggaatagcggacacgtgtcttgtagagtttgaccgtgagaaaaaaggggcctgtattgtggggcctggagtcataaaacctcatagccaaaagtaaagactagaggctttatacaaagtctgtaatcagatgtggctatttttctaatgttagtattttgttaaattaacctggttttcttttagcgttacccccaatcattgaccaacggcacacctggaaaatgcttttaaacatcaggttttgagaagaggatatccactagaacaggggtccactcactatgccccccaggccatatctagcctgctgcctgtttttgtaagggtctacgagctaagaatgtcttttacatttttaagtgattttaaaaaaaggtcaaatgaaaaattatatcacattcacatttccttctccataaataaagttttattggaacacaggccggcccgttaatatattacctatggttatgtttgtgccacaaccgtgaagttgagtagttgtggcaaatactgtattggccacaaagcctgaaatatttaccatctgtctctttacagaaaataggtttctgcactggaaaaattaagcgtaagaatttggggaaagcaactaattttacaaatgtaaactctcatgtattgtatgggtacagttgttctttgcttaaaattttaataaattccactgaagctattttgaaaaggctttcagtagaaatttatttatgagacagagtcttactctcttgcccaggctggagcgcagtgatgtgatcacataatagctcaagcaattctgcttcagcctcctgagtaacttgggactacaggcactaccacgcccggttatttttatttttattttttaatttattatttttttgtagagccagggtctcactatgttgcctaggctggtcttgaattcctagcctcaagcaatcctcccgcctccaccttgcaaaatgctgggattacaggcatgag

SEQ ID NO: 128666 - DNA, 1050 bp, Homo sapiens
gcccaagtgatcccactgccttggccttccagagtgctgcaattacagcatgagccaccacacctggccagtagagtaaatttttgttttacttttttctttttttttttttgaaacgggtctcgccctgtcacccaggctggagtgcaatggcgcaatctcggctcactgcaacctctgcctcccgggttcaagtgattctcctgcctcagcctcccagtagctgggattacaggtgcccgccaccatgctcggctaattttttgtatcttttagtagagatggtttttcaccatgttggcccggctggtctcaaacccctgacttcgtggatccacccacttccgcctcccacagtgctgggattacaggcgtgagccactgtgccggcctcggtttactcttaaatgtaaatagaacaaaatctattgggcaggggatgctggaatttcaaatgtatgtttcatgttcatatcttgttttcagatgtagtggcctatgttgaagtgtggtcatccaatggaacagaaaattattcaaagacatttacaacacagcttgtggatatgggggcaaaggtaagacacttattttgctgttgattcatatgacagtcttctgattggtaaaaagttacatttgcattttcttattttgggagtttttacttagaatctggacgaagcaatgggtaagcggtgggagaaaaaagagccaaagtgtgaagaatttagaacagtaggactttcagaactcaatgcctgtgggcattgagtgaggaggaggaacctaggatgaaatgctggattcttacactggttacttgaatgcatagtgctattaagcaaagtgaggaatacaggaaaaggaacaggtttctaagggaaaaattgtaaatttgggcatactgaaaaatatctgttagatatttggatatacaagtctggagcttggagtgttcaaggctagagatgatgatctagggggtcaggaccataggggtcatgtgaagtcacaggtgtggacatcgtcccatgtcaggcatggtta

SEQ ID NO: 128667 - DNA, 1037 bp, Homo sapiens
gtgacagtgtatttgaaaatactttggcaacatggtaatgatagatacaaaattttcttcttagaccaaatatgtatcgtaattaaaaactatatgtataaagtattaatgattcaactaatgtacatttgtatattgtcagaactacagtaagggtgattcaggcttaagagtcccaaaggagaatatattaaatgattcttggtatttttttgttgggggtgagtatcaaagttctgaagggctctttgagcatatgcaaggtagcattccagaaaaaaacacaactctgcacccacacaaaacgagctcataacttcatggttccgggaccatgctgatcccacttcatgcagtcaagttcatgtctgggtctgtgagtgtgtttgagggtaggagtgatggttcatgggggcagtttctgaaacctgagacaagaaacagaaactaaattgcattccagctttacaacttttaacttctgtgtctcagtctttgtcttcaagtggggatactgatttgggtttggatttgaggttggatgcactaatgcatatattgttcttagcacagtgcttggtgagggcagttgctcagcagatgtgagccagcagctgtagcagcaacatcactgcctgtggaggtggtggaggtagaatattagcaggagtaggtaatgatgttgaaagggaagaaggaaaacggggtgtggggggttgttctttaaaaggaatcacattcctgaagtatgaaggcactttttggtcttaaagtggattttttgtttattttcagatgatgatgtacctattctcttatttgaatctaatggttcattaatatatactcccacaattgaaattaatagtaggcaccacagcgcaatggagaagagattacaagagatgaaggagaaaagggaaaatctttcccccacctgtaagtaattagtttgtaaaatgaaaattatgcaaatagccgattcaattatggtggaaagcttcttttttctttgcctagatattttaatgtttcct

SEQ ID NO: 128668 - DNA, 2797 bp, Homo sapiens
atcacagattacactcttagtgacatgtcacattgcttatcgggtttttgaaaagtgtgataaaacataaaacaattttaggtgctgaataagatatattgagcatctaaaattaaaagtgaccttatttccaactactgccttgaagacacctggggcacagttggaagggaagctttggtggttacctgtgttcttcctttttaaagtagaacttcagtgatttcagacagagagttctaacacttacgtgacctccagattgagtgatttctacaaaacacaggccctccaccagcaagtgctgagcccctattgagggagccagcacgggactagagacttcttcatattcattccagtagcttatagcacagtgacgggcagatgcccacgtaaccatggggcagtatgatgcatgatggtgtgtagcagagggggcaaggccagggagagctggcaagggcagtgggagggtcccagggatgttgacaacccaggtgggtttggaaggatgaattgtatttacccagaataaagtgtggaggaaaggggaaggcccagagggtacagaggagtatagaatatttaggaggtagcagcagcttagcattactctcaggaaatgagtaatccatataagagttgaaacattaaagcctaccaaatggctcacttttgaatatcagtgtaatacgaggactttactggaagacagggaaggtaagggtgagctgtgttcattgagggaatgtttcatgcaagtctagaactttccctagatcttacaacagtagttcttaggttttagaattattgatctcctggaaaatttagtgacaaactatggatgctcttttggaaaatgtgcacatgcatatggaaatttgcctaaaatttttagaagtttgttacacctcttctctatccccactgctatcccatacacccatcaaagcccaggttctctagttaaaaatactggcctaaaatgtacccttaagtggaaatgagaagaactcaagtgtggttaatagtcttcttaactaatagctgtactttaaaagttgttttattggtcaactgaaagttgaatatagaataatttaaaccacttttaaaagttagctctccgttaatgttttccagatgaatactttgctggtggcttacactcatcttttgatgatctttgtggaaactcaggatgtggaaatcaggaaaggaagttggaaggatccattaatgacattaaaagtgatgtgtgtatttcttcacttgtattgaaagcaaataatattcattcatcaccatctttcactcacctcgataaatcaagtcctcagaaatttctgagtaatctttcaaaggaagaaataaacttgcaaagaaatattgcaggtaaagtagtcacccctgaccaaaagcaggctgcaggtatgtctcaggagacgtttgaagagaagtatcgtttgtctcctaccttatcttcaacaaaaggccaccttttgatacattcaagacccaggagttcctcagtaaagagaaaaagagtatcacatggctcccattcacctccgaaggaaaaatgcaagagaaagaggagcaccaggagatctatcatgccgaggctgcagctgtgcaggtcggaagacaggctgcagcacgtggcgggacctgccctggaggctcttagctgtggggagtcttcatatgatgactatttttcacctgataatcttaaggaaaggtattcagagaatcttcctcctgaatctcagctgccatcaagccctgctcagttgagctgcagaagtctttctaagaaggagagaacaagcatatttgaaatgtctgatttttcctgcgttggcaaaaaaaccagaacagttgacattaccaatttcacagcaaaaaccatctccagtcctcggaaaactggaaatggtgaaggccgtgcaacttcgagttgcgtgacttctgcccctgaagaagccctaaggtgttgtagacaggctgggaaagaagacgcatgcccagagggaaatggcttttcttacaccattgaggaccctgctcttccaaaaggacatgatgatgatttaactcctttggaaggaagccttgaagaaatgaaagaagcggttggtctgaaaagcacacagaacaaaggtaccacttccaaaatatcaaactcctctgaaggcgaagcccagagtgaacatgagccatgttttatagttgactgtaacatggagacgtctacagaagagaaggaaaacttacccggaggatacagtggaagtatgtgaatctccttttccaagtcaccttcgctaaataaacatgtaacagtgcatccatattttaaatttatcacaactttttcataacttatttccccatttactcctctttttacttaaagaatgtgcatttgatcattccaatgataaactctttaggaatagatgacttgctgtcttgtggaacttctagacttattggttaagtctgttaggaatctatttctccaagacttttccttcttataggtcaaaaggataagtagtccatagtatgaataactgaggggagtgaagtctttttccttattccattggagtcttggcgctgcagcgtgtgtaaagatgtatacgatagagagttttttaaaacctaggttcttaatagtgaggctatttaaagaaagaaattaaggtagattaagccatcgattgtatcatagagaaagtgtgaaaaactacttttagaaatctgttgtcaatattgattt

SEQ ID NO: 128669 - DNA, 1055 bp, Homo sapiens
tatatttattcatctgcatctacattgtctattgggttgtgagctccctaagtgtgggactatatcttgtgcattttgcatctccagtgggtagatgattagctatttgttaatcattaggtaatcaacagtgcagtttggctatcacctgcctggcaggttctagtaccccctaggctgctacataacttttgcgtcaaagtttgcattataccattgagaccatgttatggtccatgttagctcctccttcaaaatcccatgtaagtcataaagtaggcaaactgtttgaaggaggaggaagggtgagagtaagaggcaccctctgaggcagtagatgagtcaaatcaaagtacacatttcacatttcatcgtgggttacttaggtctacagaggttagcatctaaggaaaccacatttcacttgaatgagtatccttttggtttgtgtgtcttcatggcaagacgctggtctaaggtggaaacttggggggagtaaaatcatcatccatcatttgtaggttgaagcctgaagctctgtactgaagactattttctagaaaatctcaaactgaccccaaaagttagattaattattgcctctaatatggaactgcctactctgaagagctgttctttgtcattattttaaaatctaagaatttaagtttgacgagtgcgtaaggtatgggtatacattttcttacattatcaaatggacggagttgatgctgtagaacactgtaacctgattgttaccgaccattgaattaagtgaattgcttgggatattggaatgtaataaactgaaagttctagatagatctcaaagagccagatatatacaatttatttaaaaggcctataacttcctgtttccattatgcataaatgtgatttttgttttgcttaagttgtatttggtccatgtaaagttctaactaatttttaatccccttgggttttaggtgttaaaaatagaccaacaaggcatgatgttttagatgactcatgtgacggctttaaggacctcatcaaacctcatgaggaattga

SEQ ID NO: 128670 - DNA, 1357 bp, Homo sapiens
agcctgggcaagagtgagaccctgtctcaaaaataaacaaaaaagaaacttaaagattttagtctcaattttctacactgaacccatctttagatcatagcatgtataaaattaaaaatgggggaatatcaacattattatatttaatgctatagcttattattgtatttaataagctacttgtttaaagatctgggatctcttgggtccacagactgagtctttctgaaggtgctttacacgatgtagctgccagggatctaggtcatataatatcctcaggatgggatttgaagacatttttccagaatttatcttttgtcatattggattttatttttaaaaatttcctctatagtcaaaatttatataaatatatgattctgatagtaccatatatatttagatgggcttatactgggcgtgaacaaggttaataatctttgtgaatatgtgggttatctccttattttacttattcttaaggaaaattaatttcactgtttaccaaagaactgatagctaaacccaaaagatttcaaagaatgttttgtttttgaaatgtttctatttatcactaataaaacgggtatatctgtttaacttgacctatctttggtcttactaaaacaaaatcagctagaccatttcccaaataatcatgcattcaatactctttttctctctctctccctgctccctcatctctactcctttagaactttcagaacattcttttgtgtagatacagtgtttcatgtctgttattgtttctcactggtcgttggattctttcatgtgaccacctttttcacgtttgctctgattgcctttggatgcgcctaactgtgtgcttttcctgttaaggaaaagaatcctgcatgtttttttctcatcgaataacaatgttaaaaacagaaaagggttgtttttcttctttgcagtaggcattctgtagtagataccttgacatacttaaatttgtgagatgtgtctagacgaatggaagagtaatatctcatattaatatattgctaataataagataaaggtttcagcttcctggagctgtccatataatagaatttgtacttgttttttcatttctgagatcctcatactttggggttttttttatttttttattttttcgagacaaagtctcgctctgtcacccaggctggagtgcagtggcgcgatctccgctcactgcaacttccgtctcccgggttcaagcgattctcctacctcagcctcctgagtagctgggattacaggtttcctgccaccacacccagctaatttttgtatttttaggagagatagggtttcaccatgttggccaggctagtctcga

SEQ ID NO: 128671 - DNA, 1010 bp, Homo sapiens
catgtttcatgaatacaagtaaacccatgagtaactcatgaatacacataaacttctgggcctccaaacgatgccctgccagtggccatgccacaggaatcagaggctgtacttcactttgtggttgctttattattccaccattataagctttagtagaaaatgtaaagagggttgttaaactgaaggagtgttgtctcaaactgaaggagaaaagtagtgttgctgctgtaagatgtacataaactaaggggtgtcttttctaccatccagttagcaattaggaaagtccttctttgctcataccattccaaagggagtcatcttattctttctctaaatttccttacaatggaggctgctacagtttaagtatcgaaggtccttttttttcagatttcacctgcagtgcctataaatttgggggaatgccttttttggggggtgaccaacatactcagtggatcttggacctaccaccaagtgaccttccttgctcacctgtaaggctgagaacaccgtaagcaaagtaccaggcttctttccccaaaagggctttgtaagcgttggcgccataaaatcaacctgaggacttaggtggctggttatttctgagtaagtgaatatcactctcaaatacgacattccagcaaaggccatggttgcatagccactgtttttagttatgtcctggtaactaggaagatggattgttttttaatctatgcaaataattatattgcgctgaaaaaaatgatactcaattacagtttcacaattctggagggatcaggcagggataataagataccatttccagatgtttcctttctgtttataaaagcacagtcgactgaattgttaggagatacaggcagagggagaagagaaagggttccttatgtatccagaatatagagtgttaaaatagcaacaatactgtaaacaaaagccgcagtcctccttcagtagttcatctgggcctagtcattaatttttgttccacttga

SEQ ID NO: 128672 - DNA, 1068 bp, Homo sapiens
tagatgccaaggctatatgaaactgtcagtattcactacagtggcatttccacagtacaatacagacatacaaacagacatagataatttgtaagctgtaattctaaaatttcaggccaggcgcggtggctcacctctgtaatcccagcactttgggaggccgaggtgggtggatcacctgaggtcaggagttggagaccagcctggccaacatggtggaaccctgtctctactagaaatacaaaaattagctcggtatggtagtgggcgcctgtgatcccagctagttgggaggctgaggcatgagaattgcttgaacccgggagatggaggttgcagtgagccgagattgcaccattgcactccagtctgggcaacaagagcaaaactccatctcaaaaaaaaaaaaaaaagaagaagaaaaaaattcagtcatagaccaaacttaaaagcagaaatataaaattttactcagatgtgtacttcctgatggcatgaaattcttaattgttttgaaaccaaagtagaaaagcagacaaacgaaaaatactagcaaatcagattctgttatctttcacccaacagagacaagatctctataaaccagcagtccttccccaaatacgtagtatacaaaccgcttcatgtctgtcattttcgtcaaccctggggtccttcaaatgccttttgttccttctcatttacttcaccttgacttttcaagacatattggttatactacacagttggttacatttgaagtatttcatgtaaattacaaaagtatatgaataatgtgaattcatttttgtttatatatgtatatgcatgcatacacatacacacacactcctatagagtgaacatttggctgaatatactgccaaattgttaaacaatagtcatttctagctggtggaattacaggaaaatttgtgtttctgattatatatttctatagcatttaaattttttgcaagtcagcgtgcatttcttagataagcaaaaaaaaaattaaacattttatttaaatttttttcaattccagttgatagcagatgtcaatag

SEQ ID NO: 128673 - DNA, 1072 bp, Homo sapiens
cattggaacatttcagtgaaaaatatgctgcagagagggcacctttagaacattttcagtagtgggatccttttcctgcctggggcttagaaataaaagcactgatcatcaaacaccatacattatatagtgaaaaagggggtcactcaaaatttttgtaaatatattatgaaatatattgaacattctaaatagtctaatacagaagcgaatattgaatatatgtgtaatattttttaaagtctttgtatttttccaaaataaaagaaaaattactagttaactgcttattttctcattcaagatttaaaaataaaacttttcatttaggccgtcttcttgtcttactctttttttctccacatggacttcttgtgatacttaagaataagacctggacattctgattttatgtggattagctgagccttgcagagacacttgttacttactggcacatccagcaagcagctgccagcctcaggatggagttctagggagtgtgtagtttagagctttttactttttgtttttgtttttgttttcttttatcatttttgcctttatttctttccaagtttaattatttttcttgactcaagcacacattctcgggttgaagtagtgatgaggcccagatcttgactcacacatcttttctaccctaaggatctcttaagaatttaaaagcatgatataattcagccctttcattttacagataaagaaacaggttttgagatggacatacctaagatcactagagataaaactaagaaggctgggtgtgttggttcacggctataatcccagcactttgagggtcccaggtggacatattgtttgagcctaggagttcaagaccagcctgggcaacatagcaaaaccttgtgtctacaaaaaaatgcaaaagttagccagacttggtggtgaattgcctatagtcccaactacttgggaggataaggcaggaggatcacttgagccctggagatcaaggatgcagtgagccatgattgtaccactgcactccagcctgggcaacagagtgagaccctgtctcaaaacaata

SEQ ID NO: 128674 - DNA, 1057 bp, Homo sapiens
gcgctactgttttcaggaaagagaataatttatgtttttcctccttcatgactgaattgtctggcagatacatggaaatagaaaaccatgccaggagttgccgagcttcctatttatgggagacaggaagtaacacaacagaaaaataaagaaattaatttgaccaaagtgtccctttagactcacattgttttgttatgtgttgttcaagcatagcacaatttgaacctttaaatactctttatcccactctcacttaatttgatgattcctgcactttcctgtgacttgtctaaaattctactttccctcgaaacccttttgtggatgctaacatacaagcagagtgtcctgtgattcagtcttccctttttccagctaccactccgtgtcactctgtccagcacagtgaggaataactcagcctgtattcagattttaatattttgattctgaacagcttatgaaaaggatctgataatagagatttaaagctaattcacttataaatacaagtgtagggcttaaaagctaaatcagctttacaacaaaatgtcaaggccgctaactatcaacagataatctagtgttttcttaatcaaaaatgatttcatgatgactattttcttgagataatgtgatccacattgaacttagtaagcagtgagtcagatgagatatgtttttatcagtggtgagcatagaatcaatgaactgttagaataacacactcagttcattccgttcacgcctctcattttacattaaagaaatgctgagccgctctcctaaaattataactcatgggagaaccagaactggaatctcagcttttcactggtgttagttcatcaccctgcattcctaagtctgttcaaaagggatcatcttgaaaaaccattctctttttaactttcagttggcagattaacttcataactcatgttaggaagaatcttcagggacattgtacttggtgtgtcacactgacactgagtttctgagggtgcccttcaggtctctctggcagacatttattgctcgcacttgcaagctg

SEQ ID NO: 128675 - DNA, 1192 bp, Homo sapiens
gtccatgcctgtgtcctgaatattattgccaaggttttctatgctatagaaatagcatatttctatgctattcatcattaataacaattatttaataatattaatattaaatagttaatattaaatttttagaatattaaaatttaaaatttttttaaaaataaatattttatattaaattatcaaataaatattaataataattatttaatattataaaattaataatctttcattattgaattattgattgagttaagtaattaattgattaactgataaggattattgttaaattattgtactcttgggtagtacagagactgcatactgcgctttgccatgtaaatactattgtctacttcctggtacgtggctctagggaggctatggcagagtcaagtgcttttgcccttaatgtgaacaaaaaatagtgattgctcttagtagccataatatttggtttattgtctgtgttggtaataatttctgctgtgttttcatacagtgaagtgatgtttctgctgtttattttagttgcattggaatttgttatatttatttctttgttttccttttgataagagaagtacgcacttagttatttataaagatgtttggacttcacatgtgagtacagtggtgacatgctgggttttcctggtcattgcttagctgtatttataaagtgaatattactgagcagttaagccttaacatcgagaatcacccattttcatttttgaaaactggaaaggattaggtagaatgcaaggagaataaattgaacttaaatgtttgtgttcaattgaggtgagctttttcataagaatattcaagcctaggtcaacatgcagcttgttttccctctcaccacctggaattcagtctctatcggtcaatgtcttctaaaagggaaatgggttcttaactatatacttttagtactttattgcttatcttccctttcttggttgaataggctgtgttagatatttagcttcctgcccctttctttatgagacagctagagcagtgcttttcaaaaccttactaatgtgtggatcacctgggggatcttactgaagtgcagatcctggttcagtgggtctgggtctgctcaggcttgaggtgaggtccacgctgctagtcctgtgacccagcattaggtccccaggatacaaaatatgac

SEQ ID NO: 128676 - DNA, 1038 bp, Homo sapiens
tatgaatgataatattaaaatgtaaaaaacactattttcattatgtaatgtgtcacctacaagatgctgaattcctgttgcagcggatgctgaattcactctgcccttcttataagaaatatgttgggccaaccttttgtttttaagtttgcttacagccttacctgtgctctttcaaagtagattttcactattttgaacactctattaaggtaaagatgtgttcggccaatgaaactactagagcaaaatgtttacactgtatttctgatttgattgttttaatacaactgaattagtgttttctcctatctctatgcaatattaattcctgggatgtctgtgtaaattaattaatttactgaccagaactctactttagcttcttatggttttgttttcttaacatttagaaacggctaaatttagaggacataaattttctccatgagattgtttaaattcagttgactttttaatgtggattatatttgaacttgaatgccgcacgcatttttaaggctggttcatggcttctgtcactggtacgttgtatttctcactgtactattcttttacgttgcctcttgtctgaaatgaacttgattttaaccttttattttctggtctaattatatgagcttgtggggagcctcacatattgttagtatatctccttaaataacatgcattgaggctgaggtcagcagatcacttcaggccagaagttcgagaccagcctggccaacacggtgaaacccgatctctactacaaatacaaaaaaaattagccaggtgtggtggtgggcgcctgtggtcccagctactcaagaggctgaggcaggagaattgcttgaacctgggaggtggaggttgcagtgagctgagattgcaccactgcactccagcctggatgacagagtgagagtttgtctcaaaaaataaataaattaaataaataaataaataaataaataaataaataaaataaacatgaattgtataatccagctttgttattttagctctaaacttctg

SEQ ID NO: 128677 - DNA, 1150 bp, Homo sapiens
gatggtaaatgcagtttgctgttctcaagaaattattataaacataagggtggacttaagtttttatccagtcaagcacaattatgcccataattaaaaagacattcacagaacttaacaccttttatcaatttattcgcgagaacaaatgtgagaacgtgagaccattgtgcaaaaagtagtgaggaatgcagtccaaagaaaatttgacgattaacatcctcagaactgagaaaaacaaaaatgaaaaaagactgaattcttgggcaggtagtcttatatcttgcttaatgtttttactgttaatagaaatagaactgataggtataaagattatggcttgctggtgctgtgataacagtatttatatttttatggctttcctaaattccacttcaactttcaaatgcttcattgaaaagttctgggttctaattttttttaagattaagtaataattaagtggataatttaaagtttgcttggatacaggattgtgcagaagttgcctttcatgttcaaaaatgttaatttgtttgtcacagtttattcattcaaaagattaatagctgaaagataaatggtgatttttatctgccactggtgttgttatttagctgtttgagtaggccatatgactaaaacataacaaggagttgaactgtgctccctgatcactgtagttatctaggttgttgggttgttttgttttcatttttaagattactgtttgatttcctttcagctttataaacattttcttaaggagagacaaaagctcctctcagcaaaactgtttgtttgaaataccgtgtaaggaattgaagtgtaaagtaaaaacacaaattccccccattctcgctcataagagattatatatgatgcacaatgacataatgagatttgtccttgaattttttatcacctgcctacaaagagaattgatataaattgtgttgttgccagtttttcctgcattagcgtttccctacctaagtatccatcactcttgtcattgagatatcctagaaacttgttgttgtctttcgaggctgtgaaattttcttattttcagttgtttttcaacttgatacaaggccatgataccgttgttgaattcataaaaccttcttaaatataaagtagatac

SEQ ID NO: 128678 - DNA, 1050 bp, Homo sapiens
gttccaagatgatctgtattgtataacataagtgttctgttttccagttatttactgataaacttgcacataacattcttggttgtgacagcagcgtctgtaaactgtcagtctgattctcagcctcgggttcatctttgcataggtgttctgtctaatcacaattatggatgtttagggtcttgctttggtccgttaagtgatgcaagtttaagtgataaagtttacaggctctaatctggagcatgtgggtcccgtcagcaccgagcacacgccctctgtggtggaagaggacacagtgcgcagccgtgactttcagtgcactgggcttaagtctttgaaaatagttcgagacagttcctcaggtggactgggatgtttagaaatctgctggtcggatcatcatggttgtggccttgagcgaatagcctgagcctttccagtagtaccatttaatgccgttgaacttatttgtgttctgcctctgtggatagtacattccgttcaagttggaaggaccacatgcatcaaaccaccagcctgtgaaagtaaaacacagaaggaattaggaactaggtgatgccagctcccaccacgaagacagcaatactcagctaaggcaggaggcacactgcaggcgtgtggagtaggcacatgcagatgatggtgagtataggatgtgcactggcagagggattgttttccagccatacacccatgacatcacagttccattacggcaaatgcttttacaagccttcttccaccttttcccttgtgctgtgtggagaggcctgaattctccacagtcctatttggtaagcccacagtgtgtacacacttacagcaggagtaagcaaacatctgaggcacagttggaaaactctccttcaaccaggattactttgcagtcccagcaacatggtgggctggactcgctcaggctccccttgctctattaaatgattttttcggttgaagtttaaactaaaatattaagtactcagtggagctacataaaaaggaagtctctatgtttcagagacaaaa

SEQ ID NO: 128679 - DNA, 1005 bp, Homo sapiens
ttgtggacatcgttacaaatcacaatttgtagtccaaattgccagcctttccctctatgaaatcattccttgccaatacaaataggaagacagaaagtcatccctacctcctgttagcatttgtgaacatttgcaaatacatttgtcgttgtctccatcctttgtgctaaaatcatttcctggttggctgatgctgcttattttgccggctgtccctgtaagtcctttaaggtgaatcctgtaagcgtgcaaagaaaaaaaacacattggctagggtcattgatttaccgtagtggcaaattttttgtgatgaagaattccattctacagaagcgtgttctgtactcgttaatggactaatgcatactctggacaaaatattttgcactggtataaacaggaaccaacttatcatcaaatccttcagcaaagagggatgttttcatgaaaccttcaacacatatcacttgcacaactatcagaagcgactgtagagccctgtaatttattttcctgctgctttcagataaacagaagagaaagaaatgcagcaccaggctcctcctcccaggtctccagtcatcttccatagagacggagtcctgagacaactggacaacctcaaacattattttccgcagggggccccgggggggatggagaatgcagcagacaaggaatggccactgagtttggggaagaaatctacagaacggtgctgaaaataaatccttgtggctacatttcctcatgtctgtatagtagggtaatgtaattaaacttttagacattgagaaaggaacaaatgtcggagtaagttagacactatttacaatacagacgatccctgacttcccatggggctatgttctgataagcccattttctgttgaaaatgttgtatattgaaaatgcatggaatacacctgacctttggagcatcatagcttagctctagccttccttaaatgtgctcggaacactcacattagcccacagtcagac

SEQ ID NO: 128680 - DNA, 2764 bp, Homo sapiens
cctgagtgcaggactcagccgagagggttctctgggatataaggcacggagtagaccatcggggttgtctaagaaacagatggtttcaaataaattgaaagtgatggattaaaatgatggtgaaacataaacagtaatataatataaagtgttgatgagaatatgactcacttgtcatcatctgttccaggctaaagaccccaccctgatggctggtccagagattgctgtttttttagagattcattatgaatggcacattttggcagattggccccgaaccccacatctccatcctgtagaaaaccattgacttgtgttcacagccttgaaacctttcactaaatgccagcccctgcccctccacagagagctatgtgaaggggatactctttgatcatagggtttggaggactcctgttacattctcgtactgtggggctgtttggcttcctttatgtgcaatactaatcagattttttggttcacatctgagcacaagggccttgaggctccagtgtcctggtgcaaggtgtgtgacctgggcttggcttagcaccttggcctcaagggcatgacttcacgcttctctgtacatagctcactgcccacagtttttctctaagcaactctttttatttctgctcttaaactggctctgtgggtttaaactttgtccagaacacagaattctttcttaagctaagcgcatgcatgctcaatttcaactcagctggagttttattatgaaattaaaaacccctgaaaataagattacataaatagttttaaataataaagattacagtagaacgaaacatgttttccagaaagtaagataaattttctgccacatacaaggtaggaaatattgaagttaaggttcaaaaccaattgtaaatattcttcttgtgttgtgtcccatggtctttttgagaataatggaggcgatttggcagggtaagcttcaacgcacactgttctctgtttacgagttagaatcctaaagaggagagcgaaaagagaaccaagagagtgctattcctgttctttcatttcctacatgaggaaagaggggtgcagaggaagtgcagtggctgcctgatgcctcattgccagtgcaaccagagaactgtccctggaacagcctggtctgcaggggacttctccccagcatggttctggtctctctccaggaaggtcacccagctcgtattgccttccccagtggcactcatgtttggaaacataggtgccattaatgaaagttacatttattaagaagaaaattatttcctcattttaaattaatctgatgtagaaaatcagtctgcacaagctaaccccttgttaccgctctgtattgctatgatttttattatcattgctacacaccactctcatccaagtactctgccagatactttgtgtatattatctataatctcacagcaactctgctgtagtatcataattctgcatttttgaaaggagaaaagatttagcaaagttcgattttgatcagttactcaccttctaagtgatatataggatttgaataaggtctctttgattcctgttatgttttttttccactgacatcatgctgccaaaaacagagaaacctgaccctttggtaaataggccaaaagtccctcaacacagttccaagtttaaatcagttcatgaataatactgcctcttatttgcctgcagtcaacaaaatggtcagtgctgctcacttctatcaatatttctttttaaaaatctatttcataaaccagctgaataagctactttggtttgaggattcatgtacatatattgaagttaattctgtatcctaaatggtatgctcttgggttgaaagcattgacgtggctcttggtgagcctatccttgttccaagaatgtttgattcttcagtgtcaaaattactgctatgaagttaccagtacttaaatacatgttctatcttgttcagagaacaagtttatcttgttatggaagtcagaggcaaaactcttaaatgtctgagagtcactgccagcacataaatgatttgagccatatgagtattcgctttgattccattagtgatgatgataaggttattagaacattttcttagtacttcatccaggtttttagaaaaaagaacagaggatttgtaaaaactggagtattatggttaattggactataaaacttgcagagaaagatagtgttcaaatagagttatctacccagccagaagatactgagtaaaagtgctgaaattgattatatcaggatcagcaaagcagaagtcctcagatacttcccaagaccttaccactccaattacaacaaacctaagggcagttaatatctttaatctgtccactggtgcatggtgcaggaacctgatatctttctataaagcttgatgtttttcagcaaataatacttgacttgcttcaactctgaggcaatgattaagtgacgggttaaatagcaaaccatagagacaaccgttaggagtcaggtgtcctgtgaaatttagggaaggaaatgaccatacatgcttttgataaatgccatcttgcagtctctctctcgtagaagaaccaaatgaatttttcaaaactaaagctgcagtattttggcctttcaggaaaagatgtgctcaaagaccaattgaacattcttttcttgaattagataaatgagtgcagaatcgggtctcctgccaggcagagaagttgtctggtagtctttgaag

SEQ ID NO: 128681 - DNA, 2113 bp, Homo sapiens
ttatctgtatcatgaccccattgcctgccccttcaggccattatcccactgaggacatagtggggtgcagtgacacatctcagcttaccgcatcctcctcctcccaggtttaagtgattctcctacctcagcctcccaagcagctgggatttcaggtgcccaccaccaagcccagctaatttttgtatttttagtagagacaggatttcaccatgttggccacgctggtctccaactcctgtcctcaagtgatctgcctgcctcagcctcccaaagtgctgcaattagaggcgtgatccaccacacctggcccttccctccaatatataagagacgctgcaaagtgaaacaataataaggaaggcaaaatgtgcttaagaacctggcaagataagggaactagcatctcttaagtgccattgtattatctcatttaatcttaatggccatcccatgggtctgatattatttttcccatgtaaaacctaaataaatgaatatcggctgtggtttagtaatttgcccagtctcatccttctaattaatgatggaactaactaaaagtaggctctttactgccatgaatcaaaagtatgcttggggtgtttgcttcataataattagtataacatatatttccccttctcttcttccttcattttaattggtagatatttcatatgaaatatatgagaaatagcgccttttctgaaaggtgagaattttttagtcttttgagtgttttactgactaaaggttattaacgctgaagaaagcatgatatgtaaacttacagtttgatgtggacatcatagtcagtaagttattaactgtctccatgagatcatgttgctgcttctgaagaactgaattattcaccgtggcagtcactatttttttttctagttcttcaatgatggaattttgcttggatactaacacctgtagctgatctttctcttcttttattgactgtagttggatgatgtgcttgtcttccatagctagcaccttcttttctaggaaacttgtaaggaaaagaattgttagttagtgaaggctattctaatgaaatattttatatttattgaatttctacttctccaaggtactctgttaagatattgtagtggttataaagtaatatgatgttaccagagccctaaggaatctctgaaacttgctgagaagattagatatataaatgtgtgtatatatgtaaacgtataagcatatatgtatgtacatgcagacttatgcatacacacaagaaaaggtaccccatctggtccaggataggtgggatatgggtgttttttgtattagatgctgcagcgctcagaagaaaggtgctgctctttcaagcttagtgctcatgaagtgcttttttgagaagggagagtttcaactgggctggacccttgggtaggatattagctttctcctaaactatttatattttaatattaatcctaatgataataatagcacttaatgctatgtgagaaatactccttcatggggaggtgaatacttctcccagactcaagtactggcttaccagccctgcgacttggaacagtttacttagtcaccctatgcgttaatgtcctcacctgttaattaggatactatcacctaggtcatggggttggtgtgaggaacaaatgggttttaaaatgtaaatgctggccgggcgcagtggctcacgcttgtaatcccagcactttgggaggccgaggcgggcggatcacgaggtcgggagattgagagtatcctggctaacacggtgaaaccccgtctccactaaaaatacaaaaaattctccaggcgtggtggcgggcgcctgtagtcacagctactctggaggctgaggcaggagaatggcgtgatctcgggaggcggagcttgcagtgagctgagatcatgccactgcactccagcctgggcgacagagcgagactccgtctcaaaaaaaaagaaaaaaaaatgtaaacgcttagactagcgcctgtcatacattaacagtcaatgaatgtttgttaacgttaatatagacattattattcccatttccaatgaggaaattgaaacttagggacattgagggcca

SEQ ID NO: 128682 - DNA, 1198 bp, Homo sapiens
tcgggccccttttagttcgaatgatctggtaaatccacctttttttgacagtaacattttctgactctttaaccctgcaaacaatattaaccagccaaggaactggctacccattacatatctcgcccataagcaataacaatcagtattaataataattattagatattcaattgtagctcttaaatgtattccagccccctgatcgttgtaaattagtatgtaattttggagagatgggggtctgtctttgttgcccaggttggtatcaaactcctaggttcaagcgatccacctgcctcagccatccaaataggagggattacaggtgtgtgccaccacatctggctaatttttgtattttttgtaaaaatgagttctcattatattgccctggctagtctcaaactcctggcctcaagaaatcctatcactctggcctcccaaagtgctgggattataggcatgagccactgtgcctggcttgaatctattctataaagaaagcaattgcacttttggggaattataaaagattatttaaaatgtggtttgtccaatgtgaaacaccatttgcatatttttgtaatgatatacttgcaaataaaatcataggccagtcagaattaaggtagaaaacacagcatgcagaactcatacacctgtaaaatcatcaacactattttctttttttattatttatagctgttgatgaaaaaaacctttttatttcctttcatatctgtgacaaaaaaatacgatttctacagctgatgagaaaaagcttattcttcctacaggcatagttgaaagccaatatgattggaaaaatatttgcaaagatgatatttggggaacataattgacccaaattggtagttttagcattgtagcatgctaaatttgaaacccaagtggggaaacagtattcagtattagggtatgttctacaaactggacatatcctaggtttgtcacggacatcattgtataacaggcaagagaaaagtaatctccagctcccatgtgttccaggaatcactgcagcattttgaagagaacattactaagtaagactattttaagaaaacgacgccaggtacggtggctcatgcctgtaatcccagcactttaggatgctgcggtgggcagaaggcttaaattcaggagtttgagaccagcctgggcaatatggcaa

SEQ ID NO: 128683 - DNA, 1055 bp, Homo sapiens
atgcctgggccagtggttctttcactccacagcactagctgtatttttataatagattagcatgtagaatactgaggcagggtttggaggattactctaagaggatcttttgggccagtggttctttcactccacagcactagctgtatttttataatagattagcatgcagaatactgaggcagggtttggaggattactctaagaggatctttaaggggccagggaatgaaaggtaaaatccaggactgtgttaggagagctgtgcctgtgcaggaattttctccaagccctctcccttctcctccctcatgaggtttctgacccttacactagacatgaagaaactcaccattctgataattcatcatttgagaccgactttcatatctggaaagtgtgcagtcctgaattataaatgttttagtactgttattacctgttcttatcttgcaatttgtttatttcactggtctggtccaaaatctgtttttccaatttgtttgtcgagagggagtgttccaagagctgaagttcaagtctcgtggtctgatttaatacctaaatgtaacaaaatgaagttcctattaattattttttaattagtttaactttctaacttccttttcattaaagtacccaagctacaggaaaacataacaaaaacattatttattaacccaagtatcttattttggcatatttttcattttcagaaaaggctcaatgtcttagatcacatctgagtgtgttaaacctttttactcttttccccacgtctctattttttttttttttgagatggaatctcgctccattgcccggggtggagtgcagtggcatgatctcggctcactgcaacctccgcctcccgggttcaagcaattcttctgcctcattctccccagtagctgggattacaggtgcgtaccaccatacccagctaattttttatatttttggtacagatggggtttcaccatgttggccaggctggtctggaactcctgacctcaagggattcacctgcctcggcctcccatagtgctgggatt

SEQ ID NO: 128684 - DNA, 2808 bp, Homo sapiens
acaaaatgctattctcatatttatttgtcactagacagagagattggaagtcacatgcttccattatataaaaatatagataatttttagcctgggatttcctcatttgtcaccacttgtttagacttttatttcttcttgccatttctccttcctgttttaaaacttgtttgaaccaatcgaagccgtatagcgtgagtgtgaagcggagcctcagccttgccgtgcgggcctttgtgagctactgcgtggcatgagcagtgcggctctcccgcggattctctagcgcctggttgcccttcagcaggaagaatcgactactcacttcctccatgtcatgcttattcaggatgtgatatcacatgcaaatgtcagtcagcattgttgccaaggaaccggagaccttgaaagaatcattgtttgctggtgtctttatgtcatttgcaggagccttggctggtccacagcgtgggtttcagggatggtcttatccttagagctggtttagttcttatcacaaaaagtcttctgtgagaataaagtccttggccaacgtaaggttttgtttgggttttaatattaacacctggaatatacatttggcctacgtcttctttgagtccaaacattctatgttggttatttctaaaaggaactggaaaattgtgtcctgtttaattcataagggttataacatgagtaaaattccgtgtggaggcagggaaggatggcatataagtcatgattggcccagtagtaattgtaaccattttcacatcacttttctggagagcatcaaaccgctggaccagcctgaaggcgtccatctgcaggggactgtaaattacccaggccaggtattgatctctcattccctttaagatatgagacctccagccacccattgttgctcaatttgatcgtctctcattctgacaggcttggagaatcttgcttctaatcagaaattttcagatttgaatttaagtctgtttcacaaaatcagtaactgctcagcaagtaccttcaaacagagtgggtacataattcagtttctttgcggccttccttaagctcagccatttttcttttttttttttttttgagacagagtctcactctgttgcccaggctgcagtgcggtggcaccatatctgttcactacagactctgcctcccaggcttaagcacttcttgtaacctcactaagcctcccaagtaactgggtctataagtgcacacaagcacgcctggctaatttttttttttttttttttttggtagagatggggtttcaccatgttgctcaagctggtctcggactcctgatctcaagcgatccacccacctcggcctctcaaagtgctaggattatagatctgagcaagcgtgctcagctggctcagccattttcatgtgtttaattgggcttcacatggaaaaactgcttactttccatctgttttcttattttcctgttatcctggataacatgatatctagtttcacaataggcgttttttttttaaatcatatgacgcaacacaagtacatcaaatgctatgaagtctctgaccgctataggatgtagcaaggtttgcattgctgctctgtcctaacactttttcattactattattattttttatttttttaaatttttgccaagttcccatgcttggatctaactattattttaaaatataagaaatgttgtagtttaaaaatgcttatgagacattttttggatgagctattcaattacccatcagtgttagtatcaaaaggtggggcatgtgacttaatcattactaatttattttaataggttggtgcaattttgccattgaaagtaatggtggccaggtacggtggctcacgcctgtgatcccagcagtttgggaggccaaggcaggtggatcacctgaggtcaggagttcgagaccagcctggccaacgtggtgaaaccctgtctctactaaaaatacagaaatttagccaggtgtggtagcctgcacctgtaatcccagctacgcgggaggctaaggcacgagaatcgcttgaacccgggaggtggaggttgcagcaagtcgagatcacaccactgcactccaacctgggcaatgcagtgagactctgtctcaaaaaaaaaaaaaaaaaaaaaaagtaatggcaaaatctgcagttacttttggtccaacctaataattcgctttagatatatattgatatattgacttttaaatctttagtttttatgacttcctaagatttaaatttttagtaccttatgatccgttatgtaaaatatttatgtatgtttttcttgaactgttgtgatattgtggaaagacctggtagtcaagtaatttgttattctattctcttatctgtaagtcttttgttaatctatcatttcactactgttttctctgacctcatccaaccatttttaggaagacaatgaaagaacagctgtgtccttctagaatgagtcttacgagagtggcagggcttatggcatctcccctctcatgtcctctcctggctgacgtctagcatttcttgatcctttttgctgaagtagcatttaggaataatatggagtggggattgtttcacttaaatctgctctttttttaaaagtattccttatagcccagagtaggaagccactgacttcagaagcatgtaaagaagccaggatgaggagtcagaaagcgggcttggccgccgagagtcacgaccacggccttgagcttggagcgtctgcatttgtactgctaatagcagcttttccctttccca

SEQ ID NO: 128685 - DNA, 1091 bp, Homo sapiens
cagagtttctagctctttgcctcagtgcttttcatttctcaaatgttcaaagactttaggacttagaaatggaaaatgattcccggagtccagaaagcaccagggagacagagggggtattcatcttgcagtggttgggatgcgtggcatgaaaatgactcacatgtcttcagtagatagaacacatgaaatttaacctcagtattaaaaacaaaaacagatttactgatttttaattcataagcagccatacatccttaatttcttatcaattcattccttttctcctgtggtggtgctttctttagtttctcatgccttcattgaggaagctcctgacgcgactgagtgctagtctctagctgcagggacaccgtgtgctttatgtggcattacttacttgggcttccacatcagttaacttccgcgtttgctccgctgtttggttcaacaggtttgtccctatttctatcatcacagccgtctggttctgtactgcattctgctgtatctctaccatttctttcttcatgttgtcctggatataattctcaagctagaaaagaacagtgttagaaggcagtcattagtcaaatgaccggaaacctgattcctaaatgtttgtcgtctcctccctatctttaaaaaaaaaaaaaaaaaatctatcaaaagacttgtaccttgccttccttttggaatcttactatttttttttatcattaggaaaatacagtgtgattttatttttatgcaaaatctggcaacttagtcacatcatgtaaaggagggagacaagctactggttgcttctgtgttcttctagaagtccatgtcatggcaggccacagagggtggtgagggcagccacagggactgctgggtgcggccactgtggggttgtgtctgtcctacccagctgcaactctgaccatgcagtcaggaaatgataatttgacacaaagaagcatcactatttctctcacattctagacttttggtttctccacatagacttgagaagacactctaagacagcatataaggagaggagcacccttttgattttccttttaacctacggaatcaccact

SEQ ID NO: 128686 - DNA, 2273 bp, Homo sapiens
aaaaaaagaaaaaaattaaaattaaaagtaaaaatacttatgttcttactcttgaagtcattaaattaaggttttaagagaaatatatgatgtgacagtcaggtactctttaaaaacaaggaagaatactgtatatttagccccagaaacactagcgacaggaacagccacagtaatggtaggtactgtttcttggttgccggcactgcctgtgctgtatgggaatcgctgtgtcgggatcccaggcgcctcacatcagcacaggtggatgcagggctgagcactggaatgaccctcagcaaaatgttagctcaacccagaggccgcttcatacttttccagccttttaagagccaaagtgatatatctcaaaattggcttgagtatgccttccaattccaggcttcacaatgccttaagaaaacagacagaccacccacccctcagtggagggccatttttaccaccagaaaagcccagaattaaagatgaccaatgccaattctatcttctgggagcatcctgacaaaagaatctgtgttttcttccaaagattagtagtaatttttagaggtacagaaagactatggatgtccatcatatagtataaaaatgaacatttccaaataaagatgtcccatttaatgtagcctttccataaatcaccacgtatcaaggataatgagaacaaacctagaaacaaagccatctggctcatccacttggatagacagaccttgaaatttccctgtctcttgaccttgatgaattagttattttctagtttattgtcctagaatgtctttctgtttagtgtctctcttatttttactggctgtgactgaaacccagaaatatagaaacctgcccagaaatatgaaattccattctaagtataaggaagtcttagtacaagaaaaaaaaaaaaaaaaaaccaacccagtaaataagccatcctccactggcagcaccaaactccacttgcctttggagaatgtttcccatccctgtcatctgcaccgaactgctctcatcaaaacagttccaagatacttgaacctcccgtgggaggggacccggctctttccaatttcacatgcatagcatgtgaaacatattcatgtttcgcaggaatgtttgccatcgccttcatatctgaagaggattattccatgagcgtgatctgtaggcacacgtgtctgaataggtcctgctgtatatgtgtgcgaggacagtgtgtgtttattttgtcctcttcttgatggttgacacagtcggcaaagtgtggggccttgggctgttcttcctttctcagaactcaagtgagttatgcaagtttaacattgagggccacagtgatccttctagctgcatggtttgctgcttagtgttatttgatttgctaaaagagttgcgccccagacatagtctttaaaacttggcagcgcatcgaaactcaagcaaccaggatgaaatattttaatgcaacatatatatatatatatgtttacattaatatatatatattttagtgcaaaatatgttctgaagttttttattactcccacaacgttttgaatgatcaaatttgacaggaaaaataggtccatttgtgaggcaactatggcagattgattacacatttaaaagtttatctggctatcttccttctcaccaagattgtcatcattattttttataccaaaagaaaagtaatcttgaaactggctcagtaaaggaaaacatagataatatatgaaaactatccccaacttggagattctgatgttgatttctcaccaactgtagatgctggttgagagatcctttctatttaaataaaattcaaggtccttagacctttttactaattagtttttgtccatctgagtgacctaaggtggacaaaaactaattaatcagagggtctaaagaccttgaattttctggtaaattaacaaataatttgagatttccttggaaactttttactgttgcccatttcaatttcgaaataggattttgcaaccatctctcacacacacatacacgtttttctatcccaatgatccatccatcttcccacccagcccttccatttttctagtaaacccttgaatttttctagtaaattcacaaataatttgagatttccttggaaacattttactgttgcccacttctatttagaaataagatattgcaaccatctgtcttacacacacacatacacgttttctaccccccatgatcccatcttcccgcccagggtc

SEQ ID NO: 128687 - DNA, 1059 bp, Homo sapiens
gcaaaagctaaaggccgagggagggaagcctggcctctggtgccaatttcctagtgggtattgtgacttctcttagggagcacacttgccttcacctgccctgaccacatggacgcctgcccacatagggtcttttaagcacttcctgaaatggatctgttctgatctagcctttttgcttttttctagtcatacttttttattgtcttttttttgagatggagtctcgctctgtctctcaggctggagtgcagcggcgtgatcttggctcactgcaacctctgcctccctggttcaaacgattctcccgcctcagcttcccaagtagctggggttacaggcgcacaccaccatgcctgggaaatttttgtatttttaatagagatggggcttcgccatgttggtcaggctggtctgaaactcctgacatcaggccatctgcctgccttggcctcccaaagtgctaggattacaggtgtgagccactgtgcctggccatttaataatttatgagtgactatctgatactgtatctagataaccaacccctttcctactttcgctagtataagagactgaaagttcacttttggccactatataactccaagatgtattaggaaataagtttgtgggcctcagctggtggcattctaacattaatagtccatgcctctcctcctgtggataggtacaccctacagtaatttgagtgtaccagaatgtctgtgctctggcaaatcctatccgctttgctcttctttgagtgcagctgcatattctttgcattaatttttttcacatatatttgaatatatgtttttccacatatattcatatcattttacctctttgtgtgtttcccttaccactactccaaaatttgataaggaaatgtgcttttcccttcaaaatgttccatttattttctactgataaagtggctatttctcatcaatagcaggcattttaaatatatgtaagtttaaggagactgctgtagtaacctcatgtaaatttctttgggcatttcatatgcaaaaggtgtcacattttaca

SEQ ID NO: 128688 - DNA, 1064 bp, Homo sapiens
aggcaggggcgccgcagggtggttcgcacacgtggactcaggcggccaccgccgcgctggctggtaagaagccccacaggatctcccaaggagccctgggacagtgtctcagaacatccacctggggcaagaatggggactgctgtccccagggggcaggtggagcctagtgggcattcatgacccaggttttggagctgtgcttgcgagagtgccgaggaggctctcatgggtgtcccgaggcagcttggagccaacgtccctaggcatggcctgggggtttgtgggaaggcctgaggcaaggcctgtctctgagatgtcctgaagagcaagttgggcccagagggttaattccgagcagcacaagagggtgaattctgagcagcaccagagggtttccctgacacagcaggggatgctttgaggcccctttaatgaaggagaaaaatgaggcttagagaaagtcagtgcccaccccaagtctcatgggccccaggctgtgggcagtggctaaagacaggctagtgggtaactcggggccacgtggaaggggagcttgtatttatagcccccagtcagcagcgctggagaggagaggagaggaaaagcagtgctctgagaaagacaatatttctagtagattggggcagggcaggcctggagacaggaaaccaaagccagggttgtcatgcaggagtgagatgaggttgcagcagcagagcgaatgcggagacgctcggcaggtccttggtggcctctgagttattctgcagacttctgccattcgtctattttttgggatactttgttaaattctcagcttagaagatagtagtgatgttttccctacagagatagaagaaaatataaaactattttctttttaaaactgtactgaatgtagggccgggcatagtggctcactcctgtaatcccaatactttagggggccaaggtaggaggatcacttgaggtcagcagttcaagaccagcctaggcaacatggcgagactccatctctacagaaaatttttttaaaaattagctggacatggtggctcatg

SEQ ID NO: 128689 - DNA, 1884 bp, Homo sapiens
cttggtcacaatgactatcctaaatggctagaaaagggaaaaggctagcgaaacttagatgattttctaaatttagataattttctagaagacattttccaggcaaactagtttttgctgtcctttataaggccggcaggaagcgtgtgttgtttctgttttaaaaagggagaggagcggacttgggaatgctgatgggaatgcttgagaaatctcacagcagggctgtgcgtgccctgccgggtcccactgcctctggacagaaacccccgcaactccacccccagccaagactttctgcttctttatctcctctttctgctagcacccaaaaagttgaaagaattccaatggatagaatttttgagataatattggaagatgctcaaaatacacaggattaatttacacgaagactcagcgggaacacaagccatcttctgtacatgaagatgcactactgacccgccgtccgcaaatgtgtttgtacagttactttctcagtatgggtgatggctctccaacgaactgctcctcgtctcctgcctggacacccttctctctgtgctttcctgggttagagtaaatggatgcaaacacacatttccgtgctctgcagcaacttgagactcctgtgagcaaaacgcactgacgggcaatgtgcgtgggtcgtggggagcatccagctcccatctgcggaataaacccgcccaaaccatagggaaaagcgctgtcgtataaggccaggggattttcagaaaagaaatgtgttctttcctctttgatttttgtgttcataaagctgtaggtgcagctttttttaatgtaatgatttcataaccgctgaagttcgtgcttttctgaactatttaggaagataatctaccccttgtattggatgagatgatctgtcccttcgacctctggttcagttcccattctcccaagtatttaaagctgcgagttttttcatattttcatatttatttacataatttaaaccccctgtgtgcatggactttaaggagctgtacatctgcctgggctttgcagaagctgaaagggcgcaatctttttataactcacattagaaacacagattatttaacggggctatgttttgcaccttaatctttaaagttgcaatatattttaagcattttaaccttgttttagatctgatcagcagtagaatgttttcagataagaaacaatggagcaaaagcaaaacaatattcaatacctagatgatgtggcaagacagagaatagtataactttttgttttccaaacataacttttatcttcatctcttgatctgaaatttggtaggaagtgtaacaagtacgaatcaacatatttaccatttgccatttcaaatgttgatagtgaagctgggacctctgtttattatggaagaccatagaaaaccccataaacacgttctacttctgtctgtggccagcagtccagcaaaaatgttctaaaagcacatgcactgtgttccgtgatgattatagtttgactgtgctggaaagagagactgtgaactgcacatggtgattatgactttgggcaaatcactgaacttgtaattatgtcttccaagacctcctaacccaaaataagagagtattttactacaaaatatatgttacgtcaaactgttttttacaaaataccagctctagggatgtttccaagtcattttcggagagagtttgtcgaagtttttttcagggtgtgtcattcatgtattggagggggagagggttgagtaagaaccgacatgcacaacttggccatgaaatgaagcgcaagcacatattttatttctataggattcctcattctaaagtaatttttacagaaaatggcactcta

SEQ ID NO: 128690 - DNA, 1696 bp, Homo sapiens
ttcccaaactgtgtgccaaggcaccctgggtccttgcagcaaacaaattggagtaagggagacagtctgaatattcaagggcaacccagcagtgttcaatgactgtcagccactggaagaattcatagctcaaagcagttcaccgtttcaacagtatcagcttgtacctctgtaaagctaggtttttggtggttgctgtttgtgaaaagcaagtgctacaggaaaattagcatagagcgtaaaatgcaggtggcagtgtccaatttgattccaaagtttgagaagccaggtgtgcctaactggcaaatatattccattcatacgtcactggggttacttaagaaagaaaataaaggatctttttttaaaactcaatttatatgtatattggtattttcaaatagctactaaattgtcagaacataaatacttaaattatttggagctaaccgcttaatacaagcaactgttggcctagagataaatagagaaaaaatagtgaatcactaagggtcccatgagctgagaaagtttgagaacaactagcctagaagcttgcacttggtaggatataaactcaacgtaccctcttcctccccttcccccaatccaagtattgcctttaattgtaatctctatgatttgatatgtttatcggaaagcgagtaagtcaaaaagaactaataaattgtgtaagaccttcattaagatgtacccttccgtgttttcctaacttctgaaatcactaggaaaaacagccatgttccttgcaagctggctggttagtcctgtcttctttcaggtgaacagcatttataaccacggtgtacctcggaagaagcgttctcagagcaacatgcacgtgttccgtgtgtaccgtggttgccttcgggctaatgcgtttttggaagtgtagataggtgccagttttacaaaactcatgtggcctatttctgcttgtaatttatagtttgcctcctcaccatcctcacttgctctaaggtgaactagttttataccattagattatacagaaaagtcaaatttacttgcatgccacagcaattcgggaagtaaactttcagtgtgattctccaaatgcttgtggtaaaagtacagagacttgaatcattttcccataattagtttcagttctggaggtccgccccctctctttaaccctcttgccttgcatatgtgtctcttgcaatggaagctagtggaaatttcctctcccctttcactccactgccataagttataaaaagcatgccattcagaactgacgttttcttctgcatgcttgaatttttactcaacaactggaaggggaagaagttatttccagagatgtttctctgtttatcaaaggggcgcagagtcacagtagcactttggaccaccgtagaatggctgactcacttgcctcatcagtagaggggcacatgttcctatcaaacagtgagtgcctttgagtgacggtgtgtgacacacagcacagcagcaccatttctcagagctgcagcaacactggttcacacaagtcactagagattcccatctccactgactcactcggtgggaacaaaagctcccatgccggtgggaatgcggggccaggggagcaccggaagaagggagccgtggcagaggttttcctattgttaggtttgtttgtttgtttcagtgagtcatc

SEQ ID NO: 128691 - DNA, 1039 bp, Homo sapiens
tagttcctgccttcttctgccatagaaacaacatgcagaagcagcattgcttacgactcacactgaacctgaagggatgaaattacatatgacgatggaatgtggccatattcacgcagtcacagcagtgtgttgcccaatgacagtactggagcagtttccacagaggcactcatgcaatatgcagaatacagacattttacacacacacttacgatggtccttttcattgtcgaaaaggaattcattatctttcgagtaaacatgtgctttgaggtatataactctgaggtatagaagttagaacatttaacccgattagggtgactggaattataacctttaactaatgtgagatatagtatagatcttgataagtgtctttctggtgttcctattaaaattcattataattaccgttcctgcaattgtgtagcatcttacagtttccaacaccctgtgctagccatcatcttatttgaaacacataataaccctacaagttcactgatgtaggtaagaaaactggtaccgtttctgaagatacacagtgattgtttcggccagttaattaaggcaagagatcactcaacaattgttctacagttattcctgcttttttttttttaactcactcattaagtgaaagaagccagtccgaaaaggctgtatattttatgattccaactgtatgacattctggaaaagggaaaactgaagatagtaaaaggatcagggtttgccaggggttaaggggaagaagggctgtgcaggtagagcacagaggattcttagggcagtgaagctgctctgtgtgatgctacaatggtggatccatggcttcatacattggtccaaacccacagaatgtacagcaccagatgtcaactgcgggctctgggtgataatgatgggtcaatgtagattcatcagttgtaaccagtgcaccactctggtgcaggatgttgatcgtaggggaggtggctgtgtgtgtgccacggaggggggatatgggaactctctgcactttactctcgat

SEQ ID NO: 128692 - DNA, 1120 bp, Homo sapiens
ttttgaacaaataaatcaacttgcatggctcctgccccaaactggaaaccccacctaggaggggtgggcggggtcatatggtgttcactcacttacgctaatgaactgagaaataacgcacttctgcccaaattcatgttcattcacactcctctcagcagttttctgcagtcttcccagccccacggaaaattctgcttttgtcagaggaggggatatgcgtgctttcccgtgtttgctttaccgctgggcaatccatacaaggctactaaactgcagagggtactggtgttagcatgccccgtgtttataagggacttaaaaaaatatacaggcttgcatccaccatacctaccatacttgtgtactagagatattctcggggcaaaatgaggtgaggtgtggaaagtgctttaaggtgactcagagccaccctgttgcgattgctgccttcgtgatgactggtgtggctgcaaagttcagtggctgtctttatatcagaataattctagaataatttaggagaaaattctcattgttaggttccttcaagccaaaggaggatgtagtgaaaagagaataggtgttggctgtctagatgggccctgtttaattagagtcgactgtatcagttgccaaatgaagccaatcttacagggccatcctatagaacaaatatatattttttatatttaatatgatatatatgtgtgtgtacacacacacacacacacacacacacatacatatatacagggagagatagaatggtttgcctgctgacttgccattaagtaccgtaaacatcctggaaattgtgaacagctaattggaaaacagtctgtccgtgttcatgattcattgtatgcatcctctagatctcaactcaggaaatccacaaagctgaccaggccctgctgtcattttgtggccagatatggaaagatataaaccacctcctttcttccctgtcaaaacagttgtgccacgtcctccccctcttcctcatcttgactgactccctcacaggtggtgtctctgtctctcctgcccctgcccccacacgcacctttagttacctcagtctttcaaattttgctctttgttcctaagtacagtc

SEQ ID NO: 128693 - DNA, 2077 bp, Homo sapiens
gagttcagtatttagactatatggattatctagtgtctcaatagaaggtaaggttatggaaatccatttcctagttctaaactctgcaagcaaacaatcatctccccatagtgtgatatctaaatagttaatccagtatgtcagacaaccccatttagtaaacaaagactacttgaccatagaaaacatatgatatatgtataatatataatccatatagagtaaacatgtattatattttatatactgtataggcacatatcatactatacatatacatatcgcataagagatacagtaaactatatttgtattttccaaaattaaatatgttgcagttcccctaccatagtgaaactgtctcttctacattccttactgcattccttactatatagtaatactaacactgagcacaatcatatttcaccactcaggatgtagccagcggatacagtaatggttcttgtcctccgcaggaggaccacgggagaccagtggctgtgaatgggatgggatttttttctttcctctaatgaaccaagccctgggttttattgttgttgttttaatatacagctattgagtgttttgtagccacacacgacaacacacacacacacacacacacacacacacagagtccctagcaagggcagggtggggctagcgggctgggttcccctgggagcccctcaccatccatttctcccagtgacggcagctatgtttgaagagcataactgcatggtttcctatgcattcattcgtgagtagtagctctcatatattattaaaaagatacactattattacttttaaagaaagaaaaggattgcaattcacatttacactttccagcctgttcttgtgttgtttaaaaaacaaacaaacaaaaaacgatggcagaggaaatgtttgcctccgtagtaggcatcaactttatttttcaaatcattctgttttaacgtgttcatagactgcagttgtttataggtatgaggcactcatcagtgtgaaatagttctttcctttccatatttcctcttatcagaaaaaaaaattcctgtggtctcctagcaaaatacaatccattttgctaaattatttgtgagtttttataaagtgtgtttaatatcaccagggcagaggttcacactagttgcaggattagcaagagagacgtagcatgagtagtgtttggtccactgcagtgtgttttgtgtgctagcgatcatgagtttatctgatccttgtttaactactacacagtgagtaagctgtcctgtattgttccattcatattcctctgagttcattcagaagcctgacacttcctttgccggacagattaaaggggcagcgtgggaccttttgatgatgtgaaacctgctttcttagtctaagctccctaggctatgctgaccactcagaggttgaactactatttatttgccctaaaatgaaccagaaacttggtcttagtttccttcctgacacatgttttaatttcctaaaagtgtacggattttgtagtgggttgtttttgaatctttcatttttagtgctgatccaggagagaaaggagatatggaaacatttttttcaaaaaatagctcaaaagaaaatatgtaaaaccatgaaaaacccagaattgtgctgctgctttctgtgctaattaaatcagtgggtgttaggttgtaatgataaccctttaactgtgtggcttatctctcattccattttatattattttcttcctcatgagaaaatcagtgtttattatcacaggtgacaaaacacaggagaaaaacaaacagtgaggttacatttaatcactttaagtgggtttcatctttgcttttttgttttcattcccaagccagaagccgtaaaccgagcgagagtgcaaattgcctttctcaggtgcacgttgctgagataggctgggagaacaggtgtggagcccgtgaaaagataaacattaagtcattcttggggaaacggtatttagctagacagctgaagacggacttttgaaataccattgtgctactgctgttcaaatattgactaa

SEQ ID NO: 128694 - DNA, 1052 bp, Homo sapiens
cggtggatgtgggaaagccattaaccatcagcttgacggtttacaaagaaataggaagttcaagttaagcagatatttaggatatagtttgccttccacatatttcaacctgtgttgctgcatactttttaagcttagcgtaattattcacacagctatgaattttagaagatgtttaaaagcaaaccacagtgacctgggaaaggagggaaacttactggagcgcttagccaggagcttaaaaagacattgctagtgagttttatgtcacatgaaatctacatttgataggtcattttggtaagtttttgttgttttaaatgactcctcttgacacagtaaccagtggtgctgggaacattcattcacattcattcatttaagctcatgactcaaataataacttagtcgtttcctctctgaaggtaggggaggtaatgaggagcaccgattaggctccaagatccgttctgagattcagataaggtgtcctaacaaaaggtttatggtgaaatgaaagagtgagaaaataattgtgctttttctagggtcatgcgtcaaatgaggctcaccaacttttaaaagactttacatagctttagataatcacattccctgccatgtaagcattgtgatgtaatggcatcatcatgctacttaacaattaatttatgcattttgtttaaacttcctttagaatatatatagtccatataaagaaaattccaggttcgttttggattttgtataaatagctcccatgtttacatgtgaaaaaaaattatttatgaaagaaaaacagagctttcaatatcctattttggttacgtctccataaaaactctaggaaacagtgggatcatctgtgaaacagtggaatcaccccaagaacaaactgtcagacagaccgtcctgtcgtggcatgacttgaacataaccgtcccacgtggggacgcattccgcaccggttgctggaactgacgggggctgcagtgctgaatacctctgggacgcttgggaactgtgcccctgtttacagacggcaagccctt

SEQ ID NO: 128695 - DNA, 1090 bp, Homo sapiens
agagcagaatgcctgccctccaaccaggacccatgctgcagaaaccctctgggaaaaaccgatctgttacaggacccctgggcatttcctaggcaccaccccaattaagtatttcctagagagagcagttgatctcttttgtctgaaactgatttttgccgtgctaagctggcaaaatatctgaggtaataactttaatgttgaagtacaatgaaagttcctgttttttcctttaggaataaaaatattacaaataggtcaggacttcggtttatttttgttattacaaataaagaggaagaagtttggctcctgtaaacgtgtgccttttcagagggaaaaatagattcattgattttagttgattcttgaaccactagccaagttacaaaagattttcatttccgaacagttggatagaaagatctgttattaagtcacgttagaaacatcagtttctgagctctgacctttattctttaaaaaaactccacttggatattcactctaaaaatacactgtactgattaagttcattacattacaatagagaaattagaatttaagtgcctgtgtagaaagaggaatacaaactttttttttttttttttttttttgagacggagtctcgctctgtcgaccaggctagagtgcagtggggcaatgttggctcactgcaacctccgccttccgggttcaagtgattctcttgcctcaggctcctgagcagctgggattacaggcaaacgccaccacacccggctaatttttgtatttttagtagagacagggtttcaccatgttaggctggtctcaaactcatgaccttgtgatcgactcgcctttggcctcccaaagtgctgagattacaggtgtgagtcaccatgcctggcccacaaacttctttattgtgtcagaatttgttgacatctcagcattttgtaacacattatcaattacattagtcccccttggtattagactcgggcaagtcacttccctgttttaattaagctctaatgtcctcatctgtgcaattcaaggggtgcactcacaagatttttcaccttcaatcctatggctctgtaag

SEQ ID NO: 128696 - DNA, 1374 bp, Homo sapiens
atatttgttccttttctttacaggcatgctccattaaatggggatcagttcttccaccatcaaatagtataactctgctattctctgaatgcaaagcagtggcagtggcatagggtacaatttttttatttcctgtttgaaaaagcatattgtaaggtattaatatcacatatgtggttttaccttttttcaagattattttttgtagagacggggtctcactcttgttgcccaggctggtcttgaactcctggcatccaatgatcctcttgcttggcctcccaaagtgctgggatcacaggtgtgagccactgtacctggcctgcatatatggttttaaaagtcattcagttgtcttccaggcaaatagagtagtttaaaaggaacaaatagaaagagggcacaccacagtactttttgtctaccagccttgtgtcagacaccatgctatgcactggggatagagattaaggcaactgggtgtctgacctaaagaagctaatagtgtatggagagggagagacccataaacaaattggatgtggtaagagagagcagtcggagcacaaagaaagacagtgatgcttccgggtgcacaatatgccatgtgcagctggcatggactccatccttttcaaattccctcaagttccgaacatggaaggaacagctctttgtagattcctaaatggaaattatcggaaccagagagtcaggggaagctctagtagagccggagttggcaaactctgtccagtgtcagatggtaattattttcggctctgcaggctatacggccaccatcgccaccactcaaaggtaatgcggtgcaaagcagctgtgggacagcattaactgagtgagcgtgctgggctccaataaagctttattcgtgatactgaaatttgaatttcttgtaattttcacatcatgaaagattctattttctgcaatcatttaaaagtttaaaaaccattcttagctcataggctgttagaaaccgggcctggactgtagcttgctggcctctgagagcctaggtggtctgtgggggtaggaggtgctgggcaaggccgtccacagtgcacgcggtgtggtgaccgtgtgtggttggcaaggctgtcagcagtacacacagtgcagcaaccaccgtgtgtggtcagcaaggccatccacagtccacacagtgcaataaccgtgtgtggcgagcaaggctattgacactgtacgccgtgcagcgaccgtgtgtggtcagcaaggccatggagagtgcacacagtacagtgaccacctgtggtcggcatggccattaacagggcacacagcacggtgaccatgtgtgatcagcaaggccgtggatagtgcccgtggtgt

SEQ ID NO: 128697 - DNA, 1014 bp, Homo sapiens
tctgccaggccactgaccaggaagcctcggggagccaatgggaggcccttgaaggcattaggtgcaaagcctggagttgtgggtgtccagtaacaccaccatgcagcctgggggtctgaggccacccatctgggaccccttcactctaaatgaggcttgactagggggatctcagaactccagagaaaatcttgggtgttcctccctgctgtactgacgggaccacaagaggcaagtgagactgtcagatgagaaacattattacaggttcccaaaatccacctgcctacccacccaatttttgtctgtaatagttctgctgaacagctgtgcatagtgcaatttatttccttaatactgtttgttttctcccccatattctgtgtcggcaactgacatttcagaggttcccatgtgttctctgtggaactgtctcaagttcttattaccctggttgacgacaccagaaaaaccatagctacctactcccagaaagaggccagtgttacaaagaatctcgtggccagcccttttggctcagtttgcccagttggaggccctaaggcgcaaacaagaaaagccaaagggcctcctgaggaccgtggaagtgggtggcgcgtggacccatcgctagctgaatgtggaatgtggacccatcgctagctgaatgtggaatgtggacccatcgctagctgaatgtggaaaaggacttatgacagtcagaccatcccaggttcccccagagcaatccgtgcagctctcataagcaaccagaaaccaaaaaaggatgctaagtcagcacaaagtggagcagccccccagctatgggttgccaaacagaatttgcttgtgggccccgtgacccctgctgttgtccagtttaatgctcagcatttatccagatcaagggatggaaatggggccaccagcctgacccaggcccggggtcgttttgcttttccaacctgtaccatcccagcaatgcattgccagcgtgcaatttgaaaaagccct

SEQ ID NO: 128698 - DNA, 1022 bp, Homo sapiens
ggctcagacacacttaaaggcacattgctgccctgcatttatacggcattttgtgctgacatcgttttccatcaggcctgggcagcccctcctgagactgtctcccgcctgccgtcctcagcacggcctgcccggctacagtctgctttcctcccactgcccctgcctgcaggccttggaggcggtgactgctgcagacttatttgggcagcctggccttaatttttggaaagtgccttgttgatgtatgaggaacttccacggctgaaacagtctaaaaaaatgaagctgggacactatgttttgatttgagccatttgcagacagaggggcacactcgggactcttgggcgcctggcacactaagctgggagggacttttgagacatcttggccatccaaatcagtcaacatgtttatatatacaatttaatgttcagtatacagggaaaaccattagaaggttagctgcacataaaactgttgttaaagttatttttattacttccccccacaaatcgtatgcaataattaataagaactagagaaatagccacaactggcacaacacctgcccctctgccaaaagaaaaaaatcttctttctgaaggcaggctccctatatagtgattcctttatatgcctcctggaagatctgtttcgactccattttgatatatgttgaaccagatttgaagacccacaaatgcagtctagagccattttgcaaaagtgttgctgcatcaaccatttccattccccagtgctgctcatcatgttacactagtgttaaatcctgactttggaatgcgaggaaggacagttccagccatgggatttcaaaaaagtaccaaaggaaagccccttcaagttaccgtaaagacagaagaaaaggaagaaaaatataaacacacacgtataaacatgtaaggtagctttggtccctataacagacaaggaaatcaaggctccgtgaagagagagacaagaattcccttagccaagtgcctgtgtgtgtctgt

SEQ ID NO: 128699 - DNA, 1789 bp, Homo sapiens
aatggattgatgtcagtgtttactaacatgacctgtgttaagtcaaataaagtatttcctttgacaaacaccatatttcattagtggctttgaggtgggcttatttgttataagtcacattaaatgttcccaaatccatttcataaatgttgtcgagatctcaaactccgttgcttctaaaaaaatatgtccagtctctttgtcataaccatcctaataaagatctaaatttcttagagtgaattttcatttgaaagtggcttaatgccagctagattaattcttgtttaatctaaatttataaaatttttatcttaattattgagaaacctttttaaaaagagataaaaatgtcatatgtgctatttacattaagatatattatctctcttggttataggttaagataaataaaattgcttatgtcaaagaagtaaaaaaaagtccatgacctccttttggtatccccatccatctggcggacttaatatgaaaaaatcttcctgtgggaaattaggcttgattatagagttacaagtacaaaaagtagtttttgaagaattataataaatagttacacataaaaggaagtgatgtttgcttgaagtatataaaaatattccttgtcactcttgtcccctcatgaatcttagttgtctgatgatggttcaagtctttcctaataatccagaatgtatccctccactttttctcttaaaaacgctatttcaagcattttctttggtaccccattaataataaagcatacttccccaaaatgttccatttcaagtaaggggtctaaaagtcaaagaccgactgatacaaaagagaaaagtaaattgtacaaagactgaagagaggatgcagtattaaacgtaccaagttcttgacatcggtttccctcaagaaaaaaaaaaaatgagtaacgttttttgaaagcctgaaactattctagtaaaatatttacggaaaaaataatatgcgctctcctcccaaatcctgatgcgcatttaaatcacctttttcatttatagatcaaaaatcttgcttgactacaataaaaattaaaaaatggtacctatttaagaatgcaagtatcaaatccacttgtaatactcactagctccctctgctgatctcctatcaagcgacaggcaaatctatccatgattgttattacaattgttaatggaaatgataggtaatttaggacctacatcaattgcaactaaaatacaagctacaatgctttcattttaattttaatgcaaaagcacatcacaccatatacagatgttaaagaccgacgtgcacacacacagtgaaaaaatatttttaggcattcatttagcatacatagacctaggagctgtctctgtatcctcaggtgataaggttactactattacaacagcagaaaaagaggtctgtactgtctgtctccataaggagccaatttagagacccagtcctgttcaccccaagcttacagtctaacgaggtgaacagatgtcccatctggatgcacaagcactgctgcctaaggccctgggtagtgcaggagggagcccccacacgggaagcctcccaaaccacgtaagggctacgtgaacagcaagaatagtttcactgtttatttagatccacactgttacttatttaagaagaacatactctgccctttctccctccctgaagaaagaccaaaactgagggaaattatattccaggctgagaaaattgcctgtgcacttaaaaaataaataaataaaaggcgagaccacgg

SEQ ID NO: 128700 - DNA, 1969 bp, Homo sapiens
ctacaaaacagggaacaccaaagatgagcagccactgccagcagttagcagagaggcctgggacagatcctgcctcgtggctttggcttccagaaggaaccaaccctgccccacaccttcacctcagatttctgctctccagaactgcgagagagtggatttctgtttaagcaagtttgtggtactttgttacaacaaccctagcaaactaatacagccttaaaaaaaaaaaaaaaaaaaagtaataggaaaggaattaaaatataacgctaccttgcagcctccaccaaacactgttgccatttggttcttctccttcttgttcaacctcaggagggggtgaaaaaagtccaggcagctcctggtgatagctatgcaaagcttcattctgcagcagtaaaagtgtttcctagaagtactaaggctcgttaattgcagccaccctataaaagaaggtcctctttcatgaagagcctgtttctctgcaggaagatggggctgacctcagggcctccagcacttaggcacttatccatatgtctgtaaccattgttgtgaggttagttgataatggctcattatcctcgctaaaatgaactcgttgaagtatgaggccaggccttattggaatccttccctttccctttcccttcccgtttccttttccctttcccttccccttccccttccccgtccctttagatgtagtctccctctgtcccccaggctggagtgcaatggtgcgatctcagttcactgcaatctccacctcccgggtcaagcgattcttctgcctcagccttctgagtagctgggattacaggtgcccgccaccacgctctgctaatttttgtatttttttttttttttttttttttttttttttttttttttttttttagtagagatgggttttcaccatattggtcagggtggtctcgaactcctgacctcaggtgatccgtccgcaggtgagccacccgcctcggcctcctaaagtgctgggagaggcacaggcgtcagccacagtgcctggcctactgtcttctctaaaatggcatctgtgcattcatctcagccgcccctgctcagataaaagcaatggcgcctcctttgaaatctgagagacgcagggccctgcccattctgcggaattccttctccctgctgcctgctgtgaggaggccccctttgccacggaacctgaaattcctgccactggaattacgctctggacaagcggcaagatactcctttcagtcccagccactgggttcctgctgcacaggaggccagggtgctgtgaacctgctctcagccccgggcaaagggaatctcgttaatccaggtggccagcgcctcttcctcagagcatctgcagtgctgcagacagggcctccctgcgtggggcttctgtcctccacactgtggtgctgctgggatgttttcatggggcctttcccttcccgtcaccacgtgtgctccagaacccggtgcatttggatgaagccactagatgtataggtcagcagctccacatagaatcaaattatcaaatgcacactacctgatccagaatagatcgtcctggggtaaacacattcacatattctgaatgtacaaatggctgtctagtaaacacactggaacttccataattattgtccttccagataatttttcaagattatatgcacgtattctgccattccttttcaagacaactttagaacttcctttggacagctactgtaagccaaagggcttgcatttgaatatcttgcatgaagctaaatctttgttcatgaaaggcagaataattttatatgccacaaagctgcagtagtgtgttaggtttagtagatggctaagcactacactgtattattctaatcctattttcacaatttaacaaatgtgagacaccgtgctacttgtacaagagatacaaattaaggaatcttcaatg

SEQ ID NO: 128701 - DNA, 1368 bp, Homo sapiens
gcagagttcatgtttttcgttcataaatggcctggaaatcctagcattgggccagccatccagaacagtggagctgcatgatctggtctggggatatttcaaagggaatagaatactgaggccctgtgggatggaggctgcttcccgatattgagaactgcaccagactgagctgtgtccagaggaagggagaacgtctttcattcacttaaaactcacctaacacctgacacctccatcttggcatcatccacctgtagcctctagccctcttcatctgttaagtgagagtaactggcaggttatttggagagtgaagtgacatcggcagagttccaggtatggtgtctgatgcgtgagttcgccccctttcccggtccccttctcctccatttgactaattatcaaagaaagattgctttagtgaatgagacagtttagatccattcccttgggaaattatggtggtcagccctccgctcggtctcacttttagataccagaaactatatgtccttgtgttggcagagctggattgtctgtcgccctctggtgcaatcctgcattagtaagggaagtgtttttctggggcgttctaatgaaaagtgcttaagcatttgttttggtgcccagataatgtgactgtagttagtatgtagtgtttggactttttgctcatgcttttgttgttgttgttgtcattgcagaaataaaattaaccccttaatcttatgcttaatgtacacaccaagtggtttgcatattatactgagaaaataaaaagattgttttagaaaaaccaaaggacaccaacagctctttacagccccaaagcacgtgtcgccagaggtcacaggaggggttcttagttatcagcaagggaaactgaggctttctcgtttatgcagaagtggaatttattgaataatattaagggggctatgtcgccaatgccacagtcacactgcccacacagaactggcctggcgaggtgttactttgaccaccattgctgggccaggacgctgccaccaaggccgtgcccctgccagaaactaaatgtggctgccccatccctggccctttctgtcagtagggtcaggttcaaactcctgggtagtcagcccagctctcattgactcagtctgaacagctgcctgttccctagaatccacatgcgctgggacaatgggaagtatcggtagacgctatggtgggaagatgactctgtgtccaccaaggttcttgggctggggaatggtctgagcatatgacggcctcagaccccagccaaccaaagggaaaggtctcccctgtactcacgaagcctccacgatgtccatcagcactttcttcctccgttgcagt

SEQ ID NO: 128702 - DNA, 1051 bp, Homo sapiens
agtcgcccccaaaacatataccaactgatttaaaaggagacacagcagatggagattattgtgaaaagaactcttactggccaatttttttgttattttaatctctgcttatcccaattcttttagctgcatatactgagacacttcacatctataataaacttggtaccagaacacaattcattccagacctaactcttttagatcattataaccgggggaggaaaaaagttaaaaaggcttatctatcttaagaagtatttctcagtgttcgctacacgtcacttaatcttttccaaaatttgacaatatacaaagcagtttgtagtgacttttcatagtgactctacaataaaatgggcctgtcctccttgcttttccaaatgcagtcatcatctgacaaggtttagctatttggggaagtccttgcttgcaaacgtagttcttttgccaaacaggtttggtcaaactgtgtcccctagttgcacagttaccccatatttgattaacaaatagcaaaacagagataatctcagaaatattcaagagtctcaaaccccaaataaaatataggcatcctcctgttgagtcgaattggcaattttgattagcaaggctcatgaagcagtagatatcccctctgatccccatcccagtgcgagggcacagtgagttgtattttctaagtataaactattctctagcagttcggctggagtattgggagcaaaactgtatttttctaatattttcagactaagacagtgtctctgttttccggacttttccgtggctaatgaaggatttatcagcaatacaaagaaagttctcccagtgggtactccacggggagaggagctggggtctcactagtgcacagccataaaagacaccacaagcatattacacgtgaagcaggatccgtgcccaccacagcagttgtcccaggagtttcctgtttgaatgagacactttgggtggatactgcagggagggagaagctgtgtgtggccaccacagctggaagcgtggcctggtgccctcacagctg

SEQ ID NO: 128703 - DNA, 1910 bp, Homo sapiens
gtcctccagcctccacgcttccctgtgactagcctctgtggtcaaaggtgcttgctgatgcagcctctgtacagcctccatgcagtgcgtgtctttatgtggaggagaccgcccttctttcagcagttattgagcatctacccactctgtgccggtcatagggcttagaactgcatgtctggggggaattctgcaaagagagcctgaaataaaggcaaacagtgagagacggccaggagaaaccatgagcactgcagtgagtatcaagggacaaagctgaaaaaggaagactgaacgctgagcttcaagccattcatttctatgggccgcgggagcccttgaaagtctgtgggcaagttttggtgagattaagctggtagttctgttcaggacaggttgaagggatgagagattaggacacttaccacctgaatcctgtcgctggctttagtttaaaccacccgtaatgtagacatcctgacttagaattccctgtgctgcttcctttctgatggaaacagctctgctaacagagtgcaggctgtgggagccgagccccgttgcaggcagcctgcaggccgcagtttcctcggcttaccacccagcgcttttcattcggctcagcgctagggacctctgcttccacttctcggtgttggaaattgccatttatttttgctgtcgatgatctgtattgacttggcctgagtatgcgtgcacgtctctggtggtctgaattatatagaccagaagggtgtctgatgccgcttttataaaaaataataataatttgaaaggaaaaatgactcactgaagtctggcaaatacagagccctctctctgaatcgacttctcacttggccatgttgaattccaactgggtgtcctcagacatttctatcccaagatctactcctggcttagaatctgttttgttttgtcttatttcagctcatggttcttgttcccccagctttatggggtataatttccatacaatagaattcaacactttcaatgtgtggttggatggcttttggcaattgtatacagttttgcgatcacccctacactgaagatatagaacactgtttctcgtctggtgattgctggacattgaattctttccagttttcactgttatgaatctgactatgatttttggcatggatttgtatgtagctataaatcacttggtaatttttcagaagaatagcagtcttggggcctggatggcttattgtggtctcaaaaagttcctgatgataaggttgcagcctcatgcttctttataagaatgcagtattacttgcaagggagcttgggtagataagaaagcaagaaagtccatgtggagaccctgtccagagagcacagacatggactaagttaaaggatggtaaattagcaatgcccaaaagcacatggaggagatacttcccctcctgactctattggtgatgcagtttatttgtctgagctatctgagcaagtttcctctcacttacgtgctggggacagcagattccaatgcagagtccttagagctcaggctcccctcaacctgacgcatctctcaaccatttgtcttaagctgtctgaagtcagcttcccatcttggggaggtagaagtgaaagggtttccactttgccaagtgagcgtatatggggagactgagggtgtggagttgatgatggttgtggggtggctgacagtgtccacagggctagtcttgaggcaggctgacactggggccagatgggaccactgtgcctcctgtcccctccaccttctcctagtccaggaagggaatagcagcagctgctctcagtggggcattctttttccagagccaggccagcccagcagtgatcccttgataaagcaagtcaccgttatcagagcaaga

SEQ ID NO: 128704 - DNA, 1110 bp, Homo sapiens
cagtggggaagggaagggtgctaagcttcagtgactgcctactgtgtgccaggcattttcatcttccatctcgatagaatgtctaactgtgctctgagatgagaactataaatagctggtcagccaaaagttttctgctttttcttagtgatctcaagtgtttccatgacacgtgctgcaaccaaatacattatgtgtaaattgccaaagacctgttgatttccaaaccattatatagtcatgggaatgcttgtatacctgaattgtcataaaattgatgagatgcgaagatacagcagaatatatcagataattctgcagaactcttattatggaaatgaaaataattcaatagagaagtctcgattcataaaagactagttttactctaaagtatctaaaagacatgcattaaaaagacatggcactgtccccgaaacgatcttgctgtgttgcatttcaaatggtaccttcattttgaaactttgcacattagcacgttctttataatagcaaaaagtgggggagtgaggaacatttggtgccggaagaatgattaggtaaagcacaccaagctgaaaaaagtatttttgcagagcgttttcaagagcatggaagagtgttataatgttaagtgaacaacaaaaaaaaaaaaatacagatccaactatgtaatcattacacatagaaataaaaatgagcaataaagccaggatgtcagtgaggatggagtggagggaatgtcctaaatgtgcgttggcccatcatcacctcatgcatgaagtgaatggaaacatttggtttatgttttctggaatgtctcataagccattgtaaccaaaaactacaccatgaacaaaaagcaaagcaggccctgcaggccctgggtgggaagctgaggaggttggcagtttctcaaactcatgtcagatgcccctcggccactagacagaatctgctgctatctgggttctggttgaccagaggcctaatctggaatctggttctaaaaaccaatttttgttatagggcttgctggatacaaatctgcaatgagacattgtcacaagcaatagcttaagaaaaacataaaggaaaaaataataataa

SEQ ID NO: 128705 - DNA, 1050 bp, Homo sapiens
acgatgagtagttaaaatcactgtcattggctacatgcctactttttatagtcactctacttattgtggttttggctacatcctagttgaactctagggctagtgtttattaaggtcttgatctcatatggcatttgtagacaatcgaatgttgagtgataagccctggtaacgtgatttctcactgctggcccgtgaagccatggaaatgttcccatggaaatcaccccatgtgtggaatgaatggtcagtggaacataggcatctttctctcctgtcctctaggttttaaaatacctgaatgtcctgaaatgcaagagtatcctaagagcactttagaaatatctttgcggtttctttctggtgtgctttgtgggttgggtgaggtaccgtattccaggacacgtggcccttagagaaacaaataatttcctttcctcctgcttcagtgttattggtaaagtgggaaggtagccccaagacactcagctcctgcactgcatttggatagaagggcgttcaaattccaccagggacaacttcgtctaaccccctagaattcctcattttgacccttggcatactctatatttgttgaaatacaaaaaaaggagttgaaagtgagtctatctatatgtagtaggtatatcgtgttcactgtaaaattccttactgtatgtttaaaatttttcagaatacaatgctgggggaaacctatggaacagaagtagggaaaaaattcgacaacgcaaagtgagagtgggaaaccatgtgaagctctgttagagtatcatcactaatctcttttttccttatacctatattcatgaaagcaaatagagaacaatacaatatagtgtaacaccgtgtacccatcactcagcattgctcaatcttagttatcattatggttattattattattattatttgagacaggaccttgttctgtcacccaaactggagtgcaatggggtgatcctggctcactgcagctcaacctctcgggctcaagtgatcctcccacctcagcctcccaagtagctggga

SEQ ID NO: 128706 - DNA, 1025 bp, Homo sapiens
ttgagtcatctgttgttggaaatagtctcctggtagttttccccttgatttactttttatcttcattttgtttttttgaaagtagtgagggtaggaagttacagagagattcaattagagattatgtgtatttttaaaaatcagctatcaagattaaataaagcaagcgggaattctctccttgctcccatataccaatttttgtaattatgtacaagatgagggaaaccaaagaaaaacaataacttgcttcaatgcaattactaattcaaaagtaaccattactctggggaattgtattagagattaacaaagaggaaaagtactgtggttttctttctctatgttctatttgctaggaagcggtcaataaagtaaccttttccccacaggagctggttaatagttcgcttcatgctaaataaaagttacagaaatatctggagctgagttgctggagacacagaaatcttcaggttggaatttcttgtccttttccaaaggattaggccaggacattgctgtcaaatctgcaaaacctactcatcctggcaagagtgcggtatttttaagactcactagtgtgctacttctaatagtgcttagtcagggacccccaggggagtgcaagggagagagggtccccagcagggatgccagaccttctctagctggccgtgggtgctggcctggccacctgtagccctcagcgcacaggtggaggtgtaactggtattcctgtgggagtgacagtgtccatctttgacatttaagagcctgctccttcagatacatttaccattgccaccactggggattggggcggcactggccacccttggcggcacatctccagcttacagcagagtctgagtgtctctagcatacctctgactgaggcacgttaggcttgtgacatcacatcttcctaggtggggcagggactttacaatacatgtgacaagagaaaaaccttacagctttgtattgaaagatttcttaagtttttagtttattgactaaat

SEQ ID NO: 128707 - DNA, 1018 bp, Homo sapiens
gtggcttttggaaaagctaagccgggagcgattatcctgatgcgcttttactttttgcataaaataagaatttgaggaggatgtcccgggagagtgagccacttctcatttcccaggcctcgcctgccatgctctttgacaacatcatagattttatttttgccgggaatctcattatcaaagcaatgccccccgccccccccccacacacagactgccaggtaaaccacagagggtgaggggggtgcaggtcatggttgccttattacacaccctcctctgccatcacctccttttttgtctggataagttctttggcagttctctcaacttttatttctgaaacatcctgaaacatctcagtattaaaagcaaggccgattatataaacgatactcccaggcctgacaacacatggttttgcctgaggcctttactgccaagagccgtaaggaccctctaagtcatgttcgctatttttactggccttgagagtctccttgctttgacatcctcttgtctccattgtcagactgttaaatgctcatgcttctggttctcttaaatagatgcagatgtgtggggctgggttgccactgagccctcttctcttttgcaagagctgggatgcagacagaaggcggtttggaaaacacgagccaccttgattttagacaaactctaagttacaatcaggtgtcttcatttatgacatttaacttttacttaacctaatcaagccatgttgttggctactgattagaatatccttttataacttaccttaaatctcactacttgttccaaccatcccaaagtctggcgtcaactgtcattgcatgctgctcttttcagcctttctagttcgactcttagcaaaagccataatcttcctccagtctgtttcctttctgcagtgacaaaattgcccagggaaaggaaaaagaacagcatctatcttctttctttttagctccctggtttaaggctttcttttcccccatgatgaaaaactata

SEQ ID NO: 128708 - DNA, 1046 bp, Homo sapiens
ctatactaagaaccactgagttgcacccagagcttgcattactgagcgctttaccagttaggaaggtttcgcgtattccgtactttaaatctaaggtgacttgactgtaaggcctgcgagtatttcctggaccactcagaggaagaatgctgtgaatgagaactacagccctgtaagacacgtcctgtatcattgttgagatgggaaagtgcatcttaagacagttagcaggccaaggagcgactttaaagggtgagctctgcctagagggaaaagcgaatgcactaattgaaatccaacaccctgggctggagtaaatgaaccgtcagccacccatggggcttcatttcttggtgatggataaatagctgggattccttgaagctagaagccatggggaaattctgttctgcttagctttgtcaacagtacagtctgccttaactgacttggaggtaaatagattcggagagtgtgagctaaaacccattaaatcaggtgaagacacaaaggcaagcacagccaatgtggtttaaggcaaagctaatgtcccttcggccttaactgacggactttcctagcagtcctcaccctctgcaacccagggctcctaggaggagctcatggcagagaaagccttctggcttctgccactgcctcctcaactacatgtatacatcagtgtatatgcatgggtatgaaatgaacattttatgtcaccattagcagaggaaagctggaactctttcaaaccccacccaaaattcactctgactactgagcagtcctgttgtttattttggaggccacttaaccctggagcagtccataagctccacttaatcccctcttctttcatgatttcttttaaagagacatcttgggttctgtaggggaacatttgtgcttcactgtaaaactccatttgaggcctgctcacggcctgccaccttatctgcttgcagccttcattgcttgggagctgttttacagcttcataagttgtaaatagctgctggcaatgcaaacgcgcttgtctgtgggca

SEQ ID NO: 128709 - DNA, 1050 bp, Homo sapiens
tctatctatctaatctatctatctatctatctatctatctatctatctatctatctttctatctatctagatggggtctgcctatgttgcccaggctggtctcaaactcctgggcttaagcaatccaactacctcagcctcccaaagtgctgggattacaggtgttagccactttgcccagctgaagttagagtttagagcacattgctgtaaattgcgattaccaagggtattgaaaaatccatgaaaataataaacagcaagttgacttcagaatttgtgcgtttgaggcttttcgccttgatctccaggtaacacacaggctccttggcgagagccagtggtgatacaatgagaacaccgcctgctgcatctaatatttgcagcttagaattcacagctaactttttaaaatgtaccagtgtgggggaaatggtgctttatttgctggataggaaaattggccaagatcagaattctgaaggcagtgtcacagcacaaagaaactagctactgaagtcacatcctaaacattcgagaggttgatttccttttctactgcattacaaaaaggtttatttactgcttatccatatagtgagatagagattagatctcagtttttggttaagaacaagcattatcataaatgtgtgtgtgtgttgtgtgtgcattttacaggatttttaaaaatacacagagaatttttcacagttgttaactctggtaaatggtggggaaggcaggggtgagaactgatctattattcataatctcaatgatgaacaagctatttccaaaaataggtggattatttaaaattattattattaggatattttgggcttctagaaacaaaaacttaacaaaaaagtcacttaaagaatttaggggtctttttttctgacatgaaaagaacaaaataaaggatgatttcagtttggtccgtcagtgacttagaagtgtttttcaggacccaaggctttccgccttcccactgggccattttcagcgtgtcccgtggcctctgggggcttcagtgatccaggc

SEQ ID NO: 128710 - DNA, 1120 bp, Homo sapiens
atggtcctggatggttatctttgaaacttcctaacctgttgggtccccgtcgttaaacttatgccaacagaactaaactcactggatgtgaattgcatcagagatgtaaacatttaaaagcgtattaaggctgggcgcagtggctcactcccgtcatcccagcactttgggaggccgaagcgggcggatcatgaggtcaggagatcgagaccatcctggctaacacagtgaaaccccgtctctattaaaaatacagaaaaattagccggtcgtggtggcaggtgcctgtagtcccagctactcaggaggctgaggcaggagaatgcatgaacccgggaggcagagcttgcagtgagccgagatcacgccactgcactccagcctgggcaacagagtaagactctgtctcaaaaaaaaaaaaaaaaaaaaaaaaacattaaaagcagaccaaaaaaatcctagaatacaggagtcagctgtctattcaattcagaataagaaatattgtagacaaggcaacattttatgtgtattagaaatgtggtggttggtttgagaagtgaaaccagccatgtatatgctgctccaagcattttggttgtggcaggaaactttgaagactattttgctgtacaaattcacaaagccccctgcaaacactcccgtgcttggggtgaatgcccaagtgtgtcacagctgccttgcagctctgaggatcagaaaggttaatggacataaaagaaacttcaaagctcaacctcctaatgggaagctgcccttggttttaggctgtctttgcttactgaccgacttaattcatgctttgggttatgactgtaggagagattttcctgtgtctttggagtatgctgaacttgtgtttctttttgttgttgcatattagacagtcagtgttgaaactaaagtgacctaaagtgacagagctcatgttatgggctgaattttgtctccccagaattcataggttgaagccttcccagtccttagaacatgattgtatctggagctagggcctttaaagacataaataaggtaacatgaggtcataagggcaaggccctaatccaatatgactggtgtccttatacgaagaggaaga

SEQ ID NO: 128711 - DNA, 1132 bp, Homo sapiens
aattttatgttatgtctatcaaacttttaaaggcaccctccacagatagttttagtagtaagttttaccaaacattataaagttttacaggaaaaaaaaagaaatctattcacctcattttacaaggctacattgatcttgacctaatactggtttaaaaaactcatttgtaaacaagtacataaaaatctgaggctgagcgcagtgactcatgcctgtaatcccaacactttggaaggccgaggggggcggatcacaaggtcaggagatcgagaccatcctggctaacacagtgaaaccccatctctactaaaaatacaaaaaattagccggccgtggtggcacgtgcctgtagtcccagctactcgggaggctgaggcaggagaatcacttaaacctgggagaaagaggttgcagtgagccaagagtgcgccattgcactccagcctaggcaacagagtgagactctgtctaagaagaagaaaagaaaaaaaaactcagaaataagatatttcatcaagtcaaatttggtagtgtgtttttaaaacacacacacacataaccaagtgtggtttaacctaagaatgaaaggataaatgaatagcattaagtcttcttttttctaatccattaattttcttagtagtgttaaaaagcagtagggaagattcaatgccgagtaatgatttaaaaaaaaaaaaaactcttcagaaaccaggaatagataactttcttaactatggaggttatctataaaaaacgtacaacaaatattgaatggtgaaaaccttagtttaaggcttaaatcatgtacaagacacacatgaatgctattactcttcaacagtgttctatgattcctagtcaagggaataaaataaaaaaaaattacaagaattatacaggaagggacacattttgtttgcatgtcatacagttgtctacatagaaacatcaaagagagtcaataaactgttacaactcattcagcaaaattcctctttgtaagatccactcactgaaatctttagcatttgtatacccaatgataaacaattataaaatgtaacagaaaacatagtaaataatagtggattcaaggctagccatgtaatacaggttgaacattcct

SEQ ID NO: 128712 - DNA, 1006 bp, Homo sapiens
aggaactggcgtatacaagatgacttctgatatcatgtttgccatgtgttgtggttcttaagaactcataggtgactttctgatgactgaatgtctgtttcagagacgcttcgggcctttttatttttattttattttttattttttgagacggagtcctgccctgtttcccaggctggagtgcaatggcacaatctcggctcactgcaacctccacctcccaggttcaagcgattctgctgcctcagcctcctgagtagctgggattacagatgtgtgccaccatgcctggctaatttttgtagttttagtagagacagggtttcgccatgttggccaggctggtctcaaacgcctgagctcaggtgatctgtcaggcctcttctatagaattccagtctttgtgtcttagtcatgatcataattgaaaggtcacagaacctttgtcattagagcacagtactgccaaataaagaatggaaattcaatgacattgttttattactgagaacaactagagaactctgcaagtttcttggcttagactcgatctttattaatacattatctattaggtaggaaagacatttgtcagctattaaggtgacttttatctagcggagattcctctcttaaagtaatgaaaggagataggtatggggggtgttatacaggataattggtgacatctgagtgtcttacttctgcaagcctgctttatggtgagcaaagcatcaccagcaagtgatcacaatgtccactggccgctttttgcctgccgtcctcgagatgaaattggcagttggggctgattcacagaaacaccgatttgtggctgagcacggtggctcacacctgtcatcccagccctttgggaggctgaggtggacagatcacttgaggtcaggagttcgagaccagcctgaccaacgcagcaaaacccatctctactaaaaatacaaaaatcagctgggtgtggtggcacacacctgtggtcccagctcct

SEQ ID NO: 128713 - DNA, 1034 bp, Homo sapiens
tctcttctgggatctaaaggtaccgccttccttggctcatggccccttcctccatcttcaaagccagcaacggcaggggagtcgttctcatcttacttcactctgacactcactcttctgccctctcttccccaattaggaacccttgtgattacattgattaccttgggctccccaaaataacccaggtggacttgttttaaagtcagctgattagtaccttttccacctaccacctgaatccccccggccatggaaggaaacatattgacagattttcagattagaacatctttgaggagaccttactctgctgccaacactggcccctgattgcctcacactaaatccaggacggatgcactgaccatgggttctcactggcacccagcctgaaacctcagataaggcatttgtcttctcagagccagggtttcttcaactggcaattttcacaataatccctgtctggtgcctgagagcacaggatgatggccagggagtcgacgcccttctgaaagggggaagaagcaaaggcatctcggtttgcagtattcagtgagttatgctgactcaaagacacgaatcagacactgactggtaggaacccccagcacagattaagaagtgcatagccaacaggcctgactccaaacaattcaaacaacaaggaaagaatagagaacttatcattattgtgtctgtttgacaaatacttaattgaccataatgtaaggctggaatttgcctattttaaagttacctgtggttgtaattaaactgttttgttcagtgttctcaattctaattctactactttatttaaaactataaatttttgtgtcaggaagacaatatctacttttatccctctaatatttaaccccttaatggagacagtaattagaattattgacctgaaactacacaagatcatacaaacattcttcaggctaaactattattttgtttggtatgagttcccagtctaagcgttaatattttcccaaagcctcaggaccttgcagggacca

SEQ ID NO: 128714 - DNA, 1050 bp, Homo sapiens
atttactgaaaaagctaattcagtattgtctcccgtgagccagccaatgaaacctcagccaacgctgaggagggagcactcgaggggaggaacgccatcctgggctctctagggctgttgtctgtcaacagcgagatgagaacaacgggcaacagcagcagctccgtcggcccacggccgccccaggggccctgggagggcgggaagggagacactgccagacctcagagcttggcaccaagagccagttatcagccagataatgtactcaaccaatggcgagaaacccgaccatgaacttattgggaactggtcacagaaaagagaaggactctttgtcctgagtgtgtgaggctgtgatggtaggagccgcagggctgtgactcacacgatgccacaaggttccttccaaaaacaactggggatgctgtgtggggaaagggctgatggcacagtaggaggtaacgggctcaaaactgacctcctttttaggggtgaggaaaagactgtcacctcatcttgtggcttcagagcccagaagagattgtggagcagcggttagagacttacggaggaattctgatatttttaactcttcggcactttgcttttcttgagcaattcccacaccacccctttttaaagatttattagattcaggggctactttataatatccttggagcccaaattagactttaagcacataacatatctgagcttgaggagtttaacttcttcaacaaaggagcaaagagatttggtgaaatgacccccatggtccctaatgctgatggacccaccgaagttagcctgtcaccagaagcaaagggatactatttttaagatatgaggatcttttccacatttctgttcaaagcagtaactttgcagcttcatctattgaaggcctcatctccacctgcttttcctaccctggattcacagggcttgtggtgccctctccctgcctccactcaccttccaacaagtgctggagtttgattcacaccaaacagaaatagccaaaatttgtaagaactctattgg

SEQ ID NO: 128715 - DNA, 1451 bp, Homo sapiens
aatgctaatgtaatataacaataaaatgcacagttcttaagtttatataaaataaacaggttttcagttgacctgctttaagtgtaaaatagtgtgaaaaacacaagaaagaagataaagaatttaagattttgacatttctctaatatgcccttaacttctccaaggattcatacttttttttgtaagacagaatctcacactgttgcccaaaccagaggtgcagtggtgcagtctccactcactgcaacctctgcccccgggctcaagcggtcctcccacctcagcctcctgagtagctgggactacaggtacacagcaccatgcccagctaattttttttttggtattttttagtgggggtagagacgagattttgccatattgcccagtctggttttgagctcctgggctcaagtgatccgtccttgatccaccatgcttagctgattcatactcttaactgaaacattgttccaagtttctcagaaacagtcaaggctttttatctagagaacatttataactggatctttctttgtgtagcactgattcatcaaactaatcctaaactcctaatgagttaaatttatattctgaatcttgctgtaaaagcagccattcattagaatgaaacatgtttacttagaattggagaagggagcttataagtcatctagtctactcccttttatgacacttctacattctttctgcacttctgccaaaatgttgcccagcgtcgtctctgatacctatagtcctaacaagaatatgaatcataccttgtatccttaattttactcttctctgcttatttgccattcatgtgaagaccttaaatagatcttaaattgcttccttcactttagctgagagtgacaggactgtgtaggtgtgggtgtgtttctgcatttgcttatttaagcaggataataaaaacttttactataggaaattaaacatttcccaatcaaatacaattccagtctaacacaattaaattctggttagggaactgcttaacttactagacttataggaaaatactaaaaaaatgtaactagaactctatttttacactttataaatataaacctctgtgaacaaaccagttatttcaggttgcatttgtgtatagttttttaatgcctgatttttctattttaaaatcacagatgcaattatacattcaaacactgccacaatactttgagaaagttaaagtttcccctactcctacactgcgtacacctttcctaggtacatcccagtttggtgtgtaactttagatttcttccaagagcttttgagtaagtgtttgaattgtgggaaggttctttagttaaatgaacttcttacagatcagttttttagtacagtagcacgaaatatacctgcatacctatggggatacctctgtgccattacgatggaaggcacgggaaaac

SEQ ID NO: 128716 - DNA, 1038 bp, Homo sapiens
cagcagaaatcttataatgattaactggtaatatatttcgttggcataaaaatacatttaaaagttcaagtaattataaacattgtaaattgtatatgtaatcatattgaaattgaaattctttatagctgtacttctgtgtaatcaaagactggggagagatagactagctagctctttctcttatccattaatcacttaacagagttttgaataaaaagttccatttcatgggataagaataatgacaggttaacctattttagttggttactatgttctaggtgttgtatgaagtagtttacatagtttcactgatttcactacaatcccaggaggagtagttactattattacactcattttacaggcaaagaaataggtttggaggggttgggtgttttgcccaagttctcatcgtaaaatgacagatgaggattcaaattcaagtcttaattgaagtccattactttagaacctacctcttagtggctcttatgttacagtataagggagagcagactgttcctttacccttgtagggtagctagggcttgtgaattaagagactgattaacaggagaagaggcatacacatttttttgacgttagtatttttacatgcacagggaaggagggttttatttttatttttatttttatctttattttaaagagacaggggtcttgctgtgttgccagggctggactcaaactcctgaagccaagcgattcttctgcttgagattcctgagtagcagggactataggtgtgctcctctgtgcttggctaaagaaggggtttgtatgtgatttttaacaaaggctgataaattgtgaaaaagtgactagtcaaaggagaagaggatttcagctcccaggggtggtaaattgtgggaagatgactaggaaatgtatagtaataaggtttgctatgcaggtttattttgccagtttctggtctcctaataagggacagggaaacacctttacagatggaaattcatatcacctttccacagggaaatttatgtcctg

SEQ ID NO: 128717 - DNA, 1035 bp, Homo sapiens
tcttccccttatccttcaactatctacttttgacaacactttgcctttttttttttgagatggagtttcactcttgttgcccaggctgggtgtaatggtgcaatctcagctcactgcaacctttgcctcccgggttcaagccattttcctgcctcagcctcccgagtagctgggattacagacatgcaccaccacgcctggctaattttgtattttcagtagagatggggtttcaccatgttggtcaggctggtcttgaactcctgacctcaggtgatctgcctgcctcggcctcccaaagtgcagggattacaggcgtgagccactgtgccctgcctgctatttgcctttttaatctcatgaaatgttctcttttcttggctgaagtgtcacttttcttgttgaacagcatgcgtggtgagtagaatgttataaaaagggatggactttggagttagagagacccaggttcctgttcggcattgcagaaatgctgttctgcaataggctgtgtgtcagtgggcaaattacttatctctcagagccttattggtaaggtgtgagtgatagctcctttcaggcaccttacagaggctgtctcctaatcctggtagcgtacctggctcatagatggcatttaaaagtggttgtgatgacagtcatagctcaccattagcatagcgctggatccatggcagggaagcgctgcacatgcagtatctcttggactacacagggccctcatgaattaggaactgctgtttcatgaggatagggatgaggaaattagacttgctgcccctcactgccttccactcctctcctccaagttaatgggaactatgactctgctttggcttgattgccatggaagattctcacacagccaaatttattgctatcttagttaaattatgccagaacacaaaatatgaagttattgtcaaagtaatataatctcagctgtaactgagatagtcagaaactgtctgtaatctgatgtcctatctgaaaggtagctgagaataaacaaga

SEQ ID NO: 128718 - DNA, 1051 bp, Homo sapiens
ttgaaataaaaagcctttcaagaaatgcaaaaaaaaaaagctcaaaaaacagaaaatgtatattttttaaatatctcagatagatttaaagaaattttaaacatcctaatcataggacttttttttttttttttttttttttttttttggagacggagtctcgctgtcgcccaggctggagtgcagtggcgcaatctcggttcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggccatcatagtacttttgaagcccattcatagtacaacctgtgaagagcctcatgtacgcgctaactgggtcctgtctctgcagttgactggattgttgctgacatcttggccatcaggcagaatgcgctaggacatgtgcgctacgtgctgaaagaagggttaaaatggctgccattgtatgggtgttactttgctcaggtaacttgtttccatgcttttctctctatatatgtagtttataaatttttttttttttttttggagacagtctcactttattgctcaggctgagtgcagtggtgtgaacacagctcactgcagccttgacctctggggctcaagtgaacctcctgcctctgcctcccaagtagttgggaccgtaggtgcccaccatcatgcccggctaaattttctattttttgtagagatgggggtctcgctgtgttgcccaggctggtcttggactcaagcaatctgcctgtctcagcctaccaaaatgctggattataggtgtgaactgccatacccaaccctataaaaatgttatattttaaaatttaacaatatacttcatgtgaatgtatggtttttaaaatgggtttaatagtttattctcagttgaa

SEQ ID NO: 128719 - DNA, 1050 bp, Homo sapiens
gatttgggggaacacacttctgtccgtaacagtgccacataaatatctttagcaggattgattttttaaaatccctaaagatcgtgagacatgttaaggacgctttttagtgactctgtaataagtgggtggaagaattgggagttaaatccatctgatggatcaggttttttatttttaaaaatgtgtatttaagaaagaaagcattttcattttaactgccaacaaaactaaacttcatgtgttttccaatacagtgtcacatgcagtttttttgaattatgttgagacaaggcaattttcagctaaatgttctttagaagctaatgtttgaagatattaaatatagattaaattctgaaatgtagttttcattctgtactttttgcaagagaagttgcctttttgatgactctggccaattgttattttaaaagtaaatgctctttctcccgatttgattgtggcagcatggaggaatctatgtaaagcgcagtgccaaatttaacgagaaagagatgcgaaacaagttgcagagctacgtggacgcaggaactccagtaagagcctacccgtttttatttttcttaccagctctcagtttctaaatttaagaattaaattaaaatctaagaattgttttgacaatgtattttcccatgtgtaattactaattcagggttatgctgaggtaacagaaaccctctatgtacaggtaggcaggtttttcagccatcagaaagattgctgtaaacaactaggtcctttgctggtcagtggaccttaaagaggaataaaaagagcatttggtgtcgttcagagtctataaatagaactaactgcattttaacctgacatttaagctagtttacaagctcatcttacttcttgtcttctttagtatcagatttggttttagaagcagcaactgttttctgttagtgcaaattttgaatgtcttacatgtacagaaaaaccaaaaaaggatgaatctctacaaatgttaaatcattcagtgtaaataatattttataaaactttattccacaa

SEQ ID NO: 128720 - DNA, 1074 bp, Homo sapiens
aggactacagacatacacgtgccaccgcgcccggctccgtgttctctttgtttccctgcctcctgctcttccacttatctttgcatggcaggtgggtgcacgcaggcatgctctgcatgtcttcctcttggccattccccttctagttatggtgtggctttatctacgcgttctggagcagaagcctagtcacaaagctatttttttaaaacattcatgataattcatttccttttatgttttaaaaatactagctttctgtctttatttccttactaacttacttggatgccagtaattagttgttttagtgaacaccacagagtgatattttgaaactttggacttcataaagttggatgagctccagtagcaaagaaggaagtgttaactagtttaactgacaaataaatgcttcccagcttggtgtgcgattgagatttttgttgcaagtttgtgaatcaatttaactgcccctgccctggggactaaagtcagatacgtgcttgtgggaatctttgtctttcccacaccaccctgcattttaaaacctcttgtgtgggacagtcccaccatgtaatagctgttcttccttactcagctactttccctccagagaggccagtagaaaatctagactagttttttatagtctattttcatgtcacttattgagagctactgttttctgttaaattgtcagtaaatattttaatcaaggaaaagggaggtaataggaaggagagaagaacaaatccttaaccctagtaggaacctaatgaatgggatttgttctggataattgcagtagtcccccagctaaagaaccttttaaaaatatgtcagatatacccaagaggattgaaatcgtatgttcatacaaaagcttgttcacctgcagccttcatatgcaattcctatgaatgttcatagcagcattattcataatagccaaagtatggatgcaacccaaatgtccatgaagcaattaataggtaaacaaaatgtgatctgttcacacagtggaatactaactattcagccataaaaaggaatgaagcactgagtcctgca

SEQ ID NO: 128721 - DNA, 1991 bp, Homo sapiens
ctggcggaataggagctccatgtaaaaaggaggagaagctgcagcgggttattagccatttgtgagtcaggtcactgtaaaactttatcaaaagtttaaaagacaaaaagcatcctcataaaatgccttaaaaccacctgttgaaatattacatatacaattcatgtatactaatcatagagcatattaaagatattttagaagactagaaacttctattaaaccaagtttctggatgtttccgtattcatccttattttccagggacctgcataacttttccagcgtgtaatagctacctgattgatattttttgaattgaaatactgaagtgactaaaatctaaactttttccattctggccataggatgcttatagaattttatgagtcaccagatccagaaagaagaaaaagatttcctgggaaaagtgttaattccaaattaagtatcaagaagactttaccatcaatgttgatcttaagtggtttgactgcaggcatgcttatgaccgatgctggaaggaagctgtatgtgaacacctggatatatggaaccctacttggctgcctgtgggttactattaaagcatagacaagtagctgtctccagacagtgggatgtgctacattgtctatttttggcggctgcacatgacatcaaattgtttcctgaatttattaaggagtgtaaataaagccttgttgattgaagattggataatagaatttgtgacgaaagctgatatgcaatggtcttgggcaaacatacctggttgtacaactttagcatcggggctgctggaagggtaaaagctaaatggagtttctcctgctctgtccatttcctatgaactaatgacaacttgagaaggctgggaggattgtgtattttgcaagtcagatggctgcatttttgagcattaatttgcagcgtatttcactttttctgttattttcaatttattacaacttgacagctccaagctcttattactaaagtatttagtatcttgcagctagttaatatttcatcttttgcttatttctacaagtcagtgaaataaattgtatttaggaagtgtcaggatgttcaaaggaaagggtaaaaagtgttcatggggaaaaagctctgtttagcacatgattttattgtattgcgttattagctgattttactcattttatatttgcaaaataaatttctaatatttattgaaattgcttaatttgcacaccctgtacacacagaaaatggtataaaatatgagaacgaagtttaaaattgtgactctgattcattatagcagaactttaaatttcccagctttttgaagatttaagctacactattagtacttccctttgtctgtgccataagtgcttgaaaacgttaaggttttctgttttgttttgtttttttaatatcaaaagagtcggtgtgaaccttggttggaccccaagttcacaagatttttaaggtgatgagagcctgcagacattctgcctagatttactagcgtgtgccttttgcctgcttctctttgatttcacagaatattcattcagaagtcgcgtttctgtagtgtggtggattcccactgggctctggtccttcccttggatcccgtcagtggtgctgctcagcggcttgcacgcagacttgctaggaagaaatgcagagccagcctgtgctgcccactttcagagttgaactctttaagcccttgtgagtgggcttcaccagctactgcagaggcattttgcatttgtctgtgtcaagaagttcaccttctcaagccagtgaaatacagacttaatttgtcatgactgaacgaatttgtttatttcccattaggtttagtggagctacacattaatatgtatcgccttagagcaagagctgtgttccaggaaccagatcacgatttttagccatggaacaatatatcccatgggagaagacctttcagtgtgaactgttctattttt

SEQ ID NO: 128722 - DNA, 1036 bp, Homo sapiens
cctgacctgcataagatcacttgaatgttaggtttcatagaactatactaatcttctcacaaaaggtctataaaatacagtcgttgaaaaaaattttgtatcaaaatgtttggaaaattagaagcttctccttaacctgtattgatactgacttgaattattttctaaaattaagagccgtatacctacctgtaagtcttttcacatatcatttaaacttttgtttgtattattactgatttacagcttagttattaatttttctttataagaatgccgtcgatgtgcatgcttttatgtttttcagaaaagggtgtgtttggatgaaagtaaaaaaaaaaataaaatctttcactgtctctaatggctgtgctgtttaacattttttgaccctaaaattcaccaacagtctcccagtacataaaataggcttaatgactggccctgcattcttcacaatatttttccctaagctttgagcaaagttttaaaaaaatacactaaaataatcaaaactgttaagcagtatattagtttggttatataaattcatctgcaatttataagatgcatggccgatgttaatttgcttggcaattctgtaatcattaagtgatctcagtgaaacatgtcaaatgccttaaattaactaagttggtgaataaaagtgccgatctggctaactcttacaccatacatactgatagtttttcatatgtttcatttccatgtgatttttaaaatttagagtggcaacaattttgcttaatatgggttacataagctttattttttcctttgttcataattatattctttgaataggtctgtgtcaatcaagtgatctaactagactgatcatagatagaaggaaataaggccaagttcaagaccagcctgggcaacatatcgagaacctgtctacaaaaaaattaaaaaaaattagccaggcatggtggcgtacactgagtagtttgtcccagctactcgggagggtgaggtgggaggatcgcttcagcccaggaggttgagattg

SEQ ID NO: 128723 - DNA, 1051 bp, Homo sapiens
ttgtcattgggtttaacaagtgattgttctaaggatgggctgatcagctcagcttgtggagacagcgtagccttcagaaagacaaaccctcgggttgggttttgagaagtgagtaggagtttgccaggggaagtgcattacagagcaaggaaaaggggatcctgcccaagagtttaggtgtcatcaatctttctttatagttcatagagtaaaataataacaaatgcatccaatacatcactcattcaaaaagcatttaattcagctgttactaacgtccgtgtgagaacgtgcctgcggaatcgctggtgatcgttctgctcttatgccttttaagagctctctagacagatggacacgcaccgagttgctttgagaatgtcagacgttagaggcgtatagatcacagtaactgtaggagggaggggagatttaaagcatccaggttgtcttaatttacttctgtctggcacaggctttgtgtgtacttgactctcctgggaagcttcctgagctggggcctgaatacaggtgtggagggagctctgtgggcagagacaccagaggggcctcaccaaaagccaaaggccccacccgcatccagagtggggagtggagtggtcagaggagaggtgtgtgactttcccgacggaacacatcacgtcttatgtgttggcatctcctgctacacagtgattctcagagcttaggggtgattttgtatcaatctctttattagtttgcttgggctgcgataacaaatatcacagagtgcatgactcaaacaatagaaattgattttcccacagttctggagagtagaaggtattggcagggctggtttgtcctgaagcctctctccttggcccctagacgtgtgttctccctgtgtccttacaggattttcccccaggtgtatcctcgtcctaaatctcctccatgtgtaaggacccagtcagattggattagggccatgtaatgacctcgttttaccttaattacctctttaaagtcatatctccttctgagtattaggggttaggacttcaac

SEQ ID NO: 128724 - DNA, 1106 bp, Homo sapiens
aacttagaaaaggttagttaacggtgacaatgattattcaatttgcttttggagggatgaccaaattctattagtccagagaagagctgactttgggcaggacagcccataccagtctttggtaccaagaaacgtgaagcctggcaactagggtgccttcttgccttgttgtactacgattttttttccaaagtagatggctaggagcttttggatgatgggtagaaaaggttaaaaccaaccaactggcccatggtggcagccaagcagccttaaaccccaaagccagaattcagctggaaaaatacacagttccaatgtaagaattaaatttagagatgaagacaaattacctaattttgggactttacccaggaatccagctcaaatagcggcaatggggtcagctggttaatagaaggctggttcctgtgtggctctctcactttctccatgctagccaaggccagcctggcctggcgtctttcctcacaccattaacacagacaactaatgagatgttggaacaagcccagagaaaaaacttgtttagagcacttcctctccacttcaccggtacaaacatctattctgggtttgggctattttccaagttgggttatatgatgataaacaacaggttattttggcgagtaaaattttagctgggtacttcgcaaaacaatttttaaataaatttgaagaaactattaagtggaaaagttaaaggcataaagaattgtcggtggttctaaaagtgtttttccctaagcttcttgtttatttcttgatgttgtggaaagaccttcttggccacgtttttcatgagttatctgtgtttcccatagatttggggtctagactctcaattatttatcttatttgaaggataaaagtggaaagttcaagaaatcgatagttagctggcttgaatttgctgagaattcagaacaatgttcacaactaaaatttgcaaagtaaatcaacagaatacaaagaagtaatttaacccagaatgacaaaatgaaaggatggttcccatgtaacctcataaatttcctgcttgatgcatctcaagtctctgatttctaataaaattctcatga

SEQ ID NO: 128725 - DNA, 1659 bp, Homo sapiens
acctacttaaattcccccgaaatatccagttctgaggctccaacaagagtcctattttggatcccaaattatcttcctctacacaaaagggccagaacctgaaactgcacaccagagggaggatgcagacttcaaagaacataaccttgtggtctttttgttctttttcaggcagtgtctcactggtaatttattacagcctgctgcatccaaaatccacagacatctggcagggctgcctaaggaagtcctgtggcattgcaggaggtgataaaacagagagaagagattctccccgggccacagatctagctgggaagagaaccgagagctcaggctcatgccaaggggcaagttatgaaccaaccattttagggaagccccctacccctgagcaggtccccccagaggctgggctggggacccaggttgctgtggaggactctttcctcagtcatcaccactggctgtgggtgaaacttgccctaaaaacaggaaatgtgtctaagatcaatgccgcctttggagataacagtcctgcctattgtccacctgcatgggggttgagtcaacaggactacctgcagagaaaggccttgtctgcccagcaagagctcccatcctcatcccgtgacccctcaaccttagagaacagctctgcgtttgaaggtgtccctaaagcagaggccgacccattggaaacctcaagttacgtatcttttgccagcgatcagcaggatgaagcacctacccagaacccagcagccacgcagggggagggcaccccaaaggaaggagctgacgctgtttctgggacacaggggaaggggacaggtgggcagcagagaggaggggaaggacagcagagttccacgttgtacttcagcgccactgcagaagtggccacatcctcacaacaagaaggcagcccagctactctgcaaacggcccactctggaaggaggctgggaaagagcagccctgcccagcctgcatcgccccacccagtgggcttggcgcccttccccgacaccatggccgacattagccccatcctaggcacaggcccatgtagaggcttctgccccagtgcaggcttccctggaagaaccctcagtatctcagagctagaggagccgctggagcccaaaagggagctaagtcaccatgcagctgttggtgtgtgggtgtcattgccacagctgaggactgcccatgagccctgcctcacgtccacccctaagtctgagtctatccaaacggactgcagctgcagggaacagatgaagcaagagccgagttttttcatctgaccacagtcatggtgggataagacaacaggctgacaaaccaagctggccatttggtaccgtgagaaaggaaatcccacttctgacacctgtgtccttgggcacatcactgtcacctctgaatctccatctgcatccctgaaaaatgaagaaacagggctggatgattttgcaggtccaatgcaaacatcacagaccccacccatgcataggagagactctaacatactttagaggaggagaaagagattccagtcaaaattgtctgctaccttttatgagctgtaggttcccttattttatctttttgctgtggcttctaggaaacacaaaggtaaaacccagattc

SEQ ID NO: 128726 - DNA, 1047 bp, Homo sapiens
ttgtcagcctgcgagctcccgtctccggctgccacctggtggccgcaaagcaattattttaaggaaacaaaatcctaaagttgttagaaagtttgtgaccctagctccctggaattcagtggcatcatgagctctgcagctatctttcattttaacactaatgagtgcctgcagttagtgtgaggatggagaaatatgcaaagtagaaaataaaagtcccctctcagcccataatgactctctaaaggcagccccacagccatttgagggatgcccttacatttcctgggcctttatgattctgcagacactttaatgagccaccctgagaacagggtggctctctctttgccagagaaggtctcagtgggacatagccctgctcctgggtactcctcagcagcctggagtctccagtgggcactcaggatggaggggagggggagccgctgcagactcacgggacgggggtccctaggcagtgtgcacctgacgaggtgtggtgcctctgtcctgggtcccgcaggtcatgctgttggagaacatcatcctgttgctgttggccaccgactttctccagggggcatctgtggaccagcctgcagaccatagctggggtcctgtctggatttctgattggtaagtcccaatgtcaccttcttctctgcatcccctccccaacgtattttttttttttacaatgggctcaaagggtaggaaactgagttcagatgtggttaactggagaccaaggaaccaggctcactgcgatgtggggggcagagccatgcccatcagagcatgagatactgagctcagcctcatctgccttgcttgactgtgctcggaacctcaagcaaagctggggctatccctctctaccccaaagcccccgtcctccccggagcttcctgcagggttgaggacgtgacttctctctcccctcccacctaggggagctcctcacatcttcctgacatggcaccccctgcagcccatagacaagcaccccgggaagtgggtgccctagcagaggaggagaggaag

SEQ ID NO: 128727 - DNA, 1001 bp, Homo sapiens
ctgtaaaagttaggataaagaaaagtgccacttgccatgtagaacgtgaccatcctatttctagaagggctgtcccagaagctgaggtagcagaggatgtacacggcccccacgagcaggttgaacagcctccagtggcaggtgctgtcgatgatgtcactctgctgggcgacaagccagaatgtcatcaccagccagtgggcacctgcagagaagccgggtgcagacgtcagggtccatgcaaggagatggggggacaggcaaggacacagagaccaggggctggaaggctctccgaccacatttgactcagcatccaagaagagatatcaaaacccagaagagatttgagggggacagaaaaccaacacagtttatctttgcatgtattatcccattttatccttataaagggtatctgacctaatttgaatatgacacaagaaagagtagcttcaataacacttgccaaatattgtatacctatgacctttttattccagaaagtgtttaaaggggcagttataaaactgactgccaattattttaaaattgttacaagagcaaaaaacctccacatgcaaaggaaagaactctatgtggtgcagctttaatttttatgcccatattttaagacgaataaatcattttggatttcaagctgattttttttaaaaaaagaataacaaaatagctaatctctctttagaagcacagttctttttttcaaaaaaattatctttttggccaataactgtattcaatgtttgctctaggcccaaggggcaaatatttcttaatgtctccaattctcttaaaacaagagtaaactgttccttcttgcagagtatattcactgatgaccagagatgacagctctcctcggcagggacacacaggccctattcagggaatctccagagccagatagactctctgtcattgccattcatattgcgtgtgcctagactgagggaggagggagggcttggatttagtgg

SEQ ID NO: 128728 - DNA, 1034 bp, Homo sapiens
ccctccccttcacccccttctctccctccccacctctccccttccatcttcatctctcccttcctctttgctgagtgtccacaattgcatatgcacaaattaaatgcttcacatatatgcctgcactgtccttccatccatctttatcaaagagcctgacaccatttgatgttttcgttcttttattaaacctccttcatatggataaaacagcaaagtacatttggggtggaaccatgttcagagccttgtagaatcagctttgttatatacagaggacttagaggatcaggagctgggacgtttttcttaaagggcgtagaaaggaagagtccagcccatttgctgggaagagcatttagtacattgagcagtggaaatatttcctgcatatccccatttcttcctgaatatagacaggtgtatttggacatagagttgttatgttacctactggtcaaagtggtgggttagtaatactctctgtgcagccaggctttaacaagaggttacacatcccattaaagaaatgccatgagtgaatcttcacaaggtactgttacttcggaatcttcagagcataccacatctttctgcttccctttcaggggtgagcaccctgttttcctggtcctcactctcctgggcactggtgtcctacactcgcttcatgggcttcatgaagccaggccacctggccatgccatgggccgccctcttctgccagcagctctggaggatgggcatgttgggaacccgcgtgctgagtctggttctgttctacaaagcctaccacttttgggtttttgtggttgcaggtgagctgagctaatgatctggtcatctgttgctgcataaccaatcaacccagaaatgaaggtctcaagaataaccacatatgatcctcaatcccaggcctgaaggctgactgggctctctgctgaatggatcttgcttgggtggcctcagagatggcaatggggtagcagatgttcagattcataaagagccttgacaggaattagcagctgaga

SEQ ID NO: 128729 - DNA, 1039 bp, Homo sapiens
ggaaagcaaagtttgctgtactcacaggtcctaggacaggagacatggcacaccatgccgggccacaggggaatgtcaccagggtggtcaggaggcaggagacaggaaccaggggaagttgaggccagacgctttgctagggcagagcaccagcttcagattagccctttgaataatttctgtggctttggggtataagggtggtccctagtttcctggcactgggccctgggatgattaaggcaaaagaagattgccttctgcgggggtatgggccaggtaggggaggtctggctctggctagatttagttcgcatgtcaaaggcaagctcctggctgggccctttgctagctgaaataattgctagccttgggagggacagtcactccccagccagaaagattttaagaggtcagaacatcataacatccagaaaatgttcagttgtttaaaatgcaggtacccagtctcactccagccttccaacaacctgcttgcctttccccttctcacccaggcctttacaccgtggcttactacttcaccacaggacggcttctgtgggggtggctggcccttgctgtcctcctgcccgggttcttggtccaggccctgagctacctgtggttccgagcagacgggcatccagggcattgctccttgatgatgctgcacctcctacagcttggtgtttggaagcggtaagaacagctgcctctttcacctctggagcacaattgcacaagtgcagtgagaggaatcttctctccatgtggattctgtcctcaagctcataaaagttcagcattgggaagaggttcaaagcggccacagcaaacccctgctctgatattggcatgcccgggtccagcctgcacttttttgagcatctccaacctcaggggctctttctctgtgaagctgtgaccttacgaaaggctttttcttgtcttcagatgaagccctgtcttgctgttttgatttgttggttgagccgttagttccatataaagcaacttacttaaggcagttccatct

SEQ ID NO: 128730 - DNA, 1115 bp, Homo sapiens
ttcctcaccctgaaatgctgttcctcatttctctacatagtgaactcatcccaccccctaggcctctccttaagtgtcatctcttcaaggaagattttacttttttaatattactattataattcaggtaccgtatgctttgccaatttaaagtgaacaaatcaatagtttcagtgcattcacagagctcggcgaccaccatcattatcaattttaaaacattttcatcactccaaaagaaaccctgtatccatgagcaggttcctgccatttcctcctcccactaagtcctgacaatctactttgagatagagtctctatcacaggctggagtgcagtggcacaatctcggctcactgcaacctctgcctcccaggttcaagcaattctcctgcctccagagtagctgggattacagggatatgccaccacgcccatctaattttgtatttttagtagagacagggtttctgtcttcatagatttgcgtgttctggacatttcatataaatgaaatcttctaatatgtgaccttttgtgactggtttcttctacttagcataatattctcatagttcatccgtgttgtagcacgtgtcagtacttcattccttttgatgactgaataatattccattgcatggtcaaaccatgttctatttctccactcatcagtagacaagcatttgtgttgttttcactttggcgctattatgaataatgttgctatgagcatttgtgtacaagtttctgcacggacatatactttcatttctttcataaactggagtggaagtgctgggtcatagaactctgtgtttaagcttttgaagaagtgccagactgtgtaagaaagaaagcctttcctcactccctctctccatttatacgttctctttatgccctttgcttctctttcagagcaattcatgttgacctgggtcaccctcaacttaaggctcataactcccctagatcctcagggtccacactaaatgtaatgaaatatgatggaagccacatatttacttttgcattttgtagtaaccacattttaaaaagtaaaacaaaagaagtgaaggtaattggaataatatcacagatttaaacaaatc

SEQ ID NO: 128731 - DNA, 1093 bp, Homo sapiens
accgggcacagtagctcacacctggaatcccagcactttaggagtccgaggtgggtggatcacctgaaggtcagaagttcaagaccagcctggccaacatggtgaaaccccgtctctactaaaaatacaaaaaattagctgggcgtgatggtgggtgcttgtaatcccagctacttgggaggctgatgcaggagaatcacttgaacccaggaggcagagtttgcagtgagccgagatcccaccattacactccagcctgggcaacaagagcaaaacttcatcaaaaaaaaaaaaaaaaatcgtaatatgtgtagataatgcccaggtatccctgtgaagtccacatttcaggggagctgtatttcacctgatgaggtttgtgtagctacaggactttacttctgctgggcaagggcgtggatagggaatgtttgggtatgcagtgctagcctctaatgagtgtgtgtataatgcggcgagtactgagtttggtgccccaaactcatagcatctaagaaacaaagaaaaattaatcagtgcatgtgctaattcttgaagttaagcttctctgctaatacctagtaccccttgtcagatttacccaagtagtgatacggtgtagatctgatcaaagtcactgactaacagctcctacaggaaagcaagagaaaacagagggaaggacaaaatcacttccttccagctgcctgaatacacgaagggttttttgtgctgggacctaccatacagtctaaagcagaacctcttggttctctttggtcatctagggaattagaagtgttaccgattatgttgctaaaagatccctggtctcctcacagattggaaaatgtaccagtggtaatttgtgtgaactagacatagaaggaagaacaattgaaccgagataacaatctgcctagagctatttgatttcaggggcagctttgagacaaaatgcatgttcagagaggttgaaaatggagagagtagctgaaattatagactattagtgctgcaaggggccttcacaatgatgtcatcggtcattttctaaaggaggaaactcaggcagggcaggctgacagctggt

SEQ ID NO: 128732 - DNA, 1026 bp, Homo sapiens
catgtcactggaagtctggttcacatttaaagttttccttaattccaagaaacaatctagaccctttgaagctttggcaaaagagtaccaggtaaaaaaagaaatcccacttgtaaaggcctagtttgcaattcatttgtcctgggatcttgcaaaaacaacccaatatctgtatgtctctatacattggtgtgtatgataatatctttatttttctttgtagagattttacacaggatataataagtgacacaactgttttggcagatggggtcagaatatgaaggcaattccttccatgtaagaattttggtgcttgtttaaatttaatagactcgcttctcctaaccacactctggaagtctcctgtcattcatgcacataagaactcagaagagaacctctactgtctccccaaaatcttttttttttcttttaataaacttgctgacattggccaggtttcaagagcatggtaagttcatgatccatcagcctggtttctgaatggaaatccaatgagttatttgtattgtttgttcctaccttttccaggcaccttctaaaaatgaacaagagcagctctgatttggaaaaagtgagccagggctctgcagaaagcctcagcccatccttcaggggtgtccacgtcagcttcaccaccggctccacggacagcctggcctcagactctaggacctgcagcgatggaggtaacaaacttgacattgacggagaggcttagattctcctggaccttcaagaccagtcctgcgttgcttgcgggattggaagggctgagcaaggactactgtcttggtcctgctttctcaatgaagtagactcttccagggagctgttgaagtcaattatctactgaatatatggcaagccagcccatccatattgccctctccaaattataagagtgtggacgtggcaacatggtgggaggaagatgaggttgaaaggctcctatttccttgggtaatgagccatctgtgtacaggcctgctttttacttct

SEQ ID NO: 128733 - DNA, 1023 bp, Homo sapiens
gtcccagtcacatgggaggctgaagcatgagaatctcttgaaccggggaggcagaggttgtagtgagccaagatcacgccactgcactccagcctgggtgacagaggttgtagtgagctgagatcatgccgctgcactccagcctgggtgacagaggttgtagtgagctgagatcatgccgctgcactccagcctgggtgacagagtgagactttgcctcaaaaaataaaaaaaaaagatgtgaattgatctctcactagaggagcttgataaatatttctctcctaggtctgcaggtttgttcaagcacagggatcttgtcagctctgttaaccattgtatccccaacacctaacagcgcttggcacagagtcggcttaatgctgaaaagcctgggaaaggtattcaggatagacaaggaggaagatccactgcaggtaacacaggcatatgataagttaaaaacagagtgttcttatccaccaagaaaactcgaattgcttaatgattttgactttagtaagtggctaaatagtagagaataaatgaagagaaacttagtgtattttagagcatatttgaattgctttgaatcatggagccaaataagacaattggagattgaaagctgcaggtcagagaggcagagccgtctctgttttcctgtgcttttgcaggaagtgcattttatagaaaagtcagagaggaactgaggggaaacagagagctctgagctggtgaattcacagcagcctggagaagcattccggctgcctctgaagctggctcttcacacccaagggctgccccttgggaacctgaagtcactgtcccagctagtcacaaggccggggaggcctcactgatgaggacagcactacgggcctgagtctagaatggtaagaggttctcagtctttgagacaattattggttgtttgagtttaaaaccagtcttttcctttcttctttgtaattgaaaaaacatgtatagactgtttaaaaacttgttcttgctttcaga

SEQ ID NO: 128734 - DNA, 1048 bp, Homo sapiens
cttcagcttatgtatgcccttaaagctaaaatggattttttgtaagcaagtacaaaatctttattcaaagaaaaactcaagatataaaacaaacatacaggtataccaaatatagtgtgtatacctagaagtgagatattgggaaagtggcaaattagagtagaggtagagatgaagggaaaaactaaaataatgcagaccaatgtaaaaatgtgtcattaattaggcatatggtcatctcacttctctgcacttaagaactaacaggaagagaaactgtgagtcatggagaaatagaggacttacttgagagagatgagtatggtgactaagaagatgaataaaagtgatgaatgcttggaacagctgatttgggtcaagtacaagcattaccagggagccctgagaggtagtatgaattaactgtggccccaacctgcatagttgtggactttttcctggagaagcactgggctgcctggtacaggaatgaggatggaaaatgcttggggatatccagaatggggaggtcaactgagtctgaagacagagagctggacctgttgagatgcagataagagagtgaagaattgatcagggagtgtggagagaacctgtgatggtgtctgctccttattgggcaaaaggctgccccagcgtgaagaatggggaagtagctcatcctaagagctttggtccaaataacctctcaagctagaagggtagaaatgaagtctagtataaaatacactgaagctggttcaacaaagtgaatttgaaatattcaccaaatcaagaaaattagggtctgagaattctgaaagcaaggtcaccaaaaccattagtctagaaacacaaagattctggtcaggcacaggtgatcttggtgggatttcaataggattcgatcaagcccagaactgcagtgactcccaagtgggtaacaactcactagtgtttttgtttaaccaaacaccagaggtagatgtgtgctgggggatgaggagatggtgtgaagggagaaaggaaagttctaggaggctaaggg

SEQ ID NO: 128735 - DNA, 1048 bp, Homo sapiens
tcccaaaataaatgggatcctaatctttacctttttctcctccttctccctgatcaaatagtgagactctaattgataatgcacccattgtctggcatggcaaatctctaatcaggaaactgtcctgcctttctaggaagccgctctgtgacccacctctgaatcccacaaaactgcaccagagagccgggcgcaagatgaaccagcaccctgtcggctcaagatgcaccagaccctctgcctgaaccccgagagcctgaaaatgtctgcgtgcagtgactttgtggagcacatctggaaacccgggtcctgcaagaactgcttctgcctgcggagcgaccaccagctggtggccggccctccccagcccagagcgggcagcctgccccctccaccgcgcctgcctcccaggcctgagaactgccgcctggaagatgaaggtgtgaacagctcaccttactccaagcccacaattgccgtgaagcccaccatgatgagctccgaggcctctgatgtgtggacagaggccaacctgagtgccgaagtctcgcaggtgaggctgactaacactcgtggtatttttacaggggctgctcctgtttgaacacttggtgactggctggcagccagggagggctgttccagcaagaaacctgcaggatagcttcctgtcagtttgccctgagatggctcctgcctgggattcgctgtagctgctctcctttctctctgtccctttaggctaagaatcattaatccagtcccccagaatttcctcctgtgatttgcagactgtgtagggcagacaaaaaatgaagcttttttaaaaaaaagttttaaattttcttagttgatcattttaaatatatatacaagtagcaataattgcaaagtgaattgcatgcacccaatacccttcaatatgaacttcagcaaccatcaactcctgaccaatcttatttcacctccctcacactgacccccttccctatgattttaaagcaaacccagatatcacatcatttcaataaatacctttcaaagataa

SEQ ID NO: 128736 - DNA, 1082 bp, Homo sapiens
taattggaatctttcaacagtaacagaaaattcttggtttttttttttttttttttttttttttttgagacagggtctcaactcactgcaacctccaattcccagggtcaagtgattctccctcctcagcctcctgagtagctgggactacaggcatgtactacctcacctggctaatttttgtatttgtattttttgtagagatgggattttgccatattgccctggcaggtctcaaacacctgagctcaaactaatccatgcacttcagcctcccaaagtgctgggattaaagatatgagccaccatgcccggctgaaaatccttagccattttcaaattgaatattgctacttccccattctttctattatgttctgtaattctgattgtgattctgtgattcttaaactcactccatactataaaattcttaatatcttctgaaaatttttaatttaattttctctttgtgctgcattttggttaattcctgaagagctattttccatttcactaacctagtcttaagctttatttgttatgtaatttgaatattgagttttaaattgaatttactgtatttttgttttcaaacattattttgagatcttttatattgattttataatctttcactcatgatgccttgcgtttatatatttgttataattttgattgtagttacatgttccttggtgctttacatttagtaatttttgaaaccatgtttgaaggtaagttccttcagagagaatgtgcatttacttctacctggcaccagaagggcactcccttcaaagggaaactttaaaatcaattctaggtttgaagtatttctgctaaaaaaattcctatggaaattggattatggttgcgagttctcggtaagagagactagctccaagattgaaaaaagatgtacttcttaacagttccttctgtgggttcttagctttgtcacatgttcatagattgctcgtgggtttttccttacagactctcctctttggttggactcaaggatttttcttacgtctctcacactttgcacagttgtcaaaaccagaactcaaataaat

SEQ ID NO: 128737 - DNA, 1048 bp, Homo sapiens
accccaatttcaaatccccagggagctgtctgatctgcctgcttcagctcctctcagcctgcctggtgctgccgcacagaggaattggctgcccgtggccgggtggagagtcctcgtcttgtgtgtggccagggtctcaaggcctcatgctacacacttgcgtatagcatctcgtgcaggcttcaccacagtcttacgaggcatgcggtgaccttgcccttagacgtgtgcactcaggcctagagctgtcagagccatttgtcgagcgacccgctgctaggagatggcagagctggagccagaccccaaagccagcgctgcgctgttctccttttgacgcgggcttatccacagttaatcagtgatttcctcagatgtccacatgctcctacggtgactaaacccagctgtcttttgcacatagttggaaaagttactattaggcacctagactaggtttgatagcaataggattttattaaaaccttgatggaaaacctgcgtagtatctgctaacatctttgcatgcttggaggcagaggaggatttaatatacatcaagtctgtgtagcaacatcaaaggaagatttaaacactgctggcttttttgtgcgatatttaaaaagcaccccccaccttttaagaaaatgtgaagttctggcataaatcaaagtgtgattaatcagtgatgattgactggtattttcataacctgtggcattaataacaactttgtatggacataagagttgtaagcaaatttgggagggaggttactgcttcatgctattctccatgccgatcttcgatctttgtacatacttacttgcattctgtaaaattcggcgtgatgaaatccaagaaccaaaaatgcagggtggaaataggcttagtagtaagtgaccttctatttccacttcccacctccttgttaagattctttgacctcctgccacaggggccttagaggcatcctgtaagctttgcacagaagctgctaatcccccggcaggcagttcaggcaggcagttcattccgtttccacctg

SEQ ID NO: 128738 - DNA, 1051 bp, Homo sapiens
atatattatagattggagttcagcacactttttctttgaagggctagatagtaattatttctcgcttcgcaggctatagcctgtgtggcaaccacctacctgtgccactgtagtagcatcggttagcagaattgcactaccttggaaagcagtcgtagataatatgtaaatgactggctgtggttaagttccaataaaactttatttacaagaacaggcagcgggccatgttttgccaacttttgttctaaataatcacaagaggccatgaaaagtttaatttccatacatgagaactgggtctgaatattgactcttctacgtagtataatgggtgtcccaaatactcttacccagtaaaggatcttttaaaattttaagttgaaaccatattcagtggcaggaatcctgaggaagtgagagagaaaagctttataaatattaataagtgctgaaaattaagttgttgaaaaaattgttcacataaaagatcattatatagcaagtttggaatttagtttcaattttcatttccttgtagaaacatcttcatcgtgaggaaaatgagggaattaatgaacatttgtttcctgagtgtgagctgtgataccttgtagtcactgagatggcggctgcatgatgggtatctcgtaactctgctccgggatgcccaccatctagaaagatgctcaagacccgtgggacaggatagtgtttaggaatgtgtgttttaaacttttcttgcagtatttaatttctaaataaactttattaaggtataatttatatacagtaaaaatgcacctatttttttaagtgtgtgatagattctatgggttttgacatgcattcactcccaatcaagatagagagcattcactcccattaccccaaatgtaccctcactcccctaatgctcaccctcgaacaaccactcatctgctttctgtccatgggaattaggttgccctattagagagcttcctatacattcagtcatttagtatgtactttttttgtgtctggtttagaggtttgcaaacttccttgg

SEQ ID NO: 128739 - DNA, 1063 bp, Homo sapiens
gttgaaaatcaagttggggaagaggaatggtcagtaatccaatatgccaattataatttaagctttgagaagatgtaagagaggttcaggggatagagtgtgatgggtggtgcatgagagatggtctgagaaggaggcatctgaagcagagagctgaccttgcggagcttcccgtttatgcccgagaaggtggacagaagccagccctgcctctgcagaattagagcacgccagttgtgtcatttttagatcttttcagataagaagctggtgcaagagtcatgctaactttaaacaatgacaggtgtgctgtgtatatgcctaggcttatttgtattttggtaaacaagactggctaagtgtgaatagagtcatgttttgaagaagtctggactatttcctaaaatgagcaaatgacacatttgaagcctgcatctggtgagactacctgtgagtcatttttcccattttaaagagaaatagtaatattgagacaatgattaactgacttagaatcatacagtttttagggctcctatggaaggacctttggagacaacgttggttgatttttcctgtttctttggatgacaaagctgagcctgagaaactgcccacagttctcttgctaggttagtagtagaagggctgacactgcattctgggcttgctgacttcagagttctttcttctccatctgtcattcttttcaaaaggattagaatttgcgtttctgtgcctttcagcatgacacccatgtaggtagagtcccagagaacagtggattgttaattacttaaattgatcccacaatcccttataaaataagattctgctattttttaatattttgtcctctttaggcaggtaatactgctttggttaatgataaaacagaggtaattaattcttcaatttctacctttccatttttggaccttagcgtaaaagttaaatttaagagaaatgtgactccttttccagcctgtaagatagggatgagttcgctgatgtttatgggagcaggtgcagggtgacgtgtggggagaaatgagcctctgcc

SEQ ID NO: 128740 - DNA, 1035 bp, Homo sapiens
ccttgtacgtgccaggcactagcaatctaagttgtgtgtggttttttttttttttttttttttttaagaatgagcagacaccttgtgcgattgtccaggttaactaacaaaaatagttgtctgggtttatggaactgtaattacgagtcagatcctggttcccttccgctttctctgctatttctggttgctcctttttattcccaaaaggtagaaaggggcaggtaggacaggagcttgccgcctgttgaactagagggagtagcttccgagcaaactgtgacaaaatggggtattttaagcctccattttttttggggggtatgtgagtgtgtgtgtgagtcggtgtatatgtacacagtgcaagtaaataagcctgagtgggtggcaagagccttgtttgtgtagtaggagaaatggagcctgcaggggcatagtcggggtcttgagagcagacacacggactgagccaggcagttgctgctgagaacagaatcaggacctcctgcttcctttgggtgatattgggttttttaggccaccttcccagccacaaagtaggactctgaaatacatccgggtataaatgttcttatggaaatgcaatcacttctgactttaagtatgtagaagtgagggctcatacccttctcccagaatgtaaatttgactcatcggggctaacaacaatgatagcctaatataagaaactgtttaccggactctgttctgatgtcagccaagctagagctttgcatggtgggatgctttctcttggctgtgccctattagggaaggcaaaaatagaaagctttttctctggacttcagaacggaattaatgcatggttattaaaagcatcaatggcaaatggccatggaagtcagaatctcagccttaatgaagggcgatggtgtccacagaaccaattattttgcaaagaaataaaataataaaatcctcccattggttttagagtggctgaaaccagcaggcaccaggtctaaaccctcttgtgggtgtgtgtgtttgtgt

SEQ ID NO: 128741 - DNA, 1039 bp, Homo sapiens
gtgatttgataagattaatttcaacaggactgatgtggaacggctgctagcttaattggtttattagggtcgtgtagccaccctcttatgatggataccaggtgaattccaggagatatatagtcttaggtttgtaagcagtgccatttgcagaggaataaggttctttatttcttaaatttggaagggtctcatagaaataagagactttataaatatctagtaacctgtcaccgctttaaaataccgcaaagataaatgatgctgattgtcgcgtgcttggcatgatgaattatgtatgtagcgtgccccggagttctttatggttgtgcataacgaatcagcttttgttctagcttattttcagtggtagtgcttgtaaaagcagaggtcaaagcagatgcactgaagagatgtggttggtgcaggatgatcgggttttgctatcctgttctgtgcattgcttttgtttgtgctttgatttttcattatcaactttggggagggtgggagagcagccttgtggcattaacagctgcatgatggcacagagcaggcagcgactcttcttggttcatgcacctcaaaagcggccctctttttgccttcctcctcctcctctctgcacctgctttgcatagctgttaactacttttccacctaataataaaggaaattgaaataaatggttaggaacatgcccataatcttttttctcactgactttctctaaactctagacgaaactagagaggattaagaaatgtaaaacacagcagagaatgtcttttttttcctctccctttttctcttcccctagcaaagatttctttagaatctgagtgagatatcagaggtgctgtttgcatatgaagtagcgatgactatgggtggaagccagttgtaaggttgcatagtcatttataacttctttctatgttaaggttactaccgactttatgagaggagcctcccagactcaggtgtcatgcctgactcatgagtaattcattagagagggcccaagccatgtatttca

SEQ ID NO: 128742 - DNA, 1006 bp, Homo sapiens
caccaagttggcgagggtggtctcaaactcccgacctcaagtgatccagccccctcggcctcccagagtgctgggattacaggtgtgagccatcacgcccagctgcaagtagtttttaccatataataagggctcagtaaacattagctctgattaccatcatcctggtttacagatgaggagtggagacagaggagggctaagtcatatggccaggggcacacagcatgtagcagagcccaggttgtcctcaggaacctatggtctttgctgtcaccctgtgctgcttctcaggaaggcaatagcttgtcacccattaaaaatgggtagttatttgaatgaaaagcagaataacccccggaggcagaggttgcaatgagctgagattgcaccattgcactccagcctgggcaacagagtgacgctcctgtcaccaaaaaaagaaaaaaagtaaggactccttgtgtgaaatgcacatggttgcttttaacattgcagtactggactataaacatttgctggggattggcagtgaccagccatggggcagagcatggggcatgggaggggagcaaggccttgaccccgggaagctgcagtccagggaagcagtgtggacagtaagcagagatttgcagggctgtgtaataaattccaggagaaaaagatctccaggggctcggagaggcctgcgggatggaatctgtcttgatccacgtgtgtgtgtgtggggtggttagatggatgggaggtctccaggggaggtgagtcgtagggactttctgtaaaaccagggcccctgacgtgtgatgggctgtacaaattactggcagcccaactattcatttatcaatgcacgtctgtaaatatttttgttttctttttaaaccttttttgttttcctgggagacagagtcttgctctgtcatttaggctggagtgaggtggcgcgatttcagcttaccacagcctcaacttcctgggctcaagctatccttccactgca

SEQ ID NO: 128743 - DNA, 1079 bp, Homo sapiens
cccagttttttttgtgagtgattctctgatgactgtatttctttataaaaactcttttttatttgggcagtaatccccgaagtagagtcattgagtcaaaggcaaaaaatgtcattaaatctcaatgcacgtttacgttgcttcccatgaggatgggcacgtcagatgcaagatctttttcactgtacctcctcaacattgggtatcatctataaaatgcactaccgtttaatggaaacaatatgtcactggtgactgaagattttaactagtggatgtgaacgttttcttgtataaatgttgcctaattgtgttgcttcttttctgaatcctctaataacatcttctggcatcatcttggtggtttttctttttttttttttaatcacagtgttttatcagtttatattaactcttcatatataaaagataaccttttgtctatcatacttaaggcatttttttctagcttgttcccctctttgctttaaaaacctttaacgttttgaagtttcaaatttcattcagtatattaatagcttcctctgtgatttcttctagagcttaaaaaaacctcataacatttttctaaatacagaggtgacagcgggaatcacatagtgattcttcacccttataactttaactgaaaataaaaaaagtgctatccatatgtggatggtagattcattagcaaagccccctttttcataacccctccccaaactgtctcctctgtaaaatgtttcttgctgatttcttccagggaaaataaagcatgtatttgcatatattttaacaggaatgagatcatgctgtactccttgttctgcacctcgcatttgatcacttcaaaatatatttttgagatgcctccatatgaacagttagaaccctgttatagaagattattatgtgtgtgtgtgtgtgtgtgtgtgtgtgtgtgtgtgtgtgtgtagaatgttatagtatatcctacaaatatagcatagtagtctaccaatggatgtattgttcagtcacacctataccggcagacctttgatcctttccagattgttaaactaagtacgttctcc

SEQ ID NO: 128744 - DNA, 1031 bp, Homo sapiens
acctgaggcagtctgcctgcctcatcctcccaaagtgctgggattataggcatgtgccaccacgcccggccgacaacagtggtttcttgcatcttatcatcatttgagtttgtcttcccttgcctgccaacttatcaaagtttcctcaattacatttaatcaaatcctaggaagtacaaggtatttttaagtcttaggttatattttgtttgtatttgctttatagattgacttgaaacagttgggattttgtgtagttttcaaattgaagcattataatatggtggttagttgcaagagctcttggagtagactgctgggctctaatccctgtgccactgcttcttagttatgtgactttaggcatcataatagtttgtgttggttctgaagattgagttatatgtgttaaatgcttagaacaatgcttgacacctggcaagagctcagtaggagtttgctgctgtttccaccattccagaaggtacaagagtctaaacatacttttagaagagtgataagtttgtggatcaaaactcttttcttcatagaagaggtggaatacagtatgatctctgttcatatgaacaccttatgctcttttaaaaatgctttttcccctttataaaaacttataggccgggcatggtggctcacacctgtaatgccagcactttgggaggccgaggcgggcggatcacgaggtcacgagttcgagagcagtctgacatggtgaaaccccgtctctagtaaaaaattgcaaaaattagctgagcgtggtggcacgcacctgtaatcccagctactcaggaggctgaggcaggagaatcgcttgaacccaggaggcagaggttacggtgagctgagatcgtgccactgtactccagcctgggtgacagagcgagactgactcaaaaaaacataaaaaatttggagagtagaagaaaaaaaagtttctcatggtgggtatctaaagtaatcactacacattttgctctgtgtcttttagctttgtttcctccttaagctta

SEQ ID NO: 128745 - DNA, 2060 bp, Homo sapiens
accagatcgcggtgctgcccgaccactttggccagctctcccgggtgggtttgtggaagatcaaagacaacccactgatccagcccccctacgaggtctgcatgaaggggatcccctacatcgcagcctaccagaaggaactggctcattcccagccggcggtgcagccccggctcaagctgctcctgatggggcataaggctgcaggaaagactttgctgcgccactgcctcaccgaggagagagtggagggatgcccaggaggaggggacaaggagaagtgctacccaccgtcacctccccctgtgagcaagggcatcgaggtgaccagctggacggccgatgcctcccggggcctgcggttcatcgtgtatgacttagctggggatgaaagttatgaggtgatccagcccttcttcctgtccccaggggccctatacgtgctggtggtcaacttggccacctatgagcctcgccactttcctaccaccgtgggctccttcttgcatcgggtcggggcgagagtgccccacgcggtggtgtgcatcgtgggcacccacgcagacctgtgcggagagcgtgagctggaggagaaatgtctggacattcaccgccagatcgccctgcaggagaagcacgacgcggagggactgagccgcttggccaaggtggtggacgaggcactggcccgggacttcgagctgcgctctgccagcccccacgcagcctactatggcgtttcggacaagaaccttcgacggcgcaaggcccattttcaatacctgctcaaccaccggctgcagatcctctcccccgtgttgcctgttagctgcagggacccgcgccacttacgacgccttcgggacaagttgctgtcagttgctgagcaccgagagatcttccccaacttacacagagtactgcctcgatcctggcaggtgctggaggaactgcatttccagccacctcaggcccagcgactgtggctaagctggtgggactcggcgcgcttgggcctgcaggcgggtctgaccgaggaccgactgcagagtgccctctcctacctgcatgagagcggcaagctactctactttgaggacagtccggctctcaaggagcacgtcttccacaacctcacccgcctcatcgacatcctcaatgtcttcttccagagggatccctctttgctgctgcataagctgctcctagggaccagtggagagggcaaggcggagggggaaagctccccgcccatggcgcggtccacccccagccaggaactgctccgggccacccagctccatcagtatgtggagggctttctgttgcatgggctcttgccagctcatgtcattcggttgctgcttaagcctcatgtccaggcccagcaggacttgcagctgttgctggagctgctggagaagatgggactctgttactgcctcaataaacccaagggcaagcctttgaatgggtccacagcttggtacaagttcccatgctatgtgcagaacgaggtgccccatgcagaagcctggattaatgggaccaacctagctgggcagtcttttgtggctgagcagttgcagattgaatatagctttccttttacttttccacttgggttgtttgcacgctacagtgtccagatcaacagccatgtggtgcacaggtcggatggtaaatttcagatctttgcctatagagggaaagttcctgtggttgtgagttacagacctgccaggggagtcctgcagccagacaccctgtccattgctagccatgcatcattaccaaatatatggaccgcatggcaagccataacccccttggtggaggaactgaatgtcctacttcaggaatggcctggactgcactacaccgtgcacattctctgttctaagtgccttaagagaggatcgcccaatccacatgcttttccaggtaagtggagagagggagaagttcttctgtggtatgctgtaagatatgtttttggagatacttggttgtcatttggcagaatgtttgtttaacttcacgggttctccaggaaagct

SEQ ID NO: 128746 - DNA, 1044 bp, Homo sapiens
tttaccattaccaaattaccattttatagataaggaaattgaggatcagaggctaatacgtagctatccaaagtcatgctgctatttctagtaaatagtcagctggggttctctattgaggtggtgttgactcccaccaccagtcttctttttacttagctttgtttcctttgaggaacctcatgactcataatagagtggggtaaattgtattggagacgcatcttccttcttatcctttcctccgtttaggagctgcagtgaacacttttcattgaacatgtagcatgaagaggcttcagaagtttgaaagtttgaatctttaaatctgtgatgtttgtactaattataaactacatcctttttttttttttttttttttttttttttggtaggaaactcaacagtgtaaatttgatggccaggagacaaaaggatccaagttcattacctccagtgcgagtgacttcagtgacccggtttacaaagagattgccattacgaatggctgtattaatagaatgagtaaggaagaactcagagctaagctttcagaattcaagcttgaaactaggtaattaaaaataacttataaaattataaaagtagtacatgctcattttagaaaatcttgaaaacattgaaatattaaaaatcatctgtaatcctaccgtaatgacatgatcctattaacagttcacaaaaactaattaacattttttatgtgcaactctgattatttttgtctgtcttctagatgataggactgctgaatcaaagtcaaatattttaatgacctaccggcaatgtataggagtctctgtcttattatgacaagagtgttttaaatttttttagttgctcatttaaatgatggatagttatattagtgagatagagtattttttattttctttttgccatttgtatcttttataaaaagagtttgtttgaaatcaggtacaataaattaaaaacattcacttaacaggaatattttttgttttaatttctaaaaaataatctacaatgatcgtttgcatt

SEQ ID NO: 128747 - DNA, 1101 bp, Homo sapiens
agtggaataattttatattaatttcaatgtttgtatcatatatgttatcttagtatataaggcagtatgacgactgtgttggtagtatatgctgacagtgtttatggtttgaagtaccagtatatgttggagaaaatactgttatatactactaaaataaaaaaagacttgtgaaggaaaatgttaatgttgtaataaacatattattttaattagttctttgctaacttagctttgagtcttgcttttcttacatttattttagctagcatttgctaaatttcgctgtgattgtcagtgttcagcccagtgccagcaggtgagagttttgattcttgactgtagaatttacctaagtgtaactagtcttcttcttctacttagaggagtaaaggatgttctaaagaagagactgaaaaactattataagaagcagaagctgatgctgaaagagagcaattttgctgacagttattatgactacatttgtattattgactttgaagccacttgtgaagaaggaaacccacctgagtttgtacatgaaataattgaatttccggttgttttactgaatacgcatactttagaaatagtaagtgaatttttgtattttaattgtatttctagcagcaactattctggtgtttactggttatgtggaggacctcatttgctttttagccagaattagacttctaaagtaagttttttctttgccatgaactttatatcagcttgattaatagaaaagctgtaacaaagcaattttagagactactgctttctttttgcagtagcggaagttaaaatgttgttttccatttgcttagaacatctgggtgtggacatcagaatctcctggtaagtaaaaaaataaagaaaacactaatgatactgatgcctggccctagtcccagagattctaatttagttctctgatagggcctctgacatcagcatttttttgaagcttttcagttggttttaatatgcggtcaggcttgataaccaccactgtggcctagtgtgaactctgatctctaagaatgataatttacaaaaatgacttttgaacctctctctctggtggaaagttta

SEQ ID NO: 128748 - DNA, 1337 bp, Homo sapiens
ttaagtatgagagtgatagggcggacccgatttacgttttaggaagatcagtctggcagcagtatgtagtatgcgtggaaaattgtgagacctgagatgggaagacacttagggagctgtggctttcagcttagaagagatttctcttttccctcctctagaaatccagtaagccgctaggttcaggcctataaaaagagaaccactggggatgatcttaaatcttaattttgggaggattatacttttcagttgaaagtagtcccagtacttggttatgaaatttttagaatttcttaaaaatgaaactttaggtggagctaagccaaggaaaccatgaatttaaagtatcagcctttctcatactgtttcttcccctccaacttaggtctgggtattttgtaggtctacgtgaagctgcagccctgatttttgtatattttacttttatatcctcaggatcaggtagacagagctgataccttccctcaggtactaaaaaaagtaattgactggatgaaattgaaggaattaggaacaaagtataaatactcacttttaacagatgggtaagtatttaggaagattatttttttatatctactttttaaagattaaagatacccttatttatctgatttttagaataaccacaaactattattagagaccctagagtctcaccccacagggaatagtatttttcctttcacctaaggatgaaagagaggaagaaaacagtggtcacagtccaatacaggactagaacactacagaaagttaaaaatatgtaaagctaaaaagactttgctaaaactctgttttttcatgacacttccttactcaaaaaagttcagactcttgagcttggccttgaagcctctttcctctcatcccacgctacctgtttaatctaattcacctgccattaatcctctttagtcagactggcccaggaattcacatggtttaccctttctctgtgtagttacttatgcctccctctgtactgagagtgtcttctcgacaactttatcatttttcaaagcccatcttgtgttttaccctgacaacgccattgatcttttttttccttgaaaccttataatttctatggtatataccattcatgttgacatctgaccatatattctgatatataatctttgtgtacatacataagacttacttttgcaaggaaatctaaaattctttcagagaaggacttttgctgcctaataatcttccataatgcttaccttagtgctgagcttaaagtgtatgcccaaaaagcatttgttaaatgaaaagctaaatgggaagatcagaaagattaa

SEQ ID NO: 128749 - DNA, 1783 bp, Homo sapiens
actagattttaattttacttcacatttatcaaagttaatatgcgtgtgccgtgtaaatgtttaaaatattattgcaagacttacaatgaatggcagtcttctgccatagccttcaccagaactggttcctgttctgaggcaaacactttcaacttatgtaaagctctgtttttgtttttgtttttgttttttttcaaatatttacctttgtatttctaagtttcatgcttatactacttcttgacttttcagtttgcgatctattgaattcctgccctgaaagatcaagattgagttcaattaagttaccactcctgcttgtccttcccttcctgcatcttcctactatagctctattacctttcagtcagagcactcagtgttcatactcccgtgactatggagagtgtccacaactttcccctggatgtaataatttacttccgcggttgtttacttatccccttactctccattcaaactgtaagtcacttcttatgactgagaacactcaggtagtctgtcaggttttcttttttcatctgtttttcccttgcagactatcttcctggagcctttaatcctgttctaatctgaactgttagttcttcaggcttcttttaaaatcatcttaggggatttcctttaattctcatgcattagatactatgtcatttttctccctttacagtttcattttggagaagcatgttctaaagtagtttcatgagaaaaggtgcttttccttacagactcttctgttttaacagtcttttaaaactgagaagtatgcatgcagaaaagtagagttttgccgattgctataaagcaaatacccttgtaacttccacccacttaactcccttccttcctcctggagttaaccctaattcttcctttcatggtaatcattttcttattattccttatagctttagtatttaaatgtatatccttatattatatagttttgtctggctttgagcacgatataattagtattatactggctatattatttgttttttttgtttttttttttttttcaatattatgcttgagatccatccacgtcttgtatgtcactgcagttcattcactttattgctattaattccattgtgtgactataccagatttgtttatctgttctactttggctggccatttggattgtttttatttggggcttccatgaagagtacttttataagcattgttgtgcatgtcccctggtgtctgtgcactcgtttttctaagaaaaacctaagagtgcagttgctgggtcatgggatatgtacatcattgacattactagataatacaaaaatagttttccaatggaattgtaccagtttgcactcttatcagtgctatgtgagtttatagttactgtaagtttttgctagcatctgatattgtcatacattttaaatgttttgtaaatctgacgggtgtgtgataccatctcattgaggtatcagctatctggattgcttttttgcgaaccccttatttaaatttctgactgttttaaaaaaaattgggtagtctgttttttcattacctgtgtattttactggtctatagatttttactttgggtgctagtcctttgattatatttgataatctttttgtgtgaatttattttgttttttggtttatttgtctttgagatgaagtctcattctgttgcccaggttggagtgcggtagtgcgatcttggctcactgcaaccctgtctcttgggttcaagcagttctcctgtctcagcatcccga

SEQ ID NO: 128750 - DNA, 1045 bp, Homo sapiens
tgttcaggctggagtgcattggcatgatctcagctcgctgcagcctccacctcccaggttcaggcagttctcctgcctcagcctcccaggtagctggcattacagatgtgcaccaccacgcctggctaatttttttgtattttaagaagagatggggtgtcaccatgttcgccaggctggtctcatactcctgacctcaagtgatctgcccaccttggcctcccaaagtgctgagattacaggcgtgagccaccttgcctggcctgaattttttatttgccttatttgagtgggggtattgccctttgcctagctttatttagctgttagtgctaattttcagtttcttatttttcatcttaactgtggcttatattacagtttagaacaccaaagaattatttactaagctgtttatttttcaggttcctagaagccaaaccaaactgacaataatgcttgaaaaattaggaatggattatgatgggcggcctcactgtggtcttgatgactctaagaatatcgcccgaatagcagttcgaatgcttcaggatgggtgtgaactccgaatcaacgagaaaatgcatgcaggacagctaatgagtgtgtcctcttccttaccaatagagggcactccaccaccacaaatgccacattttagaaagtaacaacagttttgtgtgtggatcattccaattgaagttgctatgaagaggtagcagatgaatctcattgaattagtcctgtagtgcaaactttaagcaccttaaaacatttaaaatcttattacaggtgatagagatagatacatgtatgtgaacagattttgtaggaaggcatactgaattctttgtcaccagcacttttgatatgaacagtattcgttacatagtaacagttcctgcttacaactgaattttataatttaaggtgttcaagatatattctttttggttttaaaatgcaaaatcttattggctgttctgttgaatgtcatatcttactggtgtttaaatatgtaatgtgtttctttattaacatcact

SEQ ID NO: 128751 - DNA, 1031 bp, Homo sapiens
caagactatcaaataattattcattatacctgttactctttaacctagaaaacctttatttcagtatattcataaagggttgggaaaatccaacctgttactttcaaaacaccttttaggatataatactcttggcacagttagtgctttaaatatatttttattatatgtttcgtcaaaaccttggagctacagatttagtcattcatttcatgatacatgttcatcatataatgaaatcaagcaaaatatccatgtcatgaatcaaatcagactgactttgtcagaaaaaggtctggcttgaaaattcaggttgtgttactgaattttgaacatacaaaaatcattaaaaaccatcacagaacaccttttgtaaatgattagtgaaaacagtcaagatttaaaatttcccttatttaacttataacaagtcgcagtcatctgtggcaaaaacaagttatttaggaagcaagttaggttgatgaaaggcaagatattctttcaatataggtgtgtacgtatattgaactaaggtatttggcttttggcagaattaagaatcaaataaaattctttagtgttaataatattaacttttactaggattacgcttttcctatagaatgttatcctgctaaaaactaactggcagatatctagaacctaatttattttctgttaagaggtagtaaatatttcccatttcataagatgaagtagattcatatttgactgtatttggagtaaatatttcacaaaatgattgtggtcagtttttttcattttttgtgagcagttttgtctataggttttattcagtgcctcatgaaaattctgatagtcctgaaaattattccaagtacaattaaaatattcagcatcactaaactctttttgttttgactgtccaagggtatttttccttccagtcaatgattgttctgtggatgagtttttaaatagttgaaaaagtaacttagaagaacagctgtttgtagcagtcagtatttctcaccgatgcttgctgcttt

SEQ ID NO: 128752 - DNA, 1029 bp, Homo sapiens
ctgacttcaacctctgcctcccgggttcaggcgattctcttgcctcagcctctcgagtagctgggaatacaggcatgcaccaccacgcccagctgattttgtatttttagtagagacgtggtttcaccatgttggccaggctaatcttgaactcctgaccttgggtgatcctcccaccttggcctcccaaagtgctgggattataggcatgagccaccgcacccagccaagagatttttaaatgaacaacctaacagagtacctcaaggaactggaaaagcaagaacaaaccaaacccacctgggggaaagaaattagatgtagtagaataagataagcattaggaattcctcaaggccaagagaaatgtctgcacagaaaagagaaggaacttggaggctgcattgccagaatgcctcacccagcgtatgttttgtacgctgtgtccttggtcctccctttgcgataatttctctctgtggcacacaagatttcaactatcccttctctgcaaaaggttcctaaaatctattgccctgatctctcttttgagatccaatttcttgagtatttcataggtgtcaccagcgttttaaattttatacattaagaaacaaacagatgcttatttcctcaactgctacgccctctcccgcctccaacacacacacagcctactcttgtgtcactcaagtcagggaacaccctcccattatactcaaatctgccagttccctgttctttgaggaggtagcgtcatttgtcacaccgcaggccttctggggctttgtggccctggaggaagcctagatgcgatgggtccttgtgtccagaatgaaagttagctaacaaaactggagggaagtgttatgctttgaggaggtaacacaggttgagcatccctagtgcgagaatcagaaacgatccaaaatctgaagctttttgagtgttgtcatgatttcggattagtgatgctcaacgaataaatatcaatataatacggatattccaagatctgagaagattcaa

SEQ ID NO: 128753 - DNA, 1369 bp, Homo sapiens
aagtaaatagatgagtttatttggggttagtaagtaaatacaataaggtcaggaacataattagtattacgagtggcatttattttcatctaatctggggttacagattataattcttaacattatccagctgtgtgatgaaatgtgccattgttcgcagtagacaccggacaaaaagtgtagctggataggaaaactcacatcagtgcaactaaaatcagtccacaacattcttcttcatgcttctgttttttaatcttaacttcttgatgtacagcagagaaccattgagaagtgggagtgatccaacatgatatgttagatatccataacacaccatgtgtcccctaaataatggcctcctggaatgggaggcataagaaatatctcatctggtctcccagtggtcagttactcatagaaagtagtgatgttcagacttattcaaaatgcatctgttgtgtctatcagtacaaaaaataataataacaataaaataaggaagtctctgctggacagagatttttaaaaactaaattgccggccaggcccagtagctcacacctgtaatcccagcactttgggaggccaaggtgggcagatcacgaggtcaggagttccagaccagcctggccaacatgaggaaaccccatctctactaaaaatacaaaaattagttgggcgtggtggtgcgcgcctgtaatcccagctactgcggaggctgaggcaggaggatggcttgaacccaggaggcagaggttgcagtgagccgaaatcgtgccactgcactccagcctgggtggcagagcaacattgtctcagcaaaacaaacaaacaaacaaaaaacaaaaaactaaattgcctgaaactggactggaaaaccatgtctggaaatgcattcaatcaactggaaattgctttcttcccctcgagcagaaagtaggaaaagtacttaacattaagtatttatgaagtttgggtttataccgactaatgttgagctccaaacatgaaaggacacatgctattacctaatcttctgtggctaaacacaattccaggaggaatgcactatatcatagtggaaagagcaaagcttggggtcaaacaaacctgggcttgaaagtcacatctctgatgattactagttggctaatcttgataggtatgcttcagctctctcagcctaaaatgttgaccttagtttagcactgtcatgaggattaaaagcctaggtgttttttaagcactctttgaatgttagatccgttctcttacatggcatgcataaagtgttaacatgaactcacagccactattgatagctttcccctcgcaacttcctttgtgacaaagataggggctggga

SEQ ID NO: 128754 - DNA, 1029 bp, Homo sapiens
atatatttacactttagtttttggtgtgcaggaatacagttagatttggacagctttagagtagttttgtcgtttgtgtgctagtttattttgtttttacaagggtatgtcctttgaggacagtccagaccaaaagaggtttaatacaacccaacacatgtttgaggatctattgtagccttaataacccaatgaaagacataaatgaagtgtttgaaagtttcccttcttctaaagaagtttgcagtctagacggggagaccaaaatatgccaatgtgaaacaactggagaagaatatttggatgcattatatgatgatggaagaaatataggctttgatgttgtggccactattatttgttgtctagcagaccatttacctcgtgtcagttgcctcagttttctcatgggcaaaaatcataaaatgatgttgtgcgagcatttggtgagaagtatctggcacaaagttctccctcaaaaagtgtgaatttcttaagctctggaccccacacttgtctttttttttttttttgcaagtagttgatgattttctctcaaagacacctaataatatgtttataaaataaagagaactgtaaaataaaaacaaaggaccataatctcactgcctggatacctattgttgatattttaaaaatgtaggtaataatgttttatacattagaaacattatattggaaatacatatattgtacgttatacaattcaaataggacagaaaaatacaaaatgaaaggcatcacacagaaacatcagagataacacaccagagataacttctgttaagtttctcctatatttctaatatatatatatatcacttcttcagtttgttctgttaacagtaaaacatgtgttgacccactgtagtatttatttttaccacacttgggagatatgattaaccattttacagatgacaaaagtgaagcatatatcgatcgcttaaataagtccaaattcagtcaggaaatagtggaaattgagtttgaattcaggcagtttga

SEQ ID NO: 128755 - DNA, 1003 bp, Homo sapiens
aaattttattgtaatgttaggtttggttttggaaaggaataaacatgagctctgtgatgacatgagggagaaaacactatagtagtttagtctttaatatttttaacagcctccttttgtgtcatagacaaagaatctttgggtagcttactataaaatattgcagtagataaaattgaaggcagttgcttcttacctttttatttttccccatgtcattgtccttgaagctactttggcttatgtttattcttctgatagctaagttttggtgtagccctgctcttgaggcacctaataccatgcatcattaatagatacttatagtaagaattgaataggattagttaagataagatgggttggagtctgagggctaggtgcagcctccccttacggggcttaataaaaccaatgaaacatacacgagaaagaaacattcagaaatggactttcagtttcttggtgaataaaaagcattatatcttcaagaaaaaatgagtagggtgggtttcctagggatttctactaaagcctaggagctcaggataaccccggggctcattaaaaaaaaaaaatcactttgatttcaagtaattgaggaaagttttaggtgttttgtttttgtgtgcccgttgtttttcttttaaggcttcatcagatgtctaagtttgctttcaccagagcgagttactgagttctcttctcgaatcttgttttgccagtttgttcaggtatctgtttatagaattaaagcagcgtgagggtaaacttttttttaagctgttttttggagtgtgtcagctccccattcaatttagacaagttatttatttatttatttattttggttttggaagagggaaaataacgtgatgtaaaattttttctctatcccttttgccttttcagtagaacaaactaaactgctggtaggtggcagatgtttggacttgtttattttttcttctttggtatattttcttttaaagtgaggaagcat

SEQ ID NO: 128756 - DNA, 1913 bp, Homo sapiens
agtgagccgagatcacgccactgcactccagcctgggtgacagagcaagactccgtctcaaaaaaaataaaaataaataaaaataaaaataaactaaactccctgatgccttgttaaagtgtgtgtatacacacttttttgtgtctacatgtatataacttattatatatgtcaaattatatgttgacatatatattatatacatagtaagtagacattgaaaagttctgatgccctcattctgataatactcatcaaccgtagaaaccattttgacattctcatcagtcatgttaataagatgtgcaggtctcctcttccaaatgcttgggttattctcatgttgactgtggaaatttggtattttcaaaagaaatgacatagaattacacttagttaatacatcttagctatttttttctaatgtcttgaggtaccaacttatgtttttcttctttgcaggaaaatattcttatttggaaaaagaaaactttttggataaatttttgaaactttgagcaagctatcaaaagttgtctgcctcctccttctccccagccccaaaatacacagacttaacaacagaaaaatataactgttatcctatgttaatttatgaaagcagataaatatggggtatataataagataatttcattatttaattcaatgaattgcttgttttagtgctctgtaagtatttgaacaagtaaactttttgagttaacacttctgatttctgatcttctgacattcttaagtacataaatattaatcctcgtatattagcccagtcttttttttttttttttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgccctcatgatccacccgcctcggcctcccaaagtgctgggattacaggcgtgagccaccgcgcccggcctagcccagtcttttgtcatcagagtccaaggtcacatagctagcttttaagtaatggtgccagatttaaacccaatctggttgtcgtaaaatcatttggtctgtgctactcaaatggaaagttgatagcaatgagaaataaaatctgtattttgtgtcattttgtaatctgacgattcttactgctttctcaagttggttttctggtaataaacgtaactttacaaattttggaaagtacagtaaaaagtagggcatcatcttcccaccccaagggagctactagtgattttgacatattccctccagtccttctcttaggcatttaaagtaaaacttttttgtaagtatggtattggaacatttgcagttactagaatgttgggactatctggtcttttgttcagttgattgtttttataaacataaaaagtgtgattggaagtaatctttgaagaacctcataactaaatggaagaaggaaggatattttagcaactgctttcttatttatttattttttttttgagacggagtctcgctctgtcgcccaggctggagcgcagtggcgcgatcttggctcactgcaagctctgcctcccgggttcacgccattctcctgcctcagcctcccgagtagctgggactacaggcgcccgccaccacgcccggctaattttttttgtatttttagtagagacggggtttcaccgtgttagcgaggatggtctcgttctcctgatcttgtgatctgcccgccttggcctcccaaagtggtgggattacaggcctgagccaccgcac

SEQ ID NO: 128757 - DNA, 1199 bp, Homo sapiens
ggtatcaccatgttggccaggctggtcttgaactcctgacctcaggtgacccgcccacctcggcctcacacagtgctgtgagggtgtgagccactgcgcccggcttatcagcagtatttaaataacccttgtttctatgaatgtagtgatgagtttctatatacagttttgtgttgtgaagcctgaggggaaagtgagttcctggataagtcttgtcatatttattttgtgtttctagcactgttgcacagcacatattaagtgtttagaaaatgttttttgaatgaacagcccaaagactaaaggaagagcttccttagttctaaattctgtgaaatgagtcagtttgaatgaagctaatgtttcttttgttttacaccatttactatagagtgcagtacttcagttgttcatacttgttgatattgttacagatattctaatggttctttttacaaaatcaaatatatatacaagacattttttcgtttctttttaggttttggaaggaaggatgttgtagaacacttactacagatgggtgctaatgtccacgctcgtgatgatggaggtctcatcccgcttcataatgcctgttcttttggccatgctgaggttgtgagtctgttattgtgccaaggagctgatccaaatgccagggataactggaactatacacctctgcatgaagctgctattaaagggaagatcgatgtgtgcattggtaagtatcatttgatgatatctaaattttaaataaaggtttattcttactttttttgtggtacaaatagtgtttcctgagaataggtaaggaagggtttattgcttcttgtagaagcagttcttttccatcaaaaggtaaacagagagatggtaatctaaagttacttaggggaagactcacaacattaactttccaaatgcagtcaaatgcctattgatgtggaactcaattttaatggattactattgtcaaatttagttaatttatagtctcttttaaagactggacattttctatcctaccatcaatgagagccattataaagtacaaattctactgagttggatgacatttgaacacttgaggttgattcaaggaaactcatctagtatagtagtccccccgcttatatggggttttgagtgttttgaatacagtagttcagaacttaatcgtttcaatatgtgccata

SEQ ID NO: 128758 - DNA, 1061 bp, Homo sapiens
ttcacattttgctttgctgtatacaattttttattttgaaatctaaaaagcttctagagggcaagtataatttctcttgagtgtatcatctgttttttgatacttgagatgatggatgtttgtttagccatggcaggttgatttacgtaattgtcttcccagatgtcatccacttcagcataatcagttttttaatgatgcaactaaaatatacatgacattttaaaagatatagtggtggtgcttagtaatggttaagattattcctccttatagccatctattgcagcttctaatatatttttcaatattcctcaaattattgcaatgcctgatataaaactattttttaaaaaaatcacattttctgtcattatcctttgctacttgagcatccactaacatgacctttggatatcctgtcctttcagttttttgacatcttccagtttcaactgactctcccatttcctcctaagtctctcactaacatagccacatcctggaccaagtcattacataaaactaccttgagaagcttcaacttataacatcctctctctgactacaaagcctcttatgttacttgcttttgtaaatgataactattattgagcttggaatgtgtttcctacgtagtcttctaggctttcatcttctctgctgtaactgcttcttgcttcaccttgttgtcacagccactggatttttctcagtcattagtcagaattttatactgttctcactttcttaaaatattatcctttccaggcttcagtcttctgttttcctgcctctacatctgaagttttcattttatcagtcctttgaatatcttattgaaattagtatttctcgcctcctcctcttaatccctctttcaaaagtccataatgtaaatgctctttttatctaggttctattgaaataaaagactagatatggggcttgaatttttaatgaatggatccctgcagcactctacttcctcagttcacagtaggctttggcacatattgtcttcattctgtttaagttcttgtgccttataaaagttgagg

SEQ ID NO: 128759 - DNA, 1039 bp, Homo sapiens
actgtctatttatatatcatttataaatgagctaggttaagaaaagtcatttctcacaccttctttactgtttgcaaaaattagttgaaaattcagtgaagccttgaaaatctgattcacttggttttgtttcattaatgtctttccttttcctgccagaatacttcccttctgcatttttaccattagttgtccatataaaacctgaattggtatttttttttttttgagacggagtcttgctgtgttgtccaggctggagtgcaatgtgtgatctcggctcactgcaacctctgcctcccaggttcaagcaattctcctggctcagcctcctgagtagctaggattacaggcacccttgaattgggatcttttaaacaagtctcagtgtagcattttcataaaaaacaaagatgacaaaattccatacttgtatccttaaaacagagaagagaggcccagaatgagagtcattgtgcctttggaaataatctccgctgacactgagtactcttaacgttgatgacttgtctgcttgtgttccaactgctttcaggaaggttagagtagtgtgcatttacctgataaaattgggactgttttaacagttattctgtacaatagtggtagatatacacataacatatatatatgttatgtacttattaattgtgttttattagaattccaggaaaagcacccgtatggaagctttcactcttccaaggccttaagaaatacattgaagatgcttaaattaggtggaaaaagcaaaaaactagaaaaaaaattttcatatacttttttacagtgatgcaaggctttacttaatgcccaggtctgtctgtctaataaaagcattacacatttgcatttacttttagactcacttcaattgttcaaaacaatctatgggttaggttaggtgcagtgactcatacctctaatcttggcactttgggaggccaaagtgggaggattgcttgagttcagagtttgagaccagcctgagcaataaagtgagatcctgtctctacaa

SEQ ID NO: 128760 - DNA, 1143 bp, Homo sapiens
aaatgcagtttttattttttcccactgacgtacttggaaaaaaaagttacatgtaatgagacacatagttcactggggtgaaattaatttgttccaagtatgctagtcccagatgttgacagaattctgaattttgggtcacttttatatgaaagacaaagactttcatatatgaaagtatgactaaaaccctggaatttttgaaataatcccttcactattttactcaatttgtttctacagtcagcattattacagaatctaaattaatagatttatttcacatttgtcttatccattgctgttaccatatttaatgttagtcatttgataggaagaatgatccaatttttctttattcgttacaaagtaatttctgtaagcaagagcttttaaaaagcattgttttgcacacatattaaacagcatgcataaagatcatttttgtctgaggatcaatatcccattataaaaataacacatatatgtaataaatactaaaacagtgtagaaatgtataaaatagaaagtggaaatcccgtttatttcactttcagatataacactaaatattcctgttgttaaggtagctgaagtagtttttttatctctgttatgaacccatttgcacatataaatctatttacatatttttaaaacatgaactttaaatttaacacgtgttaaaactttgaatttaacatgtattattgcagtagctactcattgagatatctgcacaagtactctttgctgagaaccaatgcctctttccccatcatcattgtttgtattgcctcttctagttccttggccaaactttttaagtccagaaccagatgctgagccaagctggaccaaattctctttcatgataatttggaactaagattgagataatacaggcgtatgtgtttgtatctcaggggaatgtctgggagacagagaaagacagcaacacctgaattttgaggcacatttttgcctttgcgttcaatggaatacctctattctttaataaattttcctgttattaaggtagctgaagtagttttttatcctttgtgataaaaaagctctatttgataaagtcagtactcaaagatatatttatagaccacagcaccttaaatttagaaggat

SEQ ID NO: 128761 - DNA, 2603 bp, Homo sapiens
gcttgcacagtattataactattctgaggagaggaggcatttggaaattcagcagtaaagcagcgacagcaacaagcagccacagtggtagtaaagagagggcaggttcacagttagcatatttcacagtgtgagccagcgagcacatagcttcccatactgctgcttgaaggaggcaaaccaaaactctacattgcaagatttttctagtttcatgtttatgatgttaagtcatgtgataatattgtaccataagttgccaacttcatttcactctagagaggctcctttgctgcagtgcttttttgctttttttctttttttttcttgaaagagaaaaaatttgtgcaatgtatgtttatgcctacaccatgccgagacgacacttaccagtaaataatctctgtatccccgaggtaagatactgtttctgctttccctgcacagtgctgctgcagcacggagctgacccaaacattcggaacactgatgggaaatcagccctggacctggcagatccttcagcaaaagctgtccttacaggtaagaagacagagagctaccgaatgattatatctgtgtaactccttacttgattttataaaatcttgttatgctgaatttttcttttcactgatgaagctaagcaaatatatctgccattatctactactttattattgatttgatatctgtctcattaattgctatgctgtcgtaagcataagcagtaagattgttggtctacttagaatgatagcattaaatcataacatctttcactcgtattttagtcatttttatggtttatatcataatttttctgtatctcatcctctcagttgtttaagacctttactgttgagcaagcaagggcatttatattactataaaagtagttttgattggaaagacaacctgctgcctgctgccttatttcttggatcgatagtcaaataaaatatgccgctgcctctcccttgccaccccgtttatactttaatcatatgttttcacttttaccatgatagctaagttatttttaactgaggcgtttattatctttttacttcagataatgcaaatttgtggcttaaatattagttttattaaagcaaatgccaagaaccagcaaagaggaaatgctagaatggaaaaggtctctcataacaatatagaaaatagtgctctaagtgttttcattgatctgcattctcaaaatgctgcattggatctatttttgtttttattcttagcatctgagtcctgctgcctttgccctcttttacttaactgaccttcgtaatgagcctctgtcactgcagtgctaacagtattgttttaggttatgtgaaagtaaatgacttttaactaccttttaaatttgcccatggtcgaagaaaataaatattttgttcttgtttaagtttagagtccatggtgtgaaaatttagcaaaaatactgaggcgaagggaaaacgtttatgtacagaaagctttgaaaatctatggaattttgcttaattactctgcatagaaaaacaactttgcactgtgctaaaatcaatataattattgctcagagtaatatgacttttctcaatcaaagattagtgtatttagttgctggataacagtaacatacactagagtaataaacctacttaaattagtgtagataagaaatttaagtataaatatataattttaagtagtgaaattaaaatacatagcctcgggcctgctcagattctacagcctttcagtctcttaacaaagccctgggcaacaatagcagctttagagtggtctctgaccaaaggagaaatacagtgcatagtaacaggggtaggttataaatgctgagcaagactctttgtatatctaaatgtcctccctctgacgtttccttctctccaactctcaacacccgctttgtccatttgttagatacatttaatgcaacaacgcttttagatctactttcacttttttaaaaggcaaaatttaatataagttattaacaagaaactatatcctaatttgtaatgaatttcaggggagattatattggatgttgttagtttgggaaagagctttggaacaatcacttgtggagacacaagattcctggaggacagatatcacatctactaaaattgactttaaagccatctaacactgtactttgcttagataggaatatacgaaattcttggtcataatactgatttagagtcatttgttcttttcaagaatatctctagagtcatttagagttaattgttcttttcaagaatatctacttttttggaaatgatctacagcttttcagatgtgatttaaaaggaaaagtctagtaatatggttaattttgttggaatataaaccagttctgtttctacattcatgctatataatgcagtgaaataacacttaggtgaaatgtattccaaaatgtttttctgcccatacaggttctctaataagtaattctttccagtggaattatggtgaaagaattatttccagagctaaatttaaaagattaaacattaatttttttaaaagggtttcttttgaaaggaatgccttagagttat

SEQ ID NO: 128762 - DNA, 1069 bp, Homo sapiens
actgtgtacaagtatttatgtgttttccttaaaggcaattaataaagtgacaatctcttttttggttttttttttttttttttttgagatggagttttgctctgttgcccaggctagagttcagtggaacgatctcagctcactgcaacctccgtctcccgggttcaagcgattcttctgcctcagcctcccgagtagctgggactacaggcatgtgccgccacgcctggctaatttttgtatttttagtagagacggggtttcaccatgctggccaggctgatctcgaactcctgacctcaggtgacctgtctgcctgacagtctctttttatagaacatttacaaatatgtgactaataccatcttatacataagaatgcatgttttttaataaagctatacaaagcaacagtgtacccttaattttgcaattaagggaccctagcacatggccattggttttggatagcacacttggatatttaaatgagaagacttactcagagagactcatcatcctctttgctgaattattgtgtaagtgaatggtagacttagaagaaatcttgagggctttcttttgtttttctgctaatgactgaagttctggtcaataaactgaaggacttggaggtatttagatttttcgtttgttcattttttgttttaaataggggtatgaaaagtcaaaaacagcctatgtaaatgttattgaagagcagtttttgtgtgttttgattataaattttttaaagtaacatacttttggccttttctttctgattgtaaaagaaatacattcatttggaaattgagagaaacaggaaaaggatgaaaaagaaaaatcatttgtaattttgctacttagagataacattttggtgtactttatttataaccttttcttctgtgagcatcccactgtcttatttctctttaatcaaatcagcctaatgtgttataaactgcttaatagtacatatttttgtaatttagttacataaatgttcccaaagacattaagtacttttctacaacctgagtttataacaacttcacagtaccct

SEQ ID NO: 128763 - DNA, 2215 bp, Homo sapiens
tgaaagcttaatgatattaaaagctgaaacttataattagacctttgataagtagaaagatgccagacttcatgtattaaaatacaaagaagtttttacttctgtttaattcaaattcaactgcagtttttgcctcaaagttgtactttaaaccactaagtcagttgagctatttgaattttatgagtcatatgtcattgctaatgtcaagcttccctacgactgtttctccaaatttttattatttgtattttgaaaaatttccaacttacaggaaagttttaaaaaatactaagatgaatacctgtatactctcgcatagattcaccaattattaacgtatttcagggtgtatttcttattcttttccctctatatattttttcttctcagcaattaagcattaatacaatactactatttattggacaattcatcttcttaccgtttcatgaaaaatttcttcgcttttgacctttcccatcaatactaggtaactctttctttcagctgcttttgagctgcttgaaccctatcagagacacttagaaattggtatagcatttcacctctacttagctgtcacctcttttctacaggtgcatttcaatatctactgaaacatttgcttgttttcttttacttcttttacttttggtttaatgatgttactactctatattgttctttccttttttgagatggagtctcactctgtcgcccaggctggagtgcagtggcgtgatctcagctcgctgcaagctccgcctcccgggttcataccattctcctgcctcagcctcccgagtagctgggactacaggcgcctgccaccacgcccggctaattttttgtatttttagtagagatggggtttcaccatgttagccaggatggtctcaatctcctgacctcgtgatctgcccgcctcggccacccaaagtgctggaattacaggcatgagccaccgcacccggccctctatgttgttctttgcagagatagttgaatacaagttttggcattatggaaaatggtacattactgcttacattaggcactgaagaaatgcatggtgaaagtgttttaaaagttaaattaagattttttactcttccttccaaaaatgtactactaaccttctcagaggagtttaattcataggtgatccggaactggattttctaagtttacgattttcaacaataaaaatatataagtaataggttattcattgtttgtaattgcaaaatattggagcctgcctaagtgcccaaatataggagactggttgaataatctgtacaaatacacaatagagtattttacatctgtacaatagtgaagttctctagaactactgatggattactttctaagatacattgtttagtgaaacaaagtacaaaagattgtttacaatatgccatcctttttgtcagaaacaataagtgataaccagcctccaagaaggtgcccaatcaacctgtctcctagtattcacgtttgtatagtcccctcccacattgtagaagagtttttctgtgtgaccactagcatatggcagagctgatgataagccattttcaagatggtcataaaaactatggcttttatgttgggctgtttttctcattcacttggatcacttgctccggaagcagcaaactgccatattgtaaactgccttatagacaagcccatttggggaggtactgaagtctctggccagtagccagtgagaaactgaggcttgtcaataaccacatgaagattcttggaagcagattttccagccgcatttaagccttgagatgagatatgatagtccccatgtatagcttggcagcaaccttgttggaaatgctgagtcagaatcatccagctaaccattcccagattcctgaccctcagaaactatgtgaaataacattcattcttttaagttgtcatttccagatgtaatttgctaggcagaaatagattactaatacactataggaattaaggaaaaaaaactcatttaactgcatatatatatatatatatatatgtatatatattttttttccaaaaataagcacaagaaggataaaccagaaaacattgaaattgattacctataagaacgtgagaacagagggtagataagacattaagtagaccatgccattttggtataattttaatttctggaggcatgttaatgtgctac

SEQ ID NO: 128764 - DNA, 1020 bp, Homo sapiens
ggttagaaatataatcttagaacaggcttgacaagataaactagtttgatatccttatgattaagactcagaataagcaaataacttgcctaaaattttaaaactgtagtgtcaaagctaggactggaatctgtgccctttgacagtgtttttaactgaaatggtgtggagtgatttcatgaaggaagttatgtgtaagtttggccatatgtttgtggcaagattttaacaagtgcaaatgattggagcttagatcattgtcaacatgagcaaagacattcaggaaaatgcaaggtgtatttgggtaaaagtgagtgatgtagagttgatagtgtgtgttgagaaggtaaggtggaatagggaacagtgaataataaattgaataaatttagtctatatttttaaaggattttgactattcagctgtagggttgaacaccattttgtaagacaggtatggggactcatacatttatactattttgattattattattattattgaataggagaataaactaattaaagcagaaattaatgtaactgaattaagggctagagacaagggattaaggagtaatttagggattagctacaggactgttataggaggtgggtgaaagaaaaagtacataaataaattgtagcaataagaatggaaaaaagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgcgcgacagagcgagactccgcctcaaaaaaaaaaaaaaaaaaaagaatggaaaaaagaaagtagggacaaggcattgtatggattataat

SEQ ID NO: 128765 - DNA, 1091 bp, Homo sapiens
atatatttttgaaagatcctggagcaaaataatacaggtgtgtctggagcccatgtttaagtatagcagagtatcagtctgtctgaatattgctttgagaggaagacctaactctaattcttgagattagattacttcctggtgctttagctgaattccttccacagccacatagctggtttttaattttcaaatctactagtgaaaacatgatggaatatataacctaaattaatattttattcttcatataggttgtcagtttagctacaagaatcaattcatctcttaatttgctggtaccttgatgagaaaacatctatatcagtgttatcaattcatggtactacttagcactctggaatataagagtccccacattaacctgagaattgagattctagactgaagtctttacatacttcttcccttgagatgcttgataagttcagaaattaaggtatgctatggaaaatgcaaaatggattcatcattggaatagacctcagtgaattttctttattcctgaaattcccttggcccaatagcctttgcttgcaagctcatctgtaaatttaaatgctttaaagtagttttgatgaacattttttgcttgttatattgatgtgattaacctagttaaagctaataattgtcattattttttaagttgtttgattgttattactatttgttactctctccttttgcttacatgtctttttccagaactcagatttgttagtttgtgctcacattttagcctagtgcagggcctgacagataatggataatacttagtgaaacctaagacaatctgtttaactgccttgacaccaatttcagatgatcccttaggagagtggttctgaaattggggttgaggtgacacggagaaagggtgactttcaaatgacattcctctacttttatataatgcaaagtgttactgataggtttggataccatgcataatggttgaaagagaaaagtcagaatttttttttttttttttttttttgagatagagtttctctcttgttgcccaggctggagtgcaatggcacaatctcagctcactgcaacctctg

SEQ ID NO: 128766 - DNA, 1136 bp, Homo sapiens
gaaggggcaaaagcacttacaatgttaaaattgagataagtcagtaatcatgacttctccttagtgatttaagttttcttcatttttactcaaaaagtaattttgcctttacactaagtgaaagagaagctgtttctgactactccagaaaaataaaaagagctttatttttcagctttgttttaataacatagctctttaacacataagcctcgtatttctccctctctctctctctgtgtgtgtgtgtgtgtgtgtgtgtttgtgtgtgtgtatgtatctttgcttctttcatatcattactattttaccagtaaaaacaatttagattttggaaagtaaactttttggcttactttcaaaaattccatttacttttattttaatagaaaatgttttaagccatctattttcttcattcctggttgctattatcttgactataattgcctagtttcctttctggctgatctattactagtctttatctggatgttattaaagaatataaatgctccatagagcaccatagtctcagccagaatattttcagattctcagctaagatgaaagagaactggtgctttggctgttaagtaagtagctcagatttgttatcagagtgtgaggggctctaaattcattatgttagctgttcctgggagctagcgtttgaaaaatcgcttcagctgtttatggattgtggtccttgggcaccagatagtggatgctagaatgtattgcagaaaagctgattaaagtactaggatctctagcaggaagagtagaaagtcatttgtaatacctgtgtctgactctgttggatgcacttaatatatttccttttgaaagctttggtttattatcagcttatccgggaaggaatagcatttttgcaaaaatgtgccttttggtgaaaacatcaataaactatgcttgatgagaagttcaggtagggagagactgatttgaactttgaggttcctaaatactttgcggttttattaccactcttattggagtcatgtttcactacgacttaaatttcaatagtagctacttttaagttcacagttttaatgtgtttttactgtctatcagggaatttatactttaaaatgtagactgtcagaatt

SEQ ID NO: 128767 - DNA, 1015 bp, Homo sapiens
gagagacattcatgatgtttccatttcttctctgtctcgtccatacccattcccctgtgagtgtcctttgcttcagatacacagagctacttacaaccattccccttctcctttctttcactgtggtagcttccttctccctgaccctgcttcacctgaggattacttgtccttccttcaaaactgctcaagtttcccctcttccaggaaggcttccttgacccccaactacccttccaatcattaatcccatttacactggctggtaagctctctaacatttcatacaatttctttactgtaatcatttatttatttgtctgtctcctttaatagaataatattccttgaggtcagagatgatagtgtctttcgcgttaaaatctggcatacaggcctattgaagaaatgtgactctacgaaattaatacattttatagatacattgcgtaatttgatttactttgatcctggttctgtagacatttgggggcatgggttatgccattttcctcacaaggagcttttaaagttgactctctaacttccatattgctacctaaaatgtttaacaaaggtaggtcttgggctttgggaaggcaggaacttaaatagatggaggatataatgaaatgacctttactctgtcagttggctaaaaaatctgaaatacaatttatgggaaattagaaagaccaactctatgaccatgaaatcatatattctagcttatattcttaaacttataactttattggtatacaaagttcttttaagagaaaataggtatttaacaactttttactttgaaaatacctggttatagttttcagattttaacctaatcttaatccaggaggcaagacaaaattaaagctaaagaatatttgctaataatgggttatagcatttaagtatgtatttggtagccttgagatgtctttgtaatatttgcatcaatattctgcattctttagcaaaacaaaatgcgaagtccatatttacacataagatt

SEQ ID NO: 128768 - DNA, 1377 bp, Homo sapiens
ttagtctaatgttttattatatgagcacttagtatttgctttcatgtaattatttgttgagatactttgtataattatttctttagtgatgtagcaaactaagtcagtgtattacagctgaatcatagtcctggctgttctttttatttactgaaggaacaaacactgtattattaacattccttgtccttcaattgagcttgcaaaagaaatttgtttgttagatcttgaataccctaagaaatgtattatggatggtttttaattatatttctattttcatcatttgatatatttttaaaatcttgtgataaaatagaatgggggaaaattacccatgtcgcagtagttagatatctgctcattctcaaagaccccaacctccttttaaaaaatattttaagatttattatatgttaaaattggtattgaatttatatgaagtattaagattacagcatgtcagaatattattgccatttaagaatgtattcactgttttggtttttggagcaccgcctccaagaggttcatggcatttggtacgtagttcacgtatttctagtctacagaccttgcctatcgagtcaaagccttcgtggttctgatatttgcattttctactgctataaagctcaacaatagtaattaatgttttttttttaactttccatgtcattaccaataaaacttcagtttttagaagactagtaatttgtacctttaaagagccacattattttgcttttgtctcagaatgtattatgcttcccaagtatactgtgacagcctgaatagagaaaaggggggaggggacattgtcttcagctggcatgctgttatcagagggaatgtgtttctggacacgagatttagcattcattggttgtctgaagaaagctatttcatctgaggattggacaagaagctgcgtcaatttgctgcccgtctccaaggcactggtgatgctgccttcacaagctggctaacgtcacggctccatcacccagcggggtgtggactctctttttctgttcttctctatttaattctctatttgctgcctactgcatttcttaatctgtcttctgccaaatgctaacagcatgatattttgcaatcatctaggtgaatacaagaaagacgaactcctagaagctgctaggtaagtgattccattcattttaagtgtatataatgcattaaggaagagaaggaggagggcaggtggaggactataaaaaatataacgttattgtcttgcttggattttatgcaattatgcagatactaaatctttatgtactttatatcattattgtatataataaaatcttttcatgtggtgatgattataaggttaattttatttggaac

SEQ ID NO: 128769 - DNA, 1291 bp, Homo sapiens
tctcgtgtgaaaaaattatgcataaatattcataagaagctttgtaattttagaggaattgacttactacctttttataggagtggtaatgaagaaaaactaatggctttactgactcctctaaatgtgaattgccatgcaagtgatgggcgaaaggtaagttattttaaatacaatcctctttaattgcaatgcttcaaaattttgtgaatgtggcatatatatatataagcacgtatacctacatggctttattttaactggcatcttttcactgtaaatgaaatgctactatatctgttattggcagttgtgacacattcatagaactggtgaagcatggatcttaagtaagccttttctcttaaatgtcagacacagcaagttatttgttacatgaaactgcagttttgtcggtgattaaaattacagcatatgctcttttctgggtatgataatggaaactggaaatatgagtgtcctatttacccatctttgttaagacatttgtgtttttgatttcttatttggcagaagaagatttgtttgctagataccaacactttttccattaaagctgagaaattgctgttaatgatttttttacatctatgtaacagctctgctcttttattattatttgtactggctaagttttagttgtggaatattgaaagaaaatagattaaaacagagaggaatattctatattaatatgcagttgccataaatgtaaggtaatatataaaatatacagctggcagcttcattatctactttgtattcttgctgaagatagactgaaatgtaatcctttatggctttggtaattgcagagttttgtagtgatttacgtaatagacattgaaaaccaatgcactctgtaccataaagttggtttttttttaaatgagagttaattttttaatgttaactaaaaacctaaaacatttttaaagacacattacaaaaattgaggaaaattgtatgtctgatatttagaaatgaattcttttgaaattatttacagtgaaaatgttacggcaaatatcaggatggatggtaccccttagaaataataaattattttgcttttaaaaaattacttttctgtgagtgataattttgcagatcagatttttgcaagcttccccactttttctctattttaatgaaatccaaaaatagtggcaaggaattgagtccctcggaatataatttacgttcatttgtttttgtagatagcttatatatcgttacatggcccagtgagtattttgtttctctgggt

SEQ ID NO: 128770 - DNA, 1528 bp, Homo sapiens
ctgtcacagcctcgttttcccttccttacccttctactttgacagccacattcctagtgcaataaatcataataattaaggaacatgatccctgatatttaacaaattctctcttctccctgcttcatctcctacacaaatgtatagaactcatttatttttccttttccttaaaggagaatatacttcctttaactagaaccaatgtattcctcatccaaattcttgtggctccttttctatattactctgtggcacttagagttccttaaagttcataaatatctttttcttttactcctctactagctcttcttgtattttgcaccaggaccaaggctggcactttgcatatagcagaagcttagaatagaactttgttgttccttgataaacataattttatcctctgagtgagaaaaacatctaccctttgccatttagaaaattaaatcagaagtatgtgaatgcgatattttatgttttttgttattattactaatattattatattaatttattttggggtactgttaacatgagggagaaccgtataatttataatgtatagaacatttttaagaacgtacctcaagcattattattgtaccaaaagattcctaaaatataaataatgcaataatgttccaaaatgtactcatacttttttagattatcagggtttttttcaaattaaattagatagaaaaaattaaacttaagcatttattaggttttagtgctatgcatataagaaataattaacaattgctcatctgtgtggtttgaattgaataattcctatttagatattattctcatttacggcacagagtaattcttattaaatgtaccagttgcagtaaagccacagggtgttaaatgttctgggtgctaatggagattgggacaagatcccttggttatgtcagtttgtttttattttcttcctgttgttatcaagaaaacaaatctagctgctaaaattacaagtatctgtcctagtagatatgtagtccttttttagaacatttctatgtgtttatttagaattagaaagtcagattgtgtattaatgagatgataaaggtactttttcatatgtagtaaatcaggcatataaagtttatttcctgaatttcattttagaacacagcgtagaagcgaatccttttttggaagtttcctaaattactgtattattgcttaactgagcccttttcttagtttttactacagttcctggtttgtaaatttaaaaagcccatgaaaatgttaattttgaaatgtttttggaaaagaaatgtctcttatacagtggttagtaggtggggaatttgcctagagatatgtgggggtttgagactttaggtttttttttaatgtaatatgtgggattatacaatgagagtgtaaattttaagtactcttaattctatactgtgacttgatgattatctaattaggtaatatgtgagaagttaatattttgtttcccaaagacaattgttttcctaacctttagaat

SEQ ID NO: 128771 - DNA, 1053 bp, Homo sapiens
ggatagaacactgatggcatctgcagtgaagtttatgtagagcccttttcccctttaagaaaggaagtgttagcattacctgggggtacatatctggctctctatggcctatagtgacctttatcaccctccattcttgccaaatcttggtagataaaaggtcataccagttttaaatttccaacttttatggatcctagctcagatgctacttgggattacaagaaggtcaaaatgcagtaagtctgcattagggaactcttcaaatacttcaggttcaattatatatctaatcaagtcacttcttcggagtacgtcttgctgagcaatgcatatcttactgtagtgccaaaatcccttagagcaagttttcttgcctccttatgttgggatatattgtataaaatctttatgcttatgtatattcattttgtaccaatgaggacttgaaaatgtcttttttatttttcattagggaattgcttctacgaaaacaatctctattttgtcaagcatgacatttctactggtaagggtaattagtaccaatgccaagtgcgctgttttctctgctggagaaatgaatttttagtagaaggggaccgaccacagtgctaaaaagcagcaagatgataaaacttagttgtccatttacctctatttagccactctcctagctttgaattgtcctgccttcctatccagaagcacaagtttcctgctgttttccactttagactgctcaagggaccggaagggagttggtactaaatcctttggccgtgagtgtgagtcattattaaaaatttagaagccaaattacaaatatgatacttcagcatctgtttttaaaattgttagaatcgaagtttaaagtgttctttctgcctttacaagtaaaccgaactttacattagtagagtggattacaactacagcagtagctggaaaaacacccatgtcacagaggggcaaaggaaaaagagcaggaagaaacacacaagacagcttctgtggtattgccgatgtcccatttctccaactgaatggatg

SEQ ID NO: 128772 - DNA, 1512 bp, Homo sapiens
gacgttaaaattgaattaagttggcattcagagctttattctcacagagattaccctatggatttcttgttcaatcttatctgctcttctcccttcccttctctttctcttcttaatacatacatttaaaataaagatagtcctttatattctcactttaaaaataaatttttggccaagcatggtggctcacgcctgtaatcccagcactttgggagaccgaggcgggtggatcatttgagttcaggagtttgagaccagcctggccaacatggtaaaaccctgcttctactaaaaatgtaaaaattagctgggtggcaggcacctataatcctagctacacgggaggctgaggcaggagaatcatttgaacctgggaataaatgtaagtaagtaaataaataaataaataaataatgtttactatttgtggcaacttgaattacagaaaccttgttttatatttcataaattctttagctgttaaaatgccttcctaaagatgagtacttccattactttggaagaacatcctttctgaggctatgaaatatcaattgctattttatctctgttcatgtaatctatctaggattcatagaatcttacttggatggggacttaatggcaactagttcaacctcccaatgcagtgttagaaccttcgctatgacagctctgacaggttctgcttaagagagagagagctcgcttgtttagatcagaccatatttggatttagtgctcaatttagggtgtcacattttaagaagggatattgaccaaccagagtgtaaccaagaaggtagtcagaaaattcttctctaataagcagttgaagtaactgcaggggagtttagttcaagaagagaccaagtgactgtctgttagagatatctagaaaaatcctgcactgggaaggaggcagaatcaattattctttccaatttcaatattgttattctttttttgtcctgctatattaaactatttttaggcagcttctgttatgaaggagttccacatttctggggcgcttatccaatggaacagtcacactgtcattattgatagagtttaatgtctactgacctatggatcagaatgctaaagttgtcagaaccaaggagatccctgcctgccaagagtaattcttgcccctcagctatattagtccatttctgaacatcctatctagaacctgagcccccacacaaaggaaaattagaaatgcagaatgagagtttctaagtcagactgcctggatttgactcctgactctgcttttaacttgccgtgttaatcaccctgttccttagttccctcatttgttgtgtggaagtaatagtgtttctagctaaggtagttgctgtataaacaagttaatacatataatgcacttagaaaagtgcttagtacatagaaaatgcccaaattttagctgttatttttaataaaatattggtatttaaaattttttgtatatgctatgtcattttattttatttagtc

SEQ ID NO: 128773 - DNA, 1042 bp, Homo sapiens
agctctaagaacagtgcttgaaagaaccgctgaccaagaggtccaggaccagagagaaagactcgtaatgggagagaaaacatacggctattagagaatctagtcatgtcatctgcagaagagacaaattggaggagtcatactttttgataaagaagtgaataaaacagcttttttcctttcatctcacctcgttaatcaatatttattttccacaaggtttctcttttaaattatcattctagtgttccaaaagttaagtaacttcaatgagagtgcctgatcttcattatggtactacttaaaaatccctttgaaagacagcattagcaatgaaatatatttatttccatggactcatgcctatatcgattctctagctgttaatttgtttagggttctcatctaaatatcactctctcaaagagctactaagctcgttgcttcttagtttcttagcagattaatcatgtctctgtgcctgatagaaatttaataaagctaattatgtgtttattgtattttcctaagaattccattttaatggctaatgtaatattttatttttagaagggaaacttattgatcttaaccaaatgatagatcaaatgaaatatgttttgataagacagagcaaaagtagaacattactaaataattatggtacagccacacaatggaaatactgtacagctcttacaaagaataagacagacagatatgtactaatattaagaggaaagaagctaatcatagaagaatataataacattcctatttgtgtgggaaaaaacagcaacaaaaagaactcagagagaaaacaaatacatgttcatatacatggaaaaatatctgaaatgatcattgtgcaactgtaaatagtgattacatttgggaagagggcttgtttggctggagggaaaaaataataaacgtttatattatagtattttctctactgtttgaatttttagagggaatgtggtaattttataatttaaaaaggagttattggggagaggatggtgaataaatgtaaagt

SEQ ID NO: 128774 - DNA, 1010 bp, Homo sapiens
attttcatttcagaaaccttaaagtaactttagtatctgaaatgccaggaatttgcatgttaattttggttgcattgatttttaaacttagtttggggggtgattcttttcatgggtgagagaattgacatttgctcaacctcaatttggaaattattttacctttgtcttccccacctcattataacaaatccacttttgtggccagtgctttcataaactacaagatatgatttttcaatagaatttttttttcttatgtttgctagataaatactagatttccttctgtagaagattaaagtatatttttagatatttgcattatctttttgagcaattgtattcaaagaactgattatattcatggtagaaaaatggcaagatcatgaattttttgtttgatactatacaaattattcttaaaactatccacgtttttttcttcaaatgcactttcggaaagatttatttattttctttgtcattgacacattaaggctcagctagagagtggttagtgatcgctcctaaattcagaatttaagcatatgtgatgcctgcatcacagaccttaaatatacctaattaatattcttacgtatatttgacacaaaagatcaaacgtttgtcagtatctgcataaaacaacattaaaggattgaccaaactgaaataggctaactatatgtacacttaaatacatgtctctcaaactagggttgagatagattcaagctacacggtgttatgctaggagatattcatagccacagaataaacctgacccacttttttggagttttcattttatttagttgaaagtagttttttatttttaaattttaatacgaatattaaaatgaagcagaataaaaaagttgtataaatattatgttaaaacctaaaatttctgagaatatttttctctaaactgcttcagttctatcattttcttgcttatccttgggcatataaacgtctcctgtagtgctgggagtacctctgta

SEQ ID NO: 128775 - DNA, 1022 bp, Homo sapiens
tgtagataccctttaaaaaggaaacataatcagatccttaaaggtaaaagttacacactttaggtaaatgataaaataactgcttttttaaaagaaactttaaaaaatgaagagaacgttttgaacatagatttttagaaaatgttcacttttctgtgattttgctgaaaaatgatataaatgaatcacccagccgtcatatctacataatttaaacacataaaaacagaattttctcacctgttcaaaagccttccttaatttggttttagggtagattttgaatctattcaaaacattgtaatgcagcacttcctaataacttcgcaagaacatcagtaaagatggaattttactacagaatttcaatgaaagccttagcataattagtaaattacattaaaattaggcattctgattgagtaggcatagttaacaatgcatttatttcattggctccatgaatctgtatgaaatctttgcaactaatatagccattcaaactaattatcaaaaatgaacttagagccacgtgtagtggcccgtaatcactcctgtaatcccagagctttaggaggcaaaggcagaaggattgcttgaggccaggagttcgacaccagcctgggcaacacagcaagacactatctctacaaaaaatttaaaaattagccagtcgtggtggtgtgcacctatagtcctagcgactcgggaggctgaggcaggaagatcacttgatcccaggagtttgaggctgcagtgaggtatgatcataccactgtactgcagcctgggcaacagagcaagactctgtctctaaagaaaaatgaaatgaacctaaaattaaaccctcaaattcctaatatcacaatttttataagtttttttaaatgtttaaactacagtcaatggatattttctagcataagtaattaaaatatgttttggacaggtaccatagcctatgccttaatcccagcactttgggagactgaggtgggaggatcgcttgagcccaggatttt

SEQ ID NO: 128776 - DNA, 2657 bp, Homo sapiens
aataaacaaaaattaccccagtattatattttataagacagtaaagtgctaaattgacatagatgttcagaaaaggagtaatcaaagtcttcaagaaatcaaggaagacttcttggagatgaggagacttatctacactggatctcaggagccataaaggcagaaagaagggtttctctgaaaagagcagcaagcacaatgaacgtggacttgggtctgactggagtagagggtgctgattgggatctgctggaagataagatgagtcaggtttgaccagattaagaacatgatgccagtgtttcacattgtcttaagcagtctcacaactagctaaatgattcttcttcctgtgtataataactcttcaaagctttaaaaaggaatgtttgaatcctcaaatcttttttttgcttaaatatgcttgtaattcaattaagatattataattagctatattacctaaattagaaaagaaatataatcaactactttgacagtctttgcttacatatgctgttgtctttatattctggggaaaagtttggtaaaaatccattcattcagaagaatttggtgagcatcctcattgtggcaagcagtaaataccagaccagagttgctgcctccatagaccagtctagtcgtcgaagggagtagcagaaatgggaaatggtcaggaaaatggtcattccgggaagaaagggtatgttgtaattttcagtaaggtgatcagagaagggtaactaaaaagaagatagttcttcagaatcagtgagcaaaagtttataatcaatatctatgagactttttaaaagctttgaaagttgatttttttttcataagaatgtattttctaaggtataaaaggaaactaaacaagatgctcaattccatgtgcccacgcaatgatttttcagatgaatgcactggacacccttggtcagactgctttgcatagagccgccctagcaggtcacctgcagacctgccgcctcctgctgagttacggctctgacccctccatcatctccttacaaggcttcacagcagcacagatgggcaatgaagcagtgcagcagattctgagtggtgagttaaaatagaccaacagggcattttatgttttctcttccatccctgctgaaatacacagacaaactttgcagtgtttactttgcctgaagtttttctcatgtcttttcttgcaatttagcctgtggacttccccatctcccttttttggtagggtaaggtaggtgtcatgggaaggaagcagatacagcttttagtttttttaggtttaaattgaaaacctgactcatgagtgttctgatcaaaggtgacttaaaactcatataaacagtgtggaattatggtagctataaaatctatcaaatagagaaaattataaatcattcatatggtaatgacatttaattaattgttcctacctgtgtaaaattctgacatacttttaaaattcttaacttcattgcattattataaaattatcttgtctttttctggcttaaatataattataggccgggcacagtggctcactcctgtaatcccaatactttgggatgccgaggcaggcagatcacgaggacaggagatcgagaccatcttggccaacatggtgaaaccctgtctctattaaaaatacaaaaattagctgggcggagtggcgcatgccttgtagccccagctacttgggaggctgaggcaaggagaattgcttgaacgcgggaggcggaggttgcagtgagccgagatcacgccactgcactccagcctggagacagagtgaaactctgtctcaaaaataaataaataaattatatatatatataaaattataaaattttgctgaatgtttcattgtctgcctggtatagtgttagatattttaaatataaattgataagaaaatagatactggcttcctaagtcccaaaactagaggaagtaatgcagtctacctactgacaaaatgaactagaatcaaaagtttagtataattaacctctttcctaaccttttaattttgtctgtggattatatctgctatggaatgaaatgacaaaccagaagagtaaaatgtagaaggctatagactaggagtcagaagtcctggttacttttttctacctacagtctggtagttcttaactctatcaggtacagtgcccgctttttataaagaatgtcttatgacatatccttatgacatttcagaagtgaaattcatagataatatgacctaactgtataggtacctttccaaaaatctatataaaacgccctaactagatcgggcatggtggctgacgcctgtaatcccagcactttgggaggccgaggtgggcggatcacgaggtcaggagttccagaccaccttggccaacatggtgaaacccccatctctactaaatgttaaaaaattagccgggtgtggtggtgcgtgcctgtaattccagctactcgggagcctgaggcaggagaatcactggaacctaggagacggaggttgcagtgagccaagatcgcgccactgcactccatccagcctgggtgacagagcgagactccatctcaacaaaaaaaaaagaaaagaaaagaaaaaaatgccctaactataatataaaggg

SEQ ID NO: 128777 - DNA, 1119 bp, Homo sapiens
ttactctaaatagcaggctataataacctggaagtagctgaatatcttctagagcatggagctgatgttaatgcccaggacaagggtggtttaattcctcttcataatgcggcatcttatggggtaagcatactaacattaaaatctagaaaactgaccgcacgcggtggctcacgcctgtaatcccagcactttaggaggccgaggaaggtagatcacgaggtcaggaggtcgagacaatcctggctaacacggtgaaaccccgtctctactaaaaatacaaaaaattagacgggcatagtggcgggcacctgtagtcccagctactcgggaggctgaggcaggagaatggcatgaacccgggaggcggagcttgcagtgagcccagatcgcgccactgcactccagcctgggtgacagagcgagactctgactcaaaataaataaataaataaataaaataaaatctagaaaacttccctggcatttacgactttattaaatgcatactatgcattaagtaagtagatatctaactaatagcatgatttagcataattttaatcttttgttcagagttttggtgtatcttcccggctaagcttaactaccttttggccaacagtcatgctttttattgctttttggtctcagcacgttatcaagcacaataataggcatgtaatgggtgctcagtttatatttatcaatattgtaatataatatatataatgtaaaataatataataaataccaatttcttaattctacctcaagtatattttaaaaactagaaaagctgtgcagctgttatacaggcatggaaagtatgttggcttacatttatcatcagcaccttaaaaatattcgagtagcaggcacagtggcatgcgcctgtaatcccagccattcgggaggctgaggtgggaagatcgcttgagcccaggagttcaaggccaccctgatcaacatagtgagacctcatctaaaaaaaaaaaaaaaaaaaaaaaattaaatggttgagcagttgatatatatggtttcagagagtaggaattactagctaaaacctccaggtgaaagtccagagttttggacatgaagtccttgcccacgcct

SEQ ID NO: 128778 - DNA, 1004 bp, Homo sapiens
ataaagcctctgtacaattaaatggctttaactgaagccaagcatgtttctctttcccctacttcccacctttttaaaattaaaagcttcccagtctttttaggttgtatttgtcatttaaagcattttgtattgcagctggattctgaaactaggttaaattgtctgtttctcctggaaacattccaacagagatcagtttcttttctggaccttctagttcaatactttgctcttatatactgtgttgaatagaactgaactgctatttattggatttgtcagccttaaattccagttactatttttgcctcaatggtgtagctatttaaaagaattaaacagcttaagaactgtatttttagtctatttgggtagtaatatactccttcctgttcattgttctttcagacatttgtcagaaaatttcacaagcatgtagttggtttgtccaagcataaactataacttcaatataaagaaagcttaataatacataccagatatacaattcattttatacacacatacagaaacaggtaattttccttggactttttgtaattttggaagcctgtgtaaattagtctaccagattatattattcggcctgtaaacatgggagttcaataaaattaatcatcagaaacacagtttaagtagcttgtaacctcactggggagaagcttgaaattattccgtgcttttgggttaacttaacaaaaattgctgccttttttcaacatatagcctttgaataagggagataaattactaggtttggttttgttttaggtgattttgataataccacgagtggtacctctgttttcatcttttgtgttagaaaatttaaaaataattaagctatagaattaattttatagtgatattataatcccagaagaatcacaaaacatcctgttctgagaagacttagtctgattatgctgcttatttattttattttttgtttatggggttttttgttttgttttgttttg

SEQ ID NO: 128779 - DNA, 1066 bp, Homo sapiens
gtttatgaataaatgagctaaattaaagtgtcatccctttgaaatttcaccagatgttaattgtacatgaaattattaagtgtgaagtaaataaccagattatagctgtttaaacgtaaacaaaatatagtaaacacagaaattttttctaaagaagggtgacagttaacactgaaagtgcttttttttaaatgaaagaagaaatatctttaaaaattacatagtttctccaattctgtctactgaaactattgaaactctttggagctgtggataggagaaggaatgatcaaaaaccagtaggtgataatgaggcattcattaaggaaaaaatccacaaagtatttggttatcagtgaaaaacttaccattttaatatatagtattttcatggtttttgtttttaatcatttttttaggctgacgatatcagagctttgctgatagatgccatgcccccagaggccttacctacctgttttaaacctcaggctactgtagtgagtgcctctctgatctcaccagcatccaccccctcctgcctctcggctgccagcagcatagacaacctcactggccctttagcagagttggccgtaggaggagcctccaatgcaggggatggcgccgcgggaacagaaaggaaggaaggagaaggtgagtagaccccatgaatgcttatttatttataccttttgttagtggagcagaatgacttttttctattgataactattgaatgcctcaattagagacgtcctgtctgtaaattttcatacacacaacatcttacaagaaatatttcttcatagaaggctgccacgtttcttggcattgtcgttgttcttatttctgtatattctagagcatctgtttacaaccatagcatcttattgaaccacttatactgaaattgtgtcagaacacaactgagaggtcatttcaggaatgaaaactaaaatgatagctgatacatttagattttttaattcattaaaagctttagatgtttctatataagtagcattctgtagtataagaattatactataatgttaaaattagt

SEQ ID NO: 128780 - DNA, 1061 bp, Homo sapiens
gtcagtaactgacttcctgtggcgtatttatcacattttattgatttgaatagtttaatagtttagtctcctagtcactccttctgacagcttgtcctggtttcatcagtttcattgttctttttttactgcagtttcattctgagtaaatggttccattggttttcttttagccagaataatttctatagccttttattgatcaatacatagacgattgcatttaatgtatattaccaagcacagttctttccctccagacaggtgatactacctttctttgtattgaactgtgtctggcccaatcatcaagcaatcaaatttatttttattttaattgcaaatgttatttatctagccttccattataaataaatttgataaccttttccataactttaacccttagcattttctcccattaacattctatatcagtaatatgtgatgatggtcaatgtatttgtatagtcggggaggagtgagggtgcatgcattgaacgcatttaattcatatctgtttggcttaagccaggggagccgttgttttctgatgctctttgacatgcttctatgtctcattgcctgtgttcctactcatggatgccagtggggtgtggaatgtagttattttatttctggtcccagaagaaaaccttcggcacatcatagcctcacctcctatcttcacagttactctcttggaagtctctaaactaaattgtcctgtttcccatagatactttgccaagttctatgttgaataatatagtatcctttctagttaatgaaatatagtacccatgtgactttggcccttcctttataacatagctttgtacctatgaacataggtaggaacactttttatatgggaaagacagattttatttacactgcaattcctagaacataaatgctatcacttggaagactgcttgtggacatttttatggttaacctatgtattttcatggaaagtgaccagataaattttgatttcaaattcttgaagacaaaagcatggcctcccataattcattgtgaacttgattataaag

SEQ ID NO: 128781 - DNA, 1329 bp, Homo sapiens
ctccctttcccccaccgttcatttctactccctgctggatactaggatctggtgttttcccattttcaagctactgattcctcctctatcttgaggcaagcagtagatgatagaacaaaataatctaaaggaaatatagtgatgatcattttgtatttctatagtattgtttctccctttttaattctcatggacaaaaagcaaatcaaagagtacttcaagtaagcagaaaagctgatgagactatcaagacaactttaaaaaaattgtaagctcatgtttataaagggaacaaaagaattttcttaatttgaatggtactcgtagcattgaaggcaattggaaaagcttttgtcctcttaagaactgttaaagatatcctagctaattttgtttcatttttcagattacactagatgtgttggctgatatgggtcatgaagagttgaaagaaataggcatcaatgcatatgggcaccgccacaaattaatcaaaggagtagaaagactcttaggtggacaacaaggtaagctattcagaaaaaaaaaaaaatttcagaaatcagtggtacaaggtaagtattggggctgataattgaactcaggcagtccagtcccagaaccatacactgaactattgtacctcctgtcccttccccatctcagttattggcctcatgctccctctagctggaaaaatctgagtcagtcttccctgtctcccaacactttgtatcctcaatttttctggaatctctgtacttctgtcctttcccatgactgtcacttgatccaagccaccattctctctcgtggactgtcccagccacctggtttatctccagcctttacatttgcttcctgcttccttccagtaccttctctacaatgtgaacacaatcttttcaaaatgattatatgatcatatcactccattgcttaaacccctgtaatagaatcctgtttcttttaggatagaatcaaacattgctaacatggttttttacaatctaacctttcttaacttgaactttcctccctcccacatgactgtcagctttgtctttttccattgtactttgccgttacaagcctctttcccctctgtttttacccatttctctatttgttagaagcaccttcactataggaaagcaaggaaggagaatctacagagctaatcaaattataaaagagtgatgtgaaattcaaactggaagattttgtgcttgagtcttgcttatttatctgtattttagttcatccatgaaactaacaaagataatgtgttttaaagcaattgtaagtggctatttcaagccatcttac

SEQ ID NO: 128782 - DNA, 1406 bp, Homo sapiens
tcaatgtcccctggtctgtgtaaatatacttagagatcccaagctgaagactattgagataatatggaatatttcacctacagaacaaatattttttaaaaattgtttatttttagcatttgtccaacgggcatttaaggagtttttgtttgacttaatcagagtgttagttcttcttctcaataagataagatagtaattgtagatgacttaatgtgttttttaatatgtttccccattgtgtttacagaaaactctttcagaacttttatttaaaagtaaatagaaagtgcataaatttaatatttatgtttgaaattattttctcaccaaaaatacttatccactaaacttgttcatcaatttatagtgaactcctatttatttattaatactgaattttagactcatcattgtctagaattacacactgggatgtttttataaaattagttattttgttctgtagatgcaaagtactattcgagaacacagagatggtggtaatgctggcggcatcttcaacagatacaatgtcattcgagtaagtttttaaagtttcatggtgaaaactggattgcaaggcttgcctaaaaaccaaatctagacaatgaaaaaagtttattaagtcatattttcaaactgtgaaagataattcgtcacctgtctgaagtcagatagcactcttctcactacaatatctctaactccccaagacaatacgtcactaaaaatagagacattctgaaagcgtcaaagctacaaacaggaggctaaatcagcttctactagtgatacttacgtggatattggtctccctgctcatgcacaaatacaggccatagctgacaataatgttttttatcatttgagagttgcatcaaagtcctggatcttcaatctaattgaaccagtaattacctcagaatacatatatttcttaatctcggtatctcaatttataatatggaacagatgactcaagctttttacaaaggggtatcataaagatgaataaaacctgtagagaactggtttaaccctttgagttaacagacctgtaaaagttatactggtacacatcagaataacccagggaacttttttaaaaaaaatacagatttacagatccccatctcctaaaatgtattaagtctggggagatgcctaaacataacctttttacctatttttttttttaatcctgaggtgatttagaggtaacagccaggtctggtatagaacaacaaaaactgtaactgaaaattatgtcactaacagctagagtattttctgaattacactgacatggtagctttatcacttttaaattatgtcttaagcaaaataaaaattgaaccttcctaaaaggaaaacatacttttcattttaaatcataaatgcac

SEQ ID NO: 128783 - DNA, 1051 bp, Homo sapiens
gcgtggcagggacggtggacgtctccctgggcctttgcaggagtcagtaaagggaaaaacctacgttaaattgactataatacggttgtgttaaaaacggcttgttttgattattttgttcaaataattacttcttggtaccagctttctaatgtatcacacatcagtacagactttccagtgcatatacagtgaaaatacttgatctaaaattattttagtacttaaattgcaaattgagccacctagtgaattacttttgttgtaattttgtactagtacattattatgtataatagaccttcttagaaaatacttttcatttatacaccattcatttcttaatattaacctgcccgatgcaaatagtgtgcaggtaattgagcttctagaaaagtgttcaaaaacgaatctttctgtcttcgtatttctaggttctcctttcattaatgccattattcataaagggtttgatgagcgacatgcatacataggaggaatgtttggggccgggatttattttgctgaaaactcctcaaaaagcaaccaatatgtttatggaattggaggaggaacaggctgccctacacacaaggacaggtcatgctatatatgtcacaggtaagcatcttgccattagtgtaacgtttcccacccctaggtcacgaaccaaattgtcttttttttttttttttttttgagatgaagtcttgctcttgtcacccaggctggagtgcggtggcacgatcctggctcacgcaacctccacctcctgggttcaagcaattctcctgcctcagcctcctcagtagctgggattacaggcacctgccaccacgcccagcaaatttttgtatttttagtagagatggggttttgccatgttggccaagctggtctcgaactcctgatctcatgatctgcccacctcggcctcccaaaatgctgggattacaggcatgagccaccgtgcccagccccaaattggtttatcaggctctgcagaagtcacagattatcctcagtcttgcatcccggtaaatcccgttgg

SEQ ID NO: 128784 - DNA, 1033 bp, Homo sapiens
ttttttttttttttttttttttttgagacggagtctcgctctgtcgcccagcctggagtgcagtggcgcgatctcggctcactgcaagctccacctcccgtgttcgtgccattctcctgcctcagcctcccaagtagctgagactacaggcgcccgccaccacacccggctaactttttgtatttttagtagagacgaggtttttaccgtgttagccaggatggtcttgatctccctagcaggcattttctatggccgattcctaagccataccaaaactactttaaactttaagtgtaactattgagtctggtaactgtttatagcaaatcattatatcaaattccatcccattcctactcataaatctgaaaatgacatttaaattagcttgccttatgttaaatttttaaaaaattaatagatctagcagttatattattgtaagatttaaagcttccttcaaagcattgtttttttctttttccttagacaaatgctcttctgtagagtgacccttgggaaatcctttctgcagtttagcaccatgaaaatggcccacgcgcctccagggcaccactcagtcattggtagaccgagcgtcaatgggctggcatatgctgaatatgtcatctacagaggagaacaggtatgttactcatcaaacaagcataaccaagttcacaaacatgtcaatagagcacagagaccgtgtaagacttgagacacttttcagtgaaatatccaccacacagtgtgctagtattaattacttcagatacaaaataaaggtatcaaaataattctttgacatcaactttttacctaaaacccattagtagctgtcagccacataacacagtgtgaacaagagggcagctgagaaacaaaggcttgggccctcatgccgttttgaggcctgcagctctgaactaatgccttgtgccacttcgtgggcagcatgccagggcagctgctgttagtgggtcttcatggatgtacatgccacaggatttgtccaaaaacaaaaaca

SEQ ID NO: 128785 - DNA, 3216 bp, Homo sapiens
cttatgacacatggctctctaataagggatgaatggagcttaattgacagtattcgaagtagaaataacattcagttttctagattgtagggtttatacacatttatttacagttaagtaggtgaacctcaaattgttcaggcacctattaagaaactgagtctatatagaatattggtcacgattaacagcctttgaggcttccacattcggcaaggctttaatattgtgcctactagaagggtgatttgtttttcttcttgtccttcccaggcatacccagagtatcttatcacttaccagatcatgaagccagaagccccttcccagaccgcaacagccgcagagcagaagacctagtgaatgcctgctggtgaaggccagatcagatttcaacctgggactggattacagaggattgtttctaataacaacatcaatattctagaagtccctgacagcctagaaataagctgtttgtcttctataaagcattgctatagtgatgaatagtatgagtaactgatacatactcaactgctactgttccctttgaggaaatgtttacaggggcggccttttaacatatctcaggctcattttcattgcaattatccatttctaaaacaagattgcttcgatctagacttggaaatggaaaataagaaaaccaatgctttttcaaatgttcacaattcacacactacatttgttttgttatgcatgacgtgtctataacaaatatacacatacgacaggcaacaagcttgtttttgatttgccagacatgcatcattggctattgtttgtttgttttttgtttttttgtgttttttgggttactttgaaaatgagccagagccttcttgaggatattttgcacaaagtcacgctgacaaaatcattagcagtgcaacccaagcttctggctgagcaagattcagtttccactttttaaaatttttttattttgctctgtagctgcacttctcgttatcataaattgagatgaaaaggaaaaaacatcaagttttagtacctttttatgaattggcctatcttacaagagaagggcacaaacaccaacctgacttaggaacgcctaaattcagagaagtcaaagccggtgaaggccacttgctctttccaacacaagcctgccacagaggtcttcgggacagtactggagatgcaggttgacacgggcttgagttccaaggtgaaaaaactggggaggctgtgaaggaagagctgcattaaggagggtgaggagcgtgtggttctgtatcatggcagccccaatggatccaggggatgcctccaaaaaatacatgcttcccttcccttaatctgtactgttgggattgttacccctccaaattagctgccttatttcaaaagtcagtgaaattactgcacttgatgagggtcacaaaaataccacttgattgtttctttagttgagaatgctgggattcagactcgaatagtggatagatacacacaaatgcaaggacttttttgtttactccagatttggggtttattttgagtggcatgcttcaaatagttcataaagatccttgcattaaatttctgaaccatttcttcaaacttcttagtgtgtttagacaaggagaacaaaaattgaaaccaaagccctttctgttattttttcaatgaaggtgagaaagaaataccatacaattttctttgtgaaattactgtttattttcatcaacatttaccaagtgccattgacatttataaaaaaaaatgatcctttatagttcttacacttgcccttttcaccttaactgaatatgaattgagtgcactaacttatttacttgatatactgtgcatctactctgctttgaagcgaaagaaatataaacacgaggaggaataggaaagacagtgtgacacaaacttgccattgcaattcaaagccctgaaaacgatgggtttaatgcaaggtgattaagctgtgacctcctttaatctcctgaagcaaaataaaatggttacatgcaaaacttctagaaatagactcttaaaatatatacattttgctttgattttggcttcaacccagtgctggaactaggcatccagactagtttgaatgtttgtagctgaatttttatgggtcctcaaaattaaatcgagaattagcctcagttgttgcttcttttgaagtttcagtgacccaagctgggtgtttgtgtcttggctacttgtttaatagcactagaattccaggtgaagctttgagagttgatattcattaagagggctttttttccccttctttccttctcttttgctgtaacaaagggttgaagaaattgccatctgtgtagttttcagtagctgtcaagtgtgtcttacttaccttcccccagacgtagtttaaaatggtaaacacagctgtgatttttagttaagtaaaagagttaatatgatatagatatggaaagctttatggcttcattaaaaagataaaccactacctaactgtggttgtatgttgtttccatcatactaactagatgaatggatgcgccagttttcatcttggtccttacacttgagaagttaaactgtggttcagtatttaaactgccagtgttatacgtctcatgctctgtgtgccaggtgaaggtactgtgtaaggaagacatttgcggtgcttcttgtcctataatgattcaagtatatagtagttcttgaaagagtgtgcatatattactcatctgcttaagagagtgggttaatggatatatcagaggagccaaatacatttttttcagaacttgaaaaccaaaggtcatcatgagtgcactcaaaagttaggacaagtttattacatttgggattttcatctgtagccgtatgaagaaccctttccaatataaaagcatggcattaaattaggctgaagtcttttattttttgtatatgtactatatagaaatactagcaagttaggatcatccaatatggcctaccccgaaatggcccctctgtttccctaaccacatggaagaaagaatctgaacgtctccaccggctctacccgagttccaaaactaaagggcttctccagacctgatggttccagtttacctgctgttggcctgctggatacttgactcaggcataaattaagtgccctggtcccgaactttctccctgtatttgacctccttc

SEQ ID NO: 128786 - DNA, 2968 bp, Homo sapiens
ctcctcatcttgggtcttaaaaaaggagaccagatacctcctagcttttgtatcacaaccaggaatgggtattaggcctcatgcgctttgctcagaacactgccgctttgttaacaaatgacagcatggaacccagagttttgattcgatgcaaaataacagcagtgcaaccaggattcttgttttccttttccttcttggagtttggaatttctagcttttcaagcagcataagtagaatcaacattaggatgttttcatgaaatagcatccttatacttctttgagcttgatgttagtggctagactgatttccctttgctctcaaaatacaaagtgcattgaagtatacagagaaatgcctgaatatggcaagcaaataatgtagattaacattctattattgtatccgttttacaaaaaataaaattttgatatatgccggagaacggcattagaatgcaataagttgtctaggtttttctgtttcagtgtctctcccaatggcacgaagggttattgggcattgtccccacccccgcctttttaacatgtgcactatctggattcctgtaaatggccttgcaaacagaagtggtgtgtattttcaagcacctttcccccattgtatccgaatccctcttgtgtgatatctgtgacaaatagccttcttcttgtgttttctgttggactaattgtctcacgtaaagctatagaccttactaatttggcaggtattcaaaactgccattaagataggatttcatgtcagatacgtatttaaagagtaaagtcaaatttgtttaatgtcagatcagtgacagaagtgaaaagaaagtaattgtgaaagtgatgtttgagctattgtacacatctagcatatggaaagcaaatgcactcgaaaactactattctagaacatgaggcttcttcagcaacttgtgcactctgccattaataaattaaatttttcccctctagaaagccttaactatggcggaaactttttaaccttttatattttaataaataaaacattgtagtcccatttcttagtgtttgaaaggtgtgtcagtgagtcggccatgtctccatgtgtttcagacctgttcatcttattttatgatggtatatttcataagtaatattcccttacatgcaatggagctgattaaaattaatccatttcaatttctccatattggaacttcctcagctaccagatttctggtttggagaagtgctggaaagatttcaaagcctattcagttgtgtatgtggggatacgacagcaactgtgataccttgtagaatatgagtgatatgcaagctgtgttttttaattgttttaaaatgtaaattatggttatgctaaagtgaaaacctagaggaagctaatgattttatatactttgcacgaccaaatatggtcgtagtatgacgagttttatacattgccagagagttctgcctcctctgaaataacattcgcactgtagattgcatttcggcttttcctcctttcacattcttttttgctttacacttcacgtcttcgcacctgccctacctcccatcctttcaaagaggtttctttcacgttccagaattcagattgttctgtgatttcttttacatcagtctacccatttctgcaggcagccctgaaagcccttgtgttgattcagagtgtttgcagagaaatgcagttgaaccctggtagtggggtgtccctcacacacccgcgcacccctcccaaagttcaggatgaaaggctagaaaacccattcaaagttaggaaagaacacagatctttgaggccgatagcctagacctagaagatgaccttgagtatgtaaacattgtctccgtgacacaaaacactgaaactcttcatgtgcatataacacctgcttctgctcccattgtttcaagctcatcttatctttgtagtagtaatgtttgtctttgatacctacaaactaaaaaggtacttttatcaaggtttctcaaaacatttacaaaaccagctttgagaaaatgttatgttgcctggcaacagcactcggagtagtaattgtgttttctcattgtgatgttggtctgtgtgagcaaccagtgtagtgactctttggttcattattcgtgttgtttttatttttagtctctgtgtgacccaacagtggcaggggttacaaccccctctcctttcttttttgtatttatctatttgtaggattgtcagatcaagtacaagatgcccagttaagtttgaatttcagagaaacaatttcacgttaagaatgtttcatgcaatatttggcatatatttacagtaaaagcattcattatttgtctgaaattcaaatttaactgagcatgctggtttttctcattgtttggtttttctaaatctggcaatcctacagctgtggtcatgggaaatcacctacagcatgttaaagtcctctagtcatcatctcgtcacctgaaatggaagtcctttttccctcaccctccacttctttccaaaggagggcatcaaggaacttaacctgcctgcctggtgggtttctatttaagacatctttgtgattatatttaacctgcaattgtgctttggcttaatgtctagctcactgtacttgtaaatgattaatattcaataaaaccatttttaaagtacacttgtgtggatagcagttagctcttaagtattttcattttgccctgcttgttcatttctgcctgaccaaccttaacacaactgacttgaaaaactgtcagaatacaaataccaaccctccctctccatcttccagtgagacctgggttttaagtgacttatcctcacgtctcagcccacatggcagttactgaataacttctgcaatagcacgggcaacatgggttcctttcagaaatatctcttaaacaaacaggctgacactttagagccagacctcct

SEQ ID NO: 128787 - DNA, 1055 bp, Homo sapiens
aagaattcccttatttcctagtgatgccatatggtagactatcaatgtacactagtcccaacttggagtatggcaaacattatttttaagtatcaataaactgccagaaaaaagttatgtgttagctaaatgatatcctcaaagtaagatttctgaaatttataggcactgtgaaaagggattggcaggccagggctgctctgagcttcacttgccagagcttggggacaaataggatgtttcagaatacccgatgactctacagactgcacgcctcctgcagtcgttgaagccccagaggcttcgtgcaatctctgggctagaaaaccacatgcccaggtctgctcttcatcatggatggccataactttaaatacacgacggtaatttacaatcaaacacatccagatggacggctcccccaaagccaaatctatacccaggacgcagatttctacaggaaaatgcagccaagccagaaaaaaaaacaactcagggaacaaacagtccctaccactgtaaagccatggttccctctgctgctccgaatggagcaccacatgaaggaggtgaggaggacagctgccaggcgtctgggaggacctacaatcagataccaaggcccaggaaatgggcaaggggcatgcatgcggaagacagaagtgacagtggggagggcagacatacccctttctagtcgtcgttaaagtatgagggcccagccttgtacacccctgaggccccactgcgtggagagtcctgcagcatgggccaccgttccctgggttaggcccagcacctcgagaagatggaccacggaggatgcctactctcctggaagccactgcggctccagcttctcccagcatggcagaccaagatcacaactggttaggttgctccaaagtggccagcctgacgggaactgccttgtgctaactagatttgtaggaggcttcttgttggctgagatgcctgtggactggtcttttttttttgtttttatttgagacagtctcactctgtcgcccaggctggagtgcagtggtgccatc

SEQ ID NO: 128788 - DNA, 2043 bp, Homo sapiens
agtgcacatcctgcagactgcaggtgctgggctgcctctggagtcccagaaggcaagcttggctgcaggacagaaagggagaacagcttctctcacccctgagccttcacaagcccttgtctatttgccgttgccttcaaaatatacctcccccgaaaccagtagctttctgagtcctggtgtcccctccgccctttctggacaggtttgggaagaagaaagcagtcagtgctgggccttattggggtgtgaagcgccttgctctgccccttctgctcactgtgaaggccgctggatgcttctcttaggcatggtttaagcctccgattactaaaccccttgccccacaaacgtccacattgacgagcctctttttagtaactgcttccccgtaattccttcagaggttgctgtacccttcgctgatgtgctgccctcctgtaaaacctccagatgccttcccacgtaatgcccctttcagatgctttaagctgagagcttaaaccacaggtaccatggctgacgcctgccaggtttctgctgcagataatctatgatgggaggggcatattttttacttcattacttatgtaaactcttgttccagaaagctttaatgtgtgtgggagtgttctgggtctattaggtctgtgcgcatgggtgtgggcatttgcctgtgtccaccgggtgggtctcattatgaaatgtatgtttatgtagggctttaatggctgaaaatggcaaagagatgaatagaccacttggccccatgtgtaattgccaggccccttctgtgctcaaatgaggtgtccgagtgaaggtcagcccttcccttctgtatttggggcctatttatgccaccagtaattttataagaaatctgaatagttctcccctttgagtgcatttaactctttagtatcttctctcttacctatttgagcccctctagctacagtctggcttaaatgaaaggggaattatatgcttaagaaaaagtaggacacggttgaggcagtttgctgactgaatacgcgaagaaggacctgatgggctcatatgcaccactgccatcacagtccccatcgtgatgcaagcttatatgattcttgaggtaactctaccagatacttccagatttagaaatgtgtcaaaggaaaaattggtgatactcttctttcccctgccagaaacagcccagatctcctcttaagcggaaaagagattgaccttctagcagaggcaaaggtaaactcctgtaagttacttctgttaccaaagggaggggggcggcttttgtgaatgtatgaggagcttttgccagagagatattcggaggaggggtgtgcccatatgcacacatatattttcccgcataaccgtatccaatgctagcatttagaggaaggcatttagccaccaaaagtccatccatctatgctgcttccacagagaaaacattttctctttcctcctcttgaacttacataatatcctcctcccattccaaccttagaatggagtcttctgggggcagctgcaaagcgttctccctaggacagatggagcctccctttcctcatctactctgtgggtggtttcagggcccacgagtcaacatgaggagttgtgctggtggtatgtgtgttggaggctgggctggctgattcacagtgacgaggatgtcaataataacaagaatgagaatgatggtacctaataaagactttttttcccaagtcccatctacaattctttcattgggtgttttgccaagtctttctcaatctcatctcagctttttttttttttttaaagaaaatgtattcaatacttaattgcatcacaaatgtagacatagaagaaaggacttcaaacggaatttatgggaggcaatgtgtgcggctttttgccttatagagctgtgtagaaggtctggaatgatcttccagcaccaaatttagatggcctcaaaaaaaaaaaaaaaaaaaaaaaaatcaggccttattgagggcaaggaatgttccaggtcagaaataaaag

SEQ ID NO: 128789 - DNA, 1024 bp, Homo sapiens
acgcacacgcgccgctttttatttctttttcctggttttcttattccatcttctacccacccctcttcctttctttcacctttccttccttccttcctcctttccttcctcaggagaaaggcctctctctccgtgttcacagcggaccttgatttaaatgtccatacaattaaggcacgcggtgaatgccaagaatggggctggctgagcaccgtgggtcggcgagggcccgccaaggaaggagcgaccgaccgagccaggcgccctccgcagacctccgcgcagcggccgcgggcgcgaggggaggggtctggagctccctccggctgcctgtcccgcaccggagcccgtggggtggggaggtgtgcagcctgtgacagacaggggcttagagatgcaaacagactcagggagagaaacagaagctgattctgtgacagaagcagatctgtgcagcacagatgcggtgtgcgtggggagggggtcgcctgggagcgcattgcggagtgcttgtgtgtgcagatttttctctgggctcaggactcattgtatgtgggtcaacaccttcctccgtgactgtgtttttgttctgagctgagttttttggtttgcccttaaaaaaataataatttggcatccagagactggcagactgcctcagggcctggactgcggatatattgtgttctgcttgaggtttggggaggagggcaggcggtaggaagggagagggggagctgtttgtcacactttgctgtagagctgagagcacctgacaagcttaaggaagtcgttgggctatgtggacaagaaggagccagctcccagcgggttcacaagctctatcggagttgaaagcgtggtcatggctctaaggagcacctcacgccctccctgtagctgttattgcagtttcaggcagagatccaggagctgcagaggaagggagaggcacaataacctacatggacccaagggagacatgtgttcctttaaaaatgtgaacagaaggaaaaacagaatg

SEQ ID NO: 128790 - DNA, 1055 bp, Homo sapiens
ggacaaagcaccttgggttcggcgagaagggacgcgcaggagcgctgaacccagaacacgcgtggccgctgcggaagggcgtccgcccggcgtgcggaacgctgagggtattcggattgtcttttatttgtccctgtggcttgctttcacagtgtctacgtaggagaggggtcggggttgttggggtctctttttttttctgggaggggtagctgaattgtgggagacctaggtggacttgacttggctttcctgctactctgcgtctccttctcaagatgcgggggttggaaaggggacaggggactcaaggcttagaaaagagaaggagccctctgctgcctggagggctaagggagtagagagtggagatggaggtgagtagggatgggccagcccgaagagcactgaggaggagaaggggtcttctcctccctcgggtccagtggatgagttttgctgggaatgagaattcgggtgtctgtcgataggagcgctgagaaattgatgagaaattgacatgtccgtgcacatgcatgaggcggcgacaggatttgtgtgtaaacagtgtggagaggtggaggagggcatgggggtgggggcttaaaatgatgtcttattgtccttttggctttagggactctcatcctctgtctcgccccctttttttgacccggggatccagccgcattatacacgagtgaccttttaaatctacgtccaccctttacctggtaaagcccgctgacagttgggggtggggtggggagagtgtaggggtgctctctccctctctccctccctccgcctctcctccctccctcccccctgcactcctctctcttcctccctcccacctccctcgctcccgccctccctgctgcattttgcatgagctatctaggtcattagcattttagcgtatgcaagacttgacaaagctgatgaggggccagatgggcctcgctcttatggtttttttttcttcttcttcttcttcttcctctctctctctctctctctgtctctctctctctcgtctctcttcctttccc

SEQ ID NO: 128791 - DNA, 1034 bp, Homo sapiens
tccgccaagactgctcggaaggttgccatactgggagcaaaagagtgagagagagaaagagggagagagagaggcagagggagagctgaggaaagaaaaaaaggcaagacttggcacagctcagtcaaatcagcttcttttgtctgctttctcggcttgagcttcaggaaagaaaaccgtcctggggtacagaaaaactcagaactttttggttttcaaacttagaaggctttttaagtctcttgggctatttgaaagtgttggtacatacaatgacgtttagtcaccagtattaagggaaataaaagcctttttcaaaacgaagcttccatagtgtccatgcatttgggaaatactatatttgattttttgcatgtatgattataccatgagagacaggattaatatagaagatggcaaggcaaatttctaattagagggaatattaattttctacaaaataaagtttgttcatcaatacaaacctgctttcaaatcaaatcagaaagacatccttcggaatgtgttcagaacgtaagtttttagattttattttattttatttttagacatttatagacattaacttttcaaggagcctttctaagattttatgcagcccagccaggaagtcagagtaaaagttgttttatccatgtgtttaagaaaacgttttcttaaagcaacagcttttatttctgctgcttcatgctgtcctaaactacatcccccagcaattagtgacaacactgaagaccagaaaggcaagctgaagacaccagacttcgcttgaagggcaaacaagaaatgtgagcttggtcattatttttttgtgtgtctttgctctgaaccatttttgggaggtgggtggggaggtgtctatgtctaagagatgtatgcgattagtgaattctcattgtgagaaggaaatgatgaaaggtgatttttatgatgttggcagaaatggctgggaatggtagagaatagaaatttaaatcttttggagaagaagtggtgagctgtgtttgcaatac

SEQ ID NO: 128792 - DNA, 1031 bp, Homo sapiens
gcatgagccactgtgtaaatgttttgtaggacttttagaaaacatggggttgtgcctttggccacacgcatgcttgtggatctacaagaacagcggtcctgtaactcttcagggaaggggcaccacatatctgtcctgtcaccatggcaaagctggaagggtctgcagagctacccagcatgctgctggtgttgttgtaaccaagcagagggcaagattctcgccatgagaattgatgtacatgtctagcatgtgaagcatcctaagggctgaggtgggttcctgaaacctgtggaggaaaatgctcagtgcaagaagccaaagaaaaaggcaccaggctcagcgggagcacccgcctggagaagcatactttgtgaggatcagcagaaaggagctgagtgtggaagctgtccccaagtcatggcacaaaagtattcaaaagaaaggatttctggattgttttttaaaaaacaaaactgtgatgtaaatgatgaattgtgctctgtggtctgattaggaatgtaagtggatccagagtacagtggggctgaggcagtggaagtatttttttgtgtttttttttttaacttttaggtcagggatacgtgtgcatgtttgtttaatgggtaaacttgtgtcacgggggttcgttgtacagattattttgtcacccggataccaagcctagcaccccaatagttattttttctgctcttgtccttcctcctgccctctacactcaaggaggccccagtgtcttttgttcccatctttgtgtccatgtgttcacatcatttagctcccacttctaagtaaaaacatgaggtatttggtttcctgttcctgtgttagtttgctaaggataatatccgccagctccatccatgttgctgcgaaagacatgatgtcgttcttttttatggtggcatagtactccatggtgtatatgtaccacattttctttttacattctgtcattgggcattaggttgattctacatctttgctattgtgaatagtgctgcagcgaa

SEQ ID NO: 128793 - DNA, 1051 bp, Homo sapiens
ttgaagatcagattgttgtaggtgtgcaaccttatttctgggctctctattccaatccattggtctatgcttttttttttctttcttcttcttttgagacagggtctcactctgtcacccaggctagagtgcagtggtgcaatcgcagctcactgcagcctcaagtggaagtctcgatgagatcagggaggagtaggtgtgaagacagtagaagttctgggaggctgaggttggggaatggccctttgaccttgggattgcagaggtcgaggggcttctggtgtgggtggggctgcagccttgggtggtgtaagtgaagtgataaagaccactggatcagaagacatctagaaacatagaggcaaaggggtttcaagaccttctttggggacattgagaccaccccaaactgccaagatttgtgatagataagtggacagggagatcattggcaaagccattgataaatatggtgacagctccaagaagattggcaggcgagagagaggctgaggagtgagtgtggtataatggcatgggcctcaaagggcttttccctaaggagaggggaatggtggttttcccctgtatgatttctttggggcaaaccagacccgtttttctgtaagcacaaaatttgtgcttttgattagcagaatatctgctcccatttcaggaggcatctgtctgctatccgtgtgactcttatggaaaattctaaaagtgactggtgccataattggagctaggactcacttcttgctcctatgattctactttgatattaaataagtttcctttatgagacaccagtcagtaaatagaacaggatgtatggttaaatagctaaaattattttcatcattgcaattatagtatgccttgccatttcaaaccaaatatccacttatctttcctgaaattttgcaagaaatctattattcgaggatgcagagatgatttttttttggttgagttaaacatttttatggattagatatgaattcagtaaaaataattgaattaaattgggtaatatgaataattcatg

SEQ ID NO: 128794 - DNA, 1042 bp, Homo sapiens
agagccttggcttcttggagctggtcagactctttctggattgttttgttcagtgatgggtggtaaattggagaatgttgagagaggcgtgactgggatgtatccctgtgcagtacagatagaggtgaaagattttaaaatggatatctctttgagaggtaattcattggtgtcagctggtttcaataaaggtgctatctaaagaaaaaggtgctatctacagaaaagcttgaagatgggagggtgtgggagccgcgggacacggtgtggatgtcacagtgaagggagaaggagaagaaagggaggcccaaggcagggcagaatcttgctgcaacttcgatgttgagcattctggcccacgggacacacacagcccaccagttttcaaaatacattctttgttcctttgccaggataagaaataagacggctgctttcatgtctctacttctcaaatatgtcagtcttttcagtgacattcttttattcaatgtagtgggtgatctgaattgcaagaatatttcctattttcccatgggactaaattaagttatttgcattttgaatggaatagaagactctaaacacatttatttttttcttcctgaatcatccttggaaaaagaggttgctcgctgttgatttatttcacaattttatctgggtaaaagccacttgcaaaaccactccccttatcttagtacaactgtgctagtgcagaactaaggccaaagggtggaaaattccgtgagagtgatttggattcactcttaaaatgatagcagcagcagcagcagcaagactcacagcagcagagctagctaccagaaacaggtggccctagagctccttgtccccagaaatacacaggtagaggctgggtgctgtcagtctcagtccctgaggagtagacctctgtgttgggtgttacattaggccagtctgttcttttgagatctaagattctgttattttaaaggctttcattactatcccattagaaggatcaatttgaatttcttgtatttgagtggaaaatgcc

SEQ ID NO: 128795 - DNA, 1049 bp, Homo sapiens
agtagattgaatacataaatgtcaaaggcaaacgtacgaaatttcaagtagataattttcatgaccttgggtttcggaagcatttcctaaacaagacacaaaagcactaaccgtaaaggaaaaatatttgacaaatttaactatatcaaaatctgacaactttggttcatcaaaaagcatcataaagaaaatgccaagaacagaaaaaaagaaaaataaaaaataacaaattgccaagaacagagagattatatttgataaaggattagtattcagaatatataaaaaatagacttaaatgtatgtgcagtatttttttttagaaaagacagactgctgagagaaaaaatgggcaaaggacttgaattgtggcaaagaaacataaaatgataattaacgttattaatcaggaaaatgcaaattaagatcaagtgagattccattacacaccaagcagactgacaaaaagtgaaaatctgacattagcagactttaatgaattggcaagcatttagagctccaggaattcttgtgcagtcatgtggttttgtaaattggtacgactactctggaaaaatagttcagcatgtacttaagttgaagacatgcaaacactatacagcaacaattctatttctaggtatgtactcaagagaaactcatgcatatgtataagagaatacatgtcaagaatgttctttacagccccaggctggtaatgttcattaagggtagaatgtataaatccattgtggtgcattcatacaatgggatattatgaagccatgaaaatgaagaaaatggaaggacctcatgatcataattgtaagtgaaagattcaaactgtagtataattgcatttatattaattttaaaaataggctgtattagtctattcccatgctgctaataaagacataccggagactgggtaatatataaagaaaaagaggtgtaatggaccccaagttccacatggctggggagccttcacaattatgaccaaaggcgaaggaggagcaaaggcacatcttattacatggcagcag

SEQ ID NO: 128796 - DNA, 1032 bp, Homo sapiens
aaccctaaatagacatgggtaaatgtcagttgatatgttatggtttggggattacatagctcttcgtctttaaaaaattttttttatctgtgcttttgtttaaagcatgaagttatgatttaaaatgcccatggaaaaaccctgaataattcattgacttaccttagtcaaaaagaaaaatcccccctccccaccgtatgcctagcaatagggataaaattcttcttagtccctttctgtagctttgaggttaaaattacgggtgttattatgaactctaaataagaacctgtgaaataaatattttaaaagtgcccatttctgggaggcaggcacccatatttctgtgtatgcagccacgtagacagctagatcttaggcataatggtttagttgcatgtgggtgattattttcatttccacttattactgtgtgctagactccctgtgtatgagtacagattgccctttcttgcactgtatttagaaatctctgtattacccttgggcatttgttcattaatagggggtggggaaaggaaaagcttgtaataatgggctttacatattaaactgtgtgcatccgcatttgggccaaatggaaaatctggtttgtatgactgccctctgctggctgtaggcctttgctgcagtggcaggatatgagtccctgggtggagcccctgtgcagatgccggtatcagtcttttattcacttgcactgagttccatccaagtacatcagaaacagcctaagattctacctactgcccaggttgatggtggaagacagcattcttgtgaggatcaaggagacatttttgattttagtagaagtacagtagaagtatagacacaaaataatcctggccaacatagggtgatgtttgaatgaatgaattcacatttctccacgggccacactcctactcatctttcagtggcaacaggggaatgtttagtggctcccatatgtgatgtccagaccccttgtggaatgcaagatgattttacggtgtatccagatgaatc

SEQ ID NO: 128797 - DNA, 1042 bp, Homo sapiens
tgaaaattgctgtatggttatttttccctcttgtgttacagaccaaactcagtgtctgatgtacagtggaataagtgaggaaagagacaatattgggcaaaccagtgaaattaggctcttgtttacatgagtagcccttactgagattcagctttttgttgctctgtgtagccttttgatgtagattccagagttgtaacttacatgataaattacaagtctgtatttattcatacattagagataggttatttttacctttgtgtgtgtgtatacacatttgcttggaatcggtgaatttctaggccacattgaggcaattgaacgctctttataagcagttaattgtctagacccaacgtttgctgcaaacacagtctggggcaaaatgggaattaacatttttacaaagacaggcatagaaattctaatccagcgaattgtttcctttctctggtagcagggctgagtcctacctggccacaaggctgccattcacctgtgtagcccagaaaacaatggtaaagaccaccagagataagaccagctaatccatgccttgtaatagtcaggtttcgcaattcacatcacctgtctgcaaaggtaaactcacaaacccctcctgagatatgtgtacagtcaaatgggatcactgctgtcgctaggccagcagctctagaagcctatgttacttttttttttttttctgagacggagtctcactctgtcacccaggctggagtgcagtggtgcgatctcggctcactgcaagctccacctcgtgggttcacgccattctcctgcctcagcctcccgagtagctgggactacaggcgcccgccaccacgcctggctaattttttttatttttagtagagacggcatttcactgtgttagccaggatgatctggatctcctgacctcgtgatccaccagcctcggcctcccaaagtgctgggattacaggcgtgagccaccacgcccggccaagcctatgtcgcttttaagatgaatccaaaaagactgtgtgctactaggcta

SEQ ID NO: 128798 - DNA, 1930 bp, Homo sapiens
tactctgacatccagtgaatctactattaagatggattttagagttaagtgagtccaggacgaccatcgatgtctcaccgaattggaactcactggtcagcagccgtaatgtttgaattggaaccagaaaatagctctcaaatttgcagagtcagctttgccgggcttcaggctgagtgggctcatagctggttggccctgtatctctggcctgggcaccgtggctccttgccaaggccggcaacccttgatggtggcagcacggagcagaccgagcccccagccgacttacccccgaggcctcgcgcctcccccttcacagcattgcgccttccctcttccagttcccagggtcgcttcaggctgtcccagccctctgcctagtcagctgtcagggaggggaagtggcaagtccaaggccgccagagggcttcctactgcctgccctgcctgtggcatttcttaaggtgacaaagagtgtgtttttaaaccaccctccagaactcttactccccatgaattctctgcagctgctcccccagaattgactggaaagagaacctcgtttaagctgcctatgcagcagaatgctgtgagtcagacgacgtcctgccaagtgcaacctgagatgcttcagtggaagcttgttcctcggtggtgacaccttgtctccacgctcatccattcgagtgaaaattcatctctttccctcccaaaaacatcatgtaatgaatgatggttgtttttgctctgaaggagacttttttttttttttttttttttttttttagacggagtctcgctctgttgccgggctggaatgcagtggcgtgatcttggctcactgcaacctctgcctcttgggttcaagcgattctcctgctccagcctcccaggcatctgggaccacaggcatgcgccaccacgcctagctaatttttgtatttttggtagagatggggtttcaccatgttgaccaggatggtctcggtctcttgacctcatgatccacccgcttcagcctcccaaagtgctgggattataggcgtgagccactgtgcccggccgaaagtgacttatatttgcatagattatctctgtaaaaagtgaaaggtttctgtgaacgtctggtacttataaaatatctttgtagggcaggatgggagatgattaaactacttcctcatttagacagtgccacctgtaagaagacttgtggtgtggattcaaagatggttatccacagtgagatgaatagaaggcagtacttctcaaactttcatgttcaccgaagtcacctggggatcttggtaaaatgcagattcggatacagcaggtctggatgaacccagactgcttttcctaataaactcccagaagaggcgcaggttttaaggctatgaggtgcttctctggaccctggctgtccgacggccacatttaatgagaagagaacccagctgtgtggttgttgactgcgatgaggatcgcactgacttagaaagttatgactttaatgttccttagtcgaatcactaagatttctatataaaacagcagaaaatatgggagtttggagaagagagaaatgagctggatgaaatagcttcctagctcctgattgatcattgggcatcagctattttgtgtgctggtgccgatgagcaggggaacacgtcgtgaacagagttgtgtcatagctggacgagaaggagatgttgtagggttcagttcgtgtagtgaatttttcctgaatccttaaattctcatatataaaaacatatagatatgaagacattacaataatatagaaaagactgtgtatgtatgtgtgtatgtgtaccctatgagaaatgtttttgctggtatgcgaaggggaaaatctagtgtttggaaagagttctccactgtgctttgggactacaagttc

SEQ ID NO: 128799 - DNA, 1050 bp, Homo sapiens
cattggccctgctgggcagccattgccataggagccagaggggtccaattgggaattaagaaataaactataacaatcacaggcctcattgagcggaaagtgctcagagtcattttccaagggaactccatggagattactttcagaatgctcacaaataagagaaacagattccttctgcatgtgaagcgtattgcagttataaaatgctcgtgcatatatgactttattttatttccattcagtaatgttatgagtaaatagggcatgtgctgttttcccgatttctagataaataaatgaaatctcagagagtctcacttttacaaccactgtgttcctagcaacggtaactatccaattgaaatgaatctcctcccacctccctccctctctctttctgaacaaagggggttagcttacaattagacaaaactaagatatgaaaaaaccataatgagtaacagtgatgtgaaacagactggaggtgcccccaggaatttgcaatagaaggttggaatggttagggaataataatttaaataatagctactatttttgaaggtttaagagtcaagatagacaactaaaaccagtctagaaactccaataaagctaaaaataggatttcctgtataggcttaagcgtgtgctaagcactttgctaagttgttattactaacattattattatttgaggcggaatcttgctctgtcacccaggatggagtgcagtgctgcgatctcggcccaattgcaacctccgcctctgaggttcaagagattctcctgcctcagcctcccaagtagctgggattacaggcatggcatttaccacaccagctaatttttgtatttttagtagagacgaggttttgccatgttggccaggctggtctcaaactcctgacctcaggtgatctaccctcttcggcctcccaaagtgtagggattacaagcgtgagccaccgcgcccagccgctaagtgattatttaccagcgaaatcttgtctaatcccccatccagttcatgaaataggtactgttttt

SEQ ID NO: 128800 - DNA, 1047 bp, Homo sapiens
tttatgtgttaaatttctttctcttgtagcagatgccaccagaccgacagtccctaaactaggtcagagagagtgatgaattgacaaagtccctcaggctacatcatccgcgtcctcacttcgtctccagttccctggcctgctttccctggcgtcttagggtggcccctgttccgagaaccacagaggcctagggggttcctctgtccagctccaggattcctgatttgcaaattatcagccctcatagctggaaggatggagggaggtggggcttaactgtccccagccctttgtgcctctcccgtatgctgagtcctctcattttcattccactctggcactgatggaataatgtcagaggacagttagccacttgaaacagcagccagaaaaccacacttctcttcttgaactttcattgtgttggggcccatttccaacaaacagaatccaagtaaggcccccctgtgtgcagttgtaacagcgttgatatagcaggtagagaataggtttttttgttgttgttgtttgaaataggatcaaaggaaccttatttcaaattccagggcacagagaccaagagaaataacgacttgcccagtgtaacacaggaaggaacagagtccaccgtgttaaaagaagaacttcagctgaattatatttaaaggagtttaactgagcaatgaaagattcgtgaattgggcagccctcagagtcacagagaggctccagggatgcctcatggtcagaacaaatttacagaccaaaaaaaaggcggggggaagtgacctataggaatctgcagtgaggtacagaaacaactggattggttaagtttggcatttgccttgtttgaacatagtttgaaccgtcagcagtgaatgaatggttgaagtgtggctgctgggattgaccaagactcagctatcgttacaggtgcatactcctaagttagggtttcagccttgtctgcctaggttagtttgtccacaaggactcaaatatagaagtacagagtccttctcaggccatatttagtttgct

SEQ ID NO: 128801 - DNA, 1046 bp, Homo sapiens
acaacagccccggaaagtcagtcttatcattgtcccgtgttaggattaggaaaagagatccagagagatgtgacttgtccagagtcgcgcgttcagtcacctgaacactaaggttctgactccggaccccacggcacccccgcacccccacaacgctgcctccttccaggatcacctctgtggagccccgcacatgggtggcgctcagtaaattttaaattccaggatctagtcaaacctgccgactttcattcagtaggtgtctgagctatatttgctcactcattctgcaggccttgagcgcctactgtgtgccggcgcttatatgagagcgcgggaacagagctcctcacagggggccgggtgacaggggagctgcggtgagcgcggccgagagatggccgtgagctcccagcctgcagtccccaggctgcacgtgggcccggcgcgcacggtcggtctacaccagggtgtgcagatgagggaaactgggggagttcgcaggtcgcagcgcagccagggggggacgcgagagggcgggagcgactccactcggagaagcgggactgccaatcggaggaagaaagaaaaaatataaggagaaaattcagggtgagaagagccagaagtgagggagctggaggcctggacccggagactgggtgcgggtggagtgagaggagaaatcaatcaggtggctgagaaccagaacgacggcctcgccctcctgagagccaggggcggcgggggcgtcgaggggtcttgggtgagcactgcacagaacccgaggcgggatgcggcccccagccccggctccggccggcctctgtggcggcccaagttgactggggctgcggtggccgaagcccggtcattttcgaaaggaatggcagtcggagtattaagaacggctgctctgaggggttcatggtcaatgtctctcacacccaggcgggctcggcgaaacctggttgggttgattttctgaggccacacgcgcagggagggcggtggagtctggcccgggcaggcaggggctggagcgg

SEQ ID NO: 128802 - DNA, 1076 bp, Homo sapiens
cctcccaaagtgctgggattacaggcgtgagccactgcgcccgtctctcagcctttttataactagactgatgctcttcccagaggccccgcgatgccccagcccgctgtctactgtagtcacaaacccgcgccccttttcctccatccttgccacagccagttccacctgcaagcctccctattgcagatgctcttcacatgtcattgttactcttaactgggaatggatttgaaagcagcaggcaaactgcagagtttcacaattaatttgagttagttatgattcggatgagctatagaaaatacttttgagttatgctgcacattagacattctcagtggattttcttttccaacttggtcaagaggtgggtgggaaattgggtgagttggtttcttaaaccctgtttgcaagtctgaaaaagaatgttttcaacttgtagaaaatactgatgcttttgagagatgaaatcccagtgagcatctctttcctagcggaggtcatccctctgcctccctcctcctccacctgttcactgactggcaggcacacgctgagacctgtttattaagaaacagtatcagagaaggctttcggcacagtctgtccgagtgatctcagcccttggatcagcaggcagcagctgtacgttgattggagtaagaacctcttcgtcaccgccctgtttatctcgctggttctgcagctgctgcgtttcggagcctgttgtgctggagggcagggcaggaggtcaggtcgggtgctcggtgtgtgattttatagtgcttggttattaatgagcaaattagtaccgtgtcctagtaaagtcgatgactaaactccttgcataaaagtgtccgatctatttaggaaatactgaatatactgcagtgacatacacaaagccttcatggaaccagtaaaagggaggaataagccagacaaagatggcaggtaaagaagggtgggtggggccgggcctctcctgctgtggacgagtgggtcgggggctggtgcagggtgcgtgaggcgcacttcctcccacctcagctgcctgttgtgcaggcattagc

SEQ ID NO: 128803 - DNA, 1197 bp, Homo sapiens
ttttcacagactaacccagcacaggctgatgacagacaggctgtggtggcagtgagcatttgttcatcacaggcaatagccatcagggctcacaaccccagttgctaaatacattacccttgatctctgggagtctactttgttaacaaagttcattgaaggattactgttgcagcatgacctccgtgtcttaatgtggaaataagaaagcttccatcatcctgtcacttaagatcagtagtgatgtatgagcaaggctggcgagctgaaagacttgcctttgaagcccatttcctggactggcatgttgatcataagtagggggattctgtagtaaggtgcatctgcttctggcacttcactaaggtctctgtgcaaactgcttcatttccttgccccaaaagattcttttgagaataatggagaatcctctctatttgggcattgtactaataatccatctcagtatacatgtttgaatgacacaagagcaaagtcctccatgagcccagaggatcttgcgcagatactcactcatgtagctgcagagtctccagatggaggatcctaaaagaagcagaacagactttaattctgtagacatccgagaagagttgatacatgtagcttcaggcatctttcagggaccggagaggactgtggtgtattgtaattgatacccgcagggactctctgcagggtcagcttgcctttgtgcccactctttgttttctcctcagtgataattcggaattgccagagatggcgttaagattctccagctctaatcgtgacacacagtgtacgcccatgaaccacctgaattgacctgttgctgatgaggaaactgagtcagagaaccacagcagccacctttccatattggcagtgtccaggtggaagctgtccagcatctgcccaagagggcttcttgcctgggtggaaggtttggacttgggttttactctgtgctttaaaacagtcaaactttttcaagtgaatgtacatgctagtttgataaattataaaactcttttaagcctggcttcaggctgttttttatttatatgaattgcaaaccaaaatgatgtagtttttttctcttttgaaagtactatttctgtggatattttttctgcatcagtcaacttaggtgagtgtagaccttagtctctggattatgtggtcaattgatac

SEQ ID NO: 128804 - DNA, 1118 bp, Homo sapiens
gcttcaagaacctttttggattctgaacatgcagggagacagtctttcttgtactttttcacttaagttttcaatatattttttgtttataaaataaaaacttacagcttgtgtaaaacaagagaagaggttataggattatatatttaatagcagtaacaatttttattttttatgagctccttggaattacagtctcagtgtaactggttagggtttttcttgagtagaattggctttgtagttggtttgttgttgtttagtttttgtctatgctaaaaataagttgtgccggtatattgccttttttttattgtgataagaacactgtctgatgtattattttatatcatttactcttttaacatgactaatttcggaattttatttattcttactaatttcggtatcttttaaacatagaatgactttgctttgccaaatttactcctaaaaatatttctcaaatatttttatttgctacattgatttctggtgaaagaaagagtatgtgaaaatattagccttatgtagtttataagaattgaaagacgagactttttttgttagtcaactatattcacctaatttacctttcttttataaacaatcatgactacttaattattccatgtaactatgcataccctattcctagtttcaaaatgaatattttattctctaaaaagaccttattcggctgggcacggtggctcacgcctgtaatcccagcactttgggtggccgaggcgggtggatcacctgaggtcgggagttcgagaccagcctgaccaacatggagaaaccctgtctctactaaaaatacaaaattagctgggcgtggtggcacatgcctgtaatcccagctactcgggaggctgaggcaggagaatcacttgaaccctggaggcggaggttgcggtgagccgagattgtgccattgcattccagcctgggcaacaagagtgaaactccgtctcaaaaaaaaaaaaaagaccttattctttttagaaattagaagattttacatttaatagaatcttcaagaactgctgtgctttctatagtaaggagcctacatttgagttgtcatggttcttcagcaattttcacctctt

SEQ ID NO: 128805 - DNA, 1406 bp, Homo sapiens
taattgttccctcatgagataattcactgagatcggggggctacttgggagtcttaaaaatgttcaaagacagtcgaatagacatgctccccattaggggtccacagtggggtgcaatctgccactagctgagggctgtctggggagaggcgctgggtgcaagtgcagtttgcaggttggttcctgggagttggcctgcagaaagttcctaggagtgctttcaggactgctttctgggggagcaagagggaggaagcaagattacacagggagaggatttggcctgcagtatacactgaagttttcagctgactccacagggagctcttcccaactgccccagatctttggagggggcagagtctttgtgcccctgcattgaccagtcacagggtccaaccctgtggggtgagcccttctggggcgtagctcacgcttaattttcctaaagtaggctggaggggtcctgcctatgctgcagccacgctgagacttgggactttttctttctttctcagggttatagttctgctcacactgtcttggctccccttgcttaggaaatgtcacgtttgaaccgtgcaactccccacttttactggcaccattcccctgtttaccaagacagccacgctacttggtgttgtagaaagagccaaccatgcaagagaataggaaggcctcttcacttttgtattggcttcaggaaggtattgatgccgtttatagacctaactctgatgttcaattatcaggtttgtcagtcccaagaaattcacctaaaatgtaacgtctctttaaatatattggcaaggaagtgaacaaatgattaagaataattttttaagataacaaggcattttgaatcgatgaaaatgtgaaaaatgaaggattataaaccaaaggcactagtggatccacatacaacctggatgtcctcagtgaggaaagtgactgcctcccttttactcaccgtggtctagctctgcgctcgccacataaactcccttaatctggtagtgatatacgcagtccagaatcttttcaggtagctaatccttccatctttaatttgattttcagggtaacaaacctaaacacttgtctagctaaagagaaaagaactattctcagtacactatttgtgttccattagagtatgtagtgtttgttccttacatggagtggggtcctgtacacacgtatatgttggtatacatacacaagcaacagacctccacatactgggtacttaaaaatcggtctttccacacaagttagttcagtgttgtgaaaagcatttgtatttaagatctttcttatttgagtttggggtttgagaacttttgttctagaggaaaaaacagcttcaaccccagcttattgttcaaactgtcccagtggga

SEQ ID NO: 128806 - DNA, 1172 bp, Homo sapiens
ctgtcatttgctgtgctggaagacttttttattcagccccgttagatcgcttacagacacaagccggtggggtgtagttggggaggaaccttgagagaagcatggggaccttctggaagggaaagggatgaggagggaacctgagtcctgagagtgagtgcagacggcgcctccacctgtgtcttgtcgagatgagggtcaggacctgccgcttggctgtgacagcatcctggcctcctgaatgcagttgtcctcacagagagagcactctgccctaggcttgtagggttttttcggtgtgagtttttaatttcaaatatttttaaattataaaagcagtacctgtccactctagagaaaccatgacctgtacatagtacattaggaagaagggggaaaaatccatgatccaaacagccagagataaccacagtgaaaagctgggcacgtggaggtgtgtgtgtgtggtctcagtggtgtgtacccttcctgtctgtctcaaaagcagggtcatcggatacggacaatactgaacttgaaaaacaattgaacacgttttgtctctttagcagcttgcgtttttggctctgccactgggcctgtgacatgtgttgtttatggtccctgtgctatttgaggacattcctaaaatgctactcctctgaccactgccctgtctacattgcaagggagctcccctctggacagaggctaagatgagtaagttctggagacctagcatacagtatgttgaccacagttaataagaacacactgtgtactcgaaatttgctaatagattagatcttaggtgtcctcatcactcccaaaggtaactgtgagaagtgatgcatgtgttaattagcttgactgtggggatcattttgctatgtatatgtaggtcaaaacatcacatggcacaccttaaacatagagtcttcctctgtcacttataccttattacatctggaaaaaaaggatgctcgtccagcatggctcctcatctcgctggcccatcttctgtctatgcagggtcccctcagttacactgtagttacatggtcagttaccgtcagccttggagaaggtgggagtcttttattcctgctccatgttctgtctgcctatgagatgcctgctcatcccgtgagggaaggcgctgcagcaggagg

SEQ ID NO: 128807 - DNA, 1034 bp, Homo sapiens
gtggaatgacaaatagcccagtaaggactaactcagaccgtggttgagaacatgttccctattcagctttgttggaagtggccctaacttggaaaaaacctactttgcccagtaaaattcccagcatccatgttctagtctgtagtccttggacattgtcctcccttgatcccctgccagcggctcctcttacctaatggccctgtgtcatgtcccgtcactcagacatgcagggattgtggttctgtctactgcaccccagtttagagagggacagtaagtgggattagactgctgtggagtggtcaccaatgtggtctgagtggctccacttttgcccgaatgctttctcccagtcaggccgctcacctgtccatttcaaagcgtattgaagttggacctccataagccaagcaggtgtgttggggaatgaactggaatctttggtggcaggtctagaatgcagagtaagagaaatggcagagccaggcagaagaaggatggaaacaggagcagacacgtctgtcccatcatttccccagcaactgtcaggcctcggggcctcaaggagaactgttcgcttgtaaaagcaacagcaaacacgtgaagcatgaacacaccctttaaagtctcaacagttctgttgagaccatcttaaattgatgattgtattcaaatatagttaacagcataaaacataagtttatgtttataataaaattatttaagtgaatctgttactttttgcaggtactctgtccagatatagattccaaatacactgaaaaaaaaaattgacaaactagaaaacctttttttaaatactgtgttttattgaaataaaatttaaatattataatacagatgatcagtttcccaagaaagtaggaagggttcttacctctaatttccttgctgtgaaagtgtacgtgagtacaaactcatttttctaatatcaaatcattgctgcttgtgcacaatttgggaaaactgattattttctgaaaaactaacaccaggaggagctactaagc

SEQ ID NO: 128808 - DNA, 1028 bp, Homo sapiens
taagtcttgacttgaagttttacgttttcctcgaccacaaaggagaggacattacttggattcttcttgattcttacatacttgagcaattttggctttatctacttatgcgctttattcagtagatgaatgtgaaaggctcttgatgtgtccaaacaagagatcaaatagacttcaggtaaaatagcaagtcatctgtcttagcagattcaagacttaaagagtaactgcaactgttgagtgtcaaggtgaagttaccttcaccttgggtagggtgttccaattttatctgtaaactcagttatctataaatgagtcttgagttacttgtttgtgtagcagattctgttttccaaagatggcctcagtgatacctctcattccacatgctcttctaagtgggcccttaccacctccacaccaggaggtggagtctggccccctcccctctacccaggtgggcctggaacttgcttgtagccaagacagtctagcagtagggttccaggtgacttctgaggcctcgttggctggaacacttgctcttgaagctttcatgtaaatagtccagctgccccgagccccaagctatgaggaggcccggtgcccaggcaagcccccgtggagagaccatgatcagtgagttatgcaggcaccccgagcttgcctggggagcaggtgcctggccagctccccgctttgctagctctccccaccttttgacaatatccgcgtgagagaccctgagccaggactgcccagcccagcccttcctcgaattgctaacccacagaaatagggtgaacagggaaatggctgatatgtttgaagccactgagtgtcaggatggtttattgtgtagataaatgaaatggctgtcttaggatttgtcttcctgtggttctgtgattagacattgatacctggtatcaaatatatatacctggtagaaccatctgagccagtagaatgaggaaatcaggtcatctaatgaatgttctactctggtttcttctaaagggcaactg

SEQ ID NO: 128809 - DNA, 1673 bp, Homo sapiens
acgttctaataaataagtatttcttctctgagagtaggaagtactcataatctacattctacgccatgcacaatctacttgtggattcttgagaaaggattattgaataaatgtttgctcacaccattttatgtttttaaaaatcaatccaatttgccagaaactggctttcagaccttgcatttcactctagaatagtttttcacagctgtggctgtttttcattgctcagaagataaagcattcctactgcttgaaggactctcctctgacttcattggtgcttcgtatttcctccagacacagcagctgtcaggaggcgctgtttccctgctgaatccggctattcagaagtacttgcttcaatggtgaaagatcatcacgaactgccagttgctcagaaaacttctcataaactgttctgtgtggggacggctggttgcacatttctaatttccaagttcttccttttcccaccatctttgttgtatattgatttggaagataataactggtttggagtgcacctaaattggagatgtatgcactttctgtggagacaaagaaatgatcgaagataatgaattgagattcccagggccccttgagacctgcagcaggtacttgtgctgaccggtgcctgccggggcctgtgtacataagcgtgtgtcttctctcacttggtttgcaatttgaagttggagacactgaaaaacaaattccatcagttcctatctggttgaacttcctgctactctttttttttttcctctctcatttttttccctcccccaccttcccagtttccttcctctctccagcttgtttccggattgagccttatcactagagaaaatactccgaaaccagagtgaggatggagaatgtgttaccagcattctcacttcgtttctctgtctagcatgcttctggcatgggctcctggcaaaataattctccttttcttcacctctctaacctgattgaattagaaccctcatgagagtttcactctcccaggataccaaatcaataatcattttccttgaaattcttctgctggcttttgctttttgaggcaaagcatgacttctttgcagtttgtgttcctttctcgtctctgtcaatctcctttttttccccattgcttgctgattatccagtctgaaaatgaattccgagcagacgcttctgctttgcttggtggaattcatgaggtattttggaccattcatttttctggttggattcaatgccttaagttcctcatggggaagatcactgagaagagtctctttattgccttcatttttcaagtgccttttaattcaagggtgtttctccttttctgaattttcacactgatacccaacatttatggttaggtgattttcaagaggggtttataggaggtggatcccccttcctgcacctatcgctctaccctccccccactccacatctggacaccaaagtaatcttctaattaagaaccttgtagttagggagaactataagcccacaaacaagccaattaatacacttgagttccaaaattcattttttcccaacagtgatgacttcagtaattcttgtcatcattttgaccattgataacagaatcctgattcaaaatgatcactgtgagctgggacagttggccaaaacatttt

SEQ ID NO: 128810 - DNA, 1029 bp, Homo sapiens
attatgtacagcgtttggagcaggtctcaggttgaataattggcatttactattttaagcgcatccttggtattgcatgttcttttgtatgtagtaacgcatggcaatggaagctgtaatgctgctgctactactgctgatggtgatgaggatgctggtgtccacaggtgctttcagttgtgctgatggcggagtatggaaggcccagctctagtatattgagcatttgctttgccacattatgagggaacatttcagttttaatcttaagaggtcaacttatatgtctagaatatacatttattagggaaatcaggataaatgatccagtctaacattctgttgagtgttgaattaatttctgtattgtaatgtatgtcatattttacatacatacataaaatacacaaagttgtgcatgtgtatgtttgtgtggtattttccgggtatcatctccattgctgatgataatgctttttcatttacaggtcggcggaagcagaagtgggctgtggatcctcagaacactgcctggagtaatgacgattccaagtttggccagcggatgctagagaagatggggtggtctaaaggaaaggtattttggagaaaagcggaaaaaaatctgagctatgaaaagagattagaaattaggggaaaacttccttcttaggagactggaagaaacttatgctttggatcagtaagtgattttgatcccaaatcaaaaattgttgtgaccttatgatgataaattaggattggacataagtgtcaactttctatcatttaagctgccatgcttagcatctttcatagacattgcaactaggctacacgctttttccctttccatttattcttgactccagtagagcctctgctgatacctctacacttaaatggttcttgttgaggtctttagcgatctctaagtgccaaatcagtgggccgcttgttttgttctcacattacttaactcctcagcagtgctggatgtaattgactactctctccttgaaatacttc

SEQ ID NO: 128811 - DNA, 1052 bp, Homo sapiens
accacacagggaggtggcctctcaaagttcagtgaggcagcaggaagaaaagaaaggtagaatgtcccatcagtcaagcaagggagtgtgtaggcagaggtgtggtggaaaatccagaagactttcagccaagacacttgatcccacatcgtggttttatttcttttgaatcaagttgagcaaatcattcaagtgcctaggtcacatttttctcacatggaaattaaactaatgtgttatatttctctagttgaaaaaggtcattacaaggaataagtaaaataaactaagaaaatatatagaaaagcacttagcaaattggcatgaagcaagtgctcagtaaatatgagttaaatctgagatgaatgatggtttgggcaacacacccttgagcagacatcatgggtgtggggaatatggggtccagtgagagtctggggtcaccgtcagcctgtggtgcatggtggtcaggcttggtagagccccagatcgtgggtggtaaagggaatgattaaaatttaatatcttgaagctgggagttaaaaatgatttgtgtaaaatagaagtccaacttttctgaatgtatgcttggctgacatggtttgtctatcagctccagggatgcaggtggtcaccatcccacccattatgaaaagattccaggccatggatcagcaacagtagagttattttatggaagttaaagagagaataattataaggaacaagactgaaggaagttggggagttccagttgggatcccaagcctgcttgtcctattaataagttctaaggttcagaactgccatcccctgcatttccacttagacatgctgaaaatctgaggtcaaaggccaggccacactttaaatgcttcaggagcagatctgtctgtggggaggccctcccgcttgtctcaattctctgtgcctttgcatctctcgtctcaatgtctgtatggttttgcttctgtggttcttaaagtctcagaagatgaaacaaggtgcacaaactgttgaagaatctgtgtgtagtgctgagagaactgggg

SEQ ID NO: 128812 - DNA, 1052 bp, Homo sapiens
tttctgtcctgcctttggcaataccttaaatattctgtaactgatggagattcacctagggcgttgggtagtgctaatttctcccaagggaacaacatcactaatactgtataaggtgctagaatcaaacctcattttatatactttggttcttagagaaaaacaaaacatgcagaattatttctgtgaagccttactatagattgctatagccaattgtttatccaaaaagtgagacagagagaatagaaaatgaagataagatgcagagattctgtataaagtgtaacaaaaagacctttgctatttcttatattaaggtaaactatcatatatatatatttatatacatatatatatatatgtttgaggcagatagaatggaaaaacgtacagtgtggtcatctttattttgtcagttaattcacaacttttagtatgtgtgcaagagaggtttagagtggggatgggataagggatgcccagtgtgatatgggaaatcattcatctttctgttctgttccacatgttagtagaaggagtaggctgaatgagaggaaaggggaataaatcaagacatagatgtgctttttaaatgttctgagcattgatgttatgcttttgtgttgtttcttctttattccaaggtttctctacagtgctgtaaaaatgtcccctgcctagggcgctaaccaataacgtttacctcaagaaagcttaaaaaaaaaagaggcagtttttttcccatctcttaaaaaatagtgtccctctaaccaaaaggtgaggcatttccgcagaagttcagcaagagaagagaaccatttctgaggctttccttcatgtccccatccttttctaccgcaccccaccccctttagttactaatgaaagaatccaagagattagttttgaccagaagtgggttaggatgtgattaaagtgtattattggtgaatataaactttgccagaactagcggtgtggggtcctttcaaaggatggctgtgtacttcagatgtttcatgctagcatgtgtgtgtgtgtgtgtgtgt

SEQ ID NO: 128813 - DNA, 1054 bp, Homo sapiens
attttgtgcggagtaagagttaaactgccaaatcccgtcagacagccgtctgttgccccggtaacaccctgcagctgccggaaagagagagatggcgcttccgggcaccaagccttcattctcccaagtctcaagcgagctgtttggtgccttggttttctgtctggaaagaggggaatcgggagcccgtcccacaggccccctgcgtgccttagcagctcatgtacgatgagtatgtaccgagaatgttcttgtgttcctcctccctgcatttatgcagcaaaatgttctctgcgcacgaggtgccatgctaggtgcagcagtcagcagcaaaccaggcagacagctgcctctaggctgtgtcttgagtgggaaagtctgtggggcccccagatccctgggggaccgtggtgctcggaggagccttccaccgttgctcccgcatctctgtagtgagaggatcgagggcacgtgccctgcttgcatccatgcccgtagggctgatgtgcttgccagagctcagatgagccgaactgggaaggaaatgggctttctcagaactggcaaggaaggacttaagaaggacgtgtgtccacaggacccaggggacccgccatccatgaggccagagcttgctggtgttcaggttctggggccttggcaatatggtttcctaagctgagagcccaacaagcaggcttgtggtccagtccagttggtggcccttggcctgtccctttaagagagaggaaagggaaggcgatgtaaagaggagggttggatccctagtggaggaagcctgtaaacacacctgcacggggatgtggattctgggtttaacagcgccctggagcgctggccggggaaactaagtccgaatgcagttctcacagacgtgggctatgtcaggggaaagggctttagaggatgctgcaggtttaagcccaggactcattccgtgtgcagtgagagcaggtctggcagcgcgagtgggcccagctgcagctgctggggaaatcaagggatgaggggcccctgccctgaccaggtgact

SEQ ID NO: 128814 - DNA, 1038 bp, Homo sapiens
gcctcttacatgacccatcatgagggtcatcagaggaagtggaggaggagagcagacagggggcacagccatgtgagctgaagcctgtatgaccccgaggtgtggcaacacaggctctggccaggctccagggagggccttgcgggagagatactgtgggtggagtcaggggagaccgggagagctggcatcctctggtgggggatggaccaggggggctgcttctgcttcagactgagaaagaaccccagggcttctgggaggcagaaggccagagtcggtccctccaaatgtagattttttttttttttggcatatcttttcaggttggagagtggaacctgcctgccttatcaaagacagtggggcctctactctttatcccattaaggaggatcctagggccatgtttctgggctgagccgccccacttgatggcagtgattgtggtatcggtctcagctctgctgatggggcaagactgggggaagggaaaacatggaaggcccggtaatcactcttgtaagttagccacaatcaggaccccgaggttgggctggccatggagcagtgggagaagtgccccattgaaaaggagcagcctggggaggggcagatgggagaatgtaggtgcaggagtggattcggatcaagggaggagattcttcctgacgggtgcctttctgaaggaagaaatcagttatgaccagtttagcaggcaccgagggggcagggcccaccttggccaggggtgggctgttcgctggtgggagcccatgtgggtgtcacaccatcagtgtccagctggctgggttggctgcagctcctgtaggagcctgtgttcctgggaagcctctctctggtgaaaggcaaggtgggcaggctgtgtgcagaggagaaacccacgctgcccatgtccacacagctgtgtgggcaccaggacctgccgagatgccatcccaggctgcctgaagcagtagctttctgcagaagagacagggaggagaaagcattgtgcaggcacggagcagcaggcag

SEQ ID NO: 128815 - DNA, 1041 bp, Homo sapiens
actccgtctaaaagaaagaaagaaaagaaaaagaaagagaaagaaagagaaaagaaaaaagaaaagagaaagaaaagcaagcaagctggggagcagggttggcgactgtgggtagtcaagggctgcatggtgggcaggaggccctcagcgggggtcctgggccagttgctccaggtctccttggccctcatggcctgctgtaagatgaggcggactgactggttggatggtttggtctgtcaggcccctttctgctccagtcttccatggcgagaaacctatttattgattattgcagaccagaaaaattgaaagaggttgaaagggattctgagttcttttctggccaagattcctccagaagccggcagaatgaggttcttgatcatcatccagggggaagagtttctctttgggctttactcagcctttcttgcagtctcccggctcttgtttgcagggcaggaccatggccagctccctacgaacgtgagatcagcagtttctctttctaacctttatcacccgggataccccctgtccccactgcagagctttcacatcatggcttccagagcatcagatctttccagccagggtcctcacctacccccctaaacctagaggggagtctcaggtcaaagtgttccatttgggctgcaaactccatataatgggttgcaaccagaattctaaaactaaaatgagtaaaataaaaagtaccatagtgcttccaaggttgtaaggatatgtattatttgctaaaacatttgctcacttctacattcataagtgcgtgtgtgtgtgtgcgtgcacaatgagttgcagtgaaaaatacatttcttactcttgagttgtcagaagaattttaaaagcaatgagttcacagtcccttatcgcaaacctgaaagttttaagtttggcatgaggtcatttggcagcaaaacacaacctcatgtaatttaagattatttatactctttgtttatctcacttgctatgaacatttgtatgcttaactgcagaatggagttgtacctt

SEQ ID NO: 128816 - DNA, 1372 bp, Homo sapiens
ggctggaaatgaatatcaagcttttcggtgcctggagccaactttgtccaaataaaagagctttgtactgtgaaggaattttactaagtaaattttgtttaaaaaatccacgtgaattaaaggaaaggaaatgaagaagaagatcgtatcaatacgatgatctaaatcagtgttctgcaacttttctacccagtcatcagtgggagtgaatcagtaggaatgtggggaagggagtgaggggagacccccttcttgactcagcagtggtgacggtcggtgtgtcctgcagacctgaagccaagatcaagggcgcttgagcaccaggagcccccgcagttcctgaatgaccagcggagggcaggtgccagcctgtggcaaaataggaaagaaaaggacaggatggggacttcaccatttttttcagccttaaattgttccttaaaccttcatgtccttttctctaatgtatgttcttgtttggtaaaataaaaaagtttgtaaccctgagttctctaaagatatacattcttttttactggtttgtgaagtcagaaggatgagagctgctatttcttggaaccgtgcaataaatattagcatattcagtctcagttctgcctagaggacctatttgcttttctttatctcgtaacccataactcacaggacattaaccagggtgtccaagaacagtctgggaaagttttgataattacttcagcattgctgtgtgatgggagacattgttttaaaaaccgaatgtggtagaggttaaaaggacagccgtcaccatcctgtttcaaccaacgcttgactgagaactctttctggaaatctctcgaacagacttccaaaagttatatgtgaaaaagcactgaaacctcacataacgcaaagatccactgcaatacaggcatttaggaaatcatttacactaccttgctgatcacttttcacacttgatcttagccaaaaggccaagaagcgatgtggataacttttcaacctgtaaaatagccaccaatctgcaaaaaaactaattgaacactaataaatgaccaaaattgatgcaatggttataactggtattatttttatttctgatcatctacaatatcaagtttaagactgactgtatatgtcacagttttgtgtgattaactacttttattaattgtctttaaagaactgcacaaaagcgccctgaaggaagagaaaccaaggatgaatccatgagggattcgggctgtgtggcgattgccttcattttcccagtggaaggacattttccagagaaatttatgctgaatacccatttttatatctcgcccgattgagtgccaatcactgtgccaagggctgtatatatact

SEQ ID NO: 128817 - DNA, 1487 bp, Homo sapiens
tttcctcttagccagttctagccacaatattgactgggcccaggcatttgctacactcagaaggaattaaccaggcaggagaaaacttggtccctactggaatgaatagtttaaaggccatcttagatgctgaaaactctgagcacaaatgaaagcgacccaagaaggaaaaacttcagagcctaagaataaaaaatggtggtagggttgggggataaactcgcccagagctgacttaaagtgctgtcagggaaggaagtgcctttcctggggaggatgagatggtccatgccgggtctggagctgtgggcgttctgatgttggatagcccaccctagcaggctgcagtgtcttaagggtagtggcatgagatctttggaagtatcgatacatttcctaacagtgagtttgagtttgttctggtatgttctgaatggatatgtggctcaaagattaacttagctaaaaataagtatattagatattagggaaatattgttaataaaggtcttctgtccctgttggataactttagaaaataatgtagacaactgaacgtagtggagatgatggcatgaatacagtcagggtttgatgcttgcttcctagaaacttcctagaaatagaacacatctagacatagggaaataaggttccaaagaaaaccttacacttttattcagattttatgttggcctcagttgtactagaaaagcgtttcagtatgtgtctcttggggaatctgcaccttcttggtcactgcacttcatagcccggcatatcactgagaattcagaaatctgactctttacccagggacgaatacatcgttatgagttcaggtgcactaaatacataggaacacccagagaaaatgagcccgaaacaatggttctttttattttggaagtttcagacaaactctttggaaaattgaagaaatctatggatccttttcctgggaagactgtacagacatacgtattcgtgtggtttctgtgggtgtagggactggccctggtcatgtgtcaggaagccccaatccagaagatcgtcttcattttaccttggccggtgatctgactctgttctcgcgcccatctgtggttgattctctgtcgccttggaatggagcatcagatcttgaaggtcgctcattgcttttccacgcatagaactgagccacatggcaagagcttcctaatgaaatggacggaaactctctgcaaagggctgccccagaagcacgggtgatagaaatagagtccaaggcactaaggccgctgagccacagtcctcctaggcaatgcctcctgctggcttagtgggtttatttcataagttgagtactaatgtcctgttttttaaatgaacatatttcttctaacatttctaacaattatgaagattttctccctaagtgtgactttttcttatgtcttggggtatcagatttacagcgtaacatgtgtacttcaaattgtagt

SEQ ID NO: 128818 - DNA, 1064 bp, Homo sapiens
acaactttgaagagcatctttcttagttcatgtgctaaaagttaatgtaatagaagcacaaagactgtaaccgctattactcgactaaaaaaatagtttctaaaagtatgagatgcataagaacaaaatctataattttagttatgcatctgaatgtctgtcaccatgatgacaacttttaaaagaaaataaagacagaactaatgccactttaaaggctcaaattatgaatgtggagatattttgacccagtaaatactctataattaagtaggtggtgtggatgagtattgtgtaatatttattttgctttatgaaaactgccttgtttttaaataaaactttaatgttagacttaagagcttataatggtaagacgataaaaagtattaacttaaaatgttttgaaaattataaaagtaattattgaccatttctaagaaagtctttcctttgacattgtttaatttgtttcctttttgttttttaggtttgcaattttttttggtgatggcatgttcagaatcttggatccctaagttcaatatattggacatatttaggaactctggaaattatgttgttttcacatatctagtaacttactagatgaatcagtagatttcattaaagtatatctaataacagataattatgatgtacttctgggttgacatgcatgtctctcattatcagctatcagtattagtgtcatgctttggagacagttatcttttgaaggttttggggttcttatgaacctcatttttcccaggaagtttctgtaattcctcctatgcctattcttgtcttttctgtctgcttgcagtgtaagttatttagatcagaggcaattatttttcaggaagaaagaaatcatcaagtgacactcctaaaggcagtaaagacaaaatttcagtctggaaccggtctcagaatggcctgtattagaatatgcaaagtccacccaaattatatccaaatatacttgtggcacagtgctaccagtttttaaaatgagacgttactatgtagggcagaagtgccaatgaggagagagaagg

SEQ ID NO: 128819 - DNA, 1072 bp, Homo sapiens
acacacacacacacacacacacacacacacacacacacacacacatatgtgatctaagtagctgacttcattaaaatattgttaaatttaactctattaaaaataaatgtttggccaggtgcggtggctcacgcctgtcatcccagcactttgggaggccaaggcgggtggatcatctgaggtcaggagttcaagaccagcccagccaacatggtgaaaccctgtgtctactaaaaatacaagaattagcaggcatggtggtgggcacctgtaatctcagctacttgggaggctgaggcaggagaatcgcttgaacccaggaggcagaggctgcaatgagctgagatccatgccactgcactctagcctgggtgacagagtgagactctgtctcaaataaataagtaaataaatcagtgttttataatctcaggaaatgaatcaaatatgactttagctttgtagaaccaacttggatttcagttgttacgatacccagcggctaacaggataagacgggcaccactccattcaaaataggattgtgattctctgtgtagaaatgtgtacattttcatttttctgtgataaaaatggcttctaatattttatattttagtgtcatgttagagatttcattccatgctcatttgttcattcacatgtatttttatttttagctctaagcgaaagacatgaggcctcagcctgaaatgaggttgttttgaggtcatctgatttctgactagaaggtgagcgatcgcctcgtcctgaaaccacttcagcccgcatggtaaatggcaaagccagcgagagggaggccttcatgtgtttccgtgtctgtgctgccccagttccttcctcttcaagattaaaaacattttaaagttgtaaaccaaaggtattaaacaacatactgacatatcgtacctaaattagctcaaatgttttacaaaagggcttacatcataaatgctaattaaaccttttagagctgttttaacatggctttttaaagtgagctcttgtgagctacctaatcagcaacaaaatatttattatatgaaaaaac

SEQ ID NO: 128820 - DNA, 1248 bp, Homo sapiens
aggtgtagtaaaaatatggtataaataatcatctgggaccaccattagatatgtggtccatcattgaccagaatattgttgtgaatgtgttgcatgactggaaaaggagagctagacaacactgactacttcaggggaagagaactggcggctaatggcaaggatgaaaggaaaactttttattgtgtacctttgttcactttttgaattttatgcttttaagccatacagaaatattttttaaaacgttagctttatttacatcatgaagtttaagtatgtttctcaggaattttcttctttaacatcataaataaagaaaaactcaaaaaaaatgatttcatcatgccttctatgttaattactctttcttgtattttacatctttccagtaaatttcagttcctaaattcacacacagttccacataggaagctaaagaggcataatccagattaagaaccaaaaatgaaacagaaataggatacagttgaatcatctgtgtaacaaataaagaaaaagcctgggaactataaagctatggaaaatgaaagaggctcactgagatgaaccagagtgtacaaatgctgaattcaatacagtgccaagtatttagagtgtttttttgcattgaggttattgtggctgtgaacaaggattaccatccacagctagaagagaaatcccccgggacagaatctctaaaacagggtcctcagttacataactagcgatttatgaaatgtgcttatattgtatgtgatgtcatgacatcatttcttggtcttctgctcagaattaggtagtttgactataaaatctactatttggggacacatttgctgctctgcaaggttactgttaccattgctgcagtcaagtggcatatacttaagggactggagtcctgaaggtctgtgttgattctgggaggtgtgcacatatgtgggtccagtgttctttacaaaggccccctgtgtggcatctgtcgtacttcttatttgttcagcatatcccttggcttgtgatggaagatacacaatctgtacctttgtctgaaggagataccagctcctgagtggccttttacatcatccttaggtggggatagttaacttaaaaaaaaaaaaaaccggcgagggagaaaaggccgtcttagccatagttggcagcccctagccctttagcctaaggaagtctacagagactacggcacttgggtgcagacttttaatgaacccatctttt

SEQ ID NO: 128821 - DNA, 1023 bp, Homo sapiens
atgtgacgctagttttcctcaactcatggaaggagacttgggagatacactgccctgttacagccccttcggctgtggcttttgtacaggtttcctgcttcccctctcccagttttacctgccttttctttgtccctgtccctgttttgctcctttttgaatccagtcccagcactttctcctcagtgtgaggccttggcttggagcgggagccctggagcatctgttttccgagttccaggaggtgaggctcatctagtccctcggactgcactccctgtctctgtggagtggccagatccctcctagtagcagctgctggcaagaaatgggtctgctgtgcttttcagtgagtgcctcaggctgttggggtgttctgccttcccgagagcccatgcctcctctagtggctggtgcaggggcagtgactgctggggcctggtcactgcctccctacctgcgtgtgccttgctgtccacaggattctttgagttacgtaagaaatgatgtctgactttgggttttgctacttattctgcttttatatttcatttagagaaaattatagttttgtacataaaagtgaagaattttatcttatttcatggaggaaagcatcttttataaaataacacccttgttgtggaggccaagagagtaaaattgcctgttaaagctttgtaatttgcatttactattaaaggttaatggttttattctgaaattgccatagagtgggttagagaactaattgcttttattaatcattaacaagttactgaaaattatccagaatgtggcaactagctaactatatattagtgaatatgaatattgttgaaaatttcatcttgaggtcaggttttttttttttttattctgccggtgaaatggcccagataacttcattgtaaaaatattctggctttggaacataagttatttgttttatatagtttgcctgtttagagaatatagaacatttcaaataaaattagtcattttgtgaaaattcagaggact

SEQ ID NO: 128822 - DNA, 2119 bp, Homo sapiens
cactgggtaatgtggaataatctaattgtattctaattgtaattcaaaaattaataattccttcaaatagcaagattttgttagtattactctgtgatcatagtcagaaacaaaccaaaccgtggcattctgtgagctagtgcagatctgtgggctacagcttgggccattttaaagccccagtaatccagtaatatttttgctgaactatggaaagtaaaaccagtatgcttaggactgcataggaaacttctcatcattcagaattttgattggataattatatttgtttatatcagtggctgaaaggaatgaccagaaaagaaacactctgtccacaagctagttgaggatcaacatgtcatttcttggcatggcgctttagttctctgggttacttagttctgttcacttgttatacaaaagcaaacagatgagtgaaataaagcaaactgggtgttattgatattagaatgagaatctttgttcaaaatttgtatttattaggacaaacgttcagggaaagttcttcaggggcaagacatctcatcctgataggaacagattatgcttatgtggtgaggtgatttaattttcctttctcccttcttctttccttccttcagactcttcctccatcttacccatgatttattatgtatctagatttttaaaaatcccactcagtatattcgcttagctttaaaaatgcgttcaaccttgactggcgtagataaggccagcaacatgcccagatgttttctggaatcagagggctgagggtcttctgaatgtttcaggaagggcaactgtagagaagcaaagagcccttaaatacttcagagaagtttgggtaatacacttccccacagcctgtatctcacagctgatagcactaatgtccttagcattcaggccctaagattcccaagagtgtcactttttactgctgggaaaattttcttaagattcttatttgaattctatatactttagcaaaatcctgtgtaccttaatgtaaattgagaaaaaagggaccgctttgttttgatagtaatttgttaataagtttggtgattactattgtttgcctttttcttgtgatcttcttgactctaagtagtattcagtcttcagtttaatatccttttgaacgggacttgtttttttccttcccaacaagtactaagaatgatcccatttgcttttacatagccaaaattgtagtatgagtacaggtttattaattgttcttccccttgctgatgggagctactgggaacacgtaaaagctgatttgtaatagcattttaaaaggcggagcggggggatgtaaggcagaagggaacgtggatggatatattgaacaagcttgagaaaattaaaaaaaaaaaaaacttgttcaaagactgacaaatggatcgtgggtctggattttctgaactgagactctgggttcatctgctctgaatccaccaggcttccagactgcgccgttgcttctgctatcagtgctgcgtggtttagcatgagcttttagggaaatgtcacatcttgttcacatgggtagaattatattacatctgttcttactgagcatgaaccaagattaaaatcttgccattctcaacagaacaaataatagaaaattacagcaaatgatgtgcatgttctttgctcttaatcaattttctgcagtcctacaaaacttttccaaagtaaatgtaaatattttctttatacacacctagcaaatgcacagtgtatgattatatttttattagtatacatgaacttgggttaaagttcaataaatacggtttaaaattgggaaggaaaaattaaataatttcaaggttgcatactttcactagtagaaattctctacttttgggacaaaaattattattttccaaatatccaatgagtatgtcacttgcgggggagaaagaggaactggaagaatatcctgaagaggttagggaatgtggtaaaaggggcacattttaagggctactcacaaaagagtcttatatgaagcatattagtttgggtttattttttcttgggaggaattctaacataattttaagttaaggaaagatagcacaaaatagca

SEQ ID NO: 128823 - DNA, 1141 bp, Homo sapiens
tttttcccttcagttttaaacatatcagactaccagtatggaatactcgacccgtaattaactaataaggcaaggaatccaatctgcccaaatgttaaatagtgccatttaaaatttggaagcctgaagcaagacagtaaggctttggtaacagtggccaagccaagtggaatctttctgagtgataaaatgagcttgtaaaatgagcacagttgtgggagtatgcagtatcaagactggtgaagcaggtgccagtggttgggggcctcaggatgaaaccatggttctggccaaaatattgctgtttgttttaatctctaacgcagctcggataatatgaagctgtgctgcttgaaaacattttatatttcttgatttgtctttcccttccaggagtagtagacatgttgtcagcagatttataagaatatgatagaattttagaattaaaatttgagtcccttaagaattgtagactactgggaagatttgaagagggtagaggcagtcaatggaaagaaaagaggacagaagacaaggtacttttgttttctcttaaaagagttgaagggtagaccctgtttataggcagagaaggaaccaacagaaaaggaggattacatgtattctagaaactcttacttaattttcaagaaaactgtaaaaaatacactgactgatacctttccagcattagccaaactgtgagttgtgaggtgtgatttccaagactactctcacttctcacaccaactgcaagtttggggtgtttccaaaaccaccttcaggtctgacaatttgctggaaggactcatagaactcactgaaagctgttacacttattgttatggtttattaaagggaaaagatacagatcaaaggaagccaaaggaagccatggggcagagtctgggaaggttctaatgtgaatcttccgttctcctcttccatggaggctgggcattgttaccctcctggtactgatgtgtgaccgtacgcacggaatgttgccaaccaaggaatctcttctgatttttggtgtctagagtttttattagagcttcctgagatagcatgtttgattgattgattgcccacaaagttgaactccgtcaccatgtctactggtatcgtgtgagcc

SEQ ID NO: 128824 - DNA, 1578 bp, Homo sapiens
agggtaagactgagaggttcattttatgttcttggcttgtatgcagtatggtgggattagtgttctggtaattattccctttctcctaggcttatctctgcctatatttttgcatttgatgtacttgaacctaagcgtagaacttaaaaaattgtgttagctgtgtctgtccgtttcgtcatctttgcatttagaagcctgccattcctgtctgtgcacatgctggagggatatacgattgtataaatagaattgagcacagagacctgtgtttaaacgttttgttttgtttttttgctattgatggaggtggattcttttcataagagggattgtgttggtcagggtctcaatggcgactaatgaagtaaacacaaaggtttttagttgctccataattgttgggaaagctaaagaaactcaaggcgaagtttctaggcacagctcctgaagcagagtgaaaatccggttgtctgatttcttgccaggccctgcctagcactttcagctgtagccatcctgaacaactggtcatgttctcttgcttgtagtctttgtggatgctgttttctttctctggtacactcagtcttcctcttttcttggcgagtgcttctcatccttcaggccctattctaagtgttacttttaaatttttcctggtccttccataataatctcgctcagaccgttagatgcttctgctctctgcttccattgcacactgtatttcccctgtcattatggctgacgattgattattgcctttccccactcctcactgagtcccggtgcctggcacaacaccatgcttgaatgtagcaagttgggtggttcagaattgaaaagtcactgattacacgtttgaagcttcatcatcaagaaatagataccaatcaccaacttttaagttgtaatttataattttcataattgcaattgactcaacagatttttgctttggtttgagtgtaacaccctttataacatatctaatgccgcttgatggagattggataactggcctgtttgctaataattctttgaagtttggaaactgggaatctcagagatttgtaactagataaaagagactctaagaaataaacattttggccaggcatggtggctcacgcctgtaatcccagcactttcggaggccaagatggaaggattgcttgagaccgggagattgagcccagcaacatggtgagaccttcatctctaccagaaaaaccccaaagaattagctatgtatggtggcatgcacctatagccctagctaatagagagtctgaggtgggagcatcccttgggtccaggaattcgaggctgcagtgagctatgatcacgccactgcacaccagcctgggcaacagagagagactgcatctctaaaaatcatacatacatacatacatacatacatacatacatacataccttttattttaaaataattttaggttttttatgtttacagaaaagcttaaagatagcacagagtatccatatacacctcatcagcttcccccactgttaaaattgtttgtgaccatggtacatttgtccaaacta

SEQ ID NO: 128825 - DNA, 2505 bp, Homo sapiens
agaatcatttgaacctgggaggcggaggttgcagtgagccaagatcgtgccattgcactccagcctgggtgacaaagcgacactctgtctcaaaaaaaaaaaaaaaaaaaaaaaaaaaggtgatagcctagggaatggttgtgttactcagtattgacatgctgcttcaggggattttcttggattcaaggcgtatcttaaccctgttggtacctctggttctttggtgtacttaagcacatatctcctttaaacctcctattagtaaggtgaagtgggaaggtaggcaggtgggatgacctttgtttcacagatttgtaagcaaagctttagtgccattgtttcttaattaagtgatggtgttggtatgggagacaggtctcaggtatacaaggctaggagtggtcttgagaatattttacatgtgacaaatggatattgagaaatagttacatggttagagaagaacagtgtagttaggaattaatggatggaaaagaaaagggggatcctaagaatcaaagaccctctctattgtggcatgtatgtttgtgtgtatttagttgtatctgtctgcgtgtgtttgtttattgattgtgttttggccacataccttataatgtaatgcttttgaaagtgacaaagccatatatcttttaagatagggacttaaaacaagaacctcttgaattttcactttatttcattcttttctgcttttttccctttcggatcttttattttccccacaggaacccataggggagaagacttagaataacgtaaatgcaggggcgatgaaactgaggagaaagggctaatgacagccctgagtaagtgctgggaaaagagcctggaccccaggggtggagaaaaggaaaaagtctagcgagtacctaagtaattgacctcgttcctagcatggctgctatgccacacaattacagagtgtgatattgtaaaggatcagagaactgtgggctctgcttgaggcactttcaaacctcactgctctacctgaattgaagctgaagcctgtgggatgattgacttctgactttctggcagtgaataggcagacccagaagggaagtgggtaggaagtagtgctggcctggccctgtttatcttccccactgtaggcagggggattgtacacttgaaatcagcatgagagtggccccccaaaacatgctcacattactgtttggaagcatgtgtctgaagttagctacatagctgggtttgagggatggttgtctttgtgatgtctctctctacttttggcctgcatgtattttccagtgagggctggggcagggaccacagagaagatttagaacaaagttaagttccaacccttcatttagccctgtgacctaggtagaacaagctactctactctctttgccacagttcctcaactgtaaaatgtgataacaatgatacatttacctcagaggaagaagaaatgagtttatgtgctcaggcagtgcctagcacaaagtcagtgcggtagaaatgtggtctggggtagcagaccacgcaaacaacaaagcaatgcgttctattcctcctgagtgtctcgaccacattcagtgcatattttgttattcactattagttttctaaatgtttgcccttagactttgttgtaggacttcattttgtcgtagttacctatctccagcggatgcagggaaatagttacagatgtgacgaaagaaagacatggtgtatgcagatttggtggattttgtgagctttttgattctaggtgaggacttgggaaatgataatggtgacaagagataaagtctctgatgtgccagtcacattttccctgcaacagtaatcatttgttagaactcaatgcaaatagaaatatacttgataatacattcttctgggtaatataagctgtgcaatgcttatactttatgcaaaactatatgtttaaaatctgctcatgtttaaagaatggtgattattacgactggccctcacagagcatggtttaatattttctaacaatttttattattaaatttgtggattttatgatcattttaaatggtgctgattttattcgaaaataattttaggtttactgtggtattattttattaaatggttctagtttccttgttttcctgtacaagtagaaccaattggataaaataacctgtttctctttaaagaagagctgttttctttttctgtaagtgacatttttgcaggctcatggtccaaaacgattagctagactgagaataaggtaagtgatgaattagcaaaaatttctgtgaactcctaaaacactcttaccttgtagctatgctaggataggaatattggaggtgacatcactgttagtggtaatggcttaaattgaaacacttcggcttcttacaaagttctttttctggctcccaagtgtcagcctgacagaccgtcttaaaacctggaggttcagtgccttactgggttaaccagtaggccttt

SEQ ID NO: 128826 - DNA, 2047 bp, Homo sapiens
atactttgtatgacttcagtctttttaaattcattgagacttgctttgtggacaaacatagtctcttctggagagtattccatgtaaactttagaagaatgtgtgttctgctttgtttgaaaaaatgttctgtatatgtctgttagatctagttggtttatgtgttgtacaaattctctgtttccctatttatcttttgtcaagttcttctatctgttattgaataggatgtattgaagtctattattctagagctttctacgtctcactttagttgtgtcagtgcttgcttcctatattttgggactctatgtttggtgcatttatgtttataattattatatctccgattgaatttattctttaatcaaatatagtatccttctcaacttcaacaacatattgatattaagcatatttaagaaagttgctttgtaaagtctttgtgtagtaagtacaatgtctggccttctcagggacatgttctgtcagttaatttcgttcctttgaatgggctatactttttccttatatgccttaggattttgttgctgttgaaaatggggtgtttgaaaattacagtgttgtgtctctggaaatcagagtctcctctttcaccgaggtttgctttttttgttgtttttggttttatgtatctcttttttttgtcaagtgacttttcccaactatttttgtagggattatattccttgtcttgtgtggtcactgaagtctctgtttcttagttaatcttctggtactgttttttttgtgtgtggttttttttttttttttttttttaagagatggggtcttactctgtcacccaggcttggcaggagccactgtgcctagcctggtagtgttttgacagagatttccttgaatgccaggagctaaaacaaataaacaaacaaaaatactttttccagtttttgcaggttggctctttgctggggccctccttcaatagtgagccagacttgtgtctaggctagtatttagcctaaggtgaaaaagcttaaggtcttcctgggttttattctgagcatgtgtgtggctttctaatttcacccatatatatggatgcttttgattgccctaatttcctaaggtaactttcttcacgtcttttcttcccagacctcaggtcatgtgttgcatgtctcatttgtactctttgaccccaggtgtctggattgtttttgggcaatgccaaccacttccagcctggatgagttttgagttttaagcatgaaccttgtcaagtatccctgacaggttggaatggagtcactaaaaatttatgaatgcgttctacttgttcctattggaaccagggaccagggtcccattcttggaatatgggctgccatcacactgggaggagatagggcaaaggcaaataagaatgccgtaaagctttcctatcctttgaagttcttgattcagtgttcagttggttgctgtaagcatttcactgttttccagagttctgacaaagttagttctgacagttggtgcttgttttttgatggtttaggtgcagggaggtgtatgggcacttggaattgtctactctgacattttttcgacatctcccagtcagccttgttctcttgcagtagtccatttaaaaacccacagaagcctttccttctaccaccgccacacacgctgcaggcaacagatgccaccttacttgtcataccctcttcctgtatctccctggcaatcacctcaatttctgttgtatttttggtatagttattagctgaatactagtgttaatattttccctattaaatgttaggttaagccgggtgcggtggctcacgcctgtaatctcagcagtttttgagaggtcgaggcggttggatcacctgaggtcacgagttccagaccagcctggccaacatggtgaaaccccgtctctgctaaaaacacaaaaattagcttggtgtggtggtgggcacttgtaatcccagctacttgggaggctgaggcaggagaatcgcttgaacctaggaggcagaggttgcagtga

SEQ ID NO: 128827 - DNA, 1051 bp, Homo sapiens
aaagaatttgatgtaaaatctggcttgacataatttctttaaaaatatatacaaacgttgcataaaggaatattttaataaaaacaccagttaaccagtatatttgaaaccattttttcccaagtattggtgtcatgcttaagttttcttttaggtgactttatttttgacatagtacacgtaacagatcttcatttaccatttattatatgagacataccacttgactcagctaaacctccgtttctgattctataaattggaaataagagtaaccattttactcatcttagaaatggttataaagatcaaaacaaaggatttatgcatatgttggccaattcgaggagataatttcctagggttattacagttgtgagatttttccggtttcaaaatgggataatttgtaaaggtgttttaaagatgctaagcacaggtcagtgatgatcatgtcattttggaaacattcattatacaagctgggaaccttgtaaaatgagtttcacaaggtcatttgctttacacccacagagtagtgtatattgcagctgatcacattcttaggggtcagaaattaatattaatttgtcaggcttcaaatgtaaatcagcatttccctgtttttcttttgagaagaccaaagttgctaacctgtattcttgttcttggattatgctgtttgtaataaaaaaagatggatcatgatgaatgctgattagcaccttggggactgttgacggacggatgtgtagtgtattttggaaggtatggtgaccacgctgaggtatcactgggctagtaggagaaggaagcatagtgtacgggctttaaaaatcatatactgccttcagaatgaagtaattatcttcaggtagataatcagaaattaattgtttttgaggatttacagcagagagacctgaggagtagattttgcaaacagattctttatttttcttaacttttgattgcatttattttatgcggaatttattcctgtgccgtaagtttttatttcttcagtttcttctcaggtatctttttcttc

SEQ ID NO: 128828 - DNA, 1047 bp, Homo sapiens
cccataggctaattgatacaaacaagattaagtttctgtggcatatttctgttcacaaaaacaccaccaaacttttaagtaaagaccaaaacacttctagcattaaacgttgaaataaatgtgagccatacctatatttaagaaagattaatgcaacgtgagataattcttacccacttattccacctggtcacaggtggtcagagcctatcctaggagctcagggcacacggcgggcaccagtcctggacagggtgccatcccatcacagggcacactcacactcacacccgcacccatgtccttagactgggaccaggtaaatgcgttaataaacctaatgtgcccagctttgtctgggaggaaacccaggtacccagagagaaaaaccaccagacagtggcccggttgggaatggatttttcttatcaactgtgtaactaaatgatggtcaatgaaacgatgttatttgaggatgtgctgtatactaaaatatatggaattctatttggtttgtgtgttagtaacccctggggatggattcagatgatctgaaaattccttattgaggctgtgcatggtggctcacacctgtattcccagcactttgggaggctgaggcgggttgattgcatgagcccaggagtttgagaccagcctggacaacatagtgaattcccgtatctacaaaagtgaaaaaaaactatagaaattccttataaaggtgttaaatatctaaatatgacttaaatgtaaaaccaaaccagaaatgttttcatcgaaacaggtcagtatgttttgtaagttcttatagaaaaccataaaatatttaaaaaacagaaatctaccattctagccttgaagtttctaacagtcagctgtcttaaaatacctgttcagttagttccaagtgttaagttacattttctgacattcttaatgggcttttaaaaattaggttactaataaatgtaatataagtgtgtgtgtgtgtgtgtgtgtgtgtgtgtgtatgtgtgtatatatatatataaaatatgtatttat

SEQ ID NO: 128829 - DNA, 1476 bp, Homo sapiens
cttattttatcctgggacatgttcatcctgggttatgtagattcattcttggagatgttagtttattctgcaggccagtttcactagaattaaagctctgtttcagagtgtagccttcatgtgcccccacaccatcattgagtgatggagagcccagcagatactgaggtgactaaaccagccacccccatgcccactgcttgcacaaaaggaaggtgctttgatatgactgatttttcttagggttgttttcttttttgttgtttttttctaagtctttctcattatttgtgaaaaaatcttggccctcaatagcttcaaaacgttaacatgctgggaagaaccactcgtgaaccaacactccttctccatgatactgttgtcattcccattttgccagtcatgtgggaaggaatccatgtcccggagacatgtgttgcagcagttctgacatgtttttgaatcagcgatggtgtcacgatgcagcttttgagaatgtcaagtttcagttgcattgggaagttcttgtttgggagatatcctatagtgtttcaaggttaagtgacatttcttacctttcttatgctttgttggcccttgtctacaataaagaactgaagtggagctatttttgtccacttttacattctgcctccaaaacctagccatagggtgggatgctataatttcttgatgcagcattggtatttgaacaacacacatgaagcaggaatggttttacattttggttcatttgaaatatggttatagtgaggttttaaataaatcatctgagctacagtaaacaaaaaaagagcaacactagccagttgtcaaggaaaagactgatgggtagaataaacagactgctttctgcagtctaaacaatctgttttcatggtttttttctctttctttttgaagggtgattgggagaacttccaaattaagtagaagttagttaaatatgagaggcagtaaatccacaatgcgtatgttagtgattattacagcctgttttctcaatagctctaataacaacaatgtcagtgactgaacacagtagaacagtattgtttgtcgtggggtggtatggctggtggtggcttcgacatcctcagggctcaacacctcagcattcagtcagagaaaggaaagaaagtatagagaaagtataactgtttcttaaaaactctagcttgggccaggcgtggtgtctcatgcctgtaatctcaccactttgcaaggccaaggtgggaagatcacttgagtccaggagtttgagaccaacctgggcaatgtaggcagaccctgtctctacaaaaattaaaaatagatgagctggatgtggtgtggcacacctgtggttcccagctagttgggaggctgagatgggaagactacttgagcccaggaggttgaggctgcaggggcctgtgattgtgccactgcagcctggataacggagcaagactc

SEQ ID NO: 128830 - DNA, 1130 bp, Homo sapiens
actgctgacctcaggtgatctgccctccttggcctcccaaagtgctgggattacaggcgtgagccactgcacccgtccaaagcagctgttttcaaaccttggctgtgcatcagaatcacttgaggagccagatatttgagatctaccataagagactgtaatccaagagatctgggatgggcccaagaatctatatatttaaaaaatctaggttttcagaaagttccctaagcagtacacagacagggatgagaagcatagttgtacaggctgatttctgccaatatctatgagttagttatcaaggagaaggagcatatgttagaattgcttgggaatttgttttttgtttttggtaaactttttatcactaggcatcttagatttagaggggcggaatggataaaagaaggtcctcaggtgattctaatggattaccagtatttaaacaatctgaatggaccttttagctggagtggcttggcaaaaagtctgtattaaccaaagagttgctgttgccatatattatgcctggatttagaatgcaggaaagacatttaacattaaaattatgacatataattgaggattcctttgatccaaaagcttctttctttggaagtttgaagtatttcaaggtcattattatgaacacagatgatccccattggtgctcagaagtgccaggttagaggcattttattatgcttggaaattgatatttcaatccagtgaattttgtgtctcaaattcagaaatgttatatttgttgtaatcagtgccaaggataagattcctaaaaagaaactggtgaatgaaagaggagacatgacctaatagatactgagtgtcattagagacaggaaagaagggagcagagaagaaaaatggcctacctacattttgcttgatagattcgtggggagaacagccaggagaggggatgagggggagttggatggtgtttactggtaagatattagtgtggcacatcagcaagcatccctgcatctgtgcacactcaataccttccctttgcactccacctagaaatgtacatggggatggtgagaaaatccgagaaccttgtaacggagaagctcagggccagaaatcctaggagaggctgg

SEQ ID NO: 128831 - DNA, 8761 bp, Homo sapiens
agccgaagtgtgggcagtaaaaatgttggtgtcaggttaaaattcctgagagaactgtttctaatggaatctgtcctggacacttactagtagtaagctttgagacagaatgaaattggagtagaataaaatcccacctccattcacctaaatgttaattgtttcttggcaaagtggaagtccagattttagggcaaactgaaaagtacatttaaaatgtcaatttagcttttgtagttgtatgtagggtagtattttttttttttctgatcttaactttcctctgcattgatataaagtgcctgtgactttactgtctagttttttttttacatcttttttcaagattagaatatatctctaaatatttcctaaagttaacttattaaaagacatgctaattttagtaagttatttcttctaacatagctatacttcaaaagcagtatttactgaggaaggattttattaaaaaaattttttttcccagttagatggttttgcttgaaatactgcaggaacatggtctgctgttttaatacctgctagccatgttgtttgcgttgaaatcattcatatgtaaaagctttagaggaattcttgttttaatctttcggcaaacaattgcttgtcaatgtgtttgaacatacatcatctctgtttttattgaagatcttttggggttatagttgttgccttaaacatatttgctgtggaaactttgctatttcttatggtcacataacataaaggttaagatctaatatttctatcatttggtttgggccgcatctctaagaaaagatgtcagtgaagttgtacattgtcaaaactgattccattaacccgtgaatacttgtctctttacattttttaatgtaaaattatttggttatagcttggacagagcacaacaccgatttaataaaacttagtttccctcgatattaaagtggggcacttctctgcatcttgccattcctgtcaagatggcaaatacttgacgtcttttatcaaataactttacagaatgtaagaaaatattttggctgggctgaaattggagcatggaagaatggttgtctgtagaatgatgtggccccatgaacctgctttgcagagcactagtgtgtgattaaggtctttttcatgcatgccttactcccactaattactaaacatgtaacagcgtctgtacagcttgatgtgctttatttttcaggtgctttttgtggggataactggcatgtgaatcacttattccaggagcaggagtcacattgggcttcacttttgtacaatgtgttgttaatagagagtgagagcattttcttggagggtttggctttaggagcagtgtgatttagtttgcctgttgcattgatgtatgcaagttttcctttctgctattgtcctttctctgcttttgtgttacttttagaggttgcttagtgcattgtcagttctcttcagtcaagaagcaacagttctttgaccaaaatttcatggccacatcattaatctcccatttaatggatgtagttttatgtgtgtgtttgcacccttctatttcagagtaaaaggaatttacttaacttgtttataccacttgccatatttaagaggatcgtcagtggttctttatcttgtgagatgggatgtggtagagggttgccttcaggagagtaaaaaggaaaaggcattttgcattttataatggcaccatccagttgagcggtctacagctctgttttagcgttgttttctgatttgagactggtggaatttggatatgcagctctctacaaaatctgcagtgaatgttgctgggctggtgaagatgctttattatttttttaatcactcccctgccctcctgtctgctcctctatgtagggatacttagtttattatgggtctttgttcatgttgactattttacaagagtggttcttagttctggctgagaatagaatctgttgcagcacttaaatagaaaggccgaggcactgctggacctgctgaagaagactccctggggaggacacaagaagtcatagttttagaagaaccacaagtgatcacgtgggaaccccacgcttgagaactggatttcaggcttattccacttggagaggaatattagatttgtgttcttaataaatatgatggcagaattgggaaaggaatgatcgggtaccattaagtttggcccctggataataccataacaaaatgactttaccttggaagcatgagtgtctaaaagtacctcaggtgtactcaagggtatgcactaatggtactccatgttttctgttttttttggttgttgttgttgttttttttgttttgttttgttttgtttgctttttgagctcaagtattaatctcattctgaaagaattcgcaaattcaaaacagtgttcaataaatgtagcccacttctctttgccttttatgggatacaaataatgtttatgttgcgtgtgaaaggtataataattctgtttaattctgaagtgattctattaaataggcttgaggaaacataactgggattatgagtggtgttgggataagtgatctgtaatgtccctctaatgctaagattttgtggtttaagaatggtaatattcaatatttagatacctacaaatgaggagattcgtttgtgtggggccagggtaccattatagacacattaatagattgtatacttgcatttgtgggctgtgtgggtgtgtgggtagagagagagtgtactttatatgcttattaatgggtggcaatctaattgtaaaaatagcttttttttttttttcattttatccataaacttaatggaattctggtttaaaagaaactcagtgggaggccgaggtggcggatcatgaggtcaggagatcgcgaccatcctggctaacatggtgaaaccccatctctactaaaaaatacaaaaaaaaattagccgggcgtggtggcgggcgcctgtagtcccagctactcaggaggccgaggcaggagaatggcgtcaacccgggaggtggagcttgcagtgagccaagttcgcgccactgcactccagcctgggcgacagagcgagactccatctcaaaaaaaaaaaaaagaaactcagtgggatttttctgaggggaaagttgagtaaaattgatctaagaaaagtataaatgtgtttgagtagtcaaaaaaaactttgaagaatgttgagacttacctgatcaggaagtggatgtgctataatgtgtcaataattagaccaatgtgcagagaaattaagcagatagttcgcaaaggagaataaagagtctgtacatatattgatatgttagtgagaatttagtacatagtaaaggtggcattgctaatcagtggatagaaaaagaattatttaacatgatattagcagttgactatccatttggaaaaaaaaatgaatctctaccttaggtaaacagaaatgctaaaagaatgaaaggtgtaaacataaaatgttaaactgtaaaaacactagggtgattattttttataatgttgcagtgggcaagaccctttggtaccatcaaggaaaagaaggagcagatttaaccacatgaagttgcctcacctggtttcttcccttctccctcctcccatctgaaaaatccagaaatacttgcttagctgtgagggtaagtgggttaaattgagacagagatacttcctccaggagaatgaataagaagagaacatctctaaagatttatttcttgtttttgagtgaacagtaaccctaaaaacttgacatttatggtaaattttcaagggaaggggatgaaaaaatggcatgctttggagcgaaattgcaactggggatgcagcatagtatttccagaaggatccagaaacaaagtgtcaaaatctgtattgtaagaaggctggtgctcctgaaatctagcaggcaggtgcttactagaagtcacaagttgttcatttctgtcttcaacatcatttgatactatagacttattcataaggtcaattgcctagtcaggcttatgcagtgcagtggatagattctgtaatgttggaaagattctgtgggatggaaagattctgtgggatgcaaaaagaaactgtgtctctgatgttgccattttcaccccaggatgatttgctttacaacgtgctgtctgcaaataagtttgtggttaaaattttagtttactccccatgatgtgctattcatctagtttcttctcatcaggaattctggatttcttatttgcctcttaaaaagtaaaacttttaaaaaatttatgaaaatataacctcatttaacaagttcattgacttttgactaattgcctaaagacaatccactgcttaccgctattggagatacttaagaaaagcgcaggacatagcctggtatgaagggaatgactggtggaattaagaagtcaggtttctcactctgcaagttacaaacaaccactggcctcagtttcctcatatttatcaaacaagcagttaaatggattgatctttaatgtcccttcagtgtaaaaaagttcattatgctacaggtatttgtgctttgaaaatagctttaaagagggaatttcagattctggtttgatcacttaatctatttttaaagcaagtgtgtatgtctcctaggtgctgattcggagtagagttctaagtcctgccatggattgttttgacttattaaacaaattctcattttgtgtcacctatgtatagggacattttggagatctcattagttaatgttaaaatttatggcagactaaacctactgagaaacttgtgctgactttatcagctaattttgtgaatttgcaatttcagctaaaattaaactatatttttcagtagtcttttttttgtaatctgtttaaaatttttagtggtagattaagctaaagcaatatatgcgtatctgtttaagccaagtattttggaggtttttctgaattgtttaccaaggttaatttcttttgtgggggggggggggtcagaaccttaaaattacctgctgtaatttgttgtttgagatgtgttctttaactttgaaaagttagtgtttgtaaaaaaaaaatttttttagtgataccatcaggtcacttgagctcttttaggaaataattctgttaagtgaatttttttgtttgtttagattaaggtataagttctcttttgacactagtcgaatttttaggaaagatggaatttgctgagagaattcagtggctattgttacagtgacattaatatagttctacataaaattctacatgagatttttcatttctgtatttctaatgtgggtagatcttggtatattgtattattttaatatagctcaaaacatactacagcaccctatggtattttacagatttctaacaaaaaatttcttctcattgacctcttttacttttgaaatattaaacaagtggtttaaaaaataatttttgttttgaatggagtgtttttgtcttcttagtttaaatgaggaagcaatttctgttttatcttggtcactgatttagagcatggactgtgctcatcattcatttctaggaagaaattagagtattcatttcacagagagctacatattgttttcttcaccaccctcttggaggaaaggtagggttgataattacggtttgccctggccacatgctttcactcatgggtaggtgagctaaaacattcatatcaccatgatgcttccttttctttccgtcttaaatagacaggacaaatgaggaaaggcagcagatttgaggaagatgccaaacccatggcttgggaagcttgccagtgaagttgagcaggcagggcaatctagaactcaggcccctccagagggcaggtgcctgactttctcacttcagctgtgtttcttcaagtgtggcagagactcctgtgttaggagagcccacggggccattaacatgcggattccaggccttactacagactccaggatcagagcctcagggagttgggccagggagtgtgtatttttgctcaatttttattattgaagctttgaagcacacagggaaatagagcagtataatgaacacctgttaccattcacttggcttcagtaattttttttctaaagaaacagattctcactctgtttcccaggctggagtgcagtggcgtgagtatagccccctgcagccttgaacttctaggctcaagcagttcccttgcctatgcctcctgagtagctggggcttgaggcgtgtgccaccatgctttactcgtttaaaaagatttttgtaggccaggcgctgtggctcacgtctgtaatcccagcactttggaggctgaggtggatggatcacgaggtcaggagatcgagaccatcctggctaacatggtgtctctattaaaaatacaaaaattagccgggcgtggtggcacgcgcctgtagtcccagctactcaggaggctgaggcagcagaatcgcttgaacccgggaggcggaggttgcagtgagcccagatcgtgccactgcactgcagcctcagtgacagagcgagactccacctcacaaaaaaaaaaaattttttttgtagagatggggtcttgctatattgcccaggctggttttgaactcttggcctcaatcagtcctcctgccttgtcctcccaaggattataggcgtgagtcgctgtgcctggccagttgttaatatagatatatttatctgtatgtgtgtgtatttaacacatatcctatcctgatgttgcacctctaaatacttcacctcaaatatgaaatgtttagaatcattctacaaagctacaatattattattgcacctaagaaaattaagagtatttccataattatccttaattcgtaaaatcatctaatagctgttttgtactcagatttgcctagttgtccccagcaaatttgcttgtgggttttttctcccctccaatcagggacttgataaaaatttatgaattatattgctgtttctttagaatagtccctctctgttttttttttttttttctcatgacattgacttttttccagtgtcctgtccatttctcttgtctgctcatattttgcgtttcctgagtgtctcttgcaggtgtcgtttgcactctgtatttctagtaaacttgaagttgcatctaggggctgaattacattcaggcacaaatttttgtcagaagtactgctttcttcatgttggcatcatatcagtaggcgccccatacgtgttttgtcccactattagtgatgctaagttttatcccttggttaaggttgcgactgccagatttctttatataaaggtagtttttcccttggcaatcggtaggtaacttgtggggtcatatgttagcaaagtatcagtgtctcttttcctaaataccgtttaccttatggttttagtgtcttttgggaatccttgccggaatcaattattaagtagttgttgttggtgggtgtatgtgttttaaacaggctccctggtaattctaacctttaaggtttgatagccactgctgtcctattaatagaactaggagctgagttatcaggtctgttgaatgggttgccagtaaacagttaatgagtttaagcttcgtgttcattttagagaaactaagatcaataaagtgcctcctaaggccccctatgtcctagtttagttgttggagaggacatgtgtgtgatacttgcagtaaacttgaggtgagccctgctagtgtgttagaatgtatgacaaaaatccaaggagagtggaggaggcgtagagaaattactaaggaggaaaggaaactatattgaatattctgtttatatatatagtctcacttaattttcacaagcattttgtgcccattttacagatgaagaagtgagcttaaagtgataaagtaacctatggcactggtggaggaaacttttgaagccagagctcacagagctgtgggcgggacagaattagtttgctttacctctgggacgttgttgtctggcttattgaagatggaggaatgatattcttcaacctctggggcctcttggtatataagctgaggttctttgagacctctgatgtctagtctaatgtgttaatattaaactctgcagagcttagggtaggcttgtaagtcttgtagttgattgtaactgctgatgaatcaaacagctgagtaatattaatacctctgggtctgtgtcttaggacacagttttcagtacctcactccattctctttctcagggtagatgcaccttacaaccccgtgacttccacattacacaaaggaatatgtaggtttggcataccccacaggtcccatgtaaatactgcactcaaatatgttggttctctgttgacctgttggaaacattgagaacagcagttgtatcccaaggatataaagaagctgttttcttttcttttcttttattttcctttcttttcttttcctttcctttcttttcttttcttttttcttttttcttttctctttctttctttctttcttttctttctttctttctttcttttctttcttttctttctttctttttttttgggacagtttcactcttgttgcccaggctggagtgcggtggcgcgatctcggctcactgcaacctctgcctcctgagttcaagtgattcttctgcctcagcctcccacgtagctgggattacaggcatgagcca

SEQ ID NO: 128832 - DNA, 1011 bp, Homo sapiens
gcgccgcagcgccgccgccgacgggggggaccagccgctgcagcctcccgcggcccccggcgccggccgccaacccccgacgccctcggccgcgcggccggagccgccgccgccgcaggtggagcggccgtggctcgactgcctgtggatcgtgctggcgctgctggtgttcttcggggacgtgggcaccgacctgtggctggccctcgactactaccgcaagggggactacgtctacttcgggctgaccctcttcttcgtgctggtgccgtcgctgctggtgcagagcctgagcttccgctggttcgtgcaggactacacgggcggcgggctgggcgccgtggaggggctcaccagccggggcccccccatgatgggggccggctacgtccacggcgcggcccgcggtggcccaggcgtgagggtctcccccacgccgggggcgcagcgcctgtgtcgcctctccgtgtggatctggcagtcggtcatccacctgctgcagatggggcaggtgtggaggtaagagcactgcggggtgggggcgggccggccctgaggagcccccctccgccctcccggtgcttcgcggggcggcccctcgaaagggcccagcgcggggggctcgaaggagggaccggccgcgcgccgcccctggcgtctccaaaagaccggcgtttgatctggatccctggccacgcctttggcccggggaggccgagacctgccgttggcccgtcctcgtccccgcttcgcactcggcggggctcttgccccaacctgccctccccgtcccctctgcagagctccgttcccaagcgtcccttttccctgcctcccgaggtaaccagctgcgggcgccctgggctgcaccccagctcgcggccccggggagccttccctcctccagccgctgcattcgggtttgttcccaggtgagacatcctcccctcttcccccgttctccctctgcagtggcctgcgtggggccctgtggaaaaacccttgctgccg

SEQ ID NO: 128833 - DNA, 1082 bp, Homo sapiens
tcagtccggcattctcattcccatctgactgtagacctctaggctgtatcatccttttttacagttactaacccaccctgatttcaaataatttacataagtttatttaggtaataactggattttgagccaagaccttactgactagccaaaaactgatccccagaaatacttagacctttttattaagctttattaattgatgtcgaggtgttatttcatttttcttctagaattggtatgcacatttttttgttctttttttcatcccgtcaacacttttgagtgtgtgttatgtggcagatgcctttgttagatactagaagcaaagaaatcagcttcagtaagactaaaattgtatctggtgataaacacaatgttagagaaacattctgggtgcccatcattattagaccatgtttgcttaatactaatttgtcagttagaatatgtttccagttgtggatgtttcttttttgtctttcttttctttttgcccccaggcattgtctactctggactccatcactctgatgtaccctttcttttaccgtcctatgtttgaagtgatagaagatggctggcattccttccttcctgagcaagaatttgaactctattcttcagctgtgagttaacttttgagaactgtggattatgagaagtaacccaataccttatttgacttgtgaaaatgatcacttcttttgaagagtaataaggtgaagttgacttatccattcctaatcttaatatatttaaaaggattgaagccatgcagagtatgatctctgatcacaaaggaattagattaataatcagtaatactaagatatctaggaatacccccaagtatttctaaattaaacagaacgcttgtaaataatctgcatgtcaaagaaattagaaaacattttgaagtgagtgataatggttatgtaacatattgaaatttgtggaatacagacagctaaggcagtgtttagagataaacttacagctttaaaatttttactagaaaggaaagtctaaaattattgacctaagcaccaatttaagaagctagaaaaaaaaagcaaagt

SEQ ID NO: 128834 - DNA, 1733 bp, Homo sapiens
aggctgggcatggtggcttacgcctgtaatcccagcactttgggaggccaaggcgggcggatcatgaggtcaggagatcgagaccatcctggctaacacggtgaaaacccatgtctactaaaaatacaaaaaattagccaggtgtggtggcgggcgcctgtagtcccagctactcaggaggctgaggcaggagaatggtgtgaacccgggaggcagagcttgcagtgagccgagatcgcaccactgcactccagcctgggcgaaagggcaagactccatctcaaaaaaaaaaaaaaaaaaagactcatttatccatttacatttattctcagatgataaaatatatactgatactataactttcttatggtatcagttttctttattttcttgaataaaattacttctaccttcatttggtctttataatccactgtccacagcatcttcctttaaaccaatagtcccagaagagaccctctgaaattctaggactggatattaaaatgcctgaacctgttatctaaatcctttttaagaaacttaatgttccagctcttgaactacactgtggaacagtaatttgtgcccaatttagtggaagataatgaggctcactgtaaacactacattgtcctgcaaagtaattctgatgagagtttactgacttctagagccattctctttaaccgtctgcaggtctaaggattaactatatttgtgatttgtaataaaactgagttgtacaacactgcctgtgtttgtctggccaagacatttgcttcacttttaaaatgcacgttatctttggagaggtgaattattctacaaaatgcaccctaaatctcattgtttaaaaccttactgatctaataccatctacacaaaaaaatgttgtagttgcagaacttagtttataaaaacaaagaatgtgtatttcttcaatagccgggtatttggattgttctcttgataatatttgaatgtgactcttggatttaagtgcactattattcatggcttatacaataaaattgcactgtatggcaaatatgtctataatgtatgctttgctgaaacctcaagagtgctgtaaggtacaggtttccatattgtgaacctgtgtacgcacacacacatatacatacagtcttagggaaaaaaaaaagcagaacttttgtaagtctgtgtaacattttaatattgtttgtaatattcactaggtgataatttcccctgtaccctataactgtaatcattcaccttgggttggccggtttgtcaagcttggtttactgaatcaagaaagagtcttgtcgaatgtggtactgttcttagtgtgtaatatttgcgtatggtgttcctctgcctcagaggacagttgcacagatggctagtgttaaatttctatagacgatggtaataaaatctgaatatatttaagtgctaataaattaaatctgtgggcttatttgaatttttttttcaaatattggtgaaggtttggatggtgtttcaattaaatctatatattttttaccttacattttgaaaaaattgagatctgcaaaaaggctgcaaaatagtacactgatctccctagattgttcctatattgaatgattggtaaaattttccatatttgctttaataccacgtgtgtgtgtgtgtgtgtgtgtgtgtgtttgttacactgttattttgctgaaacatccgagttagctgcagacatt

SEQ ID NO: 128835 - DNA, 2875 bp, Homo sapiens
attagatcccagctggtgtcagcgttgtgcggtgtcagttctgaatctcagtttggcctttgtttggctggactctgtgtgagcaacactttatccctttatcacagggcctggctcacaggaggcccttgactggcttcctatcggcgaactcagcagtctctttagttcgattcctgaatctaaaagcatagctttaaaaaaataaaataaaataaaagcatagctttgctcattcgctgacaatcttagcgttcattttagctgaagagtttgttttgaagagctggagggataaaagttcacatctttaactctgctcttttctcacaaggtatttgaaaagaaaatgctgttcattaggatgctgaggcgagcggggcagagcccagcctgtggctgttggacgcctgtcctgccggtccgctttctgggcatctcccctcggcaaattccagcagatgctaacttccactctgcgtctttctctgacacagaccatccacgagtcttaattacaggttagtttttcttttcttttttctatttgcatggcttgattctttcctgtgctatgtgtctgtgcctttgcttttggaatgtgtaatatgctatctgaaccatactgcctgtctctgtagccgataatgcagcaaaaacaggcttggccagatgacagaatctggatctattctctatactatgaaaaggatttcagaatgaggtattttataatacaaaagttttaaattagagcagctgatcttattgatcagacactgtctttttcactattggcttttttgtttgtttcttagaattttgcaaatccaaatccttatttcatcactgttgccagcacttggttttgcctgccgtaatttttgttgttgttcgaaggaatctaggaaactgggggccaaatagctgctctggaacttggtttccttccatattaggatcagtctggggagtgaaggctagtggacaggagggtgctggggctagaacattgattctggtgttaggcacgctgttccttggccagagtcctgaacctaaactcagagtcattaatcccaaactgttattgcacatttgcatgttggaaatagagaaggtaagttagcgtctggtcaagggacttgttgctgcagtgttcattgttgtcctcgagcccatcatggcccttgagctcattgttgccattgaggtcatcattgccagtgactcgctccctgaacctcctcacctcaaatatgttcagcccctgattttgtatccttctcactccagactttactctgtcacttccagccagcccaaacctacctccagtttgatggacatgttttacttctttctctttcttgccaggctttcttcccttggttttacagcattatccttctcattttcgtgtgtctgtgtgtgtgtgtactctttgactgccttgtccacttctggtgctgaaataagtttcaagcttagtagatgtccctctctgcctttcctcggattcacccatcgtgttgtccgagtgtttgttttattccctctcacctcccctaatgatgcatctttcagggtgtcctggttttattcccaagttaacaaatggttacaggaagtcccacttttatatcttcctgcctcatcagtttctctcaaatgaaatggactgttgtccttacccaaatgtgctcctagcccactggcctcccgtttctatcagtggcatgtttaattcttcaaactagaagctgcactattcactttaactttctcagtggtgccttgttgattcagttgtctgcccctttttcaaatgacttcttggtttctccctgcctcttttccctttcatatcccagtccacttctaatggaggatgggattctgcctcatgtcaccagaggtggatatgaatctgttcatactggttttgaatgattttgtcacccatagcagataagcttcaaagttcatgaaaataatgaaggccaagattgagttcctgccccaagaaattccagacctgtgtctggctttcatgagatttttctcttctaatgcccttgcttctcctctttctcggaaccactccatgctggtaagtgttgtctctgaaacgaatgttacctgtattggtctctgtcctagcatgggggagatcattgcatttctaagcgctgcaccacgttcctgggaagattggaagtaagcagcagttatatcagtgcaacctaggacttacgtagttagctaagactgaaaactagtctcactcagttattacattctgggaataattgaactgtttagatttgcattaaaccttcacttttttttcttcttcatctaggggctcttggccagctgggagtggggcttgctaatcttttgaggtaagagccctaaaaacttgaaatttaaaatctgagttgttaagtatatggagctcattgggatgccttttaaacttcttttctctctcctcttgctccttaccattgttaagatatatctaaataactgctatatatagctatagatatagatatatagagatatagatatagatacagattttttttttttgagttggagcctcagtctgtcacccaggctgtagtgcagtggtgcaatcccggctcactataacctccacctcctgggttcaagtgattctcctgcctcagcctcccgagtagctgggactacaggcacataccaccacgcctggctaattttttttatttttggtagagatgggctctcgctatgttgcccaggctggtcttctaactcctggcctcaagtgatctgcccgcctcaagtgatctgcccacctcacctttccaaagtgctggga

SEQ ID NO: 128836 - DNA, 2520 bp, Homo sapiens
ctattccttttcaaatgtgcaccttggaagcagagtgaagccactctgtgtatacagggctgggaggaacagcacccactctggagcccgatgcctagctgcagccccatttcctccacttgttctctgatcctggcaagttgcttaacctctcggtgcctgtttccttatcagtaaaatgtgtttacctccaaggctgtgtgggaaagaaatggacttatgtccttaggacagggtctggcccaggcaggtcctataggagcatttgctgtcattacctggcgcggggtggttgtgacttgtgattcttccgtaagaaaaatgctgcctagtgcccagctgtcttagttattgcgtggctaccagtgaaattcacaagtcaacgggggaaaggggaaaggtccatttagttcacaacccttttcacgttcgtggtttcaatttatgttccttgcaggtccattcatttattctgatatcttggattacaagaatcttcgggagatcgtggtaaacaaccgcatcacctggctgtttcattacagcgctttgctcagcgcctttggagaagcaaatgtttccctggcgagagcagtgaatataactggtaagcatctggctctggctggatgtgatttatttgccagtttttctagttctttaagaagagatgttttcagattctgatagtgtctgttcatttcaggcctgcataacatcctggatgtcgctgcggaacacaatctgcaattgtttgtgcctagcacgattggggcttttggacccacctctccccggaacccaacccccgatctctgtattcagagacccaggaccatctatggggtgtccaaggtccacgcggagctcatgggagaagtaagcatcactcagctggattgctgaatgtgccctggctgtcacgatttgctgtttgctttctcattcgttttgcctccaaggcctggtgattcatccctggaggaactttacctcttcttggatcccagccccagagtcgcttacttaactcactgggtttgccatgtagcaggtgtctccagctcctgaaacctcctcagccatatgggaacactcagcacttcctgggtgccccgtgcccagccccgatctcttcatttgctgcttgtcttgtactccaccattctttctggctcctagtattggtagccattggtagtaactctaaaacctcaaacatcttgggtttgttttgtttgtttgtttgttttatgagacagaatcttgctctgtcacccaggctggagtgtggtggcgtgatctcagctcatagcagcctccgcctcctgggttcaagggatcctcatgcctcagcctccgaagtagctgggattataggcacgtgccaccacacccagctaaattttatatttttagtagaggcagtgttttgccttgttggccaggctggtctcaagcttctgacctcaagtgatccacccacttcagcatcccaaagtgctgggattataggtgtgaactactgcaaaatactctttatctttataactctagtagattcgagttgctgcctgctcctccagttctgtcatagccatggccctctcatccactgttctctcctctgcttttccccgtgctgcttgtgggaatgcactcaggctgaatcgttcagaatgatgatcagtggcgcctttccaaagagtggctggaaatgcctactgtagactaatgtgtcatttacagcattgatgtaccacctaaaagttgatttcttttaaaagataaaaacttaggagtctttattttctttaggagtatttaaatataactgcatggaatgagatttcagaaaaaggcagggtgttttttggttttttttgtttttgttttttttgcatctatctgatttaaaatatttgtgtttgaatacgttttctctttttcatggtattatcattaccggtatgggttagatttctgatgcctgagatatcctggaatcatttcagctgactcccagcctggaggaggaacaactggttaagtgttttctatttcttatgtctcttatatgttagataggctttccagccaggtgcggaggctcatgcctgtaactccagcactttgggaggctgaggcaggaggatcactccagccagagaccagcctggacaacacagtgggaccttgtctctatgaaaaataaacaaaaattacccaggcatgatggcccacacctgtagtcccagctactggggagtctgaggcaggagggcctcttgagcccggaaggccagggttgcagtgagctgagatcgtgccactgcactccagcctgggtgagtgacagagtgagaccctgtctcaaaaataaaaaacaacaacaaaaaaacacccaccaaaaaaaaaaaaaatagactgacttattgctaggtggagttgtcttcgtagtaaatgaatttgctatctttttagctgtatgctgaccagagtttttctgtaatatctccc

SEQ ID NO: 128837 - DNA, 1989 bp, Homo sapiens
tgagatggagtcttgctctgtcacccaggctggagtgcggtggcgtgatctcagctcactgcagtctccatctctcctgggtttgagcgattctcatgcttcagcctcccaagtagctgggattacagatgtgtgccatcacgcctggctaatttttgtatttttagtagagctggggtttcactgtgttggacaggctggtcttgaactcctgatctcaggtgatctgcctgcctcggcctcccaaagtgctaggactacaggcctgagttactgagcttgactggacttcttaatttttaagaatctgttataaaaagactctgagactagaacatttgagaactgctgccttgatccaagaggctcattcattgttttgttataacctacatacgggattccctttcagactatgcagtccagattttccatgatgccacaaagcatggcaaattcgagtgcaacctggaagcctgcacgagactgcccatgatgtacattgacgactgcctcagagccaccctggaggtcatggaggccccagctgagtccctttccatgaggacctacaatgtcagcgccatgagcttcacacccgaggagctggcccaggaggtcctcaagcacgtgccggaattccagatcacatacaacgtggatgccgttcgccaggccataggttcgtacccggtggcaaaggcctttactgtgagtccctggagaatgtaaaccttggaaggttgaagagagcatagatccttcccaagggtccagacaccttttggagaaggagcctagcccaagaaattgttgagcccaagctagcagatgctttgattttggggaatgatatctaaagtgggtgaaatcattccattccaaataaacagcttgttagcctttcatcatttttacagtttaaacataaagcaaggaaaaatagaagcaacagaggtagtatgaaaacagccccaggttttcaaatactgtaactttgccaatttgtggatggaagcacctctttgagtataaaacttcttatgaagttgtgtgagattttgataatgtgtgaaaattcacagtgcctgacgaaagatgggttaatagtcttcggccctaggagggtgactgtgcataatggcggttctgctttactcgaaggaatttcctgttttgtaccttgtacggtagacctttatatacaatggtcaagacctttttgcaaatccacaacctgaataacttaagctagtcttgcgtatcttttcctagcggatggttggccgatgaactttgatgacagcaatgctcggaaggactgggggtggaaacacgactttgatcttccagagttggtgactgccatgttgaacttccatggttctgaaagcagagttgcccaagccaactgaaagaatctggaagaggagctcctgtgtcctggtccactgtcaagggagaactgtcacaactccaaggttatagactccaaggagcctacattatttggaactgactcattggactaaattttggcagctcatattgaactgctagacaaagaatggagttaacatttaagcattttcagaatgttgtaggtatggtggtgggacttttcagtttttgctgtttgcctgaacttgtctaaacacattccacagaataaggcttaagtcatcattagtttccatttccttaattaggatgaagtgactatttctgggaagctgggagtatgtgacatttgtgtttaattaaattcaatttaaatattcctcttaagactcgattattctcttgactaaagaccaaagattacattttaaggactttcaaagaggtactcctcatttataagtattctttactatcccagcgaaagtaaaacatgtttggtgtattcatcccatgtctatcacattcaagatattttgacactgcttcaaaaattataatttctggtttttctgtaagatgctagat

SEQ ID NO: 128838 - DNA, 1012 bp, Homo sapiens
aatcaagaagttactaccacaatttggtgggaattttgaattttggagttttcctttgtactcaagcttcctcacgattcttccaggcagatcaaagccatgggttttgggatcccctaatcgcaaatccagttttgcttcttaaaatctaatcagtccttaagttattttttaaatcttcctttctactccccagttgaaatctccatttctacttctagaaatccagtcaaaccttatcgcctccatttagaactgatcgatagcaactggtgagcaggttaattataatcgcagaataaacgctgaagtctcaaagttcaccacttttgcaatgtttccaaacccctcgggaccatgccaggaggcgctcattgacccattccgagcaggtgtgggagtttgaaccaggggcagacaatcagatctgattcaaacaactcaatttggttgcttatctagaggttttcctatcttatgatatctgtcattttagataaaaaagagttcatcaattgagctgggaaatggcaaagttacattttattctgataaaagtttgctagttgttgttttatcagcttgggttgaaattgtgtctccgtcaaggtctgcaatgaccttttcagatattttatcaggtattaggtgggggagtcctttttttttttttccttctttgacctagaaaagaatgacctgacttccaagatcataaatcaaaccaggtaaagacaggcaataatacaggttgcccctcaaaattgagtaggcggggaaaacaaacaacaaataaaacctttccctagcatttggggagaacttaacttgacccgaaataaagaatgtagttcccacggagtgcacagatgtaggaaaatactgcttattttaaaaaagaaaatgctttccaggcaaaaatggcttcagagaaacacgtagtaattttttttcaagtagtataagggaaacttctttattttatgaaactcaatgtatatttattatagaa

SEQ ID NO: 128839 - DNA, 1219 bp, Homo sapiens
tattgattacagtttccttatcaagtccaatatgctggtggagggggtagcgaggggtacccagtttcacagggtgttgtctttagctgctctgtatgtgtgcattcccacgcaccgcttatttctggcatagaaaatgtattacgaatggaatgaaggaatgacaacttatgttcatttcttagctactgcatgaaaaaattgggagcgattcccttcaggtattccagggtggccttgccatcttgcatgggtgtgtttcactgccaactaagtctccttgctcccagtcactttgaaaaccacatgcgaactgctcacaccactggagcaaaagagcaaaaggcagagtccaaagacttcatttgggaaggccccccaggaggggtgagaaggaagacctttgcaataggataaatatccgcattccccagttcccctctctgggtctgtaaggcttggatctctgttcattttttctaggtccatggaaagaaattattccttagatttgatctagatgaagaaatggggccccctggcagcagcccaacaccagagcctccacaaaaagaagtgcagaaggaaggggctgcggacccaaagcaggtcggggagcccagcgggcagaagacccttgatggatcctcacggtctgcagagctcgtcccccagggcgaggatgattctgagtatttggagagagacgcccctgcaggagatgctgggaggtggctgcgtgtcagctttggtttgtttggcagcgtttgggtgaacgatttctccagagccaagaaagccaacaagaggggggactggagggacccttccccgaggtaatggtgtggccatctgattttcgtgggctctgatagtcatagggccctgcttggtggggtttgggacttcagcagtggggacatactgaggacgtccagtctgccccccagggccctgctgtcttggggagagaggccacctctgtatctacctgtgataggaagtagactgtggtctgcatgcaggagagggttgtgcaccaagaggtggctgggagaaggggagaattttcccagcaaatgtggcacttgaggggggactgtccctgaagaacattttattgcctgactcctgactagtgtgctttgaatttagggagaagattttcccagttttattttaagtatattgtttgtgtgtttattttttattgagatat

SEQ ID NO: 128840 - DNA, 1068 bp, Homo sapiens
tgggactacaggtgcgtgccaccacaccggctaacttttgtatttttaatagagacggggtttcaccatgttggacaggctggctggtctggaactcctggcctcaagcgatcgcctacctccgcctcccaaagtgctgggattacaggcgtgagccaccatgcttggccccagtttttataatctatgaatgttgagatcaacattttatgcataagactctatctaggtttaggatatgtcctcagtgtcaattcccagaggagtaattgctggtcagagggaatgcatattcttagggctgtacatttttctggccttaggaaagtgctagctgagctgaaatctcatgaatgttaggtcgtttgtgtacttcttatcaatgtaatgaagcttttgcacagaaagtctgtttgtttttgtgacatgtgttgccagtattgtttcaagtctgtcctctgtcctttgattgtgcttatgatgtctcttggcatttgggattttaaatttttatatcatcaacggtgggtatttttcttggttgcttgtaggtttccccttttgctaaaaaaaggccccttctgcccccagagaaagtcacatgccttctattttctgaagttttataacttgtaaaaatgtttagaagtgtagtctttatttgtgtggcctgacgtaggtaccataggatgctatgggctgtaaaaataactcggagtagcttctgtggtctggagattttgggctcacatgactggaagttcagaaggagggtgggctttggggctgccgttccaaggttctggcttcctgtttttgtgattctcctggctttgcactttccacgcattggttttctccttagaccagcagcaagaggctactgcagctccaggattttattcacaccaaaaaatccagaagaagagcagatcatttttagaagttcagatgaggaaactttccttagaacccccagcaaacctgtcatcatcaggagcctgccctttgctgagtcctggattagtcaccagctggaggcattgaaatgtgctccccgaaggaggc

SEQ ID NO: 128841 - DNA, 1061 bp, Homo sapiens
gggtgttcccgtccccctttcctcgagccttccccctgtagggcccgggtggacgcggccgtcctggctgacctgtccctgcccccgcaagccgccctgggcatgagcgacttttgcgtggttcccggtggttgcgctccccgtttcgtcccctccgtgagcatcggcgcttaccggtattttaacccgagggttacacatctgaggcaatgtgggtgggttacgcgggagaggacgagtgagttttttggtaagcggaatgaactatgcagataacatcacatgaaggccgtttctggaatgaagtctgactcctccagtttcaccacctcttccggagctctccccgccttgctgccttccatcgcttcatcctcggtgcttcctgagttttaaaatcgcctatctacgcttccaagttccaatgagttatctaacgtctatggattagctaggtggttggtggaaggtcagaacttggttttacttagatttttatctgcctcatgcctgtactatttgtttaatgaatgcataggaggtgtttttattccaacaagaaaattattcgtacgcgattattgaatgaatagacaaattcagccaagttcttctggtctggaccagcctggctgatttctgtaacttttttgggccaacaggacagtagcaaatgtgactcaggccgaggcttgataggtgcctgaacatcggagtctttctttcagtgtccatgtgcttcagtaaacacactagaaaataaatttctggtttttgtccccagtagactacaccctcatttggtgttatttttcacgtgctatctttaatacaggtacatccttcagtctatttgtagaacattcagttttcttcatcttttctttgccggtgctacattatttgaattattttgctacagaataacttctattatttgatatggcagatgtcactttttatatttagatatagcattcatttatttaacaaatatttgacgaccagttgtatatcagatagtgttctaggtgctggaggtacaacagtgaacaagctag

SEQ ID NO: 128842 - DNA, 1054 bp, Homo sapiens
aatttttaggtgcatatcagtaaatctacgggcatatgccgcctgcaagttgtgtggcatcacccaaaagccgagagtaatggaaagagcaggctgttagtaatcaggcagatctggctcctgtccaatctaaatcctgttatttagactaatatcttaagtctgttattaagtccgatttctgacgctattaagttaggtgaacaaccttggtaacttaacctctgaaccacagttacttcatctgtaaaatagggatgtatgtatggtaacgattttttaaccacaacttcccaactctaagatggtctgaaaagaattttttgagtgtttggctcagaatcacttggcagcaaaacctgacttgaagttgaggcttcattcatcccacttagtatattcaaatgttttgctaaagaaataattatgaggtgctacttcacactgactagggttgtatatgcattttattgcctattttctaaaacactaaaaatgctaaattctgccccaggtcttgccacagatgtttcagtggactatgggcctgtgagaccttaaagggttgattgagtaaggatcacaggtgatgtccgcattgtgcttggcatggagttaagtgcttgataaatggtggttatcaatctgattatgtaaatttatgtaaattcagttctcaagtttgtggtttttttcccctcctggagaaatctattctattttaaagtgaggaaggctccgtggagggctggtagctggtagctgttcacttgtggaactttcagcctgaggctggagccccttcctgggagtctggtcttgtcgtcttcctgaccacccccacacccttcctctaaattccctccatccctgtttttctcccgcttgcgagcttttgggagtgtgctgaatctcagactgcaatagataaacccaagagggacaggcaccagtagcctgagcttgctttctcccctggctcatgggaatcaagcagtagaaatttttagtgagtgttgttttccatagtatgcttactagttgtgtcttcctg

SEQ ID NO: 128843 - DNA, 1336 bp, Homo sapiens
aaaaatcgtctcttacagtactgccactatgttgctgggctggtcggaattggcctttcccgtcttttctcagcctcagagtttgaagaccccttagttggtgaagatacagaacgtgccaactctatgggcctgtttttgcagaaaacaaacatcatccgtgactatctggaagaccagcaaggaggaagagagttctggcctcaagaggtaacagattcagggtattttgggggaaaataactttagacattctctgaaaaatcctttaactcttgtggttgcgggtgacagaaaaacaagtcaggcctcccccaggcagcataaggggatgtggaaaataggatagcttgacatgagtttgcttcaggtagactggctgactcccaggattcacaccacgtaatcagtatattcaagccttgctgtccttgatttctttcagacggtctttctccaagtggtggatatggtaacaacccatgtgcactagcttaacaaaaagttcttaggaatggctttgttcggcctggcgcagtggctcatgcctgtaatcccaacagtttgagaggccaaggtgggcggatcacctgaggccaggagttcgagaccagcctggccaacatcgtgaaaccccgtgtttactaaaaaatacaaaaattagccgggcgtggtggcaagggcttgtaatcccagctacctgggaggctgaggcaggagaatcgcttgaacccaggaagcagagattgcggtgagctcagattgtgccactgcactccagcctgggcgacagagtgagactccctctcaaaagaagaggaagggcttggttcttctgctcagccctgaatcagttactgttgctacacagctgagttctctggcctcgcctggattacgtctacacagtacacacagaatggatttcccccaaagaaagaattctgcagcaggaaggggaaagggatggcaggtagacaaaaactccaggtgtctgtaataagggacagggtcgatctttaattaaaacatggacagggaacagaaagcttttgatactgattttgttcagaaggaaagtagaaaattttatgactgttccctgaatttattccagcatttaccttttgctttccataaaagtgtttcctgcagccaagtactttaaagttttaaaaagacgggtgaggctaagtgtggtgtctcatacttataatcccagtgctgaggccaggagttcaagaccagcctgagcaacacagcaagataccatctctataaaaaattgttagaaaatgattctgctgaaagagcaaaaataaaaattaaagaaagt

SEQ ID NO: 128844 - DNA, 1116 bp, Homo sapiens
aatgaacttgatcttcgtgaaagatgagtctgcagctaagagactttactgtatatcatagtgtttttttttgttttgttttgtttttgtttttgtgacggagtctcactctttcacccaggctggagtgcaatggcgagatcttgactcactgcaacctccgccccctaggttcaagcaattcttctgtctcaccctcctgagtagctgggattacaggcgcctgccaccgtacccggctagtttttgtatttttagtagacacagggtttcaccaccttggccaggctggtcttgaactcctgacctcgtgatccaccctcctcggcctcccaaagtgctgggattacaggcgtgagccacggcgcccagcctgtatcatagttcttatgcacaaagaccctttaatattgtttgtaaattctcccctatgcacacgctgacctgttccttaatcttcttatctgtctaggtttggagcaggtatgttaagaagttaggggattttgctaagccggagaatattgacttggccgtgcagtgcctgaatgaacttataaccaatgcactgcaccacatcccagatgtcatcacctacctttcgagactcagaaaccagagtgtgtttaacttctgtgctattccacaggtagggaagggggctcctctgggtggatacggggctaaagggagtggggtaggagtaagggtggattttgctgtgctatattcaaggatatgattccttaaaaagacgatgactccagtttattacgctgggagtttcatagcacccgcctttgcttccagccaccaaactcagctcagccttgaggttaagcctgctccttttcagaaccttctttctggatttactattttctacagctatcctaaactagttaggttcttttcctcacagttaagtcaaggtctttggcttagatttatggggagtgctgggtaaaacctgggtgaagctgttatcattaaaaagtcttcattaagcacctaattactgctgtccttttcctagacccggcataaaaagaacctggtccggtagacctagcctctcagtatgctaggaacttacactttttagttgcctttacc

SEQ ID NO: 128845 - DNA, 7848 bp, Homo sapiens
aacaactacaatagaaaattcttcccatatattattttgaaatacatatttccgatccgataatccattgctctagcatggaaaatgttggatttacttgtgtttgctttttccaaataaaatggaacttttgtggctacattatagaattgttttagactgcttaattctgtgtgttgttgagaaagggaggagtggggaaggtaaaaatcttgacatactttcttcgtgggtattttttcttgagcgattccatcttagttgattagcagttagcaattgcccattcaacagaaggttttcttacctttttgtgataatgatagctaacgacatcatttcttcttttttccctctcttcttgttgtctctaggtgatggccattgccactttggctgcctgttataataaccagcaggtgttcaaaggggcagtgaagattcggaaagggcaagcagtgaccctgatgatggatgccaccaatatgccagctgtcaaagccatcatatatcagtatatggaagaggtgggtttttatttaactacttggataatttgtagctacttttatgatttagtaatgtcactgtttaaccaggtttggatattagatgatcctaacaattcactatcctgtggcctaaagagacaggaattgatatcctttataaggaaaaaagtctattcacaggagccgagcagattgctcactgctgtgtagtaccctggtgagaggagataaatggagcaaggctgtaggttggagcccctcagtagaatcatagattttgagctgcaagatgatgcaggaggccaaccaagcttcttgttgctggtgaggaatgtgaggttgaagcttgtctgtgctgatgcagtgcgtgattgagtggatctctggctcccgtccatgtgtcctgacacccagtctggtactttcattatgccacaggcctcaattgaaaaatcacagtagggaatttaggccaaggaaagccatcaagttgcaattatttcctaaattttctttggaaaatttcatttcaaataccaaaaccatcctataaaaagaaaacttaccttcttaggtcaaatctctaatatttgactaggttcaaaaagtttatttctggccaggcacagtagcttactcctgaaatcccagcactttgggagaccaaggtgggaggatcacttgaggccaggaattcaagaccagcccgggcgacatagcaagaccccatttctacaaaaaatttaaaaattgtcatggtggtgcacgcctgtggtcccagctactcaggaggctgaggcaggtggatcacatgagcctgagaggtcgaggctacagtaagctgtgtgatttcatcattgcactctagcctgggtgatagagtgagactttgtctcaaaaaaaaaaaaaaaaaaaaaaaaagtcttagagaccagaagtctttgtaatctctaataatctctaggccctagagcagtggtttgtaaatggaggtgatttgctcccctccccccagaggacattggacaatgtctggagacatttttgattgtcctaaccggcaggaatcgggtgctactggcatctggtgagtagaggcccaggatgatgctgtgatcctcaggtgtgatcctgttgagaatgaaacactgtagactttatgaaaacatacaagaccctcatcatttttcctttgcctgagctccctccccagaggttacctctgttcatggttttgtgcatccgtctagtccccctgttacgcgtttacaggaatatggtttgcaacagtgttttcatctaaatagaattatacaaaatagcgatttctgatttctcttgcatattgcacattcttcttatacttcctccctacctttatctgacacagaaatgctgtatgtccagaacttctatcagaggcacctatggaagtctaagggaagaccacatcgcttttaaaaaccctaaaattttgtagtcactagatgaaaatattcagccagtgacccaaaaaattgctaccaatgagactctccattttgccatgtagccagaacttactttgatctatgtgcctggggtagtgaccaagtaggtgggtaggagtaatctcagggaaacttgaggccccagcctcatggctagggtcataatttgaacccaggtctgtctgacatcagaatccatgatgttaaccccaattctaaggggttcaactaccctttctaaatggaatcctgctatattaagcactatttattcattttatataaactagaaacattttatgtagtaagtagttgagagtgttttggttttgcagtttgatcactagttttagaaaccagtttttaaacactttgtggccaattccattactatattaaaattcagatttatttggtttttccttaactattgggattaaatcctggttgtaattcatagtttgagggcgagggtgggcagtctacagttggctgagccctgtttttgtgaataaatgttatcagaacacagccacacccatttgcttctttgtcttctgtggctgcttttgcaatgtgacggccgagttgaggagctgcaacaggcgatgacttgtaaagctgaaaatattttttggcccttgaataagaggtttgctgacttctgacttagggtatcagttgttctgttatcccagtaaaactcaaggcattaggggagaaatgttaatattaatacttaagttgatttgatttagggaaatctttgaagatttctaagtcttaagcagtagaacctgttaatggttttagtttcagcagtaaggacattttacaagtaaagttttaaatgaaaacattttgtatgaagccacaagtcgtctggcctcttgctggtgtccagatattaacactgatcctatttctccttgctgaccaagtctgtcctttgtagtaagaaaggaagaaacgttgactctgtccgatctctggacttagtgttgtagcgagcatgcacctggaagggacttgccagaggacctcctcatgcttctccagtgcttagtgggggcttggagtgcagccccaggtcttcacgagcagttggccacactgcagggccctcaccccactctggagcagcctctgcttcaaaccagcctggatgcttgtcagctggggagaagatcaacctgctattttgggatagaaataaatgctcagccaaacggccagaaacccccattcccctctctgccaaagtgaattccttggcagggagaatcttgttcgtgtctctgcacacttcctgtgccctcctgtggttaagtcagagaatcatccggctctttgagccccaggtgcctagctgctcaaggatggtccccagccagcagctgccaggaatcacctgggagcccattaagacatccagcccccacccaaacgtatcgaatcagaatctgcctttttttcccaaatgatgtttttgctttaatggaagtttagatgttcatagacaagagttttaaatgatgatcaagctgattccatattcgcagttgtaagtagaactgctgagacgtggaagtaccacatggactcacagaggagctgctgtatgtagcacagcattgcacaagagcttatttcagtctagtaaacatttataggagcctgtgtcatttaatcatcaagcctcgcactgtggctcacacctgtaatcccaaaactttgggaggctgaggcaggcagatcacttgaggtaaggagttcgagaccagcctggccaatatggcaaaaccctgtctctactaaaaatacaacatttagccaggtgtggtggtgcacacttgtcatcccagctattccggagcctgagacatgagcatcgcttgaactcgggaggtggaggttgtagtgagctgagatggcaccactgcactccagcctgggcaacagggtgaaggccctttctcaaacccctcaagtatttggcttcaactttatgccgggcatgtagatgaaaagtcggctatgacctgtccttgacaagcagatgtaactccttgattgaggctagtaggtttttaagacctgaataattgagtttgcagaaacctactgtgtgccttcaggtaaatggagagtggggtttggtctagcaacgaagcatctagaaggtccctttggccttaccggctctgttttaggtaagtccacgtctgagtaccagtgactgcagctcttccagttgtgctgtcatgcttatatgttagaaatgatcatcaaaggactcaaaagttttgccactaattgtattaccggggactgtcacaaccaagatttctcttaatttattcaccttacttatctcctggaagggcatattgaagtgctcttggagttctctaaaagggtttttgttggttgtgtatattcacttgggtgccagcgattgattccaaataagtaaatcttttttcccaaaaggatgtaagatggcttatggttataagtacaacaggctaacaaagtacaagtagatgagaaagtaaaatgaagaaataaagtcataggagccacagaattaacccaggaatgaataagtgtgtagtttggtgctgatgttatcatcctttatttgtacattgcttgtacagttgctctgagaaggtaagtcttaaattttcaaaagtgaaatgtcaccgagcatggtggctgatgcctctaatctcagcactttgggaggctgaggcaggcggatcacttgaggtcaggagtgcgaaaccagcctgacttatgtgatgaaaccctgtctctactaaaaaaaaaaaaaaaaaaaaaaaatacaaaagttagttgggcatggtggcaggtgcctgtaatcccacctacttgggaggctgaggcaggagaatcgcatgaacctgggaagtggaggctgcagtgagccaagattgcaccactgcactctagcctgggtgacagagcgagacaccatcttaaaaaaaaaaaaaaatctacaatataccaaaaccattacttacctgagaaactattctcagggtcattgtagtgaatgcctattttatggcttttgatggcatcagggcactcaggtcatttacaagagtagtgtgtgagaccctgtgtgtcactgccactcatcttggccttcggccactgctgtagcaaccagtttccaagtagggctggaccttgccttctgctccagagacctctcgcttcctgcccttgggcttctgacgagctgcaggaactgcctggcacgtgggtccccacaacccagaggaggtgagggccacctctctgctcctcagggccacctttcataaggctccttgaaggtccctcaagatcaagccaactcaacacatccttgataggccttcctgccttctgtttcacttctccactcgtttccaaataaatggctgcatgcaagcttttgcctcaggttctgcttttaggaggaaggctaagacaagcagtaaagcaacatgggcaggcagaaggatgacttctaatagaattatctcatcactatatattttactttatggatgcttgtattgaaaagtcttggctgggtggagtggctcacgcctgtaatcccagccctttgggaggccgaggtgggtggatcacttgaggtctggagtttgagaccagcctgaccaacactggtaaaaccttgtctctattaaaaatgcaaaaattagccagggatgcacgcttgctgtgtgccagcacagggctaggctggagataaaaaggtgagtaagtaggtgcggtgtagtcagggtgaaaactacagatggtccatttccacgtaagtggaaaggtaaaggtatgtacaatagggtggctcctggctgaacctggagctgcagacaggttttctagaaggcataatcctgaagttgagacttgggggcctaggtaggagccagttgaagggacgtgggaggcgcattccagagagaaggagtggtatgagactggaacagaggtgtgcagcagcatcgcatgggcgaaacaacagtagacagttgttcttttgtttttgtttgttttttgagacagggtcttgttctgtcatccaggctggagtgcagtggcatgatctcggatcactgcaacctccacctcccaggctcaagtgatcttcccaccccagtccccaagtagctgggggaccacaggtgcatgccacgatgcccggctaatttttgtacattttgtagaaacagggttttactgtgttgtccaggctggtcttaaacgcctgagcttaagcagtctacgtgcctcagcctcctgaagtgctgggattccaaacatgagccactgtgcctggcccggcaactgttactagactgtagagagggaggtgggcaagggctggtgacactagacaggtgcagtaggtctggaccatgggtggccttgcgctacacattacagagctcaggctttttttctccaggtgagagggctggtgccactgaggcatcaagcagaggtttgagatctccttggtgacagtgtagagcagacaggtagatttgggaatttaagcttagactcacgttggagactgagatagctcatctgagaggcactcagggcctaatctcaggcagtaattttagggatgtaggggaagagatggattctgcacatacttgggaggcttgtggaggagtggggagggaggcacagggaggactccagggtggttcatacggctccctgcttctgttcctgtccccctttgtcaagctgtggtctgtactgcgtgttccatcttgtttctaagctgcttttgcccagtctttccagcatttccctttcgtcatgttagtctgtgcctgtctacgtgaactatggtgacgtttattgggcctggcactgtgaggtgctggggatgtgaagatcattgtggctcagccgctgctctcgagggcctctgggtgcagtatgcacacctgtgcctcctgtttgctcaggaagacaggctttgagatgagctggggctgacatccccaccttatcattgggatggctttgggtaagttatgttcatgttctctgagcctccctttcctcattggtaaaatgggtataaaatacctgccagtggagggttgttgtaagtagccatggaaaatgtaaagcacatagcacttatcattttttcctgtgtctttaacagatttatcatagaatccccgactcagacccatcttctagcaaaacaaggcagatcatctccaccatccggacgcagaatcttcccaactgtcagctgatttcccgaagccactactcccccatctacctgtcgtttgtcatgcttttggctgccctgagctggcagtacctgaccactctctcccaggtaacagaagactatgttcagactggagaacactgatcccaaatttgtccatagctgaagtccaccataaagtggatttactttttttctttaaggatggatgttgtgttctctttatttttttcctactactttaatccctaaaagaacgctgtgtggctgggacctttaggaaagtgaaatgcaggtgagaagaacctaaacatgaaaggaaagggtgcctcatcccagcaacctgtccttgtgggtgatgatcactgtgctgcttgtggctcatggcagagcattcagtgccacggtttaggtgaagtcgctgcatatgtgactgtcatgagatcctacttagtatgatcctggctagaatgataattaaaagtatttaatttgaagcaccatttgaatgttcgtaatagtagaa

SEQ ID NO: 128846 - DNA, 1859 bp, Homo sapiens
gttgccaactcctggaacactgactggggtgacaatggtgagtggctgcccccttcctgccaagaacagtgaattgtgagccacaccccgtggccatctcggctttctctgttctacccaccgcacagccttaaaccctggacctacggccaggctgtgagctcctcctaagtgccaggcagtcaggagttcccttttgctgtgagggcagactctgagcagcttcagagccaacgcctgcaacagttcccacagcatcgcgccagatcctgtgatgggaagggtgaccgggcagggggcttgcccgtggaggtgtgccccacggctccagaagccttgtggtgttgaggactgtgctagtgggccaacagcaggagtggccagggatgagtgacttaaggtcttttaaggatgagtctgactatattggttgacccttgtcacactttaaaagcaccttactttttattcccaggcttctttaaaatactcagaggacaggatcactgtggaatcgaatcagaagtggtggctggaattccacgcaccgatcagtactgggaaaagatctaatctgccgtgggcctgtcgtgccagtcctgggggcgagatcggggtagaaatgcattttattctttaagttcacgtaagatacaagtttcagacagggtctgaaggactggattggccaaacatcagacctgtcttccaaggagaccaagtcctggctacatcccagcctgtggttacagtgcagacaggccatgtgagccaccgctgccagcacagagcgtccttccccctgtagactagtgccgtagggagtacctgctgccccagctgactgtggccccctccgtgatccatccatctccagggagcaagacagagacgcaggaatggaaagcggagttcctaacaggatgaaagttcccccatcagttcccccagtacctccaagcaagtagctttccacatttgtcacagaaatcagaggagagacggtgttgggagccctttggagaacgccagtctcccaggccccctgcatctatcgagtttgcaatgtcacaacctctctgatcttgtgctcagcatgattctttaatagaagttttattttttcgtgcactctgctaatcatgtgggtgagccagtggaacagcgggagacctgtgctagttttacagattgcctccttatgacgcggctcaaaaggaaaccaagtggtcaggagttgtttctgacccactgatctctactaccacaaggaaaatagtttaggagaaaccagcttttactgtttttgaaaaattacagcttcaccctgtcaagttaacaaggaatgcctgtgccaataaaagttttctccaacttgaagtctactctgatgggatctcagatcctttgtcactgcctatagacttgtagctgctgtctctctttgtccctgcagagaatcacgtcctggaactgcatgttcttgcgactcttgggacttcatcttaacttctcgctgccccagccatgttttcaaccatggcatccctcccccaattagttccctgtcatcctcgtcaaccttctctgtaagtgcctggtaagcttgcccttgcttaagaactcaaaacatagctgtgctctatttttttgttgttgttgtgactgacagagtgagattccgtctcccaggctggagtgcagtggcgccttctcagctcactgcaacctgcagcctcctagattcaagcgattctcctgcttcagccttccgagtagctgggatgacaggcactcaccaatatgcctgggtaatttttgtatttttaagtacatacaggatttcaccatgttggcca

SEQ ID NO: 128847 - DNA, 1859 bp, Homo sapiens
tatggacatgaacaggagagcctcctgtcttctcccggatctttgtgggcaggggtggggctggcggttattccctgcaagctgtgcttatctagggagcgtcccttggagggtttggggtctgggaggtctgctcgcaccacttgctgcagctgggggtgggtccacgagtggcctcgggcacttgggtagcacacagtggtctggagagctggtggtgcttctctcagaggttttcattagaggctgtcttttcagctgtaatggtggctatcctgctgaagcttggaacttctggacaagaaaaggcctggtttctggtggcctctatgaatcccatgtaggtaagtgtgtccccttggccactttctggccagatggattgtttgagcaattaaccatcatggctttatttgcctttataaactgggggttgagacagaggggctgctgagaggtgctagccaggtgcacaggcctctggcaggacctgcctggcgtccatgctgcaggcacgaggcttgccttgccccaggtcttctccgtgggggctgtaggttgactccgctttctcccgcgtcccatcagggtgcagaccgtactccatccctccctgtgagcaccacgtcaacggctcccggcccccatgcacgggggagggagatacccccaagtgtagcaagatctgtgagcctggctacagcccgacctacaaacaggacaagcactacggtaaggggcctggggcctggccacggcgcacgtggaggctggggagctgctgcatccctcctcacgctgcagcgaagaggtcagggctgaggagccttggggtcccggaactctaggatagaggagggggagtgatgccctcttgccaggagaagcagcacactctccactttctgcctgttccaccctgaactcagcctcagcccttccaaactggaagggaccaaagccctccttttacaagggagtggcgtgtcctggagtcttgaggtatcctggcctcttccggggcctcgtgctcattgctccgttctcccatttctgagcttccagccccagccctgtccttagttcttcaggggagccttccttgagctcccctggcagggcaagtccccttagatgcagtcttcccctggaggccaccagaaatcagtgactggctgaccgtggcgtgccacgaggcacggtcactgccctccccaaccccgagctcggttcattttccaggatacaattcctacagcgtctccaatagcgagaaggacatcatggccgagatctacaaaaacggccccgtggagggagctttctctgtgtattcggacttcctgctctacaagtcaggtgcgtgctgatggctgatggcaatagagggtgggggtcgggaggggagcctgggtgccaggatggttcatgttgaccaatagggctggattgggcaggcaggtgaggggctggggaagagggctgtgtggggccttccatataggctcactcctctgtggaccagcctggcacctgactgtctttgtccaggtgttgtgccaacacacacaattccagaggcctctcccagagcctctgggctagttccttcccatccattagcgtccagctcatacatgttctctgtgggaacgcccccctccctggtggctggccacgcctgccctcgccttcctggctttgcattgctttaccagcatgtttctgttataatggcaggccgttcgtgtttgcactggctgacacattttcttcatctttctctttgcaaaggcctagatcgtgcctcacaccagtggatgaacacacagggaggaccttgccctgggtagtgccat

SEQ ID NO: 128848 - DNA, 1025 bp, Homo sapiens
ccgcctccaggaaaaaaaaaaaaaaccacacacacacatacaaactaatactacacattttgcagatttcagaaatgaacccagtttccaggcagaggttcacgggggtgcttctcttgctttaaaagctgagttgggcaaatcgttgaggcaggagagtggggcaagtggctcatcacgcctctaatcccagcactttgggaggccaaggtgggcaaatcacttgaacccgggagttcaagaccagtctggccaacgtagcaagaccccatttctaccaaagaaaataaaagctgagtttgagccccaggagcgtcccctggtgttgagagatcagttgcctacaaggtctgaggtgcccctgtggccctttgaggggactgctgcagagggcccagcccggacatggcagcctcacccggtggggctcgttcctgcaggccttcggggctgtggaagccatctctgaccggatctgcatccacaccaatgcgcacgtcagcgtggaggtgtcggcggaggacctgctcacatgctgtggcagcatgtgtggggacgggtgagtcaggctgtgcttccacagcgggtttagtgctgagagaccctgggccccagcttctcagtggaggggactttgaggacttcctgggactgctgcgagtcagaagtgtttcggggagactccgagagtctggcaggcagggcctggcaaggctgctgcttcctgggaggtgcctgaaccaaggctggcccggcagagctgtctgaggggtggcatcccagcaaaacagtcagtttcagaaaatgtggtggaatgtctggcccctggtctggtttgtgtcatcgcatgttcctttttcctgcttggggaaccagtttggggcatttccttatgtgtagttagcggggatggctccaccttaacaacaaggtggtggcacagaactttctgctccagctgcctgcagcctcgccttggttccgcagtagcggtgttcactggcggctgcagatccgaaatgcct

SEQ ID NO: 128849 - DNA, 1345 bp, Homo sapiens
ggtggatcatgcctgtaatcccagcactttgggaggccaaggcaggcagatcatttgaagccaggagtttaagaccagcctggccaacatggtgaaaccctgtctttactaaaaatacaaaaattagccgggtgtggtggtgcatgcctgtaatcccagctactcaggaggctgaggcacgagaatcgattgaactcaggaggcagaggttgcagtgggcagagatctcgccactgcactccagcctggatgacacagtgaaattctgtccactcccaccctcccgtcccacccaaaaaaaaaatcaaaaggtgcattgagcaacagaatttccttttgttttatgaaattaccaaggacacctgtctgcagccttcttcggcatgtcttgtgctcatttccttgttaggggagtgtggcccagccaaagtggcctttgcagggattggggagggagttgtgggatcagagcttgtaatgaagaccttcctttatccagagttatgtttaccgaggacctgaagctgcctgcaagcttcgatgcacgggaacaatggccacagtgtcccaccatcaaagagatcagagaccagggctcctgtggctcctgctgggtaaggccctgctggctggcggggaagcgctggagagaaagtgggagcaacactggagagtcttgggggattcggggtggggacaactctgacaaggcaagttatagaaactttctgagtcccagtttccatcagtacaaaaatcacaatccctctggccatgaatgatggcgaggattaggtggagtggcgggcagagcatccagcagattgcaagtccacgtgtacaggtggcgaagcagctccctttccctgacatgctggcccgtccgcaaataccaggagctctcactgctactctgcttcaagaaagcatccctttagtgtcagtgagctgtcttaattttgtcatttaattgtggtaaaatacacgtaacagaaatgtaataatcttagcaatcttcttttgttttctttttctttcttttttttttttttttttttttggagatggagtcttgctctgtcacccaggctggagtgcagtggtgggatattggctcactgcaacctctgcctcctgggttcaagcaattctcctgcctcagtctccccagtagctaagactacaggcatgtgccaccacgcccagctaatttttgtatttttagtagagatggggttttgccatgttggacagcctggtctcaaacgcctcacctgttgatctgccttcctcggcctcgcaaaatgctgggattacaggcgtgagccaccgtgcccagcaacta

SEQ ID NO: 128850 - DNA, 1813 bp, Homo sapiens
ctgtcgaaactaggactcctggattgtaacttttcttacatttccctgtcccctgggtcctccacttagggtgtaatcacacagacaggctcttaactgtttcatatcactcacttgggaaagtgtctcaagctgttctacaaatccatgcaaaggccgtttaaaaatagcagcgaaggccctggactcggtctcgtccagcacagccccttggctctctctctgggctctggccgcctggcccccggggacccacacgaggtcatggcgtgcttcgggcaggggggcggggatcccatagacacctcagctccttaagagttctccgcctgggccaggacgagcatgggggtccccactgatgcccgagacggtgcccctgtgtgtgtgagccctcgacccacataacagagaggtgtcctgatgccctctgtcctctccaggtggatctaggatccggcttccaacatgtggcagctctgggcctccctctgctgcctgctggtgttggccaatgcccggagcaggccctctttccatcccctgtcggatgagctggtcaactatgtcaacaaacggaataccacgtggcaggtaggctgtggggctgcgtcctatgtatgtcccctcccaggtcggtctgtgcacactgactccaggaatgggaagccagccctcactgtggcccacagaacattgtcctggactgttgaaaaatggccctgaccctgagtcatgtcggctctggaccacgcctccctcctttgtcccataccccacgtgtgtgcatgagtgtgtgtgcatgtgtatgaatatatggttgtgtgcacgtggaggtgtgtgggggagtaagtgagcttcggaagtgttcaaaaccagctagcccctgtgacgcccgccgtggcacagtggcagtttatcagtcccgcccctgattccctttgtctctgcccagccctgaccctcggactgagaaccaagaatgaggagtgagccatgttgagggctggagagggtctctgattgtcagcaaatgggagcagatcaggggagacacccactctgcccgtgtgtcactctgggctgttccccagtgccccccaacccttgggcccttgaattgggtagggtctctggttttccctgggttgggcttcgtgtgtgggcagcgtgcccatccaccgccatcccgggagacccttcagtcagtgggtgactctcttccaggccgggcacaacttctacaacgtggacatgagctacttgaagaggctatgtggtaccttcctgggtgggcccaagccaccccagaggtgagtgcctgctcctctgcaccgctgtaatgtgagtggcaggcgttggtttggggcagtgggaagtgggagagtgaaggcctctctggcgtccgcagggctcatgctgcccagggctgccgacaccgcttgaggtacagtacttgtttcttttcatttttatattactttctctttttattttattttttccttctcaagttattagtagagaagatgctggtgcttttttttggtttttgagagagtctcactctgtcacccaggctggagtgcagtggcacgatcttggctcactgcaaactctgtctcccgggttcaagcgattctcatgccacagcctcctgagtagctggggccacaggcttgcaccaccgtgcacggctaatatttgtatttttagtagagactgggtttcgccatactggccaggctcgtctcgaactcttggcctcagcaagtcatctgcccaactcggcatcccagagtgctgggattac

SEQ ID NO: 128851 - DNA, 1045 bp, Homo sapiens
aatgtaagcacttgacttttgtttttgttttgttttgttttgtttttttgagacggagtttccctcttgttgcccaaggtggagtgcaatggtgcgatctcagcccactgcagcctccacctcctgggttcaagcaattgtcctgcttcagcctcccgagtagttgggattataggtgcacaaccaccacgcctggctaattttttgtatttttagtagaaatgggatttcaccatgttagccaggctggtctcgaactcctgacctcaggtgatccacctccttggcctcccaaagtgctgggattacaggtgtgtgccactgtgcccggccaactttcaattctttagagctgactatgagaggagccagcagtatagccacagcaccaacgaatgaggaagagcaaaatactgcatgacagctttgctaagaattctttcactttttttgtctatcagccaggagctagcaacttggcttatttggaaattttaagtgtacatatcctgtctccttaaatcctttacagatttaaagtgcagtctacctgagggctctgtgaccatgtaagaaagctttttctttctttttttttctctgagacagagtgttgctctgtcgcccaggctggagtgcagtggtgtgatcttggctcactgcaacctctgcctcctgggttcaagcaattttcctgcctcagcttcctgagtagctgggactacaggcagcaccaccatgcccggctgagttttgtatttttagtagagacagggtttcaccatgttggccaggctggtcttgaactcctgacctcgtgatccgcctgcctcagcctcccaaagtgctgggattacatgcgtgagccattgtgtccggcctttttttttttttttttttttttttgagacagagtctcgctctgttgcccaggctggagtgcagtggtgtgacctcagcttactgcaacctccgcttcctggattcaagtgattctcctgcctcagcctcccaagtaggtgggattacaggcacccaccaccgt

SEQ ID NO: 128852 - DNA, 1032 bp, Homo sapiens
aacttctttggtctggtcatcaagataatctagcatcaccagcaagcatgcatggagaaggatgggcccaatgtggccaagatggtaacgggaccagtagagagccctgtagaagacatctagatattctgccctaagagcccggagggccgggctgtctcatgaccctctgacgtgctgacctggactctggcagaatgtgcacacacacagtcacacagcttcctggcttgcgcaagtcccaggagggcggtgccagccacaggcttttcccattcgagggttggaagcgtatcatcaaaccacatcagagtgctgggggccacctgccacccattcccaacccactcagccttcctggtgtttgggacatgctttgctttggcagtcaagacagcagaacaaatcaacttttaaggccttgtcactgatagtacaatttccattatttttcatccaaattaggatacttctgaaaatagaaatgatgactctgggatgcaaacgttggctgtcctatgtataaggagatggcttttcacgctcccagtgactgaggaagtttctcccagatggcgctgctctgagcctggtgcagggtaggcactttcaaaagagtgtctccttgtatcttccatcagccttgcgagatgggtatctgttcccagggccccaagggaggaaaacaggacctagctggatccaagagctaggcctttctttttttttttttttttgagatggagtctgactctgtcgcccaggctggagtgcagtggcgtgatctcggctcactgcaaactccgcctcccgggttcacgccattctcctgcctcagcctcccgagtagctgggactacaggcgcctgccaccatgcctggctatttttttgtatttttagtagaaacggggtttcaccgtgttatccaggatggtctcgatctcctgacctcgtgattcgcccacctcagcctcccaaagtactgggattacaggcgtgagccagcatgcccggcccagagctaggcctt

SEQ ID NO: 128853 - DNA, 1018 bp, Homo sapiens
ccgagacgggttcctctgcgccctcagtcgggcccaggcgcggccccgcggcgtccctgggggccggcggggagccgggaccctcgggactgtccctgacgggcgggctggggtgggagtccgcgcgctccgaagcgtcggcgagaaaagcagaaaacagctccgcccgccagccctctgccctccgctcccctccccgggctgtgcgccggaccccggccctcggagcggggacgcggccaggaccgccgagggaggcgcctgcgaggaagagctcggccgggtccggagactgctgcctgggaccgcgctcccagcgcctgggcctcggtgtctccgggccaaactgccgacataatcgcatctgccggcatctattttcggtttatttccccctcattgcgaaggatttgcctggccaactttctgcgcaagatcccacgcaattcctgggaccccagaagacaggtcctgttgaagaacaggaatctggcactgggtgggctggggaggaagccgcacggtgttaaatccataaacaggaagagaaaccagacagcgaaaccaagaggcgaatgggcgattggatgccggtggggagaaggccgggggcgcaccctgctcctggactccagtaaagggaggccgggcagagtccctggggcgccacctccccctcggttagtagccctggaggccggggggagttggcctctggggagcagtgggtgctgggtgtggggcgttgcaggcaggctggggtgggcgacccaggtggaagtgaattgcacttggcttcctggtgggcctctgtcacccccttcccaggcgctgagaaagccagcaggctggcaaagaaaaggaccctagcgcaggccccacactcctcctcctaacggacgagagaccccccaaacccactggagaagtgacgctgtggggttcaaatgcagacctggcacctttttgtagcctggaaaaacattcccactgcctgctgccggaggagaggatagct

SEQ ID NO: 128854 - DNA, 1468 bp, Homo sapiens
ggctgcattgatggccagattgtctgctgcctttgcacatctagtgctggtttcagaaatttaatgaaacttttctttttccttcgacctcctgaatcatgtggttctgcaaatgaataccttcaactaggatttagaccactaagaacttgcacagaaaaacacgcattgaatgtgtgtcgaacctctacattgtgaagttgcactatgtaccatactctaaaatgaaataagaactctttatgtctgtgagagagtgtgtgtgtgtgtgtgcgtgcgtgtgtgcttgtgggggttgggtagtgtgtgtgtattttctctggctttaaaattttaaaacaaacaaacaaaaaagccatagagagcagaacttgccgagggtcatttattgcccaagtttacaagagtagcgatacaagtttttgcaaattgaatttgcctcagatatatctgtcctaatgcttatatttgcacaagtatgtaaaatatcgtgttgaggatcattctttgttggaaacactgctcttgctgaactgtcttgaccattgactatgacacagtttcttatttatgtaaatacttgcatcacagtggccgacaggcattggatgcagaacctagagccagttttcaggaacaattgtaaacctgacatggtactgtgcatctattcataaaacactcaaaactgtgaaaatatggtttacatttaattgtacataaaggtaaagggagaactcaattcagtaccagttagtttgtacattttagggggcttttcacattaactgcccatttgtgtaatttatagtttgacatgatgtgtttgttttaaaaaaaaatgcatagtataaacccattaaggatctgggaaaagagaagaagtttaatatagaactaagcttttaaagtttgtttttgtttttaattctggtctcggtgcaaatgttagttatgccttattcatatcacagttagatcaccatgctgcaacatggtttatattcatgctgccctagaaacttttgtaattatttgttgcaaatttgtgactgtccttattaactttcttttatgtaagtaatttgtaaaagtttcttaaaatttttgcttttgcttatttaattttgaataaaagctaaattcctaatactttttcttaaattgtaggtcagtgttataaaaacaagtcagtagaagaaccaaactgcatatgttaaagaacagatgagttttgcttatggtttggtggcattagatatatgctatggtttccaaaaactttggccatttttattttttgagaaaaaaaaagcaatttattgagggtttaggcctcggaaccatccctaaagcactatttttcaaccttttaaaaatccatgtccctttagggtaaggctaaaattctttctttgatgcctcaccatttgagacttctcttggttacacagactggactgtttct

SEQ ID NO: 128855 - DNA, 3851 bp, Homo sapiens
ggtactttgtcttgtgcagttggccgaaagtattgtgtgagttgaaattttgagttgattgatagaatctgtgccttaggcatacttggttaatggaatcacttgctaaaggttcttctttgtaaagttaataaccatatttcagttttgtgtaaatttatgtcttcacttattggatttgatgacaaaatcacttgagtatatggctaaattacatgactatatgtattaatacttacaaacatgtaggcaatagaatcacattctaaaagtattacagatatgatatttataaacgagtcctctttggtcctcggaatgtctagtaatcttttctcatcatgtcttcatctatataatgattttcttgtccattctggaaaaccttctcaaatttgttttatatggcaaattttcctcttcttataataattctgttttctgtgacttctaatgaaattttaagttctgttaaaattatcacagtaaagttccttgactttaaaagcttgcttttaaaatggagctggccaaaaagcaggcagagactttaaaagcgtctctgcctgctttttggccagctccgtttttcatcactgacgcttataattgttatcattccttgtttaccagagcctgtcatttgttttcttgaattttgtgagggtgcagagcagatgctttaaaaaaaaaaaaaaaaaagatttaacaaggcataagtttgtttcttgctcctatcaatgtatgttagcaggggcctgaatcatgtatagtcatttcaggaccaaaattcttcaattgtgtggctcctctaccttttttaaaagtttatttttattgtggtaaaatatacatagaatttaccattttaaccatctttgagtgcacacagtggcattaagtacattcacattgttatgcaaaaaacagatgctctttaaactttagttttcatttcaaatctttcaaaagtaaaaagtttgcttttttgtctctggtgtgctgtagtcttatttttatatttcgaaatgttttcagagtccctttgttgtttttaaatgagtcatccttgaagtatgaaaggctgagtcaggcctggtattttttcagatgagtttgtgcatatgagacagagcacgacctggcaagtagcaagtgggatgtaagtgtgcattaaagaaatcagtataagatggatgagttaaacttagatcttcccacctgtgttctctgagactactcttctatctcaggctggaagcctgatgcaattaattttacatttgcagtttggtgacccagtagtctaaagaatacactgaggggttccagaggtagccatagccttgggccttgccagcagaagctcatcattgtgtaattgactctctgacatactggctttatatgctaacttatttgttgtagctttttgtttgtttttgtgttttgacccagttccctagtaaaagatgtaactgtgcctggactcctcctgttactactttctgtcatgtcatctacaccctaactacttatcttttctttttttgtagcaactatcatccacttttttgttccactgctttcaaaaaccattgatccataaagacaaatggaattccaaattagacctctgaaccagaactcactctcaatcttactcttcccacttgagggctgttgtagggttctgcaatattgcactgctaagtcagcaaggttaggcataggtcaggccttgttgtctttctttagtctggtcagccctatatgagacagaaatgtgtattaaagcataggaataatactctctgggacgtcagcactgaaacaggtattgccctgttcttctgatccctttttccatttgtgtcggttggcatatggcatatggacgggggattagacacagaagtcttactgactattgtatttctaggttgagaatgaagatgagattaagaatctcagagagcttcatgatttggtttactctcaagcctgcagctggtttcagaatttaagagacagatttcgaagccaaattcttcagcatttcggatcaatgcccgagagggaggaaaaccttcaggtatggtggcttttctgttcttccaaaagtcacttttttataaacccaaatttgcacacttctacatttgttttctcattgtcctttctgcactactttttctttgactgtcccctcccccgcaccagccccacctcatctttgcaatcatgagttctctagagcagtggtctccactacattccgtacagatagaggctggaaatacgtgtcagctgagatgcctgtaggagagagtgccagaaagggagcaagtccttaagaggatttttaggagtgggtaaggaattaaaaacgggatgttactatctagaaactgtgactgtgggacaactaaccatgcctttgagcccatcgcctgttgctgttattctttgacagcagagagacttaccattttctatacatttgaaacatcttttctcacctttctttgtatctcccaacatttgacccaaccacttcaattcatttttgtctcttcatgtttaatacctcgcttctcatgaaactattattcttttagtcttgcaggtacttagggtttacacttaagcttagtctaatgaatgtgtatctggcactttctgtgcaagcaaaactgcaggaggcataaaagaagggtctggctcctggaaaatctgatcatagacttactaaagcactacgttttaggcatcgtagcattttgaattgaactaaatgtttttgatcagaaggtgatagattttacaaaggaatggctgtcagtaaatatgtgaagatggagagataatagatctcattgtaatgcacactgcctcattcccgttttcaagggttggtctacatttgtctgaatcccaattgaatccttcacctgaacttgaaacaccaacattaggccatctccaaatttagtattcattctgtttagcatattatcagttgccatctatttgttttaactgattacttgaatctgattaaacatcacagaaatgggctttgataagaacaatattgaataagaaattttaaataacaaaacagcttatagaaaaattcagcataacttttccatcaccttcaccacccttgccttttattatcctgtcctgtatcactgctttctgttagcagtgttgtgtgagttaggatttgggcaggaaagcaaaagcaaccacccgtcattttcccagaatgaagggtttgacgtaggatgtagactttgtatagtagttgggagagctgtgggagtgaaggtcagggatgtcacctacagaagtcagggaatctgccaccagagatcctgcatcagaaacagccaacagcgtgcttctgaagaactagtggggaagtggctataattcttaggaatcccagcaagtctgcaccactgtctcagtctacagcagtggagaaaggggtttccaggagctctctggaaagttcctgcccacactttgcaacaatcttcagaggataatggcttctcttccagcttccacacccaacaagagtgcctttcatcggccaactctaacctggaaccctatggcagaggggattttagaagacagtttgtaatgtctgtggaatgcagatgaagaggtagcaatgcttagttgacagcggacaatacacaaatatagaaaccgaatctgattctagaggggcctactgagatcagcactgatgtcgtagctccttttgtcattctgaagctttatattttaagtccgataaatagcaatttaaggttcagtgaaggtgg

SEQ ID NO: 128856 - DNA, 1050 bp, Homo sapiens
gggagttattgactcagctctgtgggctgaagcagtattttgggcgggggaggaatttcctacagtgccatcaggcagtggaatgggaaatagagagggggcgctggtgacagtgacattggtggtgatggcggctctcatgtgtcgtggtagggcaagaggaaggttgagggtcagtagcctagattagcaggggattttctgtcacatggaggcccggaagggggctttccaaactttgagatctgagattgaaattggaagaggggtgttcagggccaaatcctcaattaatgaagatactgactgggagcacaactgagttggtgtcgggagggtgaaaatctcggaggcaactttgggattcggtaaggcaggccactctgcaaagaacacagcagctgatggagctgggtaggcagggccaggcattgcttgttgtcccttttctgtttttctttcccgtttttctccctttcttttccctaaatgtctttccctcttgtgcagtcacttgggtctctttaaattttattaacgggtttttaatttctttatttcttttactctcttttaattgaacacactaaaaaacaaaattataatttgtatatgctgttttatttaacaactttttgtttccattgattttcaaaatataaattgaacattttgtatgtcactttctaagaaaagctgtgcttgtagactcctttatcaacatgtgcccatcagatgtcttcagtgagccaggtgccttccacagaagaaagatttccactctttatagaaatagatattgatttgtcttctcacagaattgatattttattgtgtggtttataaaatgatatgacaattatgaacctttctgatcagtgctgaagcatctagatttaagaaaactgcatttctgcttttgaaaatttaaacatggtgacacaaccagccagcccacggaagagtggtagactcaaaggacagaggagggagacacacagagagctgcgcattggagagaagagaagcgacagggtgtccagctgctta

SEQ ID NO: 128857 - DNA, 1047 bp, Homo sapiens
taaatagttgttatactgtattgtctagggaataatgacaagaaaaaagtcgatatatgttcaggcttttttttagaatattttctatccccagttggatgaacccacggatgcagagcctgtggatacggagggccaactgtgctggcaaaaatcatttacttgtcacagtgttggaatcaagttagtgctattaaatgaacattaaaatgagcattataaggcattgaaatttcatttcagtttgattcttggtgagaggaataaaggatagtaaagaaatacagttacctttgtttattgtatttttgtagagtgaagaaataccagaggtcacttcagagcctgtcaaaggaagcttaaaccgtgctcagtcagcacagtctataaattcaacagaaatgcctgccagagaggactgtttaaaaagagtgtcctcagaacctgttctgtcagttcaagaaaaaggtgttctgctgaaaagaaagttgtctcttttagaacaggatgtgattgtaaatgaagatggaagaaataagctgaaaaaacaaggaggtaaaaattttgctctacacttatataaaataaatttatttagtcagaatagtctttaaagtttttcctaaggaagaaaaccccatgtctttgttttaatagaaactcccaatgaagtctgtatgttttccttagcttatggtgatattccagaagaattaatcgatgtctcagatttcgagtgttctctctgcatgaggtaagcatataaaactttatagaagatgaatattttatgttagtatacataaaataccgtgtagataaaggtaataatagacaatgtaaagtaacacaatgctggaataaaaatcaaaagacatgaattttagtcctgggtttacctttcatgccttgggcaaataactgaatctctgaacctcaggtttcctaatttagaaagtgggatcaagctttgcatggcctacatctcattgttgtgagaatcacatggcttcagtataaaaggaatctgggaaattgtaaagtact

SEQ ID NO: 128858 - DNA, 1039 bp, Homo sapiens
cccgagcggccgctcgcttcctgccgcgcgctttccgggaattggctctcgggccgggcccgccgcggggaaacgactgccggggcggggagagaatcccccgcgagggcaactaggccgggcaggcggcgtctcccttcctcacccacaaaagtcaccgggacaattgggaaccgcgggagggcagaattgcataagctgggggcggggggcgttgtgtaacgggtgacgtccggtgggcgtggcgggagctccgcgcgggcgcccggccccgggaggccctgcaggccgccgggcttggggcttggggcggagctgcccagggtggtcccttgctacctggaaatgcctgaactggttcctcttgaaagtttcagctggcctgtttcagatcctgcttatttcctatgtactttgcagtgcacctagcttatggtaaagatgagaggggctgcctgatccatagttctctgccacgcttctcctggcctttccacttaggatcaggctgtggggaaaggccttataggtcttgagtgcatttcttagtctccaagaagcagcctcggcctcctaacctaggttagcactttcttcttaaggtggttttaggcgctgaaagggggcagtttcaagcttctcttacgtaaaaggaagagttgttctatataaatcagtagttctctaccagggggattttatctcccctctctcagggggcattatttagaacaatatctggagagatttttggttgccacctcttgtgggggtggtgctggtaccgacatctagtgggagaggctggggtgctgctcagacatcctactaggcacagcaggattcccacaacaaagaattatcaggccccaagtgccactgttgataaaccttgtgttacgcgtatttcaagatcttagtgtctatccattggcatgaaatgataggggaataatccccaagaaaacagacatctagaatagcaactgactttaggtattacaggtaaatttatagactgtgtaactgaaaggatcat

SEQ ID NO: 128859 - DNA, 1010 bp, Homo sapiens
aaaggagctagttgctaaccagttaccttttcaaacagatggatgttatcgttttgcagctgaaattgctggaaaaagcatcaagcaaatgaataactaaaaattaccaagcgcctgcctctgcatacggtactaattgaatgaaaataatgtttcttaggtttgatttcataatcaaggtaaaatattaggaaaatgattgtttaaaaattatttttccttctcaaagccgcagatagtctacccatttaatgaaccacaatacaaaggaagaaagtaatgtactgagagagaaataatagcacctggcttgttagttctttcattagatgaattatctgtgtttttcccgaatctttctctcccctgtaactttcagcatgctcattttaaggattacagaaatagacatgacttgtttattggagaataacataagagtatgcttgaattcactttaattacttatttcataccctggtgcttgtcagattcctttttttccaaactattgaagtagatatgattggatctcttctatttttaagcagtaaattaccagtttatttgcactcacaaattacattagcacatcaagggatggtcttgattattgaacaaaattttgttatatttacctctgatatttggagttggaaaatgagagaaaatattcgtccagggagtggataacaataaggttatgatagtatggtacttttattataagtgcagaacagtagcttactcgaagagaaagtggtgtattctctcatggtgaggtggaagatggaaataattgaaacatgaacatgtttctgctttcaaagaatatttgttgatatttttaatagcaacaaaaaggtagccaagagaggcaagaagtagcaactgtctgggcccatgtctttgtcttctctgttccctttaacacagagctagtgaagtaggtgagcttgataaatgttagagagttttagtgtttagagaaataatgtgtttataagaaa

SEQ ID NO: 128860 - DNA, 1027 bp, Homo sapiens
gcatggtggcaggcgcctgtactcccagctactcgggaggctgaggcaggagaatggcatgaacctaggaggcggagcttgcagtgagccgagatcacgccactgcactccagcctgggcgacagagcgagactccgtctcaaaaaaaaaaaaaaaaaaaaaaaaaaaaaattcctacatagtttacagatcactttaagtgatcggataggcagggatctgagccactgtttcaattttacagatgaggaaattagcgttgtttcttataatatgaatcctcgttattaccgcaagtaatccattttgaatgaaaacacaaattgccaggaaaaaatggctgagacaatctcttcttgggcaactttcaaggaatgctcccgatctaaccttaaacaaaaggaaagggcaaaccaatgttatcttttaggtcagaaaaataaacagacttttctgttttcttccctcttttgtaagcagtgacacttgagaagtttctcaccagcaggtttctgcccaagcctgagaattatctgactgacatgagcctaaacaagagtggggacaatctgaggacgcctccctggtgctctaaacagcatgttgtgagcggatggaaatgaaggctacagtttttagggaaaaatcttcctgctcattttttgatgacattgcatcgtatccctgacccctgaaaatgttgagaagagtagaaaaggatgagatttgtcggtatccgcttgctttccgcatgacttggatgatttccaaggaacctcaggggtcaaatttcttaactgcaaaggggtgggactggcgaaggcgcaatcagcagtcccatctgcaaagcctactcttgctgtgtggtttaacctgcattatggccctgggagattcacaggtgtctttctctgccttctgtaggaggctcagtaaagttgcctcaagtcaaacatttaagaagtgatacctggccctgcaaggtgcctcacacctgtaatcccagcactttggaacgctgaggtgg

SEQ ID NO: 128861 - DNA, 3346 bp, Homo sapiens
ttaatgtgctcttgtccaggtatttgattgaaccctgtgggccaggaaaatccaaactcacctacatgtgcagagttgacttaaggtatgttctgattctgatttttttatatggtgagggtcatgaaggaaattctgactttttgtctaatgcaaagaatgccttaaacaaacacgtcattttttcttggtgacttcatgaagaatggtgtttagaaagtagcatttcatgtttgttggtctttcagcgaccacttcgtaatttggttcccttagaaaatgtggttctaaagcaaagcaaatatggtagctcggccatgaattcaaaggcatgggaaatgatagattttatgcatttgaactagcaaacagatgtttctcattttatttccatgctttctaacttaaataattcatcagcttttctttcttttctctgataggggccacatgccagaatggtacacaaaatcttttggacatttgtgtgcagctgaagttgtaaagatccgggattccttcagtaaccagaacactgaaaccaaagacaccaaatctaggtgatcactgaagcaacgcaaccgcttccaccaccatggtgtttgtttctagaacttttgccagtccttgaagaatgggttctgtgtctaatcctgaaacaaagaaaactacaagctggagtgtaggaattgactatagcaatttgatacatttttaaagctgcttcctgtttgttgagggtctgtattcatagaccttgactggaatatgtaagactgtgcaaaaaaaaaaaaaaaatttatgtgtattcttattcaaattgcttctgagaagcaaaactctttaaatacattatggaagataatgaagatacttcattctcttgtgatatcagtgtatgcgtacctgtgtcgctttatttgcagtgtgttgagggactggtgtatccactggaatagttggtactcttggatgtgttttctcaccaagatgagcaaagaaaggtttgcacagaggagtgtgaatgtgtgtttgttgctggctgaatggcaatagatgtctaaggtggattcagtgtctggcacactgagacacctccaagaaggagattgatgcatcaggttcagtttaacctggaatatctgactacccctgaatccacccagaaagggggcccaacacccttgtccatttatgggtattttttttcgaagttattaagcatattccttttccacgaacctcttctgtactttgattgtaataggttggctcttacacccattccaaatgcagtttatttttagacccgattgcaaatagtgatgtagttttaaccagtatggattagttcagggatgaactgctccctctagccttactggctctgatccacagggttttgttttgttttgttttgttttttgtttaagtcgagatataaaaactgaacacgataacacttactcttaaatcaagcatcaacactttttccctgttagaattctttgcatttttgtgtttgtaacagaaacgccttaagacactatgtttgggaatataggaaactatgtgtgtcccaaggaaatccctgtaaatttaactcacctacaaaaggctttttccccgcctttggttgttaacggcattcctgaaagccacatgtgtttattcattgggcttgttcttatcagcaaataggttttctggttttatgactttttgtcttattttatttttcctacatttctttttttttttttttcctttagaatgccctggaaatatatttaagtggtaatgaaaaatagtaatcatagtaaaacgcaacaagaagaaaaccaacccaaaccagtgaagttttttagaacctttagaagggtggtctttattcaggttttactgtaatggtaaggattgactcaagagacagtattagtaaatttattgtgtatggatcaaaagtgaataatgtatgaatgagagctgtaagaaggatttttattttgttataatttagttaccattttcagtgttatttcaaaggttctttgaagaattttggggcagggcatcagattagagttttaaaatttgagtattttggatatcagtgttcctcatgaagatatacatggatattcaattttgatggcttccagatttgtaagattgtatgttgtatataccattctattaagaaacatgtccactgtgctttcaaacatagataaagcatgataaagattattatttaagatatacttgtatttatacctcagatattcttttgggttttgtacctcaaggcttttttcttcttattgtaaatacactttacgtgaatacagtctaagtgaagaaaataaataaaaggaagaggtttataacttgctctatatctgtacagattataatcaataagtgcactattattaaatgtttaaagtaagggaaaagtctgggctgccttccttaatattgcatctcactcccacccttaaaaccacagattgcaaagcatagcattttagcatcaactacaatcaaaagagcgatttgctgaaggaaaaatcggactgcaaatcattccaaggccaaactgcaactgagccacccactcccaaacaggaaaccctggtgaaggttcaggaagcacggagattctctccaacaaaggtccagttaggaaacgacgctgagaggatgacgacaacgtgcaacagcagaaagatgcttgcaagcagagtcagggtcaccagtgaatgccacaaaagttctctttcccactgtttaatttgacaagagaagaatttgaaggatatgaacattttcaagaactctgctgaggtcacttagagcgccatcacaacttatttgtgtgactaattgcctagattgtaagctctttgagggcagggcttgtctcttacacatctttataatcccctgcagcggctttcagtattttgtacttgtaggcacctaataaatttattatttgctatactgaactgattggattagcttctgttactgcaaagggaagagcatctaggatcccgatcatcttaaagcctccttttcattcactgctgattttcagatgacagagactggaaatttccaacttcatgggactttttttttttttttttttttttttttttttgagatggagtctctgtctgtcgccgaggctggagtgcagtggcgcgatctcggctcactgcaaggtccacctcccgggttaacgccattctcccacctcagcctccccagcagctgggactacaggtgcacgcggccacgcccggctaacttttgtatttttagtagagatggg

SEQ ID NO: 128862 - DNA, 1394 bp, Homo sapiens
aaacctcttgagggcagaggcatcttgtaaggctcagcaggataggtccatcggaggtatatgttgatgccgcctctaccatcttgaaaataaacaaacagtgggagtaggctgggtggccttgccggctttggaaatgagtgcaaatgtctgatgtttttgtttttatttatttatattttttgagatggagtcttgctctgtcacccaggctggagtgcagtggcatgatctcggctcactgcaacctctgcctcccggtttcaagctattctcttgcctcagcctcccgagtagctggcgctacaggtgcccaccaccacgccatgctaatttttgtatttttagtagagacggggtttcaccatattggccaggctggtctcgaactcctgaccttgtgactgcccaccttggcctcccaaagtgctgggattataggcgtgagccaccatgccctgccagtgactgatatttctttattgcatgcactctgatataggtcccagaaaaaaaaaaacaaatgtcatcatttttttcttttttcttttgagatggagtttcattctcatcacccaggctggagtgcagtggtgtgatctcagctcactgcaaagtgcctcctaggttcaagtgattctccttcctcagcctcctgagtagctggacttacaggtgcctgccaccacgcctggctaatttccatatttttagtagagacagggtttcaccatgttggccaggctggtcttgaactcctgacctcagatgatccacccgcctcggcttcccaaagtgctgggattacaggaatgagccactgcacccggctcaaatgtcatcattttgactcgagttgacaacagctttttttcactttctggcttgctcttaaatatgcttggggacagcagcctatttaagtcatagatttattagcccccaatatttctttatatactgattatatagtattatttatatcatttaatcaattaacgttgattatatgtaactaaaattgttagtctaactaacaattcgacttcaaaaactaggtgtgtatggattgccttggcactgaaaaatacatcctctttccaggtgagcgaaggaccccctctgaggctttggaggtcagtcattgaagtccctgctgtgccagaggaaatcttaaagcgcctacttaaagaacagcacctctgggatgtagacctgttggattcaaaagtgatcgaaattctggacagccaaactgaaatttaccagtatgtccaaaacagtatggcacctcatcctgctcgagactacgttgttttaaggtgagcgcttcccagttgtttttttgtgacaaggatgactccatatatgaaccaagcctatatgtcactgat

SEQ ID NO: 128863 - DNA, 2036 bp, Homo sapiens
agaacagtgttatctgagctggtcagataaagatcaggtacgaagatctctttctgtctccaccttgtctacagaaatttcagttgcttcacacccctcttggagggccgttggatttaaaatttcacaggtgtctgtgtgttttatcttgctgtaaaatgaataaataatctttttctgttattcatctcagtctctgccagaaatacttgggagaacaatacccatgcccttcttacttttatgtaaagcttaaagaaaacagttgtcgaaattaatgatcaagatcaggattatggcttttacagccttgtgtttttcttggctcagtgtggtattacagcaacgtaatttaaaagcagcctctcttagcgctcaaattgtctctaggattggcacagtggactttattttatgagaaatggagctggtctggattatttcattggttgtttcatcctttcatattttataaaaacacaggtcacattttcctcaccgaggtatttgttatgtgctgtaaccatggagctgtttaatcagtttgtcctatggagctacatttgagtgacttgatttttccaccacatgctcttttaaagagttatgtattcaaggagacctgaagatcgggatcagcattttctacctgtagattgtttatgggtttatttgcatttttatatatttgcatattcatatgcatttttatagcctctcgagcatgctttctaaaacttaagaaattactaattcagtgtgttttatttattaattgaactgaactgaatattttcagttcagttcaattcagaactgaatattttagcagcttttcccacttcaagaaggaacaaatcagttaaactcatgcaaatctccagagatactgaacattttgtactcaaggctgagagatctctgttcttacgttcttgtacatatctcagataagatttttcatcaacactaaacaaaagtgtatagtgttttcagtaattgagattgataaattagggatttttttttttcatgcttaggaaagaaaaaactgttctgtaaactaaaagagcaggcatcctctagagccgaactctgaggtggatttaagagtgtttgggtattgtgggtgtttaaaaattttttcactccttcatgaggcaggaaatacttgaggatagtgacgccggtggcaattcataacttttaccgtattaacctctagtgcactttctacaagtgcttgttcagtactgggctgaggtatttgatgccgatatttgctctgggacatttccttgcaatgtccatgcaaattcaccaagctgatggagaaagtgctggtgtcgtgcagatgtgcccaaggaccagcgcctgcaggccatcaaggctgccatcatgctgctgcctgacgagaaccgggaggttctgcagaccctgctttatttcctgagcgatgtcacagcagccgtaaaagaaaaccagatgaccccaaccaacctggccgtgtgcttagcgccttccctcttccatctcaacaccctgaagagagagaattcctctcccaggtacgggctgcatgggaggtgcatgcacacagggggcagcctacattcttcctaggactctccgtagctgtggttttgtgggactctttcctgaaacaagcaagaaggttagaccgctatattagtccattctcacaccgctaataaagacatacctgagactggtctgttggcgtgcatgagaaaatagtctcactggacttaacccccacagacaaaatccatcgaactgatccttttcctcagctctaaaggaacttgaaaagtatttcttagctagaggcctggggcctagttatgctagtgcaggttaggttgcttctgaaagtcatataatgtttaaatgtatgtttaaatagttccttttgagacagagtcttgctctgttgcccaggctggagggcaatggcacgatctcagctcactgcaacctctgccttccaggttcaagccattctcctgcctcag

SEQ ID NO: 128864 - DNA, 1049 bp, Homo sapiens
taacatgccatggctgctggtgagcattcaaaaggcaaagcagtctgtcttctctggagttcctctgtgcttagagtaatattttccctgctggctatttaaaactgcatattttagattctcatttcggagtggcccacccccatcccaccaaaccctcaagaatctgaaagtccataatacttcttgagttctggtcagtgtttccagtgactcaaaaccaactgtaaaagcctcacatggtgggatctgtggagcagggaggaatcctacacaaggttcttttcctgtttggccttgccctttcgggtcctgttcagagaggtcatttggagagctggaatttctgcttgacagcctgaaatgcatgacatgggtttcctgctgttgcatatagtgctggggtggacctggtttcaggacaccagggagcctggggtcggctcacaaaacccccattgttccttttccatcttcctttagaaacctaaagatgtaatgttctccgggtcatcagcagcagattttattttgacttcaggtcattcactgttgagctctggagttggctcccattgtgttaggctctcattgctgttttcccatcatgtgttatctgcgccttttaaccctaaatgctttcgatctcatcaagaactcagaagtgattcttacccttttttcaagacaaaagggaccttgtttttcacactctatcagatgcacctaattagggtattacatgttgttttctgcttgttccttcctataccgccattctgtaaggaaatccatcagcttccttaagactgtagaccccaattctccaggttcaaggtggaaggacgctcctaactgaggaaacggacctgtcaacccccactcttagaagatctagaacagcactgtccaggagaactgtctggatgataggaatgttctttatctgcacaggccaatacagtaggtactgagcacaaaagatgaaggagcacctgaagtgtggccagtaccactggggaactgaatttgtcattttgtttaattta

SEQ ID NO: 128865 - DNA, 2320 bp, Homo sapiens
cctgttaaattctttaaatacatctttgttatttaaagaacaaaacaaaacaccgggcactgtggctcatgcctgtaatcccaacactttgggaagcccacgtgggaggatcgcttgaggccaggagtttgagaccagcctaggcagcatagtaagactactgctctctacaaaaaatttaaaaaagaaaaagaatatgtaagtggggctgggcacagtagcttatccctgtcaccgcagcactttgggaggctcaggtgggaggatcacttgaggtcagcagttcagaatcagcctgggcaatacagcctgtacaacagagtgagaccctatttttaaaaaaaaaaaaaaaaaaactttaaaattaaaatcatgaagtacaagggggaaattgatactactggcatattatgagcagcctcctgctcatgccctgctccctgctggctgccagccccagtgtgtgaatggctcctttctgtctttgcagagtgacgattcagacgaggatgagccttgtgccatcagtggcaaatggactttccaaagggacagcaagaggtggtcccggcttgaagagtttgatgtcttttctccaaaacaagacctggtccctgggtccccagacgactcccacccgaaggacggccccagccccggaggcacgctgatggacctcagcgagcgccaggaggtgtcttccgtccgcagcctcagcagcactggcagcctccccagccacgcgccccccagcgaggatgctgccaccccccggactaactccgtcatcagcgtttgctcctccagcaacttggcaggcaatgacgactctttcggcagcctgccctctcccaaggaactgtccagcttcagcttcagcatgaaaggccacgaaaaaactgccaagtccaagacgcgcagtctgctgaaacggatggagagcctgaagctcaagagctcccatcacagcaagcacaaagcgccctcaaagctggggttgatcatcagcgggcccatcttgcaagaggggatggatgaggagaagctgaagcagctcaactgcgtggagatctccgccctcaatggcaaccgcatcaacgtccccatggtacgaaagaggagcgtttccaactccacgcagaccagcagcagcagcagccagtcggagaccagcagcgcggtcagcacgcccagccctgttacgaggacccggagcctcagtgcgtgcaacaagcgggtgggcatgtacttagagggcttcgatcctttcaatcagtcaacatttaacaacgtggtggagcagaactttaagaaccgcgagagctacccagaggacacggtgttctacatccctgaagatcacaagcctggcactttccccaaagctctcaccaatggcagtttctccccctcggggaataacggctctgtgaactggaggacgggaagcttccacggccctggccacatcagcctcaggagggaaaacagtagcgacagccccaaggaactgaagagacgcaattcttccagctccatgagcagccgcctgagcatctacgacaacgtgccgggctccatcctctactccagttcaggggacctggcggatctggagaacgaggacatcttccccgagctggacgacatcctctaccacgtgaaggggatgcagcggatagtcaatcagtggtcggagaagttttctgatgagggagattcggactcagccctggactcggtctctccctgcccgtcctctccaaaacagatacacctggatgtggacaacgaccgaaccacacccagcgacctggacagcacaggcaactccctgaatgaaccggaagagccctccgagatcccggaaagaagggattctggggttggggcttccctaaccaggtccaacaggtaagaacttttctcctgcctccgggtgtggggcactgggggtcagaaagacattgcctgtgcttgttctgtgggaagaaatgggattaagtctggcattcttagccatgtccattcctaaggaaggtgtcaaaccaggaagcaccaaaattcaaagaaatcgataggattgaatgggtatagagttccggttggggaagatgaaaaaagttctggagatggttggcagagatggtcacacaatgagaatgaacttggtgccactcaactgcacatttaaaaatggtgaaaatggtgcactttatattgtgtatattttcccataatggggattaaagcatgggatagaaatcaagtcctatcagttcctaagataagatgccagcaagcagcccattgctaatgt

SEQ ID NO: 128866 - DNA, 1308 bp, Homo sapiens
ttatttatttatttatttattttgagaaggagtctcactctgtcgcccaggctggagtgcagtggcgctatcttggctcactgcaatctccgcctcccgggttcacgccattctcctgcctcagcctcctgagtagctgggactacaggcgcccaccaccaggcccggcttgtttttttgtatttttagtagagacggggtttcaccgtgttagccaggatggtctcgctctcctgacctcgtgatccacccgcctaggcctcccaaagtgctgggattacaggcgtgagccaccacgcccggccaaggtatttttaaatgactcactttttaaataagtttctaatactcctctaggtattaggtattactgagtttcaagaaactccttaaatatatgaattgtttaaaaacaggtgtttatccactcattagagagtggttgcctatctttgctaacgttatttctttgctctataggcgtctaaatactttaaacaaatgtgcggtgatgaagctagaaattagtcctcatcggaaacgagtgagtatacaaattgcataatagaatgagggggaaaaggggcaaacaaaaaagtgaatgatgtgttttgtaataggttttgtttctccaactcttagtttgttgttccgtaagcatctacatcttgaatgatatcgcctagacttgatagccttatgtagttgaagccaatagttgcaactagtccattacattattttatctattgtttttgacctgatcacatcagctattattttgcctaattactaactcaatgcctattacataataaagggatcatgcttaaggaatcccagtggatttttgcattgctcatagaggaaataaactgaggtttatttccaactcttctgtcttcccaaatataacaataactgtgcttcaaagctgtagagatgaaagcgaaggccgatttgtgcaatattgaagaataataagagatttggagggaggaaaggaattggaagaggaagaggagaaggcaggagatcccacacagtttagtcaaatggtggtacacaaccgagctggatggtattttcttctgcgtgtgagttgtgaagactttttatgagatcttaggagaagaggtgggtgtagtactgggagtaagtgtcacaaattagagtaaacaggaatgagtctggtcaaagaacatatttctgacttccgggttcaaattttaattatgccagaatccctgagctgcaaaaagttgccttcttggggagtcaaagcttttaaacaaatgaactggaacc

SEQ ID NO: 128867 - DNA, 1066 bp, Homo sapiens
cattttaaagtgtgcagactttttcttagttatttgttttcttttcttccccatcaacagagagaacttttctgaacctaggcgctctgggctatctttatttattctataaacaggctaccacctaaggtatgaaggcaaaatcgggcttatcaggcaggcaaaaatgctttctattctgttgcatcaacattgttaggcaaacagcaagaacaggatcaggaagataaagccctgaggaggtctcacggttcccaggaatttgtgtgaattaaatgatctgatcttatgaaaatgtagaattgcaattcgtaggaaaaactagaaaactggtgatagcagatggcaaacagacacattacaggttcatttgaggaagactaagtgatgatcatctgggagatggcaggaaaattggggccttgaagggctgtcattcatagttgtacataccgtttagttcagcatatttaaagtgtttcttttttcaactgttgcattatttctccatgaggttttgggttttttttttttttgtaagtattttattttcaacgaaactaaatttccctaattttaaattgatattgctgtttggcagaggtgaaagtattggtatcaaaatgacaataggatggctgttgcaaaaagagtcttacctgagtgcttaattttgaacccggtaagatttggatccttgaagttacagtacgcaaattctttaaatgatcatttgccgtgactatagcacacattatattgtcctataacaggaagctgttctaaatattggatattaaagagggcttcaatttccattctgtgcaaggactctaaaattttagacaggctgtccaagattatgattcatcggagataactaaaactaattttttaaatttgagttttgatttcaaatacaagacactgtttattttgccaaaaactctacttggttctttgttgctgttttgctgtttctatttctatgaaaggagacatcacaaacttttcttttctttctttcttttttttttttttttttttgagatggagtctggctctt

SEQ ID NO: 128868 - DNA, 1167 bp, Homo sapiens
atctcggcctcccaaagtgctgggattacaggagtgagccaccacaccccatctcagtatttttttcaacttggaaaaacatcatgaaggtagaatgacacccagtatttctttcctctttgtaggcaaggaaagcagtggtagttctgttttctgcctttctcatataatacagtgttatatgaagcagccaaagtaagcagtggtttggggcagatagatgggatatttagcatagtgtatggactagactagttctcatggtttaagagaggaaaaaacaaacagtcctcttaaccacagaaacgctgtcacttttgtagtccaattaaatgactgatagaaacgtacagggtgtgtacccattttctgaaagaaacctaattccaagaacttcactgtggagtgtaatatcattactatatcatcgggaatgaaaccagatgcagtttcgggaggggaaggagtctgcatctggaatatgaactactccagacatttttttaatgttttcatgcttagctgtggagcagaattaatctgttttcaatccatcactgctgatcatgcatatgcatgaggtcacttctgagatgcatcttaggaaatatttaagcattacatcatttcacgcagttagagagtgggcactctggacagcagcaatagcttaggaattcttgggtcataaaaatatcactgcagcatttcaggccaaagggtcatgattaaattcttgaatgctttttcagaatatcagtttgaaatgttgttttccatttctgggaaaaaaagtatcctctgtactttgcaatttacactggctctgagtaccttttgagaagccacctttctctgaagcgaataagtctgtgctgctagatctttggtgaaaagaaaagcctagaagaagcagactctgccacatatgctagttgggcttcagttttctctcctgcatagaataacatcttataggaaatgcagtgatggatgtcagagcgctttaaaaattaaattatcaggccccaatttgagtatgtgcagaaaggcctagggttggattttcttttttaaaaaaggaaattcttcagagttcacagtaatagtcatcaactggtttgtaatggaaaaccccagggctcttgtccacatgtccacataaat

SEQ ID NO: 128869 - DNA, 2552 bp, Homo sapiens
tggaggtactttgtggccttttgttgaagtgaaaagtagtacaataggccggccaggcttcaaatgagttattaaatctctcttcaactttctcatgatgccttattttcataaccgtttgtaatcagagcacttcagaagcagcacaaaatgagaaacttactctcaggaccccatttctattttttgtaaagggaaaatacatcctcatgtacacgtgaaaaaactggaaacgatgcatacaaaatgtaaaccattcgaattaagcgtgtatgtctgtttgcttatctgtattttctatggcagtcatgttttgcttgtatcataaaacgaaagcttattcaggaaaaataagcatggcgaggtacacatggctaattttgtctttcttctgttctgttctagaaattgaagccaaggaagcttgtgattggctacgggcaactggtttcccccagtatgcacagctttatgaaggtaagctgggaatgccactttttaaaagttggcataatcataatcccttgttcgcgagtattactgatctatgacttattttcagcagttttatcgtttaaatgttttatttttaaaaaaaatgttgtaagcatgcaagacccccaccgctgaaaacaaaagctagcaccttggtaacacgcccatgccactcccccatctgctgcctgccactccctacccaaagtaatcagcatgctgaagactatcattttcttgctttctttttgtataattctactccatttcctgaaaagtacatttttacaaagtaatttttacgtttataaaaagggtagtgtgtcgtatgtaatttcatggggtttttatttttcacttaatattgtattgttaagattcttctatactgtatgggcctgttatgcatttgctttggctgctgtgtaatacaccattgtgtattacacaagaaaccactgtttattcatatccacactctggttggtgggtattttggctttctctgttttgcttttataagctgtgctgttgtgaacattcttgcatctatcttttgtggtacatgcataatgattcatcttgcttctatccctaggaacagaattactgggtaataaagaatatgtatgttcaattttaaaatgcaagcttttcgaaagtgcccgtaccaattttcactcttaccaatctgtgtatccacattccctcaacgcttgatattgtcagactttaatttttgccaaccaaatggatataaaatgatatagagattttgactgccatttccctaatccttcatggtaatgagcatttattcatgtcactcggccacatttgtttgctcacattatgcttctcttaatgatttataagggctctttttattctaaatactaatctttcattggtcacgtgttgcagatatctttcccaccatttgtaattaggcatttcacttttctctaggttgtcttttaatgaatattatgttttctgtggcattcagtttttcaattgagaaaaatggttcaaaaaaaaaaataggatctgtgctgaattcttaacatctcattttcttatcagtgccctggggattgcttggatactgaggtcattctctcagcttctgcgtaccctggggagtgcttgtgctccctgcatgtcaagataaataggctgttcatttatttatttatttgttttgagacggagtctcgctctgtcgccctggctggagttcagtggtgtgattttggctcactgcaacctctgcctcccgggttcaagcgattcacctgcctcagcctcctgagtagctgggattatgggcatgtgccaccatgcccggccaatttttgtgtttttagtagagccggggttttaccatgttggccaagctggtcgtgaactcccgacctcaggtgatccacccaccttggcctcccaaagtgctgggattacagacatgagcaaccacgcctggcctaggcagttcatttaaatgggagtttcattatactctatatgaagtcaatttaaaataattacagctatgaactaatgcattccattttatgggtaactttcaaacagaggttgggtgaatagcaaagtgattcccaagttagaatacccggtcttccttatgtagcctagactgattgtgatattttttccaagaagatggattctgaattgttttattgttagaccgtgtaaaatatcttactgtttcttcattccagagaatatctccaatttcttttgattaacttgcatgcttattttggtggagttacttgtctttcctttagagagaagttttaacctgttaacatttagaagggctttggggaaagggggaccagcattctattggattttcaattcatagctctactggagataaggaaagacaactgcattggcagtaacaccaaagtggctgtccttttgttctcctatttagaaactaagttttcttcaattatgctcgtttttggcattgatttgctgccaggtagcactttcttgtgatatatatgtttgctaag

SEQ ID NO: 128870 - DNA, 1026 bp, Homo sapiens
atttattaagttgtcatcacatcacagggaaaatgggtcctttttcccctcctttctataatttctaggaatgttctttaatagaaagctgtatatgtatgtctccaaatctcaagcagaagaataagagaaaaaaaaatgaacaaaacttaaaaaggaagctccccaaagcttccattccttactaggactgaaaaccagtatggtgatttacaagtgagggcactgttgaaataggcaagaagggcctaacctggggatgagagctgggtagctttagccccttcagcaaatcacctcaattctgtaccagcttcctcatttgtaaagagaaaagatgaaaagcttcaagaggtatttcagcgcccaagtcacggattctttggaagacaacatgctgctgtaaacatgaaagatcaataaggaaagtaaaactcttaagagccttctatgcattgaagtgttttcttcctctcaagttgaaatttagagggctatagacacgcacagaagcaaacgtcattggttttgtgttgtctatgatatgaatacaggcttcatgggacaaatcaagaagtcgatctcttaaaaagcaaattaggccaggtttggtggctcatgcctgtaatcccagcactttgggaggccaaggcggatggctcacttgaggtcaggagtttgagaccagcctggccaacatggcgaaaccccgtctctactaaaaatacgaaaattacccgggtgtggtcgtgagcacctgtaatcccagctacttggaagggtgaggaaggagaatggcttgaacccaggaggcagaggttgctgtgagttgagattgtgctactgcactccagcgtgggtgacacagtgagactctgtctcaaaaaaaaaaaggaaaaaagaaaggcaaattggaaatgttagcttttaaaataaaagtaattaaaactttcgtaaatttacaaaactggggatctcttgtagcagtttctagtggtccagttttttgagggaagaagaatgttt

SEQ ID NO: 128871 - DNA, 1055 bp, Homo sapiens
gagtgttggggtagtttagcaagccccgtggcttgcaaacgtgcttcttgctaggaaacacacacacacacacacacacacacacacacacacagttttggtttttttcccggagatgggtcgctgaatcgtgtccctgaaatgcccccttggggatgcccacccccttgacccggacaaggaggccgaggagcgagttcctgggccggagagaggaaggaagctcgcctcccgacccgactattttcgtaacaaggcgacagcttcttggaagcctgcccccactccatgtcgctgtccccacctccagagtcctggggcgagcctttgatccctccgaaggaggtgcacccctcctctctgcagcaccctgctgcgtgtagtttgctgcgtccgcgagcgtccttcagcgcacagcccctggggcgaggaaagtgagaggggacacggggtcaggctggtggggtctcatcctggtcagcagcctgctagctgggcgaacttgggcagtgacaggacctcgctgtgcctccttcatctgcaccaaaggggtgataactgtattacctccgcgcggggaggttgtgaggatcaaatgagctcatgcaagtaaagtgattagcaggttgcctgttcccgatgttcaataaatacccagtgtgtgctaatcaccgcagaaggaaacccctgcttgcagtcattaatctgcacttaaagaaagcttcgtcccactccccaccttttcccatccccagtcttgttttgagtgagtctttttacacccaatatggatgagcaaatggattcattctcaggattcagaggttgtttcggcgattactggtgacatagaggaatgcagcctaggctggtggcattgatgatgtatttggaaaaaacattgcagctcgggagaaggcagaatactgagtctcagattacattttttttttcctccaaaattctgtttgctgaagggatgagggaaaataatagtccagcagactgcagccctctgaatgtaaatctatcagcagctccaagaggttgactaa

SEQ ID NO: 128872 - DNA, 1178 bp, Homo sapiens
ggcgcttcccgctgggaacgtggaggcccgtgggggaaacattccagccttcggcggaggaggcgcggggcggggcgggggggaggagggaaccgagggggcgggacagaggagaggcggggcctgggcggggcggggctagagggcggcctgaggctgcggccacgaggaagaggggcggggggcggagcctgggaatggggcggggccggagaacagcccgtcgctaaggcctgcgacccagacagcggggaggaggcggtgccgcccgctctggccccgcccctcggggggtgggcccagcgggagggcccggctggcggagcgcgcgggagacagttcgctccgactgcccgagcgagggcgcttcgctcccagccaggacatggccgcacctctccgcatcaggagcgccggctcacggacttctcgcccaactccctgagcgctccctcgtttcgatctttagaaaaccccgctttctttctggggccgtgacgaggggcagggagcggcgagcaaggatgcgttgaggaccgcgagggcgcgcgtctcgggtgccgccgtgggtcccgacgcggaagccgagccgcctccgcctgcctcgacttccccacagcgcttccgccgccgcctgccgtgcttgatgtgcagaaagaagccggacaccatgatcctaacacgtaagctagacttgcgtcttgccgtcgggctggccgcgggagcgggctgcggaggggacccgccgcgagaaagtgtcaccccgccttgtcaagtcggtgcctgttctgtgctctttaaacgctttctgcagagtctccggattttcttggaggtggtgtggggatagcaggactcgcagtttggggagggagtttgaattttggaggagtgactcttgattaccttttgcctggggaccgcgggccagcgcaccaggcgggctccggatcggtcgcaacccgtgaagggaagccctggttcactttcctccttgagccgggcgggggctcgcggctctggctcgaggggcgcggcgacaccgccttctaccttcctttcctctggggactgctctgcgctcgtactgatctcctgtcattcaccagcttagtccaaaatcaaagtgaactccgggagagtttactgtttgggaacattttagaccctagtggcgc

SEQ ID NO: 128873 - DNA, 1109 bp, Homo sapiens
ttatccaaggtggtactggccacatttccagtgcttggtggccacgagtggctgtggctaccctcttggccattgcaggctttggagatatctatggggtgcctctggtgtgagcttgctggtgagagccagggattgtggtccctgtttccctttccactgtcaccacccatggctggtgaggttttcctctcttctctggtgtcaatgccacataataaaatctgtctgcagacagtattctctctctctctttctggaccttggaattacattccccttatagggtttatgaagggttttagtgattgctgaaacaatgaattatactgacaggtcaagtgtcttttgaatgcctttgagaaaggcaaaagtcataaataggtagcaaataatgaatttgcaggtacacaaaaactaacttaagatgcagttatgtttagagaagtaccaggatttagcagatcagaagctgtgggctgtgggatcagaagaaggtttcagattactggtggagtggagggagaggcgtgggcccgagaggtgagtggaagggtggcacaggggacaagaaccaagcagggttagagtgatgctgacctcacctagagatgaagatgaagtcgccaagtgtggggggaagttgaaggagtatccttgggccactaactccgtttccaccctttcttcaccaaaatgttcccctaaacattcattggcctgaggaaaaatctggaagagggattaaatgataagcttgctccacactgtagtatgtgtttgggggagtgctgggggattatattgggggtgagatagataacgaggtagaaaagtagaaatgggtttccatcagctccacaagaaaattcaaaagaaaggtgagaaaggaaattacaaatgactggtaatagcaaagaaagtggagttcctgaggcctcttcgtagccacatgatttataggaagccaaagataaattgggggtttgcttacattgctattaaacccttattggccaggcacagtggctcatgcctgtaatcccagcactttgggaggtggaggcgggtggatcacctgaggtcagcagttcaagaccagcctggcc

SEQ ID NO: 128874 - DNA, 1019 bp, Homo sapiens
gggctaacggggacatctcgttacgtgagttagaggtagggtagacggtttgaaaatggatacatagtgtttgatgcatttttgttgattagcataatttttaggaatctcagttgaaaatttttcttccttgtctgtttgtattcaaataccgtgtcacactcttgtgtatgatttgtaatccatttagtgcggaccaaaggtttaacatgttgctttggtggctttagtgctgcttatttctctaatttttaaattcagcatttaaaattttgtcatactgcttcagtcacttcatcgcttaagaggcaattcattttctttaaaaataaataggtttatttgtatccattataaataattttggatcctatatatattgatggaaaattttgctcaaataaaaccttcaggtttataaaagattcccacattattactactcttggttatagcttgtccatcgcattataaattcttgactactttctcattgtagggaagttctgattttgcatgttatatgtcatctgtgcagagtaatttatttcacaaaacactccacatctttttccagtgttaaagcaaccttgttttataatgtattttacacacacacacacacacacacacacacacacacacactcttactgaaacacatctaattgaatgttgactaagttttctaatgttgcttgctggaaattggttgaaagattgtattctttggtttgaaataagttgcaactgtatttatagcatatgaagctacataaattcagatagaggcctatgtcatttttttccctgtgtgaatcaaaagagcttggaagaagaaattggaaatgactttaaaaacatgtgattgtttggatttaattaagcggatgctacgatttatattttgttgttacatttcaatgtagttgaactaatgataactaccatttatttaatatttgctaactattttacatgtattatttcatttaagcatcatcacaagcttagcatgat

SEQ ID NO: 128875 - DNA, 1112 bp, Homo sapiens
cattttgtaataaaatgcggaactaataaaactcactttagatttgaaagctagagctagcgcagagaagattgacggtgatggtaaaagtgaaaatcctgctacatgaggattactggaagtaatttgccaagtttagcttggaaaatgaaaaataataggcttattattgttccctttgaattataaaaatgtgttctatggttaaggctttttctttgtagctccagagagcaaaactagatcccgtggatggtaaatatatgcattcaatgtaagaaagaagaattttgaaatatcattgttttgaagtgcaattggctgcttagtgggatagcaggatagcaagctaatttgtactggaagtgttcacctttagtgctcagctgtcaagactgtacatgccatattttgtgggaggtttaattaaatttaattaaaatggattttttttcttaagcaagtattggaagagtacattaaaagaagtataagccatttatgtatatcctaaaaccagaaaaaaaccacaaacccttattttattagagatctttcttaaaatgaggatgtagtttttggaaggaaaaatcaggaaaggaaataagaggagtagcaccttagtaagcagatgtgctgaattaaatctcatgatagatagtgtcagttgtttgtcctctgtattgcaggggcagtattttgtgagaatatgttgtttaaacaggtacttaaaggcagtgtaatcaaacacagcagcttaactgttttaatatttctgtgggaatttgaaatatttagatgtttaattgatgttaaacttgttaaagatttccttaagattcttaattgtcaacgtcataaaagtatttttatggttaatttgagtaattagagaaccaatgtgttggcgtgtagttagttataaaattatcagtctcagcacaacattgacttaaaggcagggtgatccagaaggataggggtgtttgttttgttgtttcttcccccgcttttttgtattataaaagcgagaaaagattctgcttacatgtaggaattgtcttacaattctcttatctgttttgattaatttggtcattgatcatgcatta

SEQ ID NO: 128876 - DNA, 1036 bp, Homo sapiens
aggttataattttttcaaagtcacacagctagtaactgttcagggttgcgatttgtgactccagagctattagaatttaatgctttccttaagtgcacatattcattattgtctctattctgtaaactgtaattgtgtcttgcttttgtgttcctaaccaagattattagtgtcttagggcagtgatctctccgccagcatatcctaaacttgtatgatcatgaaaagcttttattcaggaatgtgtctcataatggggactggtgaattgaatacagctggctaaaatcacgtggaaaagagcctatcacccttttgtttccttacagagaggtcacacctctcatgggtttagagtgtgaaattaacaaataaggtaaacttgggtcccttgtacatcacttaaagcacttgtaagtatattacttttttggggtttggtactacaacccttatcatttcctcttacctttgataatatttcttcatagcccttaatttttaagtttccttaaatttcttggctacctgaacaaggtatttcacctctttgcaagactggggaagtgtcatgccttttacatgttctttttctggtttggctaacgtgagacatttttcaggcttgagtgaatccatgaccagtttggtataaatgatgccctcaagttactgctgagctatgtagtttaattttcttattttttacattgaaggcatatgacgtaactttagtgtgttaactttcttcctaggtgtctcttcctcagataggataatcccaccatttttactgtttacagcaaacgttcattatatatgtgacattgtagcattccttgaattcttttctatattctataatttttcctttaaagtccagctatagtctcttcatctttttaatttcaagcttacagaaaattgaaactagtacagtggacacctgtgctaccctttaccaaaattcactaattagtaatgttttgccactttgcattttgctctcttttaagtataggtaaaagaaatcagt

SEQ ID NO: 128877 - DNA, 1050 bp, Homo sapiens
aaattggtctttgcattttactaaacattattggaatatttaatttatgtgtatagggaatgctgcaaaatgtttttattccctagagtaagagttggcaaaatttttatttaaagggctaggctttgtgatacatgtagttgctgtcttgttgttacaactttgcccttatagcacataagcaatatgtaaatgaataaatgtggctgtgtcgcaataaaactgtagttatgaacatcagaatttgaattttatgtaattttcatgtcagagaatcctttttttaaaaaaaaatattttaaaaactatgcttttcttacagtctgtacaaaaactggccagtgcttgtcctagggttgtctgttttaataactgctttgtagatgcttcagtactgatgtgtttctactatggcccattattcttatcaggcaagctaatgaagaatatcaaatactggcgaactcctggcgctattcatctgctttttgtaacaagctcttcttcagtatggtggactatgatgaggggacagacgtttttcagcaggtaaagagttatatcgtattcatatatttaacatagttgtttgtggtcgatacatttttgtttgtcacataaaaatacaattcattcatcgtctgaacctgggaggcggaggttgcagtgagccgagattgtgccactgcattccaggtggaggacagagcaagacttttacacacacacacacacacacacacacacacacacacacaaatacaattcattcaataggttagtaaatacaataagtagttataatacattttgtgatgtgattaacataattatggctaaacttatttttatcattgtacaggtttttgccattatgataaattcattttaacttttgcaacatagaggaaatgtgttttttcagcatgcagtcgcagtttacatgcattggtcttattctggcatttaattataggtggtagtgtattatagatagtattttgcacagatttgtgacattttatataaaatttattgcaagttttactt

SEQ ID NO: 128878 - DNA, 1069 bp, Homo sapiens
cttttgtatccttgttttctcctttaaaaaattgtgcaaactagaatatttagactcccagtcgtgcattgctcgttcttgtctttggtgtttttggtgtttttattgttatttttggtacaaatgcctatcagagccaggaagctgaagtaaggagtgattgggcaagttataggatagcaggaagtacaggtactgttttaacctagagaacacatttagtctaaaggagtcccagttcattaactttaaaatattttgtgatttaaacaaaacatgctgacacctcagttatactgattgaactgtgacttctggtttatgcattctctccccaccctctctgcaataccttggatcttcaatattagttttccaactacagctttgtctgatatattcagcaggtatataatctttgcgagttattcctggctatgtctttttgtgatttcttccatctctaaacatcttctgaatttactgtgtcgtaaactttgctgaaagtatttaggtacttacggagatttaagtaccgtaatccaagaatgtagggttttggttatccaaactaatagaagaatgatgtttagaggatatagaagatgattatcatgtcctttaaaatatcactagaacatcaagtgtctcatctgtgcttctgactggctcaggtgagcacatagtatcagattgcctgtcaccaggccagatgctttacatatgttatccgatgtaattattaacatatttctttaacagagctggcataccaattttatagatacggaatctgagatgcagggagaataagtaacttactcaaagtcccatagttaataagtgaaattttttaaaatgtgtgagctgatacatgatttttaaaagatactttcatgatgaccattgtcttttagaaatgcattattctggtattctctggtttacatattgaaacactgcaccctgtttttcagtgtatagtctttgctatgacttctggccagatgtggaaccatatccgtggacctccatatgctcataagaacccacacaatggacaagtggt

SEQ ID NO: 128879 - DNA, 1044 bp, Homo sapiens
ttaaaaattcttaaacagttggatagataatttgttcccttaacagaaagtttattattgatgctctgtcaacagggcctgtgttttgaattgtatttttcaaaagtggtattcactgcagtcctctgggctatttatttctactacacattgaccttaacatcaacagtgtacacttgggggaaacactgtttagaatggcgcatagtttgtggcagtcaacagaatcaatatataacagacctatatgagctctgaaattctgattctatctttaatagcttaattttccaactgcattgagcaaattgggcctgacaagcttagtaaaagacaggagtattttgttgggtattcatttagttcttaggtttttttttttttgaaaaattagtggtatttgtaaggctagtgactctgctcatattaattgtgaaatcaaacatgtctaggaaaacctgaagatattgacaaagtgtttcttcattgagcttaaatgtaaatgaatacagagaatataaagaaaattaatagtgcaggcagtgtgatgcggtgctgctttgcaagtttatttgtttgtcactattaagatactatgtaatggcacaagtcaagtactaatggtccacttaacagcatgaaaatcaacacaaaagcagtcattattgtgtagctaaagggaaactatacaaacatatggttacataggacataaaaacaatttttgttgttaaaaaagcaataatctttaacaatatgcatttaatgaaataaagcttatgcgtaggctgtaactcccaccgtgaacaaatgcgttattttcaagatttggattttagctactgcttgaggattgctatgggtttgccagatatagtccaaaaattttcactgcattacaattcagttgtgagtaaaactaagcgttatattctgcatgcacatgcagaacattttattgcaaaatgacctgctgatttagtctaaaatttatcatcgaggcattttttttttctatttcttaggcagccataccatattgta

SEQ ID NO: 128880 - DNA, 1010 bp, Homo sapiens
atggcctgaacccgggaggcggagcttgcagtgagccgagatcgtgccactgcactgcagcctgggtgacagagcaagactccgtctcaaaaaaaacaaaaaacaaaaaaatggtaagacaagagtaattgacatacattaaggatatacagaaatcttgatgttagtatttggaattgagattcttccctcttatttatttatgcctttatttttccatctgattaacatatttgttaggtactctgtttccagtagtagtacagatacatcatgcagctcatcatctagtggggatacataatatgatatcggttagcctcaagtctcagtcttcagagcctcgcttcttattgagttacatgatatttgaggctgcaattgttttagaattttgcctcagcaccatggtcattttatggctgtgacactgcatctgatgtctttcaaactctgccttaatctttatattcctttttattttttcatatttgtgtctgtctagttagctttggtagaactccatcttcagcatctgttgttgccgctcattccttctttccacctggttttaatttttagtgtcaccatttaaactacatgcattcttgatcctaacgtctgactgaatcttgattgccagcccagactgctcttacacttcccttcaactgttgctgcctatctatgatcctgccaattaattacaacgaagaaccttgtgatttgtacccttacttcatgacaaagcacttcacacgtggcagatactaaataaatgatactgcatagataaataaatctttctttgcaaataggaactcagattgtatctttagcctttcaaaatgttaagtatatcagaaaaaaattgttttccctgctaacatttgtttgtaattaaaaccacatgcacagagggattatggaactgcataatgagaatgtgttttaatatgtcaaacttcatctaatacagttaattattctctgagtatcaagaagaaata

SEQ ID NO: 128881 - DNA, 1115 bp, Homo sapiens
cttccttttgtagactctttttgtttactctggcatttactcttaaaagacttttcataggtacttcagatggaagagactctaatgttaccaaagccagaatcttctgtttgagtaagaaacccttttgtaaacattggtattaaataatagttgttgagccacttcttaaacaatttagatagggaacttgctttctcatgagacagccaattttagctttagaatgctttatttgttgagaaagtgtttcatatatggagctgaaaactgtttctttgaaatgcttaatagtgctttctttcctccctctggaatctcatggtataaataccttccaaggttctcatatcagctgaacaaatatttgaggtgggtgttcacactgtactctctttctaggcaacctgtttccagctctttcagcagtcatcatgccacagattggtagtgtctccctatcctggtttctgttctctgctttgctctccagtttgtcggtgtcaccattaatacctgcagcgttcaagttgaatactattctccagatgcattctgaacagggaggagtggaagtattacctttttttctgtgtaccagacttatattacttaaaataacaaattgaaacaaacaaacaacatcaacaacaaaaaatacaactaacttctctttagcttttctaatagcttcatcagactagaaactcatggtccacttggtttcagcattgctaggcatagttgacagtgattgagagtttcagaaagatgagctgaaattgtttacgtgcatgatgccaagaagtatactgtcccagtttactaattaaacaaacaaaaaacaccacacagtcgtgcaatggaggtagtagtgaggctatcttcttattgtttgtttaacttagactctgctgtagggaaaaactgctgagattctttcatgttgattccccaaatgattacagaatctcattttagttgcatagcttgctattattagggaagaaagtatctttctaaactctttatgaattcaagaatgttatagagaaagtatcaggggacattagtataggtataaactttaaagagatatgtaacttgagcctaat

SEQ ID NO: 128882 - DNA, 1066 bp, Homo sapiens
ttttcccccaggataaaaattaaaatggacacacacacagagattatacttttcatatatacgtgatgtgacagctacaaaagtaattacagcatagatttatgtattttctgtattcacattaaaagctattcagttgaattttaaaatgctgaaggatgtaatactttttcattttgaacttttaattgcatttagttaaacacaagaaaattctatgaaagtaattatacatttcagtttttctttgttactgaacaaaatgaaatctgtaagtctagaaatatgttatcaataaaacacaaattactaaaattacttaagcagttcagtcacaggacagactttttaaagtttatgtttagaagaaacttcatctaggttatatttttgttgtctcaacatttatttggaaaatatagtagaatgagaagctctctaattggtatagtatttttgtatatatatacaaatatatagtatagtatactactatcctaatagtatagtattatatttttgttgtctcaacatttatttggaaaatatagtagaatgagaagctctccttttaacagttttgatcacaaagtataaagtgtttgctgaaacacaattgattcccattagctgtctcactagtgtctggggcttagggttgttttacgttatcctaggatcctgggagttttccatacctgcagtctatgtttttgttggctgactttctacggaggggcagctatcgtgaattatttcagcatagtctgcttagggtttccttagtattgatgggttttgtttctttcttttttttttttttcctttacctacaacacctagactaccagtcttattgacagggtaataaaggtaaagctcatcaggagagctatttctccattttactatcaggacagataactttttatgaagaagggactgaataagaccaagcatggggtcacagttaaccaaaaatctgtggactgaatctagtctctggttaggagctgctagcccaccatttggttcttccatctccaaaaggctcagtttctctctt

SEQ ID NO: 128883 - DNA, 1054 bp, Homo sapiens
gcactcctgtgatcttccagccactcgagacactgaggcatgagaaccgcttgaacctgggaggcagaggttgcagtgaatcaagatcgtgccactgcactgcagcctgggctacaaagtgaaactgtgtctctaaaaattaaaaaaaaaaaattaaaaagtcatagtaaaataatctgcaattctatttgaattattagtttaaatatgtgtatttaaatgtgtagataaaaatttatacatgcatataaaagatattgcagaaaaaatgattaaaggggaaacttagtaactccttgttaaggatccatatcagtcacatctatctgctctagaaaactgagttttaagcagtagaaatctcctacatatgaacagttttagtgaaacaagtttttaatttttatcatgttgttattaacaatgtcccatgtctgtggattcggggtaatgtatacaagtagatggtccaaaacactttaagaataatggatttaatttaaagtctacagactaccatactgatgatacaaaacagtcattctcttagaatattcttttcaggctactgcctacatgattgaaaggcaggaatttcatagaaatttcagtgtttttcaagctgtgtagcatggatctctaaaagtttagtgctagtctatggtatgtgtatggtgggaggggcttttctcttgtatatgttaggctcccaaacataggtttttctttattttccttttttctagaaagggttccaaagctaaaacaaatacaatagtttgaaaaaccgtttgtatagagaggtcatggaagcataaatgccttactagagaagtcaggcatttatccttatccagaagttggataatatggtcatgaagacagattcaaatatgaacattataatttattactaattagaatttcaataatatggttataaaaacaagactcagagaggaaatgttctgtgcagaattttctctgacctcctccacttgctggtatattgcccaatactgtcctttgagcttttgttgatagagacatcctg

SEQ ID NO: 128884 - DNA, 1045 bp, Homo sapiens
gtatctcatgtggctgccgtggttcctttaataattattaacccctccctgcactgagttcctctgccttcccatatacaagtacttgagtagcattattttgttccactgcataggatcaagtaattatcttctgtcttacttgatcacacatttcaagcctcatttctgatagagcacaacccaatggggctactaaaaaggagcaaagggaatgaaaagagtgctttattcttctgaaaaataaaaaaggagatggaaggaaaagaaaagaaagacgtgttagataaaatgacagatttgggaagtatagagtaaataattttgtaattaattataggtttttataaacaaagttgttactatgctgtatctgggtcctggtatgtgtcatacagggatattctataattttcaaaaatgttttttttattttatgatactcacagactcattttttgctttattttctcccaatattcatttgaagttcagctgcatgagtgttgtctgaaatgaaatgtcagaggctacacttggatgctattaaatgtttgtgttgtttcacaattcatattcaaaacttagaagatattcctgtagagttgcataaaaattgacacatttgcagaccatattttgacaaagccgtaccttatgtactccatgattgccagaattgcagttaaacttggtttggtttatatattggaaaaaattttaaaaatcatagttccttattatagaatcatatagatctgtttgattttccttattttcttctgctttaatctttctctattttacaaataacttcaaatatttttcaaattgtttagaattctctgaagtgaataaaaggtgtattgtgcaaattatgtgttcttaaaagatgtttagatatttcttaagagattaacactaatttctacttatatatttaaataaattttatttaaatatctttgtcttttattctaaacgtactttaattggctcagattaagtatttaaattttataagcatgtttagattgtactaact

SEQ ID NO: 128885 - DNA, 1509 bp, Homo sapiens
ccttgcaaagttgtcttgtgttgtcaagactcaaaaagaacatgccacgtgttagcagaaaggtacagatgtaaacaaaagcttcataaatgttatttaaattgatttaccatcttacaaaattaaattttgtttcataaattaaagctttgcttagggaagtttaaaaaaataacatagttatcttttacttttatatgtacaagtatctctgctgatgtttcatcagaaattttatgattcatgatttgtgtatactctttttggttgttcaatatgatgaaattgtaaattaacaaaagaccaagtgattaaattatacggttagagaaaaaatatttttaggacattcaaatgacccacttcacgcatttgtttcagtccattcccttgtatttcccctacattaccattttaaatgctgatttaactgctgttctagccagcaatgaaaggaatgtctatgtaaatttaaaccacaaattaaagctttcagcatcttctctcaccctgaccctgttcccaacctaagcctcatctggttaaaggcactagtttagaaaaattgccctgatgtaaaaattacaattagttgaatacaattatgacattttaatgttatatttacatgtgctaatttagaatggaataacaaacatattgtattttccttatgttctatgttcagcacataataattttctttctttttcagctttttaattaaatgaagccaagtgggatttgcataaagtgaatgtttaccatgaagataaactgttcctgactttatactattttgaattcattcatttcattgtgatcagctagcttattcttgtgtactttttttaaactgtgggttttcctagtaaatttaatttacagaaatcaatggtagcatttagtaatctacaaaggaaatatcaaagtgtttttcaagcctgttatattcagtgtgtgccacaggattgaaataaatgacaatgtaattatgaattcatgttttagagctgtttactcattagtaaaggaccgcaatgttagtaaagaaaacctatgaaatgtatgttaaagattcttagtattgtacagggataaagcaaatgcatgaaaatatgtcatgtactgaaaattaaacttacttcagtttcagttataaaggacgtgcactgttacgaatagtgttttgttattaattataactagataaaggtatataggacagggaactggatgaatggtacctacaatttggatgcctaaccaaggactagagctccttcttgagatctaaatctaaagtaaatgtgcattaaagcagtgtgcttcaaaggcatcagacgatgaaagcaacataccacaactaggagttatttctcaaacttaaatgtcctctgggaatccagacttaaaaataagagcaaacttaacacactatccattttcgagcaaacctaacccactatatccattttgctcatgtgttttatgcaaccagctttccat

SEQ ID NO: 128886 - DNA, 1035 bp, Homo sapiens
cgtgattttttttgtcgcatcagtatatttaatagtcatgtaaatgactaggaaaattaaggagattttccttgcaaggctcgaagaatgtgaacggcgtagatgaaaataatttagaaaacagagagctatgctgtttctaatgcaatttttataggctttgttcttaatacgcagtggtgatctgatgtaagtgcatcatttcctttggtggaggttgtcaatgcaattaggttacggaatctgctttatggactatctagcagcagatcacaagcacataacataaagtccttttacacatgaatattcaaaatactaggaaataccctcaaatctccaccccctcccccttcacaaatacacatccacttttgtggcttggcaaggagcatagcgtttttcatgatggcagaacttttaattaaccatagttggtctaggaacagatcagcaaggtagggaattcaagtagtattttcttttctttcttaaaattaattttacttttacagttgagagatgttatcttgcagtttttaaaaagaccacgttcagaaagctagaactttggctccacgacttgctacttgtgtcattatggagaaattacttgacctgtcaatgcctgtttcctcacctgtgaaatgaggctaatagtctcctggggtgttatgagagttaaatgagttaacacagtatatttaaaacaatggtactactaaagaacattaaataaatttattttttggctgagcgtggtggctcacgcctgtaatcccagcactttgggaggtcgaggcaagcagatcacctgaggtcaggagttcgagacaagcctggccaacatggcgaaacctcgtctctactaaaaatacaaaaatcagccgggtgtggtgttgggcgcttgtaatcccagctactggcaaggctgaggtaggagaatcacttgaacctgggagacagaggttgcagtgagccgaaatcacacctctgcaccccagcctgggtgacaagagcgaaactccatctcaa

SEQ ID NO: 128887 - DNA, 1121 bp, Homo sapiens
taaagtatttttaaattaagttatgtactgttgtagacataatgctgttgcacacttaataggctaattgtagcataaacataacttttatatgcactgggaaaccagaatatttatgtggctcgctttattgcaatatttgttttattgtggtggtgtggaactgaaccttcagtgtatccgaagtatgcctgtaaatggagaaaagtcccagttttttatagtgagggaagttacatagacatgaaattgaagataagctaattctatgtggaatagcattgttgtatgagaagctaaatagctgatcccctctcttagtttcttcaagtgcacgagagtctggatgccttataatggcctgaccatctaatagagtcacatacaatgatttgagtagagattacttttcagttttagtaaatatttgggtttaatgtgacttcttaattgattctcacatataatgctatatataggattatacatacataatttggggctggactattttataagtgctaagtaatatgtagctgtcctcttacagattgaatatgtaatttatctctagtaatttttgagaaatgaatgctattttctacccaaagattaaaggaaacatttgggatcattaaacaatgatattaaccctataaaataattttatatatttatggctcagtgtaatattttgatatgtgtatatattgttgagtgattaaatcaagctcatgaaggtatccatcatcttgcattctttttttttttttttttttttttttttttgagatggagtttcgctcttgttgcccaggctgaagtagaatggcacgatctcagctcactgcaacctccacctcccatgttcaagtgattctcttgccttagcctcctgagtagctgggattacaagcatgcgccagcacgcctggctaatttttgtatttttagtagagacggggtttctccatgttggtcaggctggtctcgaactcccgatctcaggtgatccgcccacctcggcctcccgaagtgttgggattataggcatgagccactgtgcctggccccattatcatatttttaaccttaaatttttaaagcttctttgaggaaga

SEQ ID NO: 128888 - DNA, 1097 bp, Homo sapiens
tgggtctctgaatgactatataaagcagagctccttgatcccactcccagcccctgtcctagtacgttctcttggggctcttatgtgagaaagaaagacacacacttgtgttgtgttggagccattacatttgaggaagttagcctaccctgtctaatacagtagagaagggattaattggtgaaggtcttgatcattgagaagggagatgatcgtttttggataaaggtgaattaactgtcagctagacatgtctcttaagtcctcccagtatgaaagttcacctaactgcctgcctgtacgttcaacctcaccacacacactaagacccacagaatataaggagctttagattaatagctaattggctgcttgacattattaatgtaactgattgatccctgtgatttagccccagtcttctatccgaatcccctgtttcagattcctatcttagaaggtcacttaaaggatcccagtgaccttatgtcaattccccagggactacatttcttcttcctgaatggaggctcctcttatctacttactcttctttgaatagtgggcttcagtcaatttgcctgctgcttgaacctctttgtaatctcctctattcctggctgaggttcatagtctgggtcttgaagttggttaaggattgtgccaaatgaatcatatgctgcatctcccatacctttcctgtctggcttcttgttccctccatttgctgcctgctcctgcagtcctccgtgtagtgctctcctgcagtcttactcatttgaacctcttccaagtgatatttatgtttttctttttcttgcaagaacttatggctcaaggaattcatgattgaatggaagagacaaatacgtaaacagataattgcaacctggtgtgactggaggaaaggagtacaagtgatgtaatagggatatataaaggaaatcactaggatttatccagatactgtgttggctcacagggaagctgtgtggtcagagtctaaggtatgctatcacaagggatgtgattaattaggaatcgatgtggagcagtcagtagcttatacagtagagagggtgtggcagcagaagttt

SEQ ID NO: 128889 - DNA, 1060 bp, Homo sapiens
agcctataagagtacatagtaggcattcagcaagcgctggtgttccttctaaaagtaccactggctccataatttaatgttctttaagactgaagcttaagaaataaaccaaaaaaaaatcacaaatcacttctccaaagtgccagtttaaaatccttaagctcttaatgatattttttgtagaatctttcgaatattaatttattttatttatgtgaataatttatttataaagtgattaacgtttttcagaagacgatattttcacacttcctcatttactctgtttattcactttcaacataattaaaagtatcttctagagggaggtattacttcacatcatccaaatgtatttgctttcttaactttaggttgctattggcagaacagacattgaagacttagacctttatgccacatctcgggagaggcgatttcgtttatttgcttctatagaatgtgaagggcagttattcatgactccgtatgattttattttggctgttacaacagatgagcccaaaggtaagtacacttttgaaattatcttaataattgtataatttttttatctctagcttgtgaatggatggagcagtataagttttttagaagaactgagtaatgtggtatttcacatgatattgtgctattcagtgttacagactgatatttcttacaaactcttactcacatctcttctcttttcagaaactttcaattgctccatctttctcagcttaacaccatcttacttttgatactctttataaaagactcatattctgcctcttcattcttatatcaaacctgaacagagtagttcagaggactggctttgaggttagccctgggcaagaattctacctgtatctcttctgcgtttgtcatagctcctgcagtgtaaatatattaatagtttcattgtctctcaccttttcatatgttagaataatggttctcaaaatttttggaagtatgtacattcttgcaaatctcttaatatctaacttaacagaagacagctgtattctcatgtgtgcttttttatttgatc

SEQ ID NO: 128890 - DNA, 1023 bp, Homo sapiens
tgcatttaaaacatagtatgtgacacttggctacctggctgtattttttttcctcccggcaaacagatcaaactactatcaaatcctcaaagaagttggttttattgtagacaacttctcaggtattccagctatggagaattcttgggatttctcaacaaagtaaactgagaagtagtagtagagatctaccaaacaatgacaaggaggttatatgctggaaatgattaggaaaatctaaactatattacttaaatgtgaatagaatatttagtcgattactaaagaatgtcaacaattttagataatttaaagtacagatgaccctacatgctggagtttttaagacatgtgaataattagtcactttagaaacagattttaatgcattaaaaggggacatgtgcaggggaaatcaggtgtggtctttgttactccattttaatcattaaaagagaagaagatgtggtccatggagaaaggaaataaagatttaacaaatgttatgaaggacaaaattgccatctttatgaaagattaggaagagggctatgaggaattaaaggaatatgaaaatttagtatatgggtgaatgagacttttggtcagcaaccacagaagactgatcctttgtagagaagtatttgttttctgtcttatgttttctatggagtactataagagttctggacaaaaagctaaaaacgatgtgcctatctacagctatttttcttgaataaaaaataggattatttaaactcttttttcacatttcctaggatgatgtgtaggagagttatagtcctttgaattttatgctttttgtacctgagtttatgaaatgagttaatggccaactggagaaggaaggaaggaaggaaggaagggaaggagagaaaaggaagatctataaagctatattaaaggaaggtggatgattttcataggccattatactttataaggactataaccaagcagttttaagaaaatacttagaacttagtttattgagtgggaaag

SEQ ID NO: 128891 - DNA, 1063 bp, Homo sapiens
caggaagttactgaatttttttaaaaattccagatatcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatggcgccactgcactccagcctgggcgacagagcgagactccgtctcaaaaaaaaaaaaaaaaaaaaaaaaaaaaaattccagatatctggattgattgttatctcttgtatattcagaagaaagtatgttgccaattccttgtctcaataagctgcagtgatagtaacaagtagtttaagtatcattgctattctgcaaggtacttttgttatccccatgttatagatgaggaaactaaacccctgaaaggctaggttatttgccctgggtgctacagtcattaagtagtaaagcgatcgtgtgttcttttcattctcatttacagggaggaactttattaatctttgcatcatcatacaattatttccatataaccttttctaggacagtgagtatttgctcatctcctgttacgattactctttctttatctttttccttctttattacatttttgtcatagattcatggataatctccaaacagaagttctagaaatagaattcctttcctactcaaatggaatgaataccatcagtgaagaagattttgctcatattcttttacgatatacaaatgtggaaaatacatcagtatttttagaaaatgtgcgttacagtatacctgaagaaaaggtatctaatcctcatatttagttggttatgttactgttttgcaatacgtgcctctaaaacacattgcccttttgttagttctttggcttctctgtggattaaaagatatcttggatgtgtttcattctgtgtcctaaatgctctggctacactt

SEQ ID NO: 128892 - DNA, 1051 bp, Homo sapiens
gattctcattgattttttttttctacattacctcatcaatcctcagagcaaccttccaggcttgactttcttcagcatattttagaatagtggaagctgaggctttcagatacttagaccgttgtccaaggattcaaatccaaggctttctaagacaatgatattcttaccacactctacttatgtctttcccctccttccgcctacttaactcttccccttccttccatctctcatctccttctctccagaagaataacagctactaatatttgaatagccctttacatttctaaattgctttcattttcatttgtttacctagcagatatttattgagcatctactatttacttggctttattccaaccactggggttaaagtggcaacataagcaaaatccttctctcatggaaatgtatgttagtggagagacaaacaagtaaaaaaagacatactttcagatactgataaatgttatgaaagggagcaagagtcatggggactggaaaagaaggtagactgttaggaagagctttgctgaagagtgaagaggtaacttctggggagagactgtgaagaatgagctatgcgaagttctgggtaaagtcttctagacagaggtaacagcaaatgccaagggcctgaggacagagaagcttagtttatttgagaaaatgccaaaaggtaaagtaagtggacaggaaaattgtaggcgatgagtaaggagaggtagatatgggtcaaatcttttaagactctgtaggctaaggtaagaagtttagttattcaaagagtgactgtaagagtgatgggaagccactatagtatttaaactttaaagcaggagtcagcaaactactgcacctatttttgtaagtaaaattgtattggaacacagccattctcattcatttaatatactgtctgcagctgtttttacactataatggtaaagttgaggcaacagagaccatgtagccagtaaaaatgaaaatattgactctctggccctttacagaaaaagtttgtgaaccttgctttagcata

SEQ ID NO: 128893 - DNA, 1084 bp, Homo sapiens
ccccctagaggggcggaaggtccccgggaccgctgtggagaggggaggccgaggccggcgaggcgcgccgggggctgaagggctgagctgggcccggccccgagctgcgccagacccgcgcgggggtgctggccttggcggcggagctggatcccttgctggttggcgtcaatgcacttgttaaaaatttgtgacagcgctcaggggcgtttttgctgcctttatgatttgaggattgccagttggacacttttctagtttaaaaggatgtggaggaggtgagctactagaaagtatttttgaggacatgtgcaacacactaaaccataatttaggtgtttgaacagtagggagagaaaaaaagaggtgatcgtctgaggtttttacatccagagagcgaagtggctccagtccgagttcgaggttcctgaattggtgggtaggatacttttaatgctgaagattaaaattttttaaaaagttgattattatgcacaagtagggagtacaatgatgtcgcttaatgtaagctggtttctaccttcaggggttttatgaaaactgatctgggttatcagaaaaagatgttaaaacagaaaatgacctttctgccagtgacttgtgaatgctttctgtgtttggtgctccacctaacaaagtgtctgtttttgccctaccaagtgctagctttgggtgggacgagggaaaagatgaaatagtggcctattatattgagccttcacaagctcagcattttcaaagcctcaagattcagacataaaatcttgtctgaagccatcttacctcaaaatgttgcgccttgtgagaaagtgtcataataatacatcaaaataatcactgatgtaagttgtaagagaaccgagacttttatttcatatagttttaaaatttgctgttattacttgaagggatttagaaacaagcttaatagtccaaaaaaaaaaccttgagtctgttgttgggaaaagatgaggctgtacaggcattatcatgaggatgcatttaggtatgcagtcgtcaagtcatctaaaatatataggaaaggacgtgtagtaaattttgt

SEQ ID NO: 128894 - DNA, 1053 bp, Homo sapiens
agtattaatcacatctcagactgccctgccctttgaagattctttttctcttggaagttgccatttacaagcagattttccaaatttcttccataaaacattggccaaggttgggaccagagtgtgggggtcgagggctgggaactggatcaggtagcaaatggaatagaagaaacaaggtgatttaccctggtcctccttccacatctgctctcagctagggatgaccctgaatataaattattctgtgccctttgctgaatgaactgcaatttaggagtagtgcttatcctggtatccttggaaactggagataatgattctcattacagttagtttctatatttaacaacgtggatgtatgtggctctctaggcactttttcagttagcataatttttgcttagtgtttgtattttataaaaataacctctctttttggaatatgtgtatatgtaaaatatatgggatgtacatatattgtgtgagagtcaagtatttttggttaagtcagcttcctattctgccaaagaaaagatcacaaaagacagttatacttctaatcatttggaccacgtttatctcgtttgttgattaacgaggctcttctatttgtattcctccccctccatcctttccttctcttaccactccttttccctctcccctgtccctcctgtccctctctccactcctggcttcttttgtgttttaactctctttgctctctttagatattaggttggtttccgtcaagtaagataaactcaaaggtaacatttgtacggggaactttaggatgcactatgagagggaatgagggaggtctgcagcctcaggcatgctccattcagcgagcacacgacgtggtttatgttttacagatcccttatggctgctgctgtgttaacttcgcttgttgaagaaggttcactgaagtttccccttttaagtgctaacatttaaattgttttaactatttcataccgttttctttatttcagatttactgaaaagtttcaatagtacaagaaacttccacatacacttgtg

SEQ ID NO: 128895 - DNA, 1090 bp, Homo sapiens
agctgctgcctggcagccggtcaccacagaacactggaaccaccactgctcccccagcctggtaacagcgggtccagtgttccagcctgggcagtgtccagctggcagggctgaggtggttgcgcccacatctcaggctgcatggtccagcgagctcaggtgtttgatcttttttcgttaccatggtgagaagtgtgctagcggggaaaaaagacaaatgtatcccatagatgagtatatatgggggcgaggggttctccatgaaatggtcctcattgatttttttgtttcatttgtttttatgttttatcttgatggagaatttgtgattttccttctcagaaaaatagagctatacttacatttcataatttatactgctgatttatgccactgcgttttgacagttgtatcatatcacccagccttctcttctccaggaagtggtgtattcatgggtcccctgagattccagcactgcttatgatgagtgtagaaattctgtcttgtctgtcttgcagaatgacagattagaatatggcatagattcttaatgctgtctgttgggaaaacaatattctaaagatgattagaaagacagttttaatattatgtggaattctgttattacatattaccatttagaaatactacagagaatttataatgaaagcataaaataattgaatgaggtttttaatagtccattagaaaattgttgaaaattttttcctaattcctttaagggaattttattataattgtcttgattgttgtttcaatcaaatggcagtagtgaaaagggcgaaattatcaaggcagggggtaggaggaggaggcgctgggtaggatgctctgatttcttaagaagaataggatagctgtaaagaaaccagacatgattgcttgagaattttcctttcaaaatgataatatcacactttatatcatttatgtagcatttttcctaatttgactttttatctggccatgacttttaaattcagttataaatattaattgcctgaagtgttataaaatccatttttatttgagagatactcacaagcaaaattatatgctgcatttc

SEQ ID NO: 128896 - DNA, 1087 bp, Homo sapiens
ctagagcagatttttttttattttttattgtggtaaaatattgataacataaaaattttccattttaaccatttttaagtatacagattagtgtcattaagtacattcaaaatgctgtgcgatcatcactactgtccattttccaactttgtcatcttcccaaactgcttcgctgtgcagtttaacactaaccctcattcttccctcccccaccctctggcagccaccattctactttctgcctccgtgagtccaactgtccaggtagctcctatgagtggaatcatacaatatttgtccttttgaatctagtttatttcacttatgtaatatcttcagagttcacctgtgttgtagcatgtgtcagaatttcattttttcaaagttcacctgtgttgtagtatgtgtcagaatttcattttttcaaaggctgaataatatttcgtggcatgtatatatcagatattgtttatccattaatgggggtttgagttgtttctacctttttggctattctgaataatgctgctgtgaacagtatacagaaatacctgtttgagtccctgctttaaattcttttggtagatacctaagagtggaattggtcagtcatatggtaattctgtgtttaattttttgaggacaccatacggtttttctggagcaggtgatttttgatgcaggtgtcacccagagaagcctgtatatgcccttgtaaacatgtccaaatttgaaggtctctagaggtatccatgagatgtatcagtgtcactgcagcaattttttttttttttttttttaccatcttgccatttcatggttcagcagaaaagctgatgggcaggggattgtgaagaatcccatgttgcccatatggtggccttcattactgggtagtgtgttccttatgagagtgctggtcatcgggcatgcccagggcagaaaactcgagggcctctagcttactgcatataggcaggaattcaacaacagtttttgagtagccagagtccagagcacagaaatgacagatggaaattaaatcttgaaagaacatattagcagatggaaatggtacgcaaactga

SEQ ID NO: 128897 - DNA, 2038 bp, Homo sapiens
agtttggtgatgaatttatcctccatatttgatgaacagaccttaataatgcgccaaattctattctaggtgcttttaccttctagtttaattctcaaaagagctcggtgagataaacattgagataatgttcagagaatctaaataacttgttcaacgtaaaacatcacacaggattcaaacctcagtgagggtcatggaaaagacacaagtaaatgaaaatacaggttgtgtgagatgctaagagacgaataatgtattgccatagtgtctgactagacaggaaaagctggtatttaaactgcaccctgaaggaagagaaagaaggagccaagcgtggagtcaggtgtggagcttttcagactgggcaaagacgctaaggtttggtgtgtttttgaaacaggagctcagtgtggctgcagcttagtgagcaaagggactagtgaccagaagtggtcttggaggacagagaggaagagccagatcatgcttgaccactgaggctgaagtgaggagattggactttattttactgtaaattgagtgcagagccttgggagggttcttagtgagatgatatcactgaattgcattttaaatgagatcatggttttcttattgcaaaatgaattttcagggaattgtgtggggatccattgaggtagtcgattgccttgccccgtgtttgtggttagtagactgttaggaatatcaggactggcttgtatgttaactgagaaagtacaaactgaaaaccctgtgtttggaattcaagttttgcaccatcgaagacttattgctaacctttgcttctattttgaagctacttatctgtccttgacaaagcagttcctgcttatttactgatcagtttgttgttagaatgacttttgccttaggtcttcaaaagtcaagattttttcaccgagaatacatcacggtaggatttaagataattttatagccagagaaaccttcaagataaagtgcaaattttagtttaaacagtaaaattaaagcgccgctcagctgagtgccgtgatcaagatcacacatattgggaggattgggctggagtccaggtctcctaccacccagttcactgccagtgcagaggatcaagggagggtacaatgttagcttggttaagacacaagaaagcccagagtgacagaagcatcatgcacaagaggaaagacgtgtgaggtgagtttggagagaaaggcaggcgttttgagttatcaataaaatcacaatgacatataaggacaacaaagaaaaaaaaagaaacagtttgacttaaagtataataaaaaatataatatgtaaaaatatataagtagataggttataaagaaaataaattcaaaaatgtattaggaagaaaagggtaccattgcaattaaactgaaaatgttaacgtgaataacatatttttcttgcatgtcattaaataaggtctggaaggggtgtcacttttgacctctaatacactaaaaatgaaccagagatttttggaaagtagctaaaaggacaaaggatttggcttcaaggggttcccctggccaattttgtcaaagaattctctatgaatttgacagactttttccaaaagaagagcataattaattctgttagagtaatttgagtacagaaaattagcttagggagggtgttggtgaccttgacacgggtgattgcagtggaatgctggggaattagaccaattggagttggatgaggaggtaaaaggaggttgggggtagagagagtgattttggatgattgttaaattttcctgtgaaaaggccagaaagtgggatggcagctagagacatgaagtcaggggacagactttgttgggacaggagatgttaaagcatattgtaaagatattaaagcataaagtatttttgtcataatcttttgaatgtgagctacttctgtgaattaactgaaaatgttttcataactacatccttgttttttcagttagtttttacttctaactaaaatgatatcataaatgctaagcttc

SEQ ID NO: 128898 - DNA, 1037 bp, Homo sapiens
ataatttaatatgattaaaatttcatggggtattaggttttgtgttctgctttgttttttagatgtattttgaagatggatcatcattgtccatggtgagttggctgtatatttaaacaagtttgtgtcccttgtaaatgttaataaattaaatcacttatccatgtaaatcttttcacacatgaaatattacttgagttgacatagcaggaacttttggatttagtttctaatatttgtttaacttaaaagagcctttatttaggggagtttccatgaaatacttttaaaaccagtaggttaacaacctaaaagttaatatcgcatgttagctcagaacaaaggattttgtttgtatgcatgtgcatgaacagagattccagaatacttcacagaaatacacacaaagatgtacaagtaaattatacatagtacctcactggaaggtttttataaagaattaagtcatcaaaagctttttaacaatttattttacacagaatttgacattaaggagtagaatacaactacacagatatacaaatgcacacataaatttaaacaagattttccacatagaattcattaatatttgctaatatttctcagtcacgaaatcaggtaatttaacagaggattatttgaaagatctgattagtaaggttaattttccttccttttcctataatttttcatctcagtgtaggcatatctctgacagtcatgcccaggttgctggccaggttggatttgggcgtgagtaatgcttattcttcaagctttctttcagggatggctctacagaaaggtagacatgcccacaggtccacagtaggtatagggtgaaatatatgtagggaatggttttcttagcagcaggaaagattcccaggggaatgtaggattatggtatcctgtatctttcaccagtatacctctttcttttctccacctcgattttctcctttaaagcgttcaggctagtcaacccatacaagaatggcactcttcttaaaggtctcaataaataacgcccc

SEQ ID NO: 128899 - DNA, 1072 bp, Homo sapiens
aatgaggttggtagaggaagaatttggaaacgttgatgtaagctgatgtgagcagtgtgggtcaatatatctttcattattatgtttctctacttcctcagatgtctatttctgtttttagtgttttgtgtgtgtgggagagagatagtggttgtaactgacactgtataacgggtgtgtgtgtgtttctatatcaccatcttatatatacccttattatgtacaaggcacctttggaagtctaccaagggattccttattcatagatgaataagaagtttctgcctatttgttcaaaagcaaccaaaaatgctaacttatgtgctttcattaaggtatgagcaatcctgcattaaccatggaaaatgagacttaactcttcaagcaagataaattcatactttataaaagtacgataattttccctttattgttttatatttttaacagtcttctaattttattagggcaaatagtttccataaacatttttaataatttgtgagtgattcatatagaagatcttttacctgacttgtgagattgcattagccatgctggggcttctgagtgcagacctagcttcagtattagctggtatttgtgttaacttgattaattatataaataagttgatgaacaagagtcattttatattaatgcattaagtggtagggatcaatcctaaaatactgaactatatgtaaaaattatcttgtcattttataggaagttagaataattatttttaatttttcttcatctttcagaatatacagtggtcatatccttgaccatccattaggaaactctaagtcgaagtgcaatataattatatctcattaatgtactcattagcacactgtcattcccatttttgggtcatagtagggccttatagcatgtgttaaccttaaaataataggtgttccaaatcattttctttaagccttatttttttttaaacctgcagttccaaatcagtttctttaaaatatgatctgtttgtaagcctgcagtcaataaaaagctacaataaggaacccctttggaacaaacaactatataataa

SEQ ID NO: 128900 - DNA, 1108 bp, Homo sapiens
cagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcattttagagcacgttttggtcatttttaaaaatacctaaagtgccagaccggaacctatagctactgctagaagtcttaaaaaaaccaacagcagcacaggatgtattaagaattatatgaagtcaggtttgtttttttttttttttttttttcaaagcacagtactgttagctgtttttgtggacaggattcgattaagtattccctcttgtcaaactggaagctaggggaaaaagagggatttttatcctttactcttctagagtactgttaatgccccttt

SEQ ID NO: 128901 - DNA, 2256 bp, Homo sapiens
atggaatagttatttttccatgatgaaaaattcttataaaaatggtctaaatggaaaagacatgcatttatacactttttttgtagtctctttctttggtttctgagctctgtacttttgaggacattagtcttactcattgaactgaaatgcgtagcctcaaaggaacaccatagaaaagagccatcattattgtcagtgaacagtcagtacttacattgctgaaatataaattacaagtggttccttttggttaaaattatcttttttttttcttcaaaattcctttttagatgttctttgaagatcatattgatgatgccaaatattgtggtcatttgtatggccttggttctggttcatcctatgtacagaatggcacagggaatgcatatgaagaggaagccaacaagcagtcatgacatgaaatagtccttttatttttatttcgagctacacacatgcttgtatataggttttatctctggttgaatccctcgaacaatagacagtacctttcccccccctttcatggcccattttattgtctgcctttcagtactaagtatgaccgttcctatctcagatcttaataaaaagaaaaaaaaaaacgcattcaggttaaatttggccttaatttaatatacttgttagcaagcgtgtgtgacagagagtggggaaagctacatcattgaatattttgataaactttaccgacttgagtttggtttatttttcccttttcctaaattaactagcactgactgtaatttatttccctgtttcacgtctctcccttccattctgcaggagttttagctatttgagatcgtggaccatcagttttgcactttagagagtgtttctgactctaaacctgttttatcagaaaatttgttttttcttgatcttagctggaaaaatctgccaactttacacagtatttacttggttttgacccacagaatatagcacgttgtgcaaactgtcgattcagcgaaacttaaaaaagacaagaaactactgaggagcttagtaactgctgtttctgtacgtagtgtttaatcttccaagcacatctagtgtctgtcagtttctaattggcatgtgtaggctgctctgtgactgaagaattttcaaaccagctttacacccttcaggaaaaatcccttgtgattggatgtttactatctgccaggaaactggtactcaagatgttgaagctacagttattttatgatagcacacttcccttgatctgcttatttttattccatcaccatttaccctttttttttttttaaattttgtagccattcttatgatgctcttgatttgttggttacacaaatcaattttattaaaaatccaaagataagtctttaggtatattttgtaccaaattaaattagaagacaaaaattgtgctttcatagttgctacaaaggtaaataatggagagatttggtacaaaacaacaaaatatatatatattctcatatatatatatatagctgataaaattacctgaggagtgtaatgcttatttttttgtgtatatctttgcaatctattttatatatattgacaaaagagactgtgaaatacttagccatgcagaatatgtgaccagaccagagcatgtgtaggaagactttacggtaatcattaactctaccccgaaatgatggactacaagttataatgtgtgttacctacacttcaatcagtaatattagcaaatctccaaatgttagtcacattggtttgtctcccttgtacattctttattcatgatattacagtgctgtaactgggtggtcctttttaaacaaaacattatttgcaaaacagagggtattatttgtttttaaagcttttgtaaataaaggcttcaaaatgttttcttataaatgttgatgactggtgattttcttttggaaatacttatttgggggatattgttcatttttatttgggcaactcaacagaattcagtaacttccttcattaaccctagatgattattagtccattaattgaaaaatcagtctgagttttctgcatttcaagtgttggcttattcttgttctttatgagtacctcaactagctaattaaggactgacttctgtttctcctttccaggaatgcatttattccgaaggatatacttcacaaagtaaatacatttggtataactgtggctttttaaaaaatctaacacaatgtagtaagtttctaactggcttctttt

SEQ ID NO: 128902 - DNA, 1030 bp, Homo sapiens
tcaagaaagattattttatgtttgtagcagtagacttctgtgtaatttgaggggacttccaggaagtgaacttgcagtagggtatcccttgcttgagaaattcagcccaccctgtgaaagcactgcatgctgaggcctacatgttttcatctgactttttttttaattgacatgtctgtataatgatagttttcaggaacagggaaccaaattattgctcatcatgtggttgttactgggaagtttctaagtacagatattctgaatgtgtcctgagtaagctgctgtgttaaaattcaggttaacgacaaaggtgctttttgacctatagtcagccatgctgttctattcagttctagttctgttctcctaagcagctgctaacgatacctaatcctcgtgctatttttagcgcagaagcaactgctgtgcaaagccttgtttcaagctgtgatgcacagaagggccattttgccggtggaggccttaacaagttagagaagaatttttgttttgttgttggtgtttctttccttcacgctctacttattctcccctccctttactctccttgcctgtcctcccactttctttccttctgttactgtctttctctttctttctttccactctttccactctcatctttcttttttaatcttaggagtattaacataggtggattatagcagaccactctaaggagttgtgtgcatatactcgtcttaactaagaaaaccatagtgaagcatttagcatactcttaatgattattcataatggctttgttttgtaaaaattaagtgaaaactacaaatggatggtgggaagtttaagaaaatatgaaaaaaatggtgttatactagcttttcagttttataattattactggattgatagactatgagtgtacttgataaatattaccctatatgtggtctgcttccttcccatatctaggagagtatttacctgtcatatgccctaaaacatgatgaaaatacattttcccaattaggatcttgttttc

SEQ ID NO: 128903 - DNA, 1299 bp, Homo sapiens
aggctcatttgtgaaaggaggcatctccttctttaagatgaagtgtagtttaactcatccgcatgagacattttccactgggtctccttactggtgctgctgagagcacgggagatgggcatatgccccacagctatggctgcagctccatctgggagcattacagtggctgctgagactgagagtctctgaaaaaacttgtctgtcactttgcgacggtagcccctggtgaataggagacccttttccaaacccagttaaatgtatttaagtatgaaaggctaatagagttaatagaaaaaagattaaaattgcacctttggactctctgaatgattttttattcgaaacacttttctgaaataatgacctttgtatttaaattgcatttttcttgcatatatataaagcattgaaacaggtggactcaagccattcctctgtctcttttctggcactgtagttatagatgtaagcagaagaacagcttgtttgaagtaatggcatgtttgaatgttgtctttctctttcttctgccagggaggacatgtatgcccaggactctatagagctactaacaacatctggtatccagtttaaaaaacatgaggaggaaggaattgaaacccagtactttgcagaacttcttatgacttctggagtggtcctctgtgaaggggtcaaatggttgtcatttcataggtaaaacgactacattgaaaatggcatttgtttttccatctcatacttgctccacacttacttgggtcactatgttagcaatttcaggtttaattctggaaagagttgactgccatatagagttgtctcctaactcttaggaggctaatgttggtctgcttaaaggttaatttaaaatatgggatccatttttgcctgtgagaagcatgttgcatagtggaaacagtacaggttctctaaaaagtgaaagaccctggtttaaatccagcggcgccatttggaattggtgttacccagggttttcttttactatttctacaccttagtttttaatgttctacgggggaaaccattcacttacatttacacaacgttattgagtatttaccatatggcaggcactgagatgagattctaggaactaaggtgtgaataaaacagatgaaaattattttcctcatggagtttatattctcatgggggtgggcagacagtttttaaaaatggagttcacgttgtgatttgttagatagtgataagtactatctcaaaacagcaaagaaaatgctagggatgggtgtggagatggattttaat

SEQ ID NO: 128904 - DNA, 1010 bp, Homo sapiens
gaatggcatggaatagcgtctaaggcattggtagcaattagctttggcgatgaggcaagctgtctttgtagtctaagtaagaaagatcttcacatacgtagatgtaaagaaagacaggaatattaatctgatgtttctttgtaaagcaggtatggggtgaagccatatgctgcaagtagacaggtgaagggtgttattggaaacttaagagaaaaaggtctaaactacttgtatacctataccttggcaaatggccaagaatgatgtgcacctggagaagaatctgttttttatccctttcattgcttatagttgctaaggcatgcctcagtgtgagcactgggacctgatgaatgagattctaattttttgaggtacatatttttagcataggaaagctgtggtttcactggaaaaaaaaaaaaaaaaagaaactacttcattgggtttattctgttacccttcctaaaggattttccaggggagactgacttttacgtgattgttgtggtttccttctcttttaaaatatttccattgttttgtaatttttcagacatttagaaataaattgatttctaaaggactaaccataacgatactttttggcccaagtgaagtgaaccccatggtttagatttgtcaagtgtttaataggaattccttttgccaagaggtagaaaccagtattcttacaatttaaaaagtaaataaaaaaacactttttcacgtattctcaaaaatgtatctgtattttggtaacttttttgttttaatatttcagatacagatatattttggaaacttttaatatttcagatacacatatttgtggttggaaatatatttgaggttggagatggctttctttttggcttaagtgaaatcttgaagaattggtttatatttagatttcctggcttgattttataaggcagtcttttaggaataggattgttggcagaagaaattattgctattacagtacagtcctttatacagtgttgctt

SEQ ID NO: 128905 - DNA, 1022 bp, Homo sapiens
ggaaagtacagggcgttttcccctcttttgaaccagttcttcaagaaacttggttttagcattggaatactgtgagcatcatttcatgtatcctttgggagacaggaatttatgattttcccccctttcttggttatagagtaagtatttggttaaatttatcacatgtatctcgtatagtaactttttggatatatttaaggaaaggttattaagtttatagagttttatggttctaaaaagtgatgttctttctagttaaaatatactttgtaattgaatataaatgtgtagaatatcatctgtaggattctttgatttgcatcaaaaattaaaaatgtgtggattgtagttttgactgtttagtacataatgaatcttaaaactattttacaggacaccgagtttccaggtgtggttgcaagacccattggagaattcaggagcaatgctgactatcaataccaactattgcggtgtaatgtagacttgttaaagataattcagctaggactgacatttatgaatgagcaaggagaataccctccaggaacttcaacttggcagtttaattttaaatttaatttgacgtaagtgggaaataactgtataacccagacttttttttttttttctttaatcttaggaattgattttcctcaagtatggtgacatgctaggtgaatttggtgtagttatcctggaaatatataaaacgtaacatttcaaaagcgtggttttcttttttactatgggaccaaaaaaaatactttgatgttaaagatgttatatttaaaatatgactgcagctttttttgtatttggaagactgggtattgaaagtacttctgatagaaaaaataatcctacattagttttactttcaaaaattttgtgtgcaatttgaaatatagccttttataatatttatccttcttgtgaagatttttgttgcattcatattccagtttatgagtagattacatgtcaaatgcagtaagacgttttctggaaccttgggt

SEQ ID NO: 128906 - DNA, 2379 bp, Homo sapiens
gcgctccaccacccgcgccgccgtcacttgcgtgccccgcccccgggggcgctctccgccccctctgcgtgtcgcgtcatcatctagcgcccccgtcaggacgtgcgaaaagcgacggcgcagcacggtgcggcgcagctcctgctcgcctttcccttcgctgggcgagaggtgtctatggggcacccgctgccgccgccgctaccgccaccgccaccgccaccgccgccgagtgctgtctctatggcgaggaggaggaggaggagcgcgagctcagcgacacaagtagatcttgcatccgctgcagccttacggggggaggggcgggttagggaagtagaaagggggcggggacgatgaacctgagagggtgcgcgatggcgccagctggagtgcggctggcggaggaaggagcctggcggcgggttgggggctgggtaactggggctgggggtttgtcaaggggttggcgcgtagtgatgacgcaaaggctttgtacctggggcttcgcagtgggacggaaattgggagtggagggcggtggcctagatcctcacctcttcgtattgtttcacgcggcagtgcttgggagtcagtgtagctccagtcagtgttatcagcaccttcgcactggcgctttgccagggaagagagttatctatggcttgaatacctcggtgccgtcctctcgtttctctgggaaactgcagtacggagatgctttctccagtaatgagaaggcctttggtgtctcttcggggcttctgggactgcagtagagagagaggtggaggaaaacaatgttagactacagggtctttccaagtctttgtgtttttgtgcttatgtgtgtgtgtgtgcctatcggggtgggagagttataaaggaggggtgtcctggatctcctttagtttctctacttggagaattggaagttacatttgtgactcttcagagtttagaagacagtcataagaccctctttttactcttgttttttttttttccaatttgtatgaaaaatgcagaaggatttgaaatttccctgcccaagaatcaacaggaactctgtttatagaccagaaatgtgacatctatctttggtaaccatgcaatatgctctaagttttagacgttctattgtgttctttttccgttctgcaactgcgaacattcagataattttcatggccgttacttttttctcagagcatttacaaacatttttgacccctctagtctagttagaataaacgccggtaaagtagatcttgttatcaagtcggattttggttgttttattaatgaggaataaaaataaacaccatctttgccatggtaacatctgatcttgtcacatgtaaataagtaatttttcattttttgtctggaaatggatggctttataaagttttatgcagagtagttgaactcagataaataattagtggaaagttataaaatatgattagtatgtatgtgtaaaaaagctattttaaaataactgaaattaggaccaggaaatctgtactgtagtcctttttttcctatagactagctgtgtgaccttaagttactttctaaactttgattttttttttttatgagtcaagaactttgaataaataacttcttaggttcctgctggatcaattattctgtgattcagatttgatatatctggtcttcatattgtttttttattttgacaggtacataaataaaggataaaatattttatgaaacaaatcttcaatcaagtataacattttgatgcttggcatctagactcccttgtgccctcactatgccagcggcaactgtagatcatagccaaagaatttgtgaagtttgggcttgcaacttggatgaagagatgaagaaaattcgtcaagttatccgaaaatataattacgttgctatggtatgcccacaagcagatctttaaaacgcttcatataaaggaggaaaaggaaattttaaagtcttgaattcaacccttttggttgatatttttagggattaatttcaccatgaaaagtaaaatttgtcactgccctccagccaaaatccatcaggaatacacctgtgatttgacaggttgggtttatccctcattgcagtgagggaaaacgcactggaattcatgggaaccatgggccgtttgaataagagttaggaaggatttgggctcgtgtcaggtggtcttaggggaaggtaagggaagcagagctttactgtggattggatgtgttcgggaagctggggtaattctgtgattgggtatcttactaagtcttaaatgagagactagaatgaggttaaagctgcagagaaggaacagtcattcatttagccaggatggagatacttggtcat

SEQ ID NO: 128907 - DNA, 1050 bp, Homo sapiens
gctgcgccgcaccgtgctgcgccgtcgcttttcgcacgtcctgacgggggcgctagatgatgacgcgacacgcagagggggcggagagcgcccccgggggcggggcacgcaagtgacggcggcgcgggtggtggagcgctgggcggccaggctccctggctggccggtttgggcgtctgggccgtgaaggtgggacctcctgttccgggccgcaagtttccctctccagccgcccgccgttcgtagcatgtcccccagaactcggggagcgcaggcaggacaggcttagagaagacgcggtccccagcgcttgggccacggacgtcccaccccgctcctctgtcgctggagaaccgccgggccgagccactgggagaagcaggccagagccttccagggcctccggcccgtggacccgaggaggatgagctggctttttcccctgaccaagagcgcctcctcctccgcggctgggtcccccggtggcctcaccagcctccagcagcagaagcagcgcctgatcgagtccctccggaactcacactccaggtgactggtcgctgcctctccaccggaggaaaaagtagggtgggagggcgggcttgtcctaaccaccctcacagcgcctcagtctgctccccaccagctcctcatgtggtttacctcccttggttgtgggtcacacgcttgctctgccactcctgcccccttttactgttttcctccggaccctccctgcctcctgccgcaccactgctcagcgcttctaactcggatttcctcatccctcctgacacatagctgctgactgtaatctctcaatctctctcatagtctatttccagtatcccttgctgcccaggcttcgccactgatctttccctttgcccacctgattgccgcgtcagcagaattgttaaaatacaattgtgaagagtaatctccaggtttcacaaagaatggaaaatagaactgttgcaacatcaaaggaaagggaagccagagttttcatcagtgaatgcttctcgtctgagagtcacttatcacgta

SEQ ID NO: 128908 - DNA, 1514 bp, Homo sapiens
tttatttttatcttactttagtttttcaaagatgaggtctcactgtgttgcccaggctggacttgaactcctgggctcaagtggctctcctgccttagcctcccaagtaactgggactacaggcatgcaccaccatgcccagccgtgacagcattctcaaagtagaaaaaccacagaaaattatatggctagaacctgtggtccaataaatagccagactggactagtatggttcacctgataaaaatgcctgatctaatttctacctaagattttgtatagcttggtatattgtgtttgaaagcaactaattggcatgatgtgaagaatattctataattcatgtccatatttcacattaagattttactgcgttgaatgactagtcttgttaccaaattttagtcttaaacatattttcagacaacaccataatagagcacttattactaaatgacccatatcaaagtgtgaaaatttaatttacttttaaatagctttgttttaagattttgaccatataatgtacctttgttatctttgtttttgtttttcatctgttctacctctaccagattgcttcctccacagtttcctcaggaaaaaccagtgatcagtgtttatccaccaatacgacatcacttaatggataaacaaggagtgtatgttacctctccattagtaaacaatgtatgtatatgggataatttatttcagggtaatataataggtgtattacttttctactaaatattttagaaatctgaaatgcatttaaagtttcattttgtcatgagtactttttttaaaaattgaatatttaagactacgccttaaagttcttacaatatgatatggttgattgtgaaagattataacttccatatactctagtatttacctttgaaccctcaaattattgtaaatagtcaagtaaggaaatattttggctccattttttattcaatggacttttaacctgtttactaatcaccagatatttatggtatcgattctataagaaaatgctataacttgttaattgctaatatcctttttcatttaattcttgacctgcaaaagtaagttaatatttagagtgacattatcctaatgagactttataatctttttctggaagtgattttaagcgtcatgtattgttactttcagtttacaatgcactcagatcttggaaaaattattcagagtctgttggatgagttttggaagaatcctccagttttagctcctacttcaacagcatttccttagtaagtatatttctagtaaataaaaaagtctgcctgtattttaatgtattaatcaaaatatagtttaaaaattcaaatgatgttaaaaatcagtcctctgatttctacatccccacaaatacatccatactttcagaggcaactgttttactcttttacctgtttcttctaatgtttacctacatctttctgaataatgtatgcgtacttctatcactcgattctttcattttagatatt

SEQ ID NO: 128909 - DNA, 1048 bp, Homo sapiens
aaatttaagaaataagtgatattctcaagcaattaagttaaacagaattaagaacaagaaaaaaatacttaactatattactgctgtcctattttaagaaacctaagctgaataagctccttagtttcatacattgttctttacctgagttaagttgactttatttttaatttcaggtcactgtataactgtgaacacttccccacggttgtgatttttaaagaaagtagatatatcgatatatccattggaccaaaatttacttttacagattctgtcaagaatatattacagactgctctatgttccattgtggttgatgttttatttgattttaaggttaaaactggcagccttaggtgtatatgtaaaaattatttagaaccctatcagttaactaaagctgaaaaattgtaaatagttgtcatggagaaaaactcgatgtctgatatttattgacattttttcttttgtgtttctagtgtgtcacaactcacagatatgaatgaacaagaggaggtattactagaacagtttctgactttgcctcaactaaaacaaattattaccgacaaagatgacttagtaaaaagtattgaggaactagcaagtatgttttccctctcctgagcgcacatttcctgaaaaaaatctcatctttacctagaagtaaactagagatttatcttacaggaaaaaatctccttttggagcccagcttggaagccaaaagacaaactgttttagataaggtgagttagtgataattttgaagaaatttacataatttaaaaatagaataaaacaaccttttcattttctcttttagtatgaattacttacacagatgaagtccactttcgaaaagaagatgcaaaggcagcatgaacttagtgaggtaagactgtttatttttttccctttgccatagattttttttttaatcttatgtgcatgagtcctgatctcactttcattatcatcagaaaccatttatgaggtatctgaccttataagacatgatacctttaaacgtggatgaacagct

SEQ ID NO: 128910 - DNA, 1049 bp, Homo sapiens
tagtgaaatttaatcccatcatttttgccttattctattgaaatgagtcgtcaggttcagcccacactcaatggtgggattatgcaagggcaggaataccaggaggtgaggtcattagtggagcgtctccttagcatatatctaccacagtgatttaattcgtaaatccttaggagagaacaatgattttcccagtttctctcatttaatagtttgcagccaatagattagtttctcttgagttaggtgtctacccctatccaaaagctaaggacctgggtggggcattataagacagcagattttctcaaaaagaggctatatagggcatataataaattgcctctccataccactaccttacttcctttccctgtgaggagttcttgtgagtatcataaattaaagtagtgcctgattttctttttcagagctgtagtgcaagtgcccttcaggcaagattgaaagtagctgcacatgaagctgaggaagaatctgataatattgcagaagacttcttggagggaaagatggaaatagatgattttctcagtagcttcatggaaaagagaacagtatgtaatactcgtcagttgaggacaagtattggataaagtttggtatttttatagaggaggagaagcactgggtgttagctatttctctattatgatatcatccccctttttttgtacaatatatttacctgaaaggaaggtttctattccttgggtgtggacttgggcaaaaaccaggttcctggaacttaaaactttgaaggtctgtcataggactctggacagccacacaccttagctattcccaggggaccccaggggggcaactgccattgctctaagatgtccttttgatgtgacttgagatataaatgagagtgagggcctgtacgtgtggctatttcctgtctggtatgtcagaggaacagtcctggtcagaagggggctcttctgagcagaaattgctaataaactttgtgctgatctggaaaaaaaaaaattttttttttgacagcatagtatcaaattact

SEQ ID NO: 128911 - DNA, 1783 bp, Homo sapiens
gaaacccgggcccctggtggtgtaggcacctgagggaatctcctggtctgtgggttgcgaagaccgtggaaaaagcgtagtttctgggctgggtagcacagtccctcaaggcttcccttggctaggggaggtagttccctaaccccttgcacttaccgggtgaggcaacaccccaccctgcttctgctcaccctccgtgggctacacccactgtctaaccagtcccagtgagatgaaccaggtatctcagctggaaatgcagaaatcacctgccttctctgttggtctccctgggagctgcagactggagctgttcctattcagccatcttgcctgggagccactgtgggcaaatcttaattggaagataatgtaaagagatacatattcatcttcttaaatattagaggtattttttattgttttctttctagattttcctggaaacatgaactgccaagagaggaatgggacacaaaaccaaacactgttttatatttatggtttgcaaactggcatttcatcagtggctaaattcacagatatcctatatagattgtatacagaactgagactgattttgtaccgattagaatgattgctatgatctttgagaaatttttctgcactatttgcactgaaatgtttatttattgttgataaattgtatcatatttaagttccactgctgttcctcttaccttgattaaatgcctatgcatgtacttttagctagtttttaatattttataaaacttcatttaaatttgtatttttaacttgaagttccatttctttatcaaggatggtatttagatttttttcctcttaaccttttttcaaaaactattttcaactgtgaggaaacccttatttttctttctttgtggataaaactttcaaaagcaatttaagatattcatagtgttaggaaacaccaaacctgcctatgtgccatctcacaaaagaaacttttaatacctacaataaatcaaaagaataaaccagctgttcttatatattgtttcatttttaaaactaaagatgcatttaagaagcaatacaagtaaatattttacctaataggaaaaaaaaaagttgcctttcatttaaaccattccaacagaaattcttatgctaatttaaaacatatatatatctggtaggtttgtggttggataggttttctaaattcctaatgttaaaaacaatctttatgttaatatacactaaatctatacacaaaaaaagtcagtgaacttttctgacctttactgtgagttaccttttcctaagaggaaagctatagtaataagtaaaatttaatttttaggcaatcctgatttttaatgaatttaattgagtgttcttgtatactacattgagcagtttgcttctataccgtgtcacaaaattcatgtatttcttgagaagccctaaaagctcataaaggaaaatgccgtgaactatgtagctcaggcttggtaaggtgccatctaaattacaaaacaaactaatgcataattttgcttaaatttcatcccagtatgattgtcttcccaacaccagcatatagtatagattgtctgtcttttttatattttttagttcttcctgtacatgtttttggcaataaagttataggaagaacaaaattattttgttagaattaaaacatgcttaatatttagtctgtttgtggagggcaggtattcacgtggactgagatacaatgttggatacagaaaataactttcattgtcttcctgacactgtgctaagg

SEQ ID NO: 128912 - DNA, 1053 bp, Homo sapiens
catcggagaagcagtgccacaggaaaaatgaaatgcatgtgaaagtttgtattctgattttacaagatgagatagaaatcagaattaaagaggaatacttaggagttactaggctaatcagtgtacgaatttgtcataggtagagatttaaaggttaatatcttaaaatagaagaaaattctaaatcaatcaatcagtgagatataaactaaacagacccacttcaaagttgaaagaaatttctaggcataaattgagactaggaaatttatatcagaatagagggtgcttgacacatatatatgcttaaattgaaggacagctcagattcatttttaggagaagaaagtaaactaatgtgctcttaaagaataaaaatttattctatggtttctgtctctgatcatcaccttccattctataaaaagctcagttactgatttgctgggtcatggtcaaaattcttacctatttatttcatatcaactttaaaaaataaattacttgcattctatatattactaattgggaagtaatatgcctcaaatcagttttatactggattattccctatgctttaaaccactgctctcaataaaacacttcctgattaatgtttgattattagatattttagtcttgttggggatattttagtcttgttgggttagccatgctctgaagaatctgtgaaagtacagtaaagttttaataagcaataaatgtaaccttttatataaatctcagtgctaggttaacttctaataagcagacgaacatgttacataaattataatgtctgtcttgtaaaaaagttgaggggactaaaagtttatgactctgatatggaagttgtcatattaaaaaactacattttaaaacatcaaatatttatactatttgcttttcaaataaaagcatagtgctgtttggcatagatactttgtcattttttaaaaaatgtttattgtttttatagacatacactgtcaaacggaagaaattaaagccacatcctcaatattaggcaacagagtttctaagagtggacag

SEQ ID NO: 128913 - DNA, 2904 bp, Homo sapiens
ccaggtgtccataacatgatgaatggggaaacaaaatctggtatatccatgtaatggaatactgttcagccagaaaaaggaatgaagtacttgatacatgctgtaccatgaatgaattctgagaacataagctaagtgaaggaagccagatacaaaaatccacatgttgtatgattccattcaatttatataaaacatctagactaggcaaatccatagagatagaagttgatcagtagtagccaggggctgtggggagataggaatgggaaatgactgctaatgagtatggggttttctttcggcaggggaggtgatgacagtgttttataattagtagtgatcgttgcacaaccttgtgaatataactaaaaaccactgaattgtatactttaaaagggtgagtttcacggtaagtgaattgtatctcagtataaaagttagatgataaacacttcattcatgatttctaaaaaatgttttttgagttcatgggatgagactcatcatttgaaaccatgtaggtatagaaaagagggagactagggttcactgggtgcttcaactgtgctatattgtttattattatagaaaacctatgtcaaggcaggtattatccttacattagagataaagcaggcctcacagattttgtccaaggtcgtgaagtccaggtttgaactcacatccctctgagtcacatgttcttaacattatacccacgtgggaggtaacaaatgctaaagacatgcatatatagaaaaagataagttatttatgatttttcccctgaaattgttatttctttcttagaggctggaaaaaattcaaaaggtccagttaaattgcactaaggtgaagagtaagcaaagtgagcccagcaagcactcagggttttctacctcagacaacagcatagccaacactccccaggattacagtgggaatatgaaatcatttccatcccggagcccttcacaaggcgatgaagattctgctctgattctaacccaagacaatctgaaaagttcagatccagatctgtcagccaacagtgaccaagagtccggggtggaggatttgagctgtcggtctccaagtggtggtgagcatgcaccgagtgaagatagtggcaaggaccgggattctgatgaagccgtgtttctcactgcctgaagtttccctttggagttccaaagtaaaggacacataagcaacacttccaaaaacaagggaacaaggtggtttattgtaaaaacaggaaatggtgcatgtcattgagaactactttaatgcagctatgaaaagggaaaaaagtgcccagttcttgatttcttagatactgaagaggacgtagtcatttcatttatcaaatataaggaaaattattcaccattttgaagctcaccctagactatgaaaattatattcactgcagagcaattacttctgtcattacctgaagtgatcagtatctatcttccttgtcatagcatgcatctctcaaaaagcctccactcctttccctcacatctgtgatcatcatgattcttttagttcacttctagatgcatattttgtgttttctaaagcatctgacattatcctcctttccgaccctcttatacatatttctaaaaacaggcacattggtgagatgcaccctttttagttaatagatgcattcctaaggagcttttaattgcttatctttcaggcataatcatcactttaacttttccttggagcatatattttgaattgtgagaataattttgttgcttttctctgagatctatagtctgtttctcctcattatttaaaaatgctaaaccttgtatctcactttttctctaacactgatttaatagctaacgaggtagaagcaacattcattctcctggtcttacatatgaatttaagtatcagctttcttgtaataaccttttattactgttctagagactacactaccgacagtgtgggccagccaccagcctgatctcaaagtatcacattataaagttagtagataaaacatctgtgagtgaaaatccagtttcaagaaccagagaattgggttgtcatgtctgtttaatgaagggaataggttttgtaatctatcattttagaaattatgtaactggctaatatggtttaattaaccttagtaacatctcatgaccactgactgctgaaagttctgaaaagaatttttgttttgttacactgcacatttaagggagagtccctcccctatcttatgagttaaaaaagacttcactaggtgacctaaattaaacttagtggggaaaagtggccatgtttggacataaataaatggtattcacactgtatggttttaatatattagtacattctagaatgtaaaaggattaaactttacaatttagatcaatattttgaatatgtgaaaggattaatttaaactttacaatttacatcaatattttgaatatctgattttttttaatgggagaattattacatttcgctgaaatgaggacgagggcaagaaagcaacattgctgatctctctagtatgaaagatttggagggagtgttgcaatatatataaatgaaaacatttaattgtgttcatcatatttaaaaatatagaatatattagagaactgtgatttaaaagtactgttaatgtaaaaaataaagcaagtgtaattaattctttcagaatataaaatttgggcattctctgctgagcagttcccaaattaagtacaaggaatgtttattcattttctgcaatatactatatgtaatagggaataccttgctaaaataaaacttaggatatagtggtaatggctttcacatttttataacataacataactcacttcacaaccttcttggagctgtcca

SEQ ID NO: 128914 - DNA, 1590 bp, Homo sapiens
gacaaggaagatagatactgatcacttcaggtaatgacagaagtaattgctctgcagtgaatataattttcatagtctagggtgagcttcaaaatggtgaataattttccttatatttgataaatgaaatgactacgtcctcttcagtatctaagaaatcaagaactgggcacttttttcccttttcatagctgcattaaagtagttctcaatgacatgcaccatttcctgtttttacaataaaccaccttgttcccttgtttttggaagtgttgcttatgtgtcctttactttggaactccaaagggaaacttcaggcagtgagaaacacggcttcatcagaatcccggtccttgccactatcttcactcggtgcatgctcaccaccacttggagaccgacagctcaaatcctccaccccggactcttggtcactgttggctgacagatctggatctgaacttttcagattgtcttgggttagaatcagagcagaatcttcatcgccttgtgaagggctccgggatggaaatgatttcatattcccactgtaatcctggggagtgttggctatgctgttgtctgaggtagaaaaccctgagtgcttgctgggctcactttgcttactcttcaccttagtgcaatttaactggaccttttgaattttttccagcctctaagaaagaaataacaatttcaggggaaaaatcataaataacttatctttttctatatatgcatgtctttagcatttgttacctcccacgtgggtataatgttaagaacatgtgactcagagggatgtgagttcaaacctggacttcacgaccttggacaaaatctgtgaggcctgctttatctctaatgtaaggataatacctgccttgacataggttttctataataataaacaatatagcacagttgaagcacccagtgaaccctagtctccctcttttctatacctacatggtttcaaatgatgagtctcatcccatgaactcaaaaaacattttttagaaatcatgaatgaagtgtttatcatctaacttttatactgagatacaattcacttaccgtgaaactcacccttttaaagtatacaattcagtggtttttagttatattcacaaggttgtgcaacgatcactactaattataaaacactgtcatcacctcccctgccgaaagaaaaccccatactcattagcagtcatttcccattcctatctccccacagcccctggctactactgatcaacttctatctctatggatttgcctagtctagatgttttatataaattgaatggaatcatacaacatgtggatttttgtatctggcttccttcacttagcttatgttctcagaattcattcatggtacagcatgtatcaagtacttcattcctttttctggctgaacagtattccattacatggatataccagattttgtttccccattcatcatgttatggacacctgggttgttcagaatacatttcgccagatttcatgttttgatgttaacacaggaggtgttataagatcaagtattatgtattcattcaaaaccattcacttagg

SEQ ID NO: 128915 - DNA, 1004 bp, Homo sapiens
agataagactttacagtcagtctcccctttaccaattatagattaatatcatagttaacataatttctaaaagtggggaaagagttttacaagtacatatatttgattttattctgttactttttcacactttccagaaaaaaattaattttactactctcaaataacagtaaccaaacaagttgacctaaaataaggaacaaccaaaaatttgtggaactgagccacaaaccagatgtgtgaaatgcattaaatgcctaggtttgggcttcggttatctgagtcctgacctggatggggttgtgtttcaggtgttctactgactaaaaatgtgaaatatttgtattgcactgaatcttaagaggctttcatgaagccttgctcttcaagaaataagcacagaaaatagattaacaaagcaagtatgtcttacttcttccagggcctctagttcttcctctagctgctgagtttcttccttcactgccattaggtaatctgtaactgactgtcggggctgcatccccttttcaaagcggttatacattccactccaaaacctggaaaggatggcaaagcgtcgtgataccaccttatcacagtctgaaaattcacatcctcaagtcttctaaggtatctatgataccacagtcttaataataaccaaatgcaaatttcagcctcaaaaaagccactacttaaggtaataatttcatgttgatgttttttttcttgggtcagtaaatgccttttggggagaataagtttatgaaaagtctgcctgtatatatgaattagcacagaatacatttttctaaaattaaaatagtacatgtaaccattaccttttaagaaaatggctcttagttttgaactttgaaattgtatatttagaatctttcagctacaaagggaatcttaaacttgcagcttttatcttttgtatcacgaccactaaaagttgacatttgcattggcaataacccccccccccccgctttttt

SEQ ID NO: 128916 - DNA, 1969 bp, Homo sapiens
cttaatgtaatttccacaagggaagtacttccagtaggacttaattcagtggagacaaaaaggcaacctattacgttggtgcaaaagtaattgcggtttttgcctttttgttgtataacggcaaaaaccacaattatttttgctccaaccttaacacgtcatgatcactgttgaaacttgtgattccacatttgacttaaggcatttgcattattctctttcatttgcttttaaaaaaataaattggaacttaacctttttatgatatcattattataaaacatcacctcctgaagaaaattccacatttaggaggaataaagaggcagaggagtcactggcaaaaataccagatcagatattcaagcatctccctctggtgtcttttgtgtccaataaaagcctcaaagatcagtgtcatacactttgacctctgaatgttaaacggtaccagaatccaagttcataccatggctacaaagttaccaaggatttacatacttgtacatgaagttacatggtgttgtagggagatgaagggttccctgagtctggctgtgatcagctctaaacagaggattcaggtagtcggcccgattcttccacaggtgagcccataatgagtatgttctttcttgaatcctgttataaagaaaataagtctataaatgacctattttggtgcttacacacagtagatatgttatattaatgctggaaaggaactaataattgttacctgaaaaccacgtgtctgttcgatagcaggtaaatgtatcatcttggtgacttcatggtatagagggagaacactgtaataatctcaacttcaccaccatctgtactggccttgacaaggtgttcgattcgtgtgtgtgtgtgtgtgtgtgttaagctgttcttttggggggagttttttcccccaaatagtcattggacatttataatttgtcacacactattctaaatgttccacgttttctctcatttaatcctcactgagttgctgtgagctctgtctaatttacagatgaagaaactgaggaatagagagaataagtggtttcccaaagtcctatagctagtaagtggaaaagccatattcagacccaagcagatactgttagaattggctagtcaggtacaagaaaacaggtgaccctaaaggatacactctgctccttctaaatcatctccatctccatggaatcacacttgagcttccttagagaaaacaaactagtatccactacaaaaattaattttctttatgagtccatttcatttgaactgatcattccccaaattaaatctgataatgttgtatacaccatagttaaaaccatttcattttatgaaaatttaaaaaatgttctctcatgtatactgcctaaatcactttgttgtaagttttttactgtcacttattttaaagtccacaatttatctacttttacccttggataaatcaatacagttttaatctgaataaattctggcttttatatttgctttcccaattaaatttgcaatttttattatggtagcatagccaccaaatatatctaaccttttccttttaaatgcaaaaaccacttttttgactccagaaaattccctttcgatattcatgcatcaagtctgtcaagctgtctatcaggcagaaactgaaggaaaaaatgaaactatttatctgtcagttgatgacatttaaaccatttatgaaatgacaccaggaaaaagaaaataaaactaatctgtcagtataggtatgtgactaaatgaaaaaagtcttcaaaattatgaaaggccacctaaaattctcagtcatcaaaatctttaaataaaagttaaacaccaaaaacaccaaaacacttacttgagttctcgtctctccttttggctgttacataggaagtttccaaactggcaggaataaatgtgatgttgaatgtgaatcaaaaacctc

SEQ ID NO: 128917 - DNA, 1220 bp, Homo sapiens
gaaagtttggcctgttcagtaaaaaaaaagactgcaagagaatgttatctatggaaggcttggaggaatcaattgcatcctgagacttcacgcagtggaatgtgtgtattttaggattaagttgaacactttggggcatggcctggggttggacagaaagcccaaacagcaggcgcccagggagtggtgagagctcatggagggtgctggaatttgccatgctttccactgggccgtgtttcagggccgcgtgcataggcagaagtgagcctgatgcttggagggcctgtctggtattgctgggcactgtcacaaggcatcagatctccagaagggccgagcttgctcagttttaactcggggctggcacttggcctttgcatcagattgtgctgtcttccaattgggtccatgcacccctgaattcacaggaagactttttgaattgcaccctgggtacattactttatggaaattggcttctagatcatcagcttctgtatgtcctccttactacgattacatgacctgcctctcagaatgctcctggggccagctttaagccagctctcccttctcagctcccttcccaattgccttgttgccaccttacaaaaaaaaacataccctttaccacaccctccgtcttgctatcatgcatcatctcagggtgtgtgagggaatatgtagtttcatattttattttagaggtacatgtgcaaaaatgtttgaagacttttgatcagattcagcttccttgagcagtctaagtcaatactgtgcatagaagtaaaatgcaagacacaagtgcagaaaacatttggaattttaaactttctggtggccacattaaaagtaaaaagaaaatctcatatgttatgtaaatatatatatttatattattaattttcataatgtattttatttaaccccgtctatcccaaatgttatttcaacattatcagtataaaaagctagtaatgaagtgtttttgcattttttgtgtgtagcatgcctttaaaatttgattcatattttacacttacagcatatctatctcaatcctgatcagacatatttcaagtgtttcgtagccacatgtgactagtgagtcctgtattagggcagcactgttgtaagtgatagaaagcacaacctttaagctgatggtatttgggaaccaagattggttcctgctgaattatgaaaaaaaaccaacc

SEQ ID NO: 128918 - DNA, 1453 bp, Homo sapiens
ttgccatcttttggaggtcacctagaaaatttcactttctccccacgagtagctttgtgcctgcctaccttccacgtgactgttagattaatactgttggtcattgtttcactgaccacttattcatcaatgtattcattaaactaaaaattgagcaactgctctttgccacacttcataagtattttcatttaaatgattgtatgagattttcacaacaattgtgtgcagtatgtggtattatctgtactgtatagatgaaaaagcataattttttaaaagagtaaacagtaagttgaaataaacatgtagataaacatgtaaatttgctctggtaattagagaaatgtaagttaaaacctcaaagtaccatttgccacccaattttttacaaattaagatattcaatactcaaaagaatgtggtaaaactagtgctctaaatatttatcgtattatttaaattggcttagacagacataatatatttggtttagagatagtttttttttttaccaggtttcttcctcttagggactaatccaaaatacgtttttaaaaaataaagatacaggaagggcatggaggctcatgcctataatcccagcactttgggaggctgagacattgaggattacttgagccacaggagtttgagaccagcctgggcaacacagtgagaccctgtctctacagaaaatttaaaaaataaaaaaaatcaaccaggcgtggtggtgtgtgcctgtagtcccagctgctcaggaagctgatgtgggaggatcacttgggcctgggaggttgaggctgcagtaagccatgatcgtgccactggactccagcctgggtgacagagagttaggctctgtctcaaaaataaaataagatatagacatgcctatgttgatagtagtgttttatttataatagtagaatattggaagccgaatgaatgtctaacagtagtagactgattaattttacttcaccttcttgatagaaaagtttgcatccatgaaaaatactaaatgtgaagactatatgtactaacatgggagaatatgtataatgtaagcaaaaaattcaggtcgtaaaattgcttgcatattcttattcactatacagtaaatcatatgtctgaagaaagactaggagagcatgtgcagaatggtcactgcattaccaaggaaagataagactgatgttattccctttttccctctttatttacaaaatacttgctatggtcggtatattccttttttaaaaaatgatatttattatctcatggtttctgtagggcaggagtctggatgtttctcaagcataaattggaactcagggaccctcttagcatctttcaaggctgcagtcaaagtggcagctgggctgcgttctcatcaggaagtttgaacagggaagaacctacttccaagcacttatggttgttggcagaa

SEQ ID NO: 128919 - DNA, 1300 bp, Homo sapiens
gtggttttgtcgcttggtggttagcagtcagggactctacaatggtactgaacatctaaggtcaaagtgcacagggatgtttttgtttcttcctcataatgttagtttgatccccattcaaggccatttaggaataaggcaatcctacatttaaagcaataaccaaccattcttgtatggagatcaggctcaaaaactgatccttgctgaatggccattcgaagggagaatatcggaggagctgaccctcatttctaaacagcagccaccacaatacacatgcatgtaacctcccgccacctccacacacactttgacatatatggcgaacatgacaagacacgtacccacagacttatatactcgtgtggacaggaaattaaagagatggattatgtaatagagaagagttattcatgtggccaaccagccatatgctgatgagcagaaattctgcatttcaagcaaaaccagcttagtccgctgcttctgctccttgtgatcacagtgaccccaagaggaatctgtcgctgtagtctaccacttccggctctgcgaactgggaaaagacagaggatgcagaaaccatggccttgtgccttggctgtccatgcactgtctgcgcttctggggaaagccctggagagctggagctgggagcccgggaagtgggctgtcttgatgggaaatgcaggctctggaatgaagagggacaaataaggtgctgaattattttttccaggaatccacgtttgctctcagttacttaagccgttcttcgtttaatcagaacaccctaacgttggggttggagaaatctgagtgtcacaaacaggcctaatttccattctgtttcctggactttctggttcatctcagtcattatgaaactttgaacacatcagttaacttgtttggggctgcattacctgctgcagaatgacaggattaggccaatactttctatgggtcttccagctgtgacagtttgatgcccctctgtagcagaaatcccttcctacatctgaaaacatctcagccccagagccatttccatcttctgtacataattggcagtcagtctctcaggtcacagtgacaatacctgacattgtctcaggtcacagtgatcataccctgggcatgattatttgagcagcttcaacttttggagattatcatgcagagtttggctgttcctgctacaaactatgttttttatgtgttgaaaaattggactccttggtactgttattggaaaggcagtctgactttagtctgaagactgttcatcatttat

SEQ ID NO: 128920 - DNA, 1038 bp, Homo sapiens
taggtgtctatacagtgttgactttgcttcatttattaacttctctgcacccaaagacactgatattatcaaacagcaaatgaaccttgtgttaggaaacagggtatttttgcagtcctacttttcacctatctgttgtgtgtttcttaaacatgaattggaactgaagtgactacctttattgctttatctacttgagaacttttaggacctgaaatgcatagcttttctttagttgtgaaatggagttctcagtcaaagggacagaggaccgtatttgatgtagtaatagcgatttgtttatgtaagggatgccgtatcttactgcgcacacatacacgtaaaatgtccaagataacattgaatttttattaattgtaaaaccgtatctcctgctttgagggttcagcttttgctacattatcaggataggtcctgtaaaaaaggtggagatcctaagaaattacacttcagctggtagatgaaatattgccaccttctgttcattctgagaagtgcacattgatgttcaggaggttatttgtgttgctgctttgcttttaagggagattaccaatcagttctcccagatcaaggataatcagctatttcataatgtgtacatggagtcttaattataggttaaaataatattttaatttttgtttatgtttaaaaaatctattctacattctaacttttgtagactgtgtagtctgtctctctttttttttgtatctctgcctgggataaccctcctgtcccttgtgggtgaaggaggagaatgatcagtaacatggggtcttgctctgtcacctaggctggagtacagtggcacgatcacagctcactgcagcgttgacctcccaggctcaagcagtcctcccacctctgcctcccaagtaggtgggactagtcacatgccaccatgtctggctaatttttgcatttttttgtagaaatggggatttgccatgttgcgcaggctgatcttgaactcctgagctcaagagatctccccacctctgcctcccagaa

SEQ ID NO: 128921 - DNA, 1048 bp, Homo sapiens
agcagctcaagtcatttaaaagtgtacactgtggggaagaggtaattatagacacggtctacactcattggtgatcccagaaatcacgagaactgcatcctatcctttgtgtggatactcaggccttggtgattttcacggattctctgaacttcatgtcaccaagtattatgatttgtgtccaggataatggaatgtgatgttttcctagagtgagatcagtgccctactcgtcccctcatctcagaaccatccagtcttcttcggagcaaagcacacagcgggagagaagtgtgtggagttactactcacggatgccagatgagcgaatcagtcctggagatcagtgatgaaaccgataccacagctagatcacattcacattctactagattataagtaaagggtcccttccttttaaattctcagagcacgacacacagataaaagtttcaaactgaaaaaaaaaaaaatagctcctttgctggaagattttcactgaaacataccagaaaatctctggcttttactgttctctgtcaatttgtgcccttctctctggctcattgtgtttaaacccttccttctaatgtgactgccttcccacctcttcttcgtaccctttgttgaagcaaggtggggctgttttgaatttcctaatagttacagatgatttaatgattagctgcttagatatactgaagacaagataagaaaaggaagagaaaagacgggggctttactgaggagagattgggaagcctgtttcttaccctgtttttttcagatttaaataaagccagacagattcacctactaattttaggaccagtgatccagatatgtactgtgttgtgtaaaccttctaggaaacgtggcagctgtagagccaggcatattccagatttaaaataagttaatccaaaggatttgatttgaagggtatatttagtgctaagtgtgtttactctcagcgatgagtttgacactgatccattaaagaaaactggggtttcgtacaagccatgccctcttctcatatttatcc

SEQ ID NO: 128922 - DNA, 1070 bp, Homo sapiens
atgaataaggatactacattttatagtgaaaatactgtttcccacgtatgctaccaaagggacacttttgattttggtggtgagatgacttggctaattttgggcactgggaactggtgatcagattaggagaagcttgaagtgcacgagattttatgaacctgaagttctgttcaatataaaggcccctgtggagggtccatctttccctttgtatcagctgttaccacatgtagtgttaggttggtgcaaaagtaatttcagtttttgccattacttttaatggatgtaatcacattctttcacccctgtggtgagggagggattcctgctctaggttacagggacagccagacacacagcacttgacactgggcaggtgagatgaacagtcacatatactcactgccaaggggaggaggacaccacagcccatgaaggggcacatgaggttgcgctgaggagcagagtgacagccaggggctgtgagaggcaggctgtgtagtatcaggagcgtggggtcacccttggttcccacaggaggatgtgattagcttgcgtgcatcattccatgactggcagggaactaaaacctgcttctgggggacgggcaggaactgcacctggtctgttggataagaattgtttcacttgggaaccttacctgcaggagcagagcgtggcagggaacttgcagtgaggccatttgaggccctctcggttttaccagatgtcgaagcaacacataatattaattttaggccttacgcacatgggttatgtagagccacgtgggctccctttgaatatccagctattaacagctttatagatcatggttagagatgcttagtcatgtgcgttcggaattctgtgcatctttctttgagagttcttagaattgctatagcctttgttctttattacgctaggattttttttttaaagtttcactttaagatggtgcacagcatggtctcccaaatttacagtacacatttcgaggaaacaaaactctagaagatttccagtgaggcaactttccttaggaaaaatacagaccttcatgg

SEQ ID NO: 128923 - DNA, 1012 bp, Homo sapiens
cctgcctcggcctcccaaagtgctgggattacaggtgtgaggcgccgccccttgcctcttttttttttttttttttttttttttattaagataggataaatagagataggaagtttcatgatgttgcacttgaaattaggttgctggtaacatgcacatttttttttttgtagcatccattgattaaagaagagagaagatgaatccaggagagggagaaacgatcttttattgttgtttcagaggtgttttattgttgtctgtagaatatttaaaaagtgagcacagtgtgcctagcaactccctttttatattcttgagacaagggacattttactttttgtcaatgtgagtagtatcaggattaaatatgtattgtctcagaaagagaatttttagcagttagacctcagaggcagcttcttccccggctgacctcagacccacatggctccacgcctgctcccccaagtgctattttactgaacctccaggcctgaaaatgaactcacacagcatagttagagcttaagagtattcattgcccatatttaagattttaaagcagaaacaacctgaagctctagctcttcttccaaggtacagaacagagatgtgtctcgaagcagcgctgcgtgatcgggttaccccagggaagtcccgagtgagcacacacctgcccgcccactctcccaccccatgaactgaaatctattttgcaggtggaataatgatcaaatttgtgttttataacaatgtttacattttaatatcaaggttaattatataaatgcttctgatttgactagggcttttcctaaagggaagtattattaccaaaggtggatttctgtgcttaatggaagacactgaaataccagagtagttatctgtgctgtcattgctcatcgatggccgtatagaaaacaggcagtctcccacaaaaagtaaacaggtacacattccataaatttgctgatctgtctttcttctctttggttatttgagacat

SEQ ID NO: 128924 - DNA, 1353 bp, Homo sapiens
tgtgcaattggcctgggccttgtgtctgcctctgagaggccatcccaaatccaagcttgataggcattaaaaaaatggaatcttcatgcctaatgaatgcatatgttcttaatttttatgttccatatttgatgtggtctggaaaatatatttgcttttaaagcaacaacaaaaaaagcacaaaatggagatgtccctgtgttctaaaaggaaagaaggtactgccaagttgagttcaggtaccccaaggtcatcttgtcattggtgggaggaagtgggggaccctatccactgcacacaggttactcccaagagtgtgctgggggtgggggttgggatggcctctctgggcactccaggtgggacagaatgttttcggggagatttggctctggttttgactaagcttgatttaactttatcctaccttttcttgcagtgaaatatgaggagttatactgcttttcattcaaccccatgctggataaagaagaaagagagcaaggctgggtgctgatcgatcttagtgaagaatacacgcggatgggcctccctaatcattactggcagctcagcgatgtgaatagagactacagagtgagtgcgtgaaacccaaacactgaagccgcatgaaattagggtttcagccagcttagcatccctttatttttatctccttcaggttttatagctctttgtagatatccatatgtggatttccaggtctctcttggttagtgccagctgtatttacaacctggacctagaatcaaaacgtttgaacctgctatacagatcaccccttccagacccttcatctcacggttgcagaacttgaaacccagagaggccgggtggcaggccttgtggacaggcagttggtgggagagctggcctggatctcattctcccatcaggtctttttatagtgtagtgagtgattagtgggcaagtcagggagactctgaaggcagtttggcaccggctcctctatgtactcactgagtccttgcttggtacacaaggtcaccaagaggcttccctagagaaacatgtctacactcacaggaaggaatatggagaggcagggaagctagagtggcagaattaatcccatcttctccttaatgacaggcttacagatcaggggtggtttcactataattttaaaaatatttgagtaacaaaagtaatgtgagaacatcctagatagtttacaaaaggaaaaaaaaaaaccccaaacccaccatcccatttttaaaacattcttctgttttaaaattttccttcagttgttttctcatctgtatagtttgataacttttttcatatgtaagtaatgcatattcatta

SEQ ID NO: 128925 - DNA, 1020 bp, Homo sapiens
ggcaaaacataacatgcccaaatgcaggaagctgtttcattcttggtaaagaactaagttaggttaaaataagggttgtgggtcaaatgagatcagttaaccttgtagatctaatgtattaataaggattgaacttttctgatgaaaagacccgtttctcagaggccttcagcttttcccatgtcctctctcctctcttccctccaatttgcctcctgctgtttatttttgtatcaattatcttcccctccttagtgtttgtgggtacttcaacacttaaataatttcttttgtttgttttcccccttttcctaaactagtttctttttagtattttagtccccagttcttttggatattttttattttagaaaaaatctcatgattgaagtagtctcatttgctttattggtaactttttatattccttatataagtcattgatgtttaagcaatctttgcagtggtaatttcttttttatcagagcgtagcagcccttttccactgtgttagctttaacagtcctaatatttaatttcaacacttgtttgcttaaaacaagacagataaggtgaggcaccctcatttttattttaaatatgcaaaatccagtaatagctgtattatcttctcaccccactctaaatggtttttcagctacagtttttttttttttgagatggagtctcgctctgtcatccaggctggagtgcagtggctcgatctcggctcactgcaagctccacctctcaggttcatgccattcttctgcctcaacctcccgagtagctgggactacaggcacccgccaccacgcccggttaattttttgtatttttagtagagacagggtttcaccgtgttcactaggatggtctcgacctcctgacctcatgatccgcccgcctcggcctcccaaagtgctgggattacaggcgtgagccaccgcgcccggcctcaactacagttattttaagttgcctgaattcagcataatgtttgatgcaatttagctttca

SEQ ID NO: 128926 - DNA, 1007 bp, Homo sapiens
cctgacgcggtggctcacatctgtaatcccagcactttgggaggccgaggcaggcggattgcaaagtcaggagactgagaccatcctggctaagacggcgaaaccccgtctctactaaaaatacaaaaaattagctgggcgtggcagtgtgcgcctgtagtcccagctacttgggaggctgaggcaggaggatggcgtgaacctgggaggtgaaggttgcagagagctgagatcttgccactgcactccagcctgggtgacagaacgagactctgtttcaaaaaaaaaaaaaaaaaaaaaagaaaaaaagaaatatactctactatactctaagtttcttggaagaatacagtgaaaagagatcatttatatagaagttgtgctacacagaagtagttaataaaggaaataagatatgtgctgataattactttgccaaatgctttttgattcaggacaagaagttcaattatgaacttttcaaggcatttggttggatcctaagtttcttatgatttgtccatattctttgtaggtagctaagagctaaagttactaaatggaaatgacgccagggagctgtcaaaatctggtagtttttactttgcactgttactctttaaaggcagttggttgaggctttttcatccaagtgtgttaaaagaaaggcagagtaaggcagaaaagcagttgaactttttggagggtgcactaaaattggaacagaagttctgggaagatgtacattaggttgcacgcagcagataatgtgaggagaattctgtgctaacagtttctgtgtcactgattaatggaagtactaggcgataaatgtgctctgagcggattaatgggatttaggaatagcccagcgaactgggaaagggctgagcagctggtgatgagtgaatcacagggaccaggagggtcatggcccagagatagcgagtgccaggactctcgccgtgaggatccctgagggggaaattactgtgttccctcatttt

SEQ ID NO: 128927 - DNA, 1001 bp, Homo sapiens
gcatggtggcacctcccagcggagccatctctaacttgtgttgactgcagaagtttattttactaacttctcatgaccttatttaattttagctattaagcgcattcaatatttgactaccaaaatgtttccatacctggacttgtgcaaatttatatgctgaatggtttacttcaaaataactgtcctggatatcaggaagcttggtattgaaaaataaaattataaatttaggaagttggttcttacctggaacatctcagtgcttgtcatctgaacgcaagggttgagctagctggaggttggggagcgtttcttgtctttctttgagccacaaagaaatgttagtccttgtcgtattcattagttatttgtgcttagcttatgcacattaacatttggttctagattcttcacagtcagatttccaccattgagaaacaggcaacaaccgctaccggatgccctctgctgattcgctgcaagaactttcagataatacagctcatcatacctcaggaaagagattgccacgacgtgtacatctccctgatacgccttgcaaggccaggtagggcagaggaactcggcatttaatatggaacctctcttaaaaatttgcaaatcagattcaagaatttgtatggtgcttaggaatgataggggttcagggattatgtgtcagtctcgttctcaggagaggataagcccgaatgatcatctgatacagagtttcttgtttttttagagtctcccccgagttatttattatgtgagtctctttcatgaatcttagtattaacttaatcttggtggggttataggatgctttccttttggggtgaaattgcctttaagttatgcacttcttatattgtggtaatcgagccaccttgaatggggccagtgacagaactaatcagttgttttgtgtggaaaatgttatcagacagttctagcgcagttttctccctcttgatgcttttaaggtttggtctcca

SEQ ID NO: 128928 - DNA, 1219 bp, Homo sapiens
tgtatggaagcaaagagccttaaggccatttctacaagctagaaacacataggaaaatgtgcttttttctttttcatagaatgtaattgatacatagtgtaaactcagaacattaacacatacactttctgctttaaattagaaatgtaatataattataatgaaatgaaagcgttgaccattgtaaaacccagagagggtattcttaataggatctacacatcttttgtggtacctttaaactcatattttcgtaactggtgaatgttcatcttttaatatacacaatcctactctgagatccgattaacttaaggggaagtttttggtttttattattgggggaattctcaaaaaattgtattttggagtaagtgtgagtttaccctgttatcatttatttcgtgaattgctcttctgctttacggtaactcttttcatcatgccgatttctctaggttgaaaatgtccgcttggtagatcgagtgtctcctaaaaaagcagctctaggtactttgtatttgacggctacccatgtcatattcgtggaaaattcacctgacccaagaaaagaaacatgggtatgctttctttatttttagctttccttgttttgcgttgtttgaagcaaaaagtgtttgccctccattcatttttcctcagggtgagatgggtgggcttttgtgcctggatgttggggaactgtttctggaatgtgtgtttggactttttctgtgcagtcgtatctacttgatcgactattcattttaaacatgaattatttgaacatcagtgaagagagacttagaactagccagaagatacaagtgcttcctgtcacagctgtcaaggagagattcaataatgtcagtaggccagattcagcattgtcatcctccagtgctccatttgcaatagtctctatttgcagggtcctgtaatgcagccatttggtcattttattacattgcctctacttttctgataattttaaaaagaaagaaaatctagaggagcttcatcatcaggtatttctcctacttattaatgaaaccattagatatttgaacatcactaaataataataattattattattaatattatttttgagatggagtcttactctgttgcccaggctggagtgcagtgatgcgatctcagctcactgcagcctctgcctcctgggttcaagtgattctcctgcctcagcctcctg

SEQ ID NO: 128929 - DNA, 1052 bp, Homo sapiens
tcatataacatttctactcacagtggaagaacattgagaaaaaaaggactctgtctgaatttttagcttctcattactgtagtggtctcaaattttgtttctgcacaaggtctccttatcactcaggcactttctgaccaaggggtgggtatttcatttgagacactaagattgttctgcatgccgtgtagcgtgaatatcaacattaaagattgcaaaaagaaaagaagatggatggacggatggatgtgctaaatagattttaaaataaagtcaaatgaaagtctttatttttgagtacagcaagacgcttcatcaattcagttttaaatccaaatgatacttaattatgagagacagaaataactcaggaaatgttaccaagtgctctagggtttctagccagtgatttcctaactccccaagagaagcaaaaaagaagaagagctcgagatggggaaggaatctggaaaatgaaaaagagccactgtggctgggcagcttgttcctccaggctggtgggcttggtgccctcggccttgggatgcttatcacagtcctttgggaccagaacactggatatcagtgcagcctctgggccagcttcagaggctgttagagcatcattgctgctgtggctgatgcttcctttcctcagtaagtcacaaaagtcgtgttggccatccaggttaccgagtgacttaatttccagaaaatttaatattgagtcattattgtatgcattttcactgttgccattttgtatcctcgtaggtagtctatgaagtaccactgggtcacagctgcagtctgctagaaaggagagagacattaaagaccctttagatcccttatagaagtcaaaatgcagggataatgtctaaactgcctgctcccagcagttcaatttcagaaccagaaccagagcccaggcctcttgactcacaaatacttttcttttcatgttggtagagttagaaaatgtcatgataccaattttagcacaacaaactatttatctagctgcttttcttagattagaacataaactt

SEQ ID NO: 128930 - DNA, 2188 bp, Homo sapiens
gtgaggccgcgcccgcccgggaccctgcagacgtgggccagccatggagcacatccgtacgcccaaggttggtgacaccagcgcgggcggaggagggacgggaggagatgggggaggaggaggagggatgctgagcgcgcgggaggccgactgctttgaggggcaccggcggagcctggaccgcgggcgagggaggagcaggcattgcctgagcatcccggggtgcctgcgagcccggtcgttctcttgctgcctcccaggcctagccttagctgctgctgggtctgacctcttggttttgggggagcgcagtggacacaagggtgaacgggagggaacctcagttgtctgctagtaactgggtgtagatcaacccttctttctcctggcacgaggctttctcttttagctgttggccgctcagagtagttgaaagggaaataagcctttcggtgacaggtgcaaggaaaacgagctaaatgcagagggactcctgcgcttggaagcttgttaaatctagggtgtcaggcccacccggctcggccttcccagtcagcatcctcatcctgagcgtagcagctgcaaggggccttacacagaacggataatcaatattcattgtaggttgaatgatggtgtgttcttgccttttccagtccgttttgttcgttagagaaaaggatgcagcttacggattcgtcacgcactgttgtgttttaacaacaccagcttttgctaattaacaaaagcaaatggtccctgatcactccagtaaattaacattggaaacgttgatcgctgtaccaaatcttcctcctcagttgtactgataatctaatttagaatgaaaatgatgatcgacgttactgcatgataaaaaccctaaacgagtgaaagaatatgcttaaaaaccctattggctgtctgttgttactaccaccacagctccttgcgtttttgcaggatgaacttccattcaaaatgtaggcccctgacaggtcaaagctaggtcagagtggccatagctcaggtggttccagggatcccacacatttaagaggggtgggggcaattgctttatggccagcaagaattgattcctaaattttggaatagttcctgagtacctttttgtaaaagcagattaaaatgatctcatgtcattggaagaagaaatcttttagtttgctggagaatgtcagttccgacagtaaatttaaattgtattgattttgcactagggaattaagttgtcgcttcacaatcatgaaattgtaaacttagaagacaatgctacaaaccacagaataggtggctcaaagctttcagagtttaagtggtactaaataatttattccagaagggtgaatttaactcatggactctgcccttgccaagggcattcttcctccttccatgatgaagggagccgtttgtaaaagtgatagctgttgtggatattgatagcaagaatgatacagtgacatggcagtggatgccactttgttagagaatatgaatttgggggagtcaaggccttttctgttctatatacaaagccacctggtacaaagtcacgtgtgaacctgagttgcaagcagtgttcttactcttaaaattggtgtttatggataccctctaagcagtgcagtacttgaagtcagaaatccttatttatctggaaatggaaacaaattgggggaaaatggaaaattgtctgaagtgttactgaattgggtgagtcattaacatttgggataaagctggtgaaaaaaataagaaattacagaggttggatggatcggattcatttattcatttattttattctacaagcatttagaacctttcatgtgccaggctctgtgttaagtgctggaagcgtccaggaactcacaatctctaaggggaggcagttgtaaatatgtcagtgtatgatagagacatgtgcaaggtgcagtgggtagagagggagactgaagagaggatcagctctgccctcaaggtcaagggaagccttcttagaagagccgtcttaacatggaaggacttaaggaggactaggagcattttcaacagtggtcatgtacttgtataaatatatattgtaataaataattacaaccctaaagaaactgaaaacaataacaatggtcaaagataaatgattccttgaggttaaataaca

SEQ ID NO: 128931 - DNA, 1027 bp, Homo sapiens
tccctactaaaaaaaaaaaaaaaaattagccagggatggtggcacatgccacttgggagggggaggcacaaaaaaacacttgaacctaggaggtggggttgcagtgagccaagatcgtgctactgcactccagcttgggcaacagagcgagaccctgtcaaaaaaaaaaaaaaaaagaacaaaaataagatattaaaattcaagtttttaacagcagataattgcttttttctgatttttaaaaaatgactttgtaaaactagcaattatcttttcctggagttttgtctatgagttaaaatttaaaatttagctacagtctctgtatttatgagttaaagtgacattacttaaataatcaagtcataataattttcaatattatgtattgaaaaaaaaatcccaaatgtctgcctgtcttttataagcctaccttattttttttcaacttttatgtttttaattgagattatacgttttgtgccgaatagatgttttctgtttatttctctttcgttaattagcagtgtatccattttacaagtcattcctttcatcccaataacttgaggtccactgtggtttctgaagtctgctaagaacttgtgatcagaccgttccacccagactcggaccctcagtttcctgcatttgtacatatgtatagttaaatgacaataaataggtattcatcttgctcttagaagtaggttggctgtttttaaaacacacagtttttcatctaatgacaccaggacaaaaactttccatttgctgagggagtctaattaaagaaataaaaaagaaacttatctattataggaggaaaaattatttgccttctgaatagtgctagaagcacatgtcaagaagatgtgctaagaataaaaaaaaaagtcttgttctttgttttgtttaatgtagctgtgtgaggcagctgcaacccttcattttcatggaaacaatcccacacccttcttcaccccaaagagtccttttcgtccaactaggaacagatttttttacc

SEQ ID NO: 128932 - DNA, 1109 bp, Homo sapiens
tgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacatt

SEQ ID NO: 128933 - DNA, 1010 bp, Homo sapiens
aatgtatgcttttagaactccaaggaagtggaactggtattaagcataagcagggacaaaattttccactggccccgttcttcacattgcccactttcttttcctagctaagtggttcttacctacagaactgaaagtcagtagcctgaaaaagcacccactgtataaatgactaagagctcccaattgctcagatttgagagagggagaagtatgattaggccagtgtgccttaggactctagtgggagaaaagttgtaccaaggatgggtaagataatgtactacatgacaggacccctatttctacaaagtgcgatggtcacttttgagatgtccacccaactccagtgataagaacatagtattttctgaattcatgtaacagaactaatatatcactaagtgaataccttttctcataaaataccaaatagcaatgtggcggggacctctattgaaaatcatcaatgtcctgtaagtatgaccaacacgtttgataatcaagtgcctggtaccaggatgccggaaaacactattccccagagacagttattttctaccaatcacagcccataggccagaaggatgtcagctacttaatgtgtcttgtggaggccaaatctcttctggcaacaaagggattattccgtgctgggagcagagctgttattttagcaagcagaacatgcacaagggctaaatacgctgcaattgcttttatgagaagtctactttaaaattatctctggcctcacagcacctttttggcgtggtctatgtccacttggtggatgtctgctcacagcagcttgccatgggcacagcttgtatagagaacactctagccaagtgaaacacaggaatagaaaggagcagcagaaagagccctatgggctctctcagtccccaaggaagccatttctgactttgtctcacagagatccctggagagggctaccagagaaactgggaaaagaccacagggagaaggaaacttctagctgaact

SEQ ID NO: 128934 - DNA, 2060 bp, Homo sapiens
acttcttggcagtttttcagtgttcagccatgtcagttgaaactagatttttctgtagattttttacttacccatgtgagcctaacactatcctgtaattcattttctcaggctatgtgtaaatgtagaaccctaatttttctataaaaaaacaaactaactaactaactgtgtaaagaaagaaaaagggaagtaccaatgggtttttccaccttatttttacctttgatctacccttgcagatttaacctgtcttcttccctcccattattctcattttccttttacctttctccaccatccagagccacaaaagcaaaccttctacctcctacctacttttctctgggacaaggataaaggaatatgattttccagagccccagagccagctcatcttccaggtgctgaaaccactttccaaataaactaaagcctggatttgatattacaaattttgggaaatcttagaataaagaacgagaacaaggaagtcattggctagtataattaagaaaggtaggattcagtgcttaccgatgatgcagtacttgatagaagaaaacagtctgggaggatagcgctcatttttcagttaccctttaaggagtccctttgtctttgggaaagtagcagaatggtccgcttctttcccatgagtggaaaatgtggcttgtccaactctcctccaggttgcatttcagtttctttccaaaacttattacctcccctaatcctgagactttggaaaaggtggaaggaagaactgttgctttatctccccctccctgcatgtgtcaacattgtgatgtcagtatttactaatctacattcagtggctgtacaaataacagctgtagtaagaagagattcaggatgctagaggtgaatatttgggtcatttacatgtacactacatagcaagttgatactcatgttgcatgttcttttaaattagtgattttgtgtcttaagtctttaacttccaatacttcatcatgtatgtaaccttccatgtttgcttctgataaatggaaatgtaggttcactgccacttcatgagatatctctgctcacgcttccaagttgttctcaatgacattagccaaagttgggtttgccattcatcccctaggcatggtaaatcttgtgttgttccctgctgtcctccgtattacgtgaccggcaaataaatctcatagcagttaatataaaacatctttggaggatgggagagaacaggagggaagatgggaaacaaaatagagaattcttaagattttgtttaaaccaaatgtttcatgtagaatgcaaaatgttggcacgtcaaaaatatgaatgtgtagacaactgtagttgtgctcagtttgtagtgatgggaagtgtattttactctgatcaaataaataatgctggaatactcaagaattgcatcctctgacctacttcattcttcaaattcttcatttttacagccctgtgacagcacagtaaaggtcgtatctcctcttagtttatatttcccaggaatttccactgcaaccgcagagttggtcatgggctcacagagctagagtgagaggtaagctcttcttctctaaattcaaagctatctatgtttgacaaataaattttggctggctgtaacaatttctgctgtataagaaaattggacaaacttggtaaatatttttgaatatcgtaaaaaatgtctaaacaaagttgaatgttcttaatctatgcatctatttcatattgaaagctaaacttctaaaaacttgttctagttattgaatagactaatctacaattacacctttgagtgcagcagtttaaaaaaatgaagtgtccttgaattttttcagtaccttcataaattaactcacatttgttaaagttgctactaagacaaaatgacatttctaagcatttgagtctggagttgttgcttgtgggtaagtagttgaactgtatctagtacattttaaaattctaatatattgcggtgatataaaagagaatacttggtattgacccacgtatcaccaccaccaagtctt

SEQ ID NO: 128935 - DNA, 1064 bp, Homo sapiens
ggtagggaaggagacagaggagagttgagcggtgaatcccagttgcgttgctcttcatgcattctttgtgtgtgcacatgtggggacagagtctcgcgacattgcccaggctggacttgaactgctgggctccaagtgatcctccacctctgcctcccagagtgctgaggttacaagtgtgaaccactgccctgacctttgtatgtgttgaggagcctttaaactagagcccacgcttacctgtgaagctgtgacgtctcctaatgtggttgctttgcgtattcaacttaggacatttggttttactgttaaaccacggttttgtttgttgcttacagtttgacaacttaaatgctgcgcatgaaacctctaagttggaaattgaagctagccactcagagaaacttgaattgctaaagaaggcctatgaagcctccctttcaggcaaggatgctttttttcctctttaaacagaataaaatctgaaggaaccacatgatgttttaagatggaaatgattcataacttcctgcttcagcgaatgccctgtggccttcaggctggggtgttcttggttcctttttgcgtggtttattgttaacagatgccttttcccactaaggatgcaaataatagttacaaatgccagccttgtgttaaataggatgggctttggaagactgtaaaggccattttggcggtggtggttgccagcttaggtccctgggaagtggcaagtacaagtttctatcttgtaatccacagtaaaggatccaccccaagtgctcctgcacagcagtgttgctgtgaaatgtcgatgccacttattgaatagaaaaatagtcttttctatttttcatctgtcatcagtgggagggtgtaagccattgctttcagaacagaatcggcagtgtcgctcacagtctttctactaaaccagttgcatcttacagagcagcgtggatgagtgctaagaaccggctgtgtgaccttcagcaaggactttctcaccacaaaaatagagttgcccaaagtcaggcagaggtgataatgtgtaaaagtga

SEQ ID NO: 128936 - DNA, 1008 bp, Homo sapiens
aaaaagactactttgactttgtgtttgtctaataccttctttcaaacattcgcatgtccatgcttgcttgttgcaaattcgaaacaattttatgtttggttttggctttgtggggtgtctgattaattgaaagtgagtggaattctggagaatgagcaagaagagactaggctgaggataggagtgagagcacacacaggtggcaccataaatctctcctaagctgtagtcagtgcacaggaaagtccatggcctaaaatcggggttatgcacgccccccaccgccacacacacacgtttatgtcacagctgccgaggagcactctgagaacctttaatacagcgtttacatgtgcatcctttaaaaaatacttcatgagtctttatgccaaataaatgtttccttcgcagcccaggccacttccttcaaacgaaagccattagtgtgagcgattactgcagcccagctgttccccagcagcacaccgggccagtaaacagagcaaaggtctgtgcacagctgcaggctgatgtcactgtctggggctgggcctgctgctttggactattacaataacagcagtgaacctcctgttcccccatctgacccattttctccctttctctttcccgtttcttcccatgtgtcctctcttcacctcacttatcaaaacgtcagagctgccttttttttttttggtgaatagagggaaacagccctgtcccatggctaataggaaaggacttctgtgtatcctatttggttttaaaggctgatgtgccacaattacatattcaaagcgacagtatttttatcataaacagatgtgttaaaatcagccagggtagtctgctattaacgtcagcttcgaagctcttctagcccagggcttggaggcagtctcttgtttattgctgagtccctgagttcacttagatgtttctgtcccagatatgagcttccagatgggttcagatcttgttcctgcttttttattttttaacttt

SEQ ID NO: 128937 - DNA, 1052 bp, Homo sapiens
catgaaaattatgagctaggtataacaacatcgtgtgtttggtgcctactcatccctaacaaacaatgttcagctctcagtctacttctctgcattgtatttataaaaaataaattgtggctcagaggttaagtaacttcccaagggaagctggaaagcaaagagcttgcataagaacccaagatggctagaccaccaatcttctggtagtcaccacagggaaagtttgatgaaatgatttaaaagattggaaaactatttgaaataaacgctcgtttgcattgatagctacttttggaatatttttcttctaatcaagagtttaagaaatattgttaaaatgtatcttactgaggaaagtaacttgcaaaaaacagtacattgccaaaagcagtatacacattgcctaatcaacacttaacccagtgtctatgaacttcacattgcctcacgccatatggaatgtgttgattcattcactgttccgtttttatctacaattttggtttaacaaggctatgtatttaaaataatttttaaactctttacaggtaagtcacttttgagttgtaaaattccagaagtgacttttcttgaagtaggctttaatgaaaaatctattaatatactgaaaaccaactgtacaccaaaacagggctgtttatctccctgacttgtttgaagactgagttgatagccacctcagacttagctcattctcttcctatccacatctgccctcaatttggactttggttggctgtatttataagtaaaaggccatgttctttcacctgcagatatgcagttttaccagtggtacctgtgtttgaaacccactgactgttcctccttgtcctgttccttgtcctaactccagtctctcaacttgggattttcctaatttaataccttattgtgtagaatagtggctcccaaactttattgtgtacgaaaatagacctggttgaaatgcagatcctcagttctcatgcccattgcttctgacttggttggctggggatgaagtccaggaatctgcactttgtttt

SEQ ID NO: 128938 - DNA, 1121 bp, Homo sapiens
tgctattaaataataggtattaggatgtatgcagcttgacagctgtgtagtaattaaccacactggctgttttgtgagggcatcatctatgctacagaaaggaataatcattagactaaatattcctagaaatcccaaacgacaggctcttcaaactcaagtggaaatgagacctcatcagagtattctcctgatccagtagagtgtggtgtgtggagtcaaagcctaggtttttgtccatccactcctagttggatgttacctaacttctttgagtatggttttttcgctggtgatatgaaatcagtatgtattttgctgcgttattgtggagcttgaataaaatagtaatgcatataaagcagtggtgtagtgcctggcccatcacagcaactcaagaaaagagagctgccactatcgccgtcatcaaagcacccacttcttccctccaaaataatgggggtggggcgatgggagttggtgtcactctcccattgggtaatttttcttcaccttctcaatgaaagttgagacaaggtacccaaactactaagaactgcaaagaaaaaggacagttcataaactcaggagcactgaaacccaggtagagtctgtgctttccaccttccgcatctaacagcctccagctgtcccagcatccactgactttcccgttgttccctcagtctcactgtggcagtgtccaaagcagcctgtgtgtttccactgtctgagccacactcccttcatggaagcactggttctttgcttctgcagaaactcttaaaagtgtccctttggtccagtgattttttgatactctacgttgatgtctttactgtctcgtgttttcttgttaccttcaggtataaagtccataattgtagggattcttttctgtttcctatggaaaaataatataatatgctttctgttttcttgggtactcgataaatatttttgggtattttaagttttaaagttttttttttttttagaacaatgtatgaaaattaagatttttaagtgaaaagaaaacagccggcagctccactgccctgacataactttatttgcatattcccttttcttagtttatatgaatatatacaacttcatac

SEQ ID NO: 128939 - DNA, 1483 bp, Homo sapiens
ctgtagtggcagacatatttcattacatatcagacattcttatatctcatgaatctgagaactaatgtcacactctgtttcgcagaagacacactaaagttattttagtttttttctaattcttggtttatccttgcttagttagacggtattctgcacagacagccaaagtgaacaacagtattgatggtagtaattaagcttcttcctaaaagggtctattgggtggctttctaggtaaacttgaacagggctgaggtcaccctccccaaacctctaattcttcaaaatgcctccacatcttttttttttttttttgcaagtggaatttaacctaaagtagcacctgaacaaaggtgaattttgaatggcactagcagtaaagttgacttggaacaaaaaaacatagatgcattgagcaaattcactgtgtgggtgatggggaggaggtcagatgcagcacacgtctgagccatctgatgtggctattctctgcaagatgctctatgctgttgatgctactcagtggctagcaaaaatgcaggcacaccgatgggaccacagccagagactaagtgcctgtgtcccagggactcctaattcaattatggtgaatccattttttttttcttgagcatttcatatatttaatgcctgagcataaaggcatctttatatccagatttccacctttctcttttttcacattgtgtgtaattctgcatgttacaatacaaagagaattgaatcaacctgttatctagacggttaagagtttatcatctaagagagaaacactgatctaggagcagctgagtaaaaagaaacagtaaatcagtatctaaaggacataatgcattttatcatctacaagtaaagggtaagtacatgtaaaggccaagctaccagggagagtcaggcagaaactaacccttagtatgtgtcttttacagtatgggcactggggtcagcatttcatctatggatggtatttaaagcccttggtttttttcattactgcttcccatccgatgaggtcatctgccttgatagatgaccaaaagaattgagcctggatgttctagttctaggtaggccccatgcttcttgaaggcagggaccatgtcttaaatttcttttatattttcacagcatctgctatgaaaaatgcttagttaattagtttgaagtaataagttaccaaccaatttagaagggtaaatggtctatgcatttggaggaggggaatggtgtcacattacaagggaagaaccaactgacttttgcacaacccatttagacaaagagtgaaagatgacctcaaggttttcctgttactgttactgtgcctgacagaggttggaagatgtcagtagtttctgaggcattaaggacaggaacgtggagtgcagtggagttgaagtttggggaaatgtcgacatgcttggtgaaactccctttcccaaaacctcccttaataagc

SEQ ID NO: 128940 - DNA, 1053 bp, Homo sapiens
gtgtagatgagaaggttcccatcgtttttcattggatagtttctcagtcagatttgacagttaattttaatatgctaaaagatttctgtatactaaacacttctgacagaaaacatcctaatggttatggggaagtagtaagtgaatcacaaatctagttttccaatcttcataataaaagtgtgtgcagtctcaaaatacttcccctgaggtttatgtttgtatctgcttattattttcggtgcctaagatgaaaataaatttagtatatattttaggcacgtggtgacctgtctgctcacttttagggcattgggttggcctatgttgctacttttgtcctagatgattttacagctacagtaaattaaatcagttttattctgtaaaatatgttagctggggtgtttttatatttgttttgggctgaatagcgttaggtgtcacaggaatgtttgatgaggatgtaaatagatttttgtttctgcttcatgtgcacgtgacccctcgtgtttcttattttccacgtggctcatctctgtccctggtgatttgttttcagctgactatttttagttttcccagaggcatctcccttctctgtgggagaattctcattttttccagcacctctctctcgtgtttcataactccccttgacctgtcatttgattttgccagcctctccctttcagtctgagctgacggtaaatggggggaggcagcgaggaggaggtcagcagtggccctcctctcccagctcagggccgctgcagcccttccaactgaacaaattaataggggggaaaaataacaaagggtgccctatatttgcaataatttgtctgatctaaagtagctccaaatagcttttaattttaaagagttcttttaaaaatactgtaatccacgctccaagttaaaaatcaaacagtatggaaggttgtgcagtcctaggcaagcctctctcttacccagagtccctgtctgctctccgtggagacagccgctctcagctgcttgcatagtgttcttgcacgtttccagtcacat

SEQ ID NO: 128941 - DNA, 1177 bp, Homo sapiens
tatttaggtagcaggttcgtgagcatcaggagaatgtagtttcagagatgccagaggatacgcagcctgtatatttatttcactgataagtggaaacatttttactgcaagaaagagttgcaagttggagtgaagatcatttaagtttggcaaataaactgtgtggggagtaaagaagaaaaggtgagattaaaaaaaaaaatcttaatagtatagcaccacctggtgttagaacattaggcatttttcaaatgaaatttttgcttatcaaattgcatttttcttcctgtttgggtgattttaaaattttccactcaggagaattttgttaaagttttcagttaacgtgagttctgttttctgtgtataaatgagtgaatttcctgagatctctctttcattccaaagatgtatttggacttggttcttatttatttcttatatgatagcctattgtcctaatggattattttttttttagtcaccagtatggggggtcgtatcaatttgtttatttttttatttcagttttgccaaaagctgctttctcatgattattctgattgatcatctccttcagagaacatgtgtgagttaattactttaggagacagggttactcctacacttctcatatcctaattgcctcatcatttctgctctcttgcctctaaatgatcaaaaataaacatgtctgcgtgaagctttcatctttcatctgaagttacatgattgtgaacattcattttgtgttttgactttgttgttagtgcagaagtttgagtttacaggcttaaaaagtgccagctttcgggatgaatagcactggaaactttttgttttttttaaaccccaaggaaagcctacatccttgaaaactgcacagtcgtcatgggtgaatttgcctagaccacttcctaaatccaaagcatctttgaaaagtcctgcgctgcggaggacaggaagcaccccctcaatagccagcacccacagtgagctgagcacttacagcaacaattgtaagtcgactttatatcacacttcgggggttgtggaaacagtcattacaagaaaaactaatgctctgcaaataattagaatttttgtttctggggtttcaggaaaaataggcatactgcttccttggagttgctctgaaagtttggcagaaaaaaaa

SEQ ID NO: 128942 - DNA, 1008 bp, Homo sapiens
gtgctcctgccagggtgacagagcgagaccctctgaaaagaaaagaaaaaaaaaaaagttggtgtgaagttttgaggtctcaatgatctcaccacctcattgctcagtggagctctgctcataaaccttgactcctaatgagccaggaggctcactgtgcaccttcttttgttcttatcaggcattattagcataggtgtcagatggtaaataaatttgctggtgaacatgtgaagacccttgtttatctcctttgtatggtagctgggaaaatgaagcaacacctttaagtctttggtttattcccctctgaatttaaatgttcctgtagttgtgggacacatgttccaggcctgtgactaaggcagttatttttgtttaatccccacctgaagccacagacatcttgtgaacatacttgcagaggcaggtactgacagcatcaccgagaatgctgcgcttctgtggagttcgagtcatcgtgagaacttccctttgtgggactttttgctcctttgtcaaattactgcagtcttaagacttgccgtgtttttgttatgactcacctgtgttgctctgcctttgtctggggagcttacccttgaatttaagcaaatgaggatagttatacagagtcctattgccttgatgaactcaagaaggtggaatagtaaaatcactatttgcaacatataaatctagagtgttactgaaatattctgtgttctgcaacgtatttacttaacagatagagcgtgtatgctaggtaagtcatgtaccagacactgagggattgtgggatgagtaagatgtagtttttgccttcttggtattaactgccaaatagaagaggtgacaagttcttgtttcatcacatttgttcttataatactaaaatttaataaaaagaactgtaggattttggaagagggtgtaattacaaataccaaagttcgcttaatggttttctttctgtaatataggagattatataatgtaatagagtta

SEQ ID NO: 128943 - DNA, 1062 bp, Homo sapiens
ttcacatacttgaataaagtaattactaaaaatcagaggttattacccaataagttattctaaaagccaagttgaggccggacatggtggctcacatctgtgatcccaggaattagggaggatgaagtgggaggattacttgagcccaagagattgagacccacctgggcaacagagtgagaccctgtctttacaaaacattaaaaaattagctgggcaagtggcacacacttgtggtccttgctactcaggaggctgaggtgggaggatcactgaacccaagtggttgagggttcagtgagctataattgtaccactgcacttcaggctaggtgacagggcaagaccctgtctctgaaatgtgaataaaatttaattttaatgtgtcgctaatagatgtttctatatttttatgtaattaaattagtttccttaaagtgtgtatcaggatctcttttcataaaaatagtattagtcactaacatgttttgagtgcctgtgtgcgccaagcacagtgctaagccctcttttaaatgcataatctcatttaattcccacaactcctagtagggatactgtgataatcgccattctacagatgaggaatttgagggtctgaaagcttcagtaacgtgtccaaagttacacagtggggtaattggtggagacgggaaatgggccgggtgttctggccccacagtctgtgctcttaaccctggtcctttacgtgcatgcagaagtcttgacacactcctgtcttctttcatggacatatgtgaattcttcattaaaccacatatgtgtgaaggagaatgtggggaaggctggtttgtgctaagaactcttctaagtgctggaatgaagtgcacagaagagacccgttccttccattagggagcttaaattctaataaggggattaagaaaataaatacatttttggattcatgatgatgaatccaaaaataaaagagaaagagccaaacatggtggctcacgcctataatcccagcactttgggtggccaaggcagatggatcacttgaggtcagaagttcgagac

SEQ ID NO: 128944 - DNA, 1697 bp, Homo sapiens
cctgcagaaggacctcgttattaagtgggctttgactgggaatattccatgaagaggtagttgtgtcattctttgcctgcagatgggaccggcgctgatgctgaatggcttggcggcccagtaggaacctaagcaccttgacttcactctgaaatgcctgcgtagtcatgcgactcagtatcgggctgtgtgtcttgtcacttttatttttaggcccccactggggtaacccaggttggccaggctgcctcaccaggagactgtacctgagctctgtttgcccagtgcctggtggccatgggtccagatgtttgtcctagtaatttattctaaacagctacatcgaaaacatctttgtcagcatacttgctgtggttactatgataattttactcttctatgatataatgtctcttttatgatagttaagttaatagagtgagaatttcattgaagattttaacaaagaacttgcaaacttaggaaacttgttcatatgtacacatggctgctttctgtgcgaccatctagcttagaaaagcttccacctggcaggtgtgtagggcgtgatgcatgctgtcgtgtagaccctttacatttgaggatttagcatttgaggtctcagatactcatgatgcagcctgaagtttcaggatcccggaggtggtacggtatttttctcctattctgtagattgggaaggttgaggtatccaaaggtgaagccattagctctgactcttctaatttgtggtgttgctttaaaaaaaaaattatggtaaaatatatataacatgaaatttacgttttcaaccatttttgagtgtacggttcagtggcataaagtacattcacaaagttgtgtaactatcaccagtattttcagaacttgttcatcatcccacacagaaactgtacccatttaacaatagctccccatgttcccctgccccagcccctggtaacctcgaattgactttctgtctctattcatttgactactccaggtgctttatgtaagtggaatcatccaatatttgtccttttctggttttttttttttttttttttttacttataatattttcagggttcagccatgttgcagcatgtaacagaatttcattcttttttatggctgaataatattccactgtatgtatagatcacattttgtttatccactcatctgtcagtggtggccactgacacctttgatggtgtccactttttggttattgtaaatactgctgctgtgaacatggatgtacagatttcttggagtctctattttctgcttttgggggtataagagtggaatgcttgatcatatggcaattctatgtttatctcttggaggaaccacagaattgttttccatagctgctgcaccacttgacatttccaccagcaacgcaagggggttccaatttctccatatcctcaccagcattttgatcataggtgtcctaacgagtatgaagtggtatctgattgtggttttgatttgcatctcgctaaagactaatgatgttgagcatcttctcatgagattcaccccaatgcctggtggcatcacctccgcttccttttcttcacattttagaaaggggtaaacttactttcattttcttccccagtccttatcctcttctgatttgagactgaggtggtactagccagaatcaagtaggaaaa

SEQ ID NO: 128945 - DNA, 1107 bp, Homo sapiens
atggagttatagagtatggagacttttgtgtgtgacgtcttttgcttagcgtatgtgtttgagatacatctgtgtggtttgtgtatcaatggtttacctttctgttgtggagtggtatttcatcagatgaatgtaccacaattaaaaaaaaataatctacccgtgatggacatttgggttatttcaagtttttggcaattagatttttcttcctagtttaataacacaggcaagataataaaatggcatcagtgacccacagctccatacccccacccacatctgtttttgttttcctgtgttgctttttctacatattttacatagcaggaatcataaaacacaaaaatatttttcctagttttgtaaactgcataatttataaatagttgcattttattgaatcactgtactgtggttttctaattccttcttgtcaacattttcatcatttctaagtcttcacagatgtggaaaatatactgaaaatctgctgaaatatttcctataataaatttctgacgatagttttcttgagactcttaatggaaagtcataaaaattcaagcaaatagggacaaaaactggatgggtgtgataaggatatggagtccttctaagaacttagtgtctggcaggttctcaggaaccaagtcagtgaggcaatctaaccttcactgtttttcatttctgctccccttggtatgttggtcccatccacgtctctgtagagatttgctttctctgcttttgggtgtgtggagaaggtggctgatgcacagcgcctggatttatgttatttagttccagggacacactgtgcctgacatctttttttttttttttctttttctttttttgagacagtgtctccctctgtcacccaagctggagtacagtggtgtgatctcaactcactgcagcctctgcctcctgggttcaagcgattctcttgcctcagcctccaagtagctgggattaccggtgtgcgccaccatgtctggctaattttttttgtacttttagtagagatggagttttgccacgttggccaggctggtctcgaactcatgacctcaggtgatccaaccaccttgacctcccaaa

SEQ ID NO: 128946 - DNA, 1096 bp, Homo sapiens
taaaagtggccgggggcagtggctgacacctgtaatcccagcactttgggaggccaaggcgggcagatcacctgagattgggagttggagaccagcctgaccaaatggagaaaccctgtatctactaaaattacaaaagtagccaggtgaggtggctcattcctgtaatcctagctactggtcaggctgaggcaggagaatcgcttgaacctgggaggcggaggttgtggtgagctgagatcgtgccattgcattccagcctgggcaataagagtgaaactccgtctcaaaaaaaaaaaaagacaactaaaagcatgcacagtctgtacatcaaatcatttctttagcataactgtacagtctttgagagtgcctttgataagccctgggggtagatggtgcttttaattatttacttctatacaaacagctcattgtataaaagtaaatactttggacccagtactatcctgaaacttactgttttgcctcttgttcttttttactgattttcatgacaaaggttactttctgatggaattttgaaaatcatctacaatatgatgtgatatctaagagagcaagggctttattttgttccttcctctgggaggagtatttagaattgtgctttttatttttgttcaataaactgttgaaggaatgttgacttagattgagaaatatagttgagattctcagaagtcggctgagttaggactgcaggcagctggcacatgatccttcctagcctgcttttcaaggtggtggtttagtctgtggctgtcgtaccctactgggttgtggacagagacctacttcagtggaaggttctagatgaatatgttcaggatgtaacagtaaaacatgaaattctgagtaaagagacagaaacggtaactagtagctatcgtcaacatttaagggtttctgttgggtaggaaggattagttggcaagcagattacagaaaaagaatgcggaaaaaatctgtagattccaataagaattcatgaatatgtctcagaatacacactgctgttcactaccacatgatctttgaaacaatttttgagataacattaagtgtgatgaaa

SEQ ID NO: 128947 - DNA, 1028 bp, Homo sapiens
gcttattaggctgaacatttaaaaatgtataaccttgtagatatataatcaaatgaaaactattttctccttatatggtgtgagttgttttgatcttgaatgattagccctccatccttcagtgctagggactgcttttcttctctccttcctcctgtttttattgaatttcaaataataaatagaggtatttcaccatttagctagattttgcccaccatgacatccattatgaaaccctggggacatactttattatagaattggaaaaatgtaatgggtatccaggacatttggtgcagtaatgtcatagagagtgcacagacttaacaggcaaaattgggttcatgtctgagattttcctattagccatgtgaccttgagtgaaatttcattacctttgctccccagttggctcatcaggacgctggaaggtgggggtagtaccttgtctcctggggttattctgacacaggtgccaggtatatagaaaatgatcaatgggtgctaataaccttccttagtctctagttttaaattaaatcttctgattcatagataggtgtttcatttaatttctgctgcttagccttggaggtgttgcttggatctgctggtgctgtcggttgggagttaaattctaggctcaggaggctgataactttccctcttccttaggaggaattgatttgtagcaaacattggagattgtttattctcagactccagctttgtcacctcttgtttttcttgaaagtttaagtctagtgagctgctgatactccatttgaactgtgttttcaaaaaatcaatgtagatacttttatctttggtaaagtctgtaaattatgttgcctctttgctatcagtcagcacattcgaaagacaattgagtcatcactttgaactaatcttggacttgtggatattacagtactaaggttccctgttctgatttttcacctgtaacatagtccagaatatttgtattttagagtttcaattgtaaaatgttactattaatatac

SEQ ID NO: 128948 - DNA, 1132 bp, Homo sapiens
gctttttgtacattggaaacatggtaatatttaactcaggtgttatttacacatataccaatctggatgaaaagaatcaatatttcttcaccttatttcagataagcagttcataggaggtattcagcagtgttcagtgacaaataagaaatttattttccttaatgtttattttgtagatttttgcatgattgttagctatgaatgatacgaagttgaaactgcatgtcctcgtaaaacatagctcccttggctagctttacggaatgaaaatagaagccagcatagatatgagcagtttctgagatgacattgaaacatagacctacccccttcccctgacctctgtgtcaaggtggttgagtcatatttcccagaattctgattaagtcaccttgcactgttaaaatcttattttttattatactgtaaactgctatactgttaatcatttcgttgttaatcaaattacagaattgaaccatatttgcttattactgtgaccctaagccaacaggctttaattgaagtgaggattgcagaagtcctccttgctggtgggtcaggatagggtagaaggatattggagaatgagaaatggatttaaaagggctgagccatgccaagacctagctaccaagaaaaattcacgtgttgtattagatccccaatctaggccccacatacagaaccaagtcatttatacgtagtgtatagttaggcttatatttcatgtaaaatgataaataaaaagcatgagtaaaaatccttgctgttagaatattatgtttgatttttttttcttttatctttttttttgagacagagttttgctcttgttgcccaggctggagtgcagtggcgtgatcttggctcactgcagtgtccgcctcctgggttcaagcgattctcctgcctcagctttctgagtagctgggattacaggcatgcaccaccacgcccgtcttcattttttatttttagtagagacagggtttcaccatgttgatcaggctggtctcgaactcctgacctcaggtgatccaccggccttggcctcccaaagtgctgggactacagacgtgagccactgtgcccggcctgtgtttggttttcctcagcctcagccatt

SEQ ID NO: 128949 - DNA, 1566 bp, Homo sapiens
tggacaactttaaaaggaattgcataaacggaattgcaattctgtagacagtttgctttttcagggatggttagggcaggaaatgatacacaacttaaaatggtgatgtcctgttagtacagtgctttacagtgtagaaagtgctgttacagattttttttttttcataggcaatatattccattaggaaagctatacaaagaaaagattagaactacatgcttatccttaaaaccaaagctaaaaaaccttagaagtggaatttagtttaaaataatatgtagttatttatgtaacttgcaccacgttttttcacctgttctttttaaaatcaggtttatgaagagaaaataattcttggtaaatctgcttggtagaaaatcatgcttggaacaagaccttttaattatgtcaataagtcaaggttacattttggagtataataggattataagattctagataatatcttatattttttggaaactaacctgcagttattacactcaagcatttaaaaagcctgttacttaatagccctgttctgttaaccctgtttgttttgatttcaaaagtaatccgtgcttgctgtataaaaataggtagattgagaaaagtgagttaagcaatttcagcaaagataatcacagttaatatttaagaaaatacttgttaatatatagaaaaattttttatagttatatagtttatctaaatatactattgcgtggaggttttttcctgattaatgtatcatgaaaaattttccatgtcatgaaatcttcagaaatcttagtggctacttaatattacattacatagatgtatcaaactggttttcatttatttccacttactaaatatacttttgcaacaaatacgtttttaaaactttatgtgcagggttaatatccttagtgcccttgaaatacagttgatggttggaagatctcctcatacatattgaccatttgctttccaaaaaatgtttaaccaaattatgttcccaccagctctctgtgagaatactggtgttaccgtattcttgtcaacatgtagaatcatccttaaagggaaaaaaaaaaaattcttcccaggtttataggtgaacagtgctttctctatatttaaacttcaatttctttgattacagatgatttgaacaccaaagaaatctagttgttttccattttgaaatttgatgtagtgccagatttttctcctgggatattagtatttttccattaattcataagagccttttatggattgatagtaaatctttgccattcatattgcagatacttttcccattttatctttgctttatatatttacagtagttttgacatacacaaatttctttaatgttgataaatctgttgactttctcaaaacagaatttttaacacttctaaatcgtagcttcagaactatatgtgactgtggtagaagatttaaaaaaaattttccagccgggtgcggtggctcacgcctctaatcccagcactttgggaagccaaggcgggcggatcaggaggtcaggggttcgagaccagcctgggc

SEQ ID NO: 128950 - DNA, 1022 bp, Homo sapiens
tcccggtcttggctccttcttccggcacgggccggagctgacacccccacggaaaaccgcacagcgcctccgctctttctccacgggctgagggatcaatgcacttccgcataggcctagggccccacgctccgcgatcagcgccggaagcgcacggcatgctgggatttgtagtcctccacctgtggccggcaggcgtttagaacgcgaggtctagttggcattctgggatacatagttcctgggcgggtgggggcggattcgttggtgtaatctcttttcggcttaaagagccagaagcgacaccacagactccggcgggtcacatgactccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggtaatgcctgcgcgtccccagcccttggcaacctagggcggcgcgccccagaggcgggagagtaacggctccgggacactcggccctgttgggtctggccacgggcccacgcctcctctgtaggttcccgggtcttcctgccccgggcttcccgtgccctaggcggtcagtccgcccgctccctcaggactgatcgccgggatccccgggtgagcacctcgcgacgcgttggtgattgcaggactcccttcttgcctcctcgcccctcctgctggccctgtcggggaggctgttctgcgtcccggtggctccggctataccccttgcgggcggaggaagcggagcggggactctggtttg

SEQ ID NO: 128951 - DNA, 1025 bp, Homo sapiens
tgaggacccctgaacaccaatataatacagagtttttgaattgaaggtaaacctggtatttatgtagtgacgaggttattttattatgaagtacagtagcttttaaatgagcaaacatttttaaaatcatcggatatacgaggttgttacatagtttgagtaacaggaagctcgatcaatcagaggagtaaactttggcatagactattaaaggatagttagggctaaccatctttgttacactgttccgaaatagatatcactttgctgtttggtaagatttcagaagtttaggggatttaagcatttatgcatatcacactattttccaaaagaattgaggtaacttaaatttaaaatatgaataagttatatttttccccttcttttgatctttctaaacatactttagaccaaaactgaagtattttttattctgtatttcatagcgtaagtaatttacttaagtgatacatatttttaatcctaattaggaaacagctttgaagtgtggagcgggaaaggagcagtttctgagctgcaaaaactagtttctaaacaggtaatttgacattattatctgtattatcctttgtattagagttggagaagactttatggtggacactgctgtcacagttacagtgcatgactgaggatcctctctgcttagtaaacaaactttctgggttcaccgccctgtttgctctgcttttcggcgtgctgctttggcctgccggtatatctttgttcggaaaggccctgtcattcctaattattaattactagaatggtttatgcagtaccgtttgaaatttatttgtcttcacagaattttttcaacctgtttgaatttgtcctataactggatagcctctctttccaaatccatttaatctcaagttctctcctacaacattcctattaattggctgttcatgaactctacttgtcgaacttgttataccttgaccgaaatttagttgtctaaaattactttattattattttttgtacttcgatct

SEQ ID NO: 128952 - DNA, 1050 bp, Homo sapiens
taaaagctttttagaaataattgctcttcagaaaaaaacctcagaaataaataacctaaatttaattctactcttaaaattttaagaaagttcattttgaaagttttgtagaaattggctgggcgcagtggctcacgcctgtaatcccagcactttgggaggccgaggtgggcggatgacgaggtcaggagatcaagaccatccggctaacatggtgaaaccccatctctactaaaaatacaaaaaagattagccaggcgtggtggcgggcacctgtagtcccagctactctggaggcagaggcaggagaatggcgtgaacctgggagcaggaggttgcagtgagccaagattgtgccactgcaccccagcctaggcaacagagtgtgactccgtctcaaaaaaaaagaaacttttgtagaaatcaatatatattcttgctttctacaaaagcagacagatttttattttatagctctcctatgaggacctgaaatgagactgtcatgagaaaatacgaataggtagttgatgtatatcttaattataattctcagtgggtttttttttttttaaactggaagactaacaaaacagggcaagaaaaatggaactcaagggaaaggtcacatgtgaatgtgtgtgttagagttgttaatactacagtgattgctgtatggtgggctttagtaaaataaacaataattacaaaattagttataagattttccttttagcacattggggaagatgatggataagacgaataaaaataaagggtaattgagttaacttaaattggaagacctgggttttttcaataggagatttggccatttttttctgaaggaggaaagtggatttgagacttggagaaactagtaaggctgtgagattcacagtacagaactaagaagacaaccagaaatacctatcagtactttcatttttacggatttgagtgctaggcaacgtgctatgtaatgactactacagataaaacagtgtgcaaaacagacagggtgcctttcttcatggagtaaatttacat

SEQ ID NO: 128953 - DNA, 1083 bp, Homo sapiens
caaatttaatagtttcttattttaatttgcagctggactttatatattcgtatttttttttgcaaactacttgttttgcttatatttctccggttttatttttttaaaacaaattctctgtataacaaaggtattaactatacttagtatttctttgagatttttttttctcccaagctctcatttactattctcagcacacttaggaatttacttttatgtgaataaaatctgttgaactttttattttttatttctttgtgttctaaatttagtaagttctctgtttttaaaaaccattcaattttcttgtctttttaaaatcttaattgatgtttaaaattctgttttaatctttgactattttgatagtatgatataaggcagcctttctcagttgggagagaattaagctccaataccctaaggcatctgttgtttactgtgaattaactttttttctgtgtgtctgggatggatggtactggatatgtaccatccttgggagaattgagaaagtagtgactcaaacgatttttcccctcttctatgattgaggtgaagaataccacttaaggaagactgttaaagctctaaatgtatctttttcaaatctgttagcaaattgttgtatcagtgctcactcctacatcatagaattgttgtgaggctttaatgacataatggacgtgaaatattttagcatggtgtttggcatgtggtaagcaaaataaaatgcgttagctgttactagtttttcttactacatttttctgattacatgtatttgagggtttttgttcctgagctagtactgatttaaccatatagacagcattgttgaaaccatatagacagctaatttggattagcattctaacctcctgacctctgttgctatccttgcttttattttacagatggtaacttttttttccgatatgtttattcttccagataaattttagaattattttgtcaagttctaaggagaatcccagtgggatcttaactggaattacattaagccaatctacatttagaaaaagtggttggttgtaatatttagtatcccatcatgga

SEQ ID NO: 128954 - DNA, 1139 bp, Homo sapiens
atgcctgtgttttcagggtatcatcttcatcccaagtccattgtcagaacagagatactttctttcctgggagaagttctgggtctagctgtttatgacacttttcctactttattgttctaccctttggaactgtgttgaattaagtaagtaatcttcaagcatgcagactggtgctcacaaggtatattcaggggttttcctttccttctctgtcattccaactacctagctcattttaatcataatatgcctgtcacagctaaatcaatttgtctgtgatgtggttgacagtgcctcattttagttcataaaaatcagtgcttcaaagattgtattgctaaacttcatggaatgatttgaaaattgaatttgtttttatgtgttataaagctcagttcttaacttgtttcgcagagagttaattgttaaatccagtatggccacaggaggaggtccctttgaagatggcatgaatgatcaggatttaccaaactggagtaatgagaatgttgatgacaggctcaacaatatggtatgattccttactcttcatggtgtgttgttggctattaatgttaaaatgcagttttccccctgaccaaatttaactcactgatgctctttgtatacacttgctggccaagacattaagggaccctgggccgtttattatattaattgaagacacaaatcaaattgagtttttaagccccaaagcagatttactgttacataaagatgtaaaagtgttttttttatggaaaccatgtttaagacatgcagctgggttttaggaagggatttggagaaggaattgggaaattatcaagaattacgttttcaccaccctaactctgcttttgagtgcatctgcctaacacacctttctctttacagaccagttttctctcctctggtccatgtgatatactgtggctgtcccattgttctaaaccttttagttatgggtgcagttatgtactgactagttacctcttagttccaatttgaaattttgtagtatgattatcctaatttggattagatatgtgtttcttttttcagtcttctgtggcgagggtggggtgaggtgtaagtagtgtaacaggttggcaggaatattcactcatagattg

SEQ ID NO: 128955 - DNA, 1079 bp, Homo sapiens
ggaagcaaaataaatagcctagggtcacacagtggagtgttttttcagaaaacagtaattaggtttagaacctaggttgatttgatttcagatctctttttgatacgtactgactttataggagatcggtaaaggtatctgtaatttatttcactatttataatagaaaatcacaatgtaaaaaaatcctcttggaaatattcagattgattttagggttggcatttgaggatttgtatttgttagtgatcttgataagaaaataatctcttttcagaaggatgggctataaaattaaggtagatgtaatgaggggaaaatgggttaatagaagtaaatatttgtctctaggagtataagtctgtcaaaaatgtcttgtcttttttaattttaaaactgaccaaaactttttaattataccaatctattttcctggtttgatacaggccatgttaatttttgcttttacttttttaaaggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcaggtttgtgaattatttttaaaaatgaagctattactgtgagaaatacttgaaatggattaaataatttgtcttaggaataaaaaattgagctgtttatgtaatttttaaaaaaagtttctgtgcctatggaaagaattttaatcactggggatggtcctgtcttctttagaaggaaatgaagtcccatttctaaacttgctaaagacatgcatttctggactttatactatgttatatgactaactcaagtgattttactatacaactaaattttgcattttggtaactgaataaaatggtattaagtaatggaaagttccagtttagtatatatatcattggctaagtgtggga

SEQ ID NO: 128956 - DNA, 3082 bp, Homo sapiens
acaactttaattacattgattcattgggtccaaagcgtataaaaatactataagcaagtaataaaaagcaatatgagttaaagtgtgatccatggtcctaggacacgttgagcatccctaatacgaaaatccgaaatgctccaaaatccaaaactttttaagtgccaacatgagtggaaaatttaacacctgaccttgtgtgatggtctgcagtgaaaacgcgtcaaaactttgtttcgtgcacaaaattattaaaaatattgtataagattaccttcagattatgtgtataaggtgcacatgaaacataaatgaattttatgtttagactccggtctctttcctaagatatatctcatgtttatgcatatattccaaaatttgaaaaaaaatgaaactcctaacacttcttgtctgaaatattttggataaggggtactcaagctgtacttcatttagacttaccttgttcatattcgtcagttgaattgtctcagcaaagtgaagtctagaaaatgctaatcaaattttcatattgtagtgaaagactgttacagagccaaagctctttcaggtcttagtgcaaagctctttgtgtgcaccttctgaatcaatatctgatggcgaaactaagaacattggggttaaaacaaaattttgtcataaggttaatgtttgtgtgatttgatttctttttcatatatagagaagcattggaagtgattcccaaggtagagcaacagctgctaacaacaaacgtcagcttagtgaaaaccgaaagcccttcaactttttgcctatgcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttgctcattctttacacaaacctcaaaataccaacagtaaggtttagaaaattaggttacgcacacaggaattttagttgggtggaattaaagtgcttcactgacctcctttgttaatctgccagatttacttaaaatagagtaaatttctgtttatccaaaaatattttagaaatggcatattcaggttagttaaaggcttctgtttatttacaaaatagcatattgccagtttttagtaaagggggattggaaggaaagtgattaatagatttttgtaggaattttttaaaatggcaaatattcttttgaaaagttgtaaaactataatacatttaattaatttataaacattaggaaaatttatataaaaaattgtatgcagttgtagaagtaaaatttttcagatactgtagattaaaattttgaaatgtatttttgaattgacagtgattggagtttttagtattaccaattatgtcttgattaaaatctaagctggattcagattttttgcatgtgttaattcacacaataatccaagtgtctttggttatcttcgaaataaaaatttgtaaaactgttgctattgaactaattatccttagttttatatattgtgtactttcatgctttttttaaaaaaaatatttcccctgcagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgtaagtattcgacttttaaaataacatattatttttgtagtatctcagtgtgtatttactgatgacattctgatgccaccccagaggagttaacatattttcaaaaaatcatgccatccattataacaatttattgcccattttaatagttgtatgatttataccgctaaaatatttcaggctagagaaaatgaggaggaggatgttcggactatagattcagctgtgggatctggttctgtagctgagagcacatcgctaaacatagatgtgcagtctgaggcttcagataccacggtaagcggctttttggtaattaaagtgctggaaatgaaggtttaaatttttctcccagttttcaagatgttatttttataggcgttccttaatgaaaagtgtattccagggaagaacccctcaaattgttaatgctgtatgtgttcttctgtatttaaacacggaagttaagttttatttattaacactaaaaatagttttaatggttaatttgaaaatgtaatttttgatcttcagtttatagaaacattgtttttgtagtttgttttgttaagcaaagcttcactaattttaagaagcatcgaggaagttaaaatggatggtggaattaagggcaataggcaacattagtgattacttagcatgtagtcttttggaaataaccaagttcatttgtcactgaggacacgttaaggatattagaatttttcattttttgggctctatcctagtactggagcaaaaccagatgactgaaaaatcgagagaaagactagtaaatgggacaggatagcatttacattgtgacttattcacaatgagaaaaatgctgtaattgctgacttggcaaaatggaatttgttgaagtactgtttttctgaagaatagtaatttacagaactttgaggaaagatttctaaaacttagtgtggttcaatgctagggtgtttttaggcattttaaacaggcgtgcctataaccatgcattattaagcttttaacacctattacaggctagtaaagcttttgttttgagaggataagcatatatctcttcgggttttgaggtgttcaaaatgccattcagcattaggaatttgaaggtttgtttcctattagtattgacctgcataattcttacctgcctcctttctcttcccggaccttcctaatttgaagaggtgatttggatttcttttctctacattattttcaacaggagatacttagagagcc

SEQ ID NO: 128957 - DNA, 1026 bp, Homo sapiens
tatggtaattccgcaggatgtggtacttgcttagttacagtaagcaacagtctagtctacagaaaacttaaaagactaaatatactgctgcttggagggggatgtggattgatttttgtttttttttttttttaaaaaaaaggtggactggtactttttaaattgttttacaaggctggcttatatgttaaacaggagtttgtgttaagaatttaatatgctacactatttaataaaggaggaggcatcttttattctgagaattcggccgtgcattgaggacaaactagggaattcagcttcacaagaacaggtttcagacattgacgttactacaagtccaaaagggaaaggtgacagacctcagaatgacagggaactgaggcctaataggaaatatagccaaaaacgtggatttccctcaaaggtatactttacaatattaacttgggaagtctctaaatgagcacttcttctgttcatatttcctcttctttatttgcttttctgttgttgctattactcttacatattaattgttaatatagttgtcatactgtaatttgctttagtaaaattctgtcccttactgttttttttctactttgttatatacctctccatggattatagcttacagctgtttttaatttatattaacaaaggttttgaaatgtaatttattcccttttttataaattgcgagtataatttataacacgttcttaaaccttgaccatcagtcagttgccctttgtttctgatatttgtgtttattaatttagatggggccaggcgtggtaattctagcactttggaagactgaggtgggcggatcacctgaggtcaggggtttgggaccatcctggccaacatggcgaaaccctgtctctactaaaaatacaaaaattagctgggcacggtggcgcacgcctgtaatcccagctactcaggaggctgaggcaggagaatcgcttcaacctaggaggtgtaggttgccgtgagccactgcactccagcatgggt

SEQ ID NO: 128958 - DNA, 1455 bp, Homo sapiens
tgtaatctcagctactcaggaggctgaggcaggagaattgcttgaaccctggaggcggaggttgcagcgagccgagatcctgccactgtactccagcttgggtgacagaacgagactctgtctcaaaaaaaaaaaaaaaagagtttgaataaaaataccatttataaaagtgcatgtatctgttggcaggagcaaagtactattttagtaattgagtataggtaagactaatttcatatgttttattactggtttattacctaggactacactttcccattttgtggctattttatgggtttgttgtattttttttttttttttggtgtgtgtggctatttacaaatggtaaaacttcacctctagtattttggcagtttttttattttttctggttcctacaagaatttgagagcacagtttgaaattagttatgggaatcttattatatcaaatatcaagtaaaatgtgccccagttcaccagtagagtgaataaagtagctgattattttaaaaactagtggcattggagaagagcaaataaacatgaagcataataggtaaccattggaattttattctctttaatccttctgaatagtgacaagcgaaatttaagagttaacagttaatgcagtatctgccagttctttttttcttaaggcattacatataatttaaaaaccactttgctgtttttaggtttctttgaataatatccttataagtgattattattcttttttgaattctcttcttggcatttatttcattttgactttcttgattcttaaggctgtctcgttgttctgttagtattctatttgtaaaaacattttaatttcttcaggggaaaaaatcttaattctcaccacctgtgtttatttttttctctactctgcaggaactgtcattcttaccaccccacccctgtttcctccttagaatcttttcaaaatgtagtattctgttagaatagtggaaaacacagttgagggtcttacatgcgattcaaggttgaaagcaaccttgagacttaacgcatgatatgaaatgattgatattctagagctgcctaccaagggcacattccactttatgaaatattttaagacatgatgacatcttgtataagatgtcagaagaaggcaaaagaaagccttctacgagtagccatgcgttcattgttttcctatactcatggcccccaacttaatctcacctcttaaaatttataagctttctttgtaccttgtacctgtgttttgccattattttcatcattgctagttatttcgtgtgagattgccctgtcttttaaaccagctatggttcttcagacatgatgtcttatacttctgtatttagaacccagcacataatttggagcagatagtatgacgtaaagaagactagagcctaagaacctgatttcccttaactgtgacactgga

SEQ ID NO: 128959 - DNA, 1009 bp, Homo sapiens
gctttgctagaggagtatttgatcaacctagagagattttgttttaccccttccattgatatctgtacctatttgatttggttttacattttaccgttgactttgatgaaatcattataaaattatttttgctgcattctgagagggctagctattgataattatccctacccttcaaagttgtttttttcctaatgatgtaaactgtctggaaataagccagactaggatgaatttccacggaaatggatgtaaatatttacaaggtaactccccttatataggataggagagaactgagtaaacagtacttaatttgttaaaagtttcagtttattagaggttcaagacaacagaaaaacctctaataaatattggcttaccaagatccaggtaggctatttgtttcccatgctcatgaagtctagagatagtctaggatagagaggcactgactaggcacctctgatgtttacatgaaataatctaattatagccaacttcctatttgatcataactttcttgaatatttaactctttgccatgtacttatttgtttacttattaattttatggatttccaagtcacagtgtaaaatattaccacagttactcatgctcattcacaatactgatgagttctacttggggaggtaaagaaatttttatatagtattgtaaaggatgtcacccagaagggagtttctcttgagcccatctgcatgctccataatttctctgggaatcaaatgtacatagcaagtgtagatcagtgcatttttactttcaaaagaaatctttgaacttctttgctctctttagtcatttatttgaaatttacataacccgacaaaaatttgttagcagtacaaatttaaaattgactaagtgaaacaaaagtgaaatattttatgtaaatattaggtaaaatcgttcaacttttaaaataaaagactttttaaaaggtaaatcggtgatgaaaaatacaattacggtatacgtttcgat

SEQ ID NO: 128960 - DNA, 1023 bp, Homo sapiens
gcagtctcagctcactgcaatctctacctcctgagttcaagcgattctcttgcctcagcctcctgagtagctgggataacaggcgcacaccgccacacccggctaatttttgtatttttagtagagatggggtttcatatgttggtcaggctggtctcaaactcctgaccttgtgatctgcccacctcggcctcccgaagtgctaggattacaagactttcaggtcattaacccagtataatgtgctccttttctgtaggggcctagattcttcagtgtgtgtgtgtgtgtgtgtgtgtgtgtgtgtgtgtgtgtccatgtgtccgtgtccctcttggccttttatgttttgtatatctttttcttttccttttgttcattcctcttcctgctgagccattgattatgtagctttttactgtgaaattacctcttaagtggcaggctatatatatatctctgtgtcatcattctgttcttactcttttttcttgatgtctactaaaactatatttagggttgtatatttaataatttgttatcaatgtgtatactttgccattgataattgaaaccgcaacatggattttaatagtcagatacaagtattgttggtcttattttccaggccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctggtatgtcacagtctgagaatattctttttgtaaggaagactcatacataattgtattgcagggtggatgctgattattacataatcagatcttgattgttgtctagtttagaaaccttcatatgaggcttatactttcctgtgcttttctctggttatgcagaaaaggttgcagggacaactggccatcatactataccatgcagatagccagatct

SEQ ID NO: 128961 - DNA, 1007 bp, Homo sapiens
tcaaagagtgtccctttcaccatttaactaacaagttacatataattactgtaatttctttcttctcagcatagagttttgactagacatataggattctatatagccttgaaattctcagttctcagtggaaaaaaggtagtgttttcctttaaaacagaagcaatttataactaattgtcttttttctttatcttttttttttttttgagacaggatcttgctctgtcacccaggctggaatacagtgggcgtgatcttggctcactgcagcctctgcctcgcaggttcaagtgattctctcaccccagcctcctgaatagctaggaatacaggcgtgctgtaccacgccgggctaatttttgtagttttgtagagatggggtctcactgtggtgcccaggctggtcttgaactcctgcgctcaagtgatctgcccaccttggccttccaaagtgttggaattacaggtgtgagacactgtacctggccaccaatgtctgttttagagttggagagttagaagtcaggttaaggatggagttatttgttagtagaacagtgactatcatgaaaattgttgtcacaaaactgctttatgaatatgggggcattttttttaaattaagaagataaaaaccacagtcttttagtatgacttgtatcacaaacagccacttcaataaattatccattttactgcaggggtcagcaaactatggtcagctgagtttggctcattgcctgaaataaagttttagggaacacagccatgcccttttgtttacattgtctgtggttgcttttaccttgtaaaagcagagttgggtggtcgagacaaaaactgtatttcccacaaagtttaacatatttactatttcaacctttaagcaaagtttgccagcccctctaccggagaattgattctattcaagaacatggagattgaaacctgtcagaatcagctgtgcttttttacactatcactttccctttcactcctcactg

SEQ ID NO: 128962 - DNA, 1091 bp, Homo sapiens
atagtgtttatattgtattaggtattataagtagtctagagctgatctgaagtatataggaggatgtgtgtagattatgtgcagatactacaccattttatataagggatttgggtatctgttgtttttggtgtccccaggggtccttgaaccaatccctcatggatactgagggatgacttcatatgttaatagtggcatatcaggaaaccgtatttaatttgggaatagtaagggtatatacttacctaccagcacagcctagcaaatatttctttctctttataaagaatatttatgcatttaaaaaatgagaatgcatttaattgcgttagtcttaattcttcttttttgttgtttttttttaataagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatgtgagtaaatctggttcagcagtattgggtataagacacacaagtatatatactgtcacataataaatttagtatttggtgaatgaacacatagctcctcaaaaatatttgtagggacttaagacttgcatatgaaaagtttctaagttgcaagccaatatatatgaaagccaaataggtgataaatcagttttataattcagaaaagggaaagaataaagttggaccttgaaaaattagtaggattttaataagggaaaggtagaagagaaggcaactgtttgatacgtggacatattaatactttgtttcttaacattcaaaattttcccttaaagaaaagttaatccagttagtactttgatttaaaaacccaaaactgtgaaacatagtgtgtattaaaaaaaacaaaaaacaaaactatgaaaaacttttatatatggtttagtctagagagcccagaacttccaactgctggatttatattcatttttaaaaaata

SEQ ID NO: 128963 - DNA, 1988 bp, Homo sapiens
aactaagatgtgtggctgggtgtggtggctcacgcctgtaatcccagcaccttgggaggctgaggcgggtggatcacctgaggtcgggagttcgagaccagcctgaccaacatggagaaaccccgtctctactaaaagtacaaaagtagccaggtgtggtggtacatgcctgtaatctcagctactccggaggctgaggtaggagaatcgcttgaatctgggaggcggaggttgtggtgagccaagatcgtgccattgcactccagcctgggcaacaaaagtgaaactccatctcaaaaaaaaaaaaaaagaaaagaaaaaaacaacttaacatgtgaaagttgcgcttaagtccttgtcgtcagttttgtatgcataaagtagcactccgtatactgatgactcttaaagcctatttttttcctcactgggaagcagtgtgagagcagcagcaaaaggtagactcgtcaaggaatagaatgaggagactgctggaaaccacctacaggaattgtggtactaaagtgagcaacaaataatgatggttcctttgagaaagatactggtaaatgacagcacctttgaaatggtaggaggtagagaagtgcaaagattcttaatctttaattcctcttgaaagcatgatttatatttgatagtaacagaagttaaatagaaagtaattaaatttagttcaaggaccatagaggattagccattatctaaatagcaggtttttattgctgtttaatatttcatggtttgaggtaccacagtcacttttaacacttttctttctctcctggagcaagaaaagttccttcttggtgtccagatgtgacatccccctgatctgtgggtatgaaaaactgatgaagacctaatcagctacagctaccctgtaaagattacagattgagtactgcacatgattcatagtggccctgtttaacttaacctagaaccaagtttatcaagttagttaccaagtttactcgttagttaaaactaactagagtacttctctagttagttttccaaggtagaatatcattattcttgtcaatttccatcttttttctttcctttctgttttaacccagtggttatattgtaaaggtgatagaacctgtggaagaaagaggtaaacaagtctttgtacattttgatgtgtttaattgtggagtaagttaataaacaattttctgaaatttaaatctgcagaaattaagttgttaatttttactttttagttttcaatatccaagccaactgtatgtgtttgtttatggtaactggtgattaaaaaaaattttttgttgttgtgccttcttcagcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagtaaaacatttataatcattgtttacatgaagttaaataatagggataaattctgtttttttttttatgttgaaaattctgcaaaacgagatttatttaatattgttgtaaacattcttaagggataggtagaagaggcgtgtgtgtgttgtgtgggcataatttgagttgtctaagagatgtgatgtaacatagtttctgtgaactgatgttactttcttgtttttcaaataaaggatcaaaaataagattacagttaaaatatttctatattcagatggtttagagaccaggctgtagaatcagacagccctgaaattgtatcacacaaggctgtgttaccctgtacaaataacttagccttactaagcctgtatttcctcatctgcaaaatagggatgataatatacctgttgataaatatgttttcattaaaaaacgttggcgcagttcctggcacttacagt

SEQ ID NO: 128964 - DNA, 2077 bp, Homo sapiens
agaactcagctaacttaatttttatttttggtaaacgtagtatgtagtgtatagatctcatatgtgcagacaaatcaagaaccttccatacatgctcagtaatgtctgtatacctgattttcctgagaggtagtatttagtagtacttcacacttttgatacttgagaaactagaaatctttttgacatcaggttttctgctattaacatttacacctgcttaaaatgaacaattaaattgaaattggttttcttacacttttgtccctaaaacagcataagaaaataatgtgagattttgagtaagctgtacttggcattaacctcattattttacagtcataccccctggagagttcactaggtggatattccattaggtctaaattttgtttctgttagctgctatgatatgaaaataatgtctgtattattttgctaaaatgggtgtaaatcgtatacataaattttttgtttatcaggaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcggtaagaacttttctggggatgtttttccagcatattcattctgtcttgatacttataatgtgggaacaaaaatacttcgttgtagtatttactatttgccttttatttaagctttctactattttggtcagtgtaatcatctctgccctgtgaagaaagatgaatagggaagtatggagtacaatagttcagtaaatttgccctttgttagactgaattcgagtaaatcatgagatgtatctaacttagcattttgctgtctttttctttttaggcgtaattttcattttttcagatgtttttctacttaaatagcacatatgcagaagttaatgaaaagcaggagtcgattattcaatttgaatttaaatggaatagccaacaatgtgcttggtttggtgttattttattagcagttctaaacttggatttctttctctctttttttgtgccttaaatgacttcaggctgttttctttcttctagaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttaggtatgactgactgtatttacatataattttgctgtgttattcttacaaagtgggttttcgttcatgtgtgctctttcctttaaaagttactggttttaattatacatgttttcagcagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggtaaatattgcttggtcttttaaaaacctatttgtcaaatagtacagtcttaagtaaaatttgtgtatgataattactttggtttaattatactaatacacatttatgtatcatatgtgaggtttaaatttttagcactttacatgctgtatgtcagaggtcagcaacctttttaaattaagagtgagttggttagatagttgcggctttgtggcgatatagtatctgtcacaatttcacaatgcaaaagcagccatacataatacataaatgagaatgattatttgccaatatagctttattttattataaacaatatagctgtttttatttacaaaaacagaagaggttttgttgtttttgttgttttgctgacaactctggccttatattatgtacaacttgcagcatctcaatgaggta

SEQ ID NO: 128965 - DNA, 3363 bp, Homo sapiens
cttcaggcacccgccaccatgcctggctaattttttgtatttttggtagagacagggtttcacagtgttagccaggatggtttcgatctcctgacctcgtgattcgcccgtctcagcctcccaaagtgctgggattacaggcgcgagaaactactcttttttttctagtattaaggtgacagaattatatctagtaattttgtgattaatgaagtggatgaactaatgaagagttggggttatacgtttacagtgtaaaagacagcacataggaattgactcattattttcattcttactgggctggctggccatagattcagaacatgtgtactcataactgtttattatgttaaaatattctgatttgacttttgcagttatggaccagcatttccatcttttactggcctgaaataatataataaaatctttaagccaccataagatatctaaggaaaataactgtatgtggtttaaagagtaagttgtatatacttttgcttattaactaggatcttatacatgggtcttgagattgaacagaaaataagatatctttggtgatatcaaataatcagttaataatatgggaaggggataataattccttctgatattttcccagagtttattggctagcttttttttttttttttttttttttgagacggagtctcgctctgtggcccaggtgggagtgcagtggtgcaatctcggctcactgcaagctccacctcctgggttcacgccattctcctgcctcagcctcccgagtagctgggactacaggtgcccgccaccacgcccggctaatttttttgtatttttagtagagacggggtttcaccgtgttagccaagatggtctcagtctcctgccgtcgtgatccgcccgcctcggcctcctgaagtgttgggattacaggcgtgagccaccgctcccggcctattggctagctttatcttcagttaggttgtgttttcaaagaaaggaaaacagggcaactgtgttcattttctaaacccttgcctttcctactgtatctaatcctttttctctccttatctccaatctaaataatgtctagagaaatatgttgcaaaggtgggttaagtatacaaaattttccattatgttttatccctgttgtttctgttgtttctgagggcttgtgtttgttaacctcagcttgtgttttcatctttgttttcttatttcatgttatcttcggatgatgatggaagtcagggtctgatagcagattaaatatggcactagagccttagtgccatatttaaagtaactgcttttatgaaattaatataattgctttaattcctcataacgttttttgtgaattcctttttagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgaggtattgtaaattgtactctcttgttcctgagttagtcttttgttttcctttttttttcttcaataaggcacatctcaagaaaggaaactgaatatccttgaaacatgtttgtaaatagtagtctgctttgtgccttttttagtagacacaaaaatgtaatagattataataatataagaaagataaaacattttaatttttaaactttaattgaaaagttttaaataattttttctaaaaagtaattatcttttaaaaatatccatgttctttgttagtaaatatttggcagaaatatataggggggtagttgcagcaaatagtaatcatttcagttagaaagacctatcctttgacattttatttatatgtggtttgtagaaaatataatttttcctaaataatttctgaagtatatttgagttctacttgtttctattaataggccatgtgcggtgactcacacctataatcccagcactttgggaggctgaggtgggcagatcatgaggtcaggtattcaagaccagcctggtcaacgtggtgaaaccctatctctactaaaaaatacaaaaaaaattagctaggtgtagtggtgggcgcctgtaatcccagctactcaggaggctgaggcaggataatcacttgaacctgggaggcagaggttgcagtgagccgagatcacaccactgcactccagcccagatgacagagtgagactctgtctcaaaaaaaaaaaaaaattggctgatttttttgtaatcataactatattattattttaaccttcatggacatgttagtgtgaaaaggagagaatgagaatagaaacctttgttgatactgacaatactagtagtcttttactcttttaggctacagcaaatccaaatatttatttaactctggtttcttaaaaaaaatagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaagtaagagagctgcataaatcacttttctaaaaatgtcacctgccgaagattgacctgtaggctaggcagccacatttctcctctacatcacagcacaaatctgctatttcagtgaggctactgtttaactaccacctttgtgacccagtttaattgaatccagccactttctgttctgacttctcgtagcatcagctttctcttttgtcttaaattactatggcacttgatcaaatggtgatacagattttcttatgtgtataagccttattagttaagtttataaaaagaaaatgcttgatattttgtagtgcttttctgtcaggccagaaataggcccttttttgcttaaattgagtatctgctgtttgtaaggttcttaaggatcttaaaacattttattataatcatttagtttttaggatttcagtttaaaatgtccatatttagaatatttctaaaagagttggtcatctataagatcagtgaattatttagctatatagtagtaaccatatcaaaaattttgaaatatagatttgtttatgaccttcccttttgatatcctcagatggcatttctggaatttctggagttttgcaccaagccctactctcttctcagatgaacttctattcttggggtcccaatatgcattttactgatcagactatatctacaatattttattctgttctgggtactacacgtctgttcttctacagagttcttc

SEQ ID NO: 128966 - DNA, 1888 bp, Homo sapiens
ctgcttggtccccacgttacccacacttctgtgcaacatggctagaaatttgggagttcttacaatccccttcaggtttatttgctagaacaactcacgaaatacaggaaaagacttacttacgtttcctcatttcttataaaggattctgaactgccaaatggaagaggtgtgttaggacagtgtgtgggttggggaggtgtgcagagcttccatggtttcctctgtgtgtcccaccctccccagcactttgatgtgttcagtgacccagaagctgcctgaattctgtttacggttttttaggagatttcattgcttaagcgcaattgataaaattgttgactgttggtgattgttctcattagcaaaaattcacatctggttgaaaggggcttgttacggataacaaaagacattatcacttgggagattccaagggttttaggagctctgtgctaggaaccaggcacaaagaacagatagatattttattataccacaagaatgttgttccagtagatccaggtaaactggatcagtcttcactcctgctgttgagaattaagcaaaaataacaaattgtagatagtgaaaagagtctgccaacaaagatgttattacattgttactaataattataactgaaaatttcttcatgaataacagatggtgaagtagatacagtagctccacttgatgaaatactatgtggttgaacttaaagcgtgaagaatggaaaactacttgtgacataataaatatttttattttgcagaatacttaattatatggacactgctgtgtaaaaacatacatgaaaaagactggagactaatgaaaactaataattgtacaaagctaaagatctggacttctcccccctctatattttttaatactttgtatgttcttttaatttaaaacagaatattggcccataggcctgagtatcagagtttattgctgtattttaaaaaccaaattattatgtatgatgacttaatgctttcaatcttgtgttaggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcaggtaaaatttgctatgaaagtatatttttcgtctatttttataacttctgaagcaatacaaatttttctcaagtcatcagtaactattaacaaacattttctttcaatagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggtaatctgtttcttagaagtattgagactgtataagagctaacattgagcagaggttttacagttagcttctgggagaaaagagcaagaccaaattgcatatttggacattctctttcccttgagaattttataagtggtgatttacctaatgtttccttttaataccatggatttctgtttttataaatttatgttattgaattttacttatattttggcagattttatggtgtgtaaattgtaccacagtgaagctataaacaaacaaaaaagtgattttcttacagttttaccgactgtcggacagaagtactaagttcatttcttgttccagagggaaagttattgaattaagccttatagagcaagcacgtatttgttacagtat

SEQ ID NO: 128967 - DNA, 1050 bp, Homo sapiens
actggaggcacatgccactgtgcctggctcatttttaaaattttttttagagacggggtctcaccaacttgtctgggctggtcttgaactcctgggctcaagcattcctcctgcctccgccttccaaagtgctggagttacaggcatgagccactgcagctagcctgatttttctttcccactgttttccattgctaatgctagatctttgataaggaacttttgccagtaaaagtggtttagtgagatgggtccagaattaaaactaatttactaccttagcttatgtgatatttgcatatttaatgtgtatttttgtgaaaacatttttatagcctgttgacaattttattcacctaaatctactcgagtagactataaattcagtgtatttggagtttttgtaaactatagttgttaacttataaaaacttgttttcattggtaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcagtaagtgttgaaatttgttgaatgttgatcagtgtaaattttggtaatcttactttgacatgttgacatagatatagtttcagtaaggctagatgtgcaggtgctgttctagacttagttgaacagtcatttttagttacctttatatatataatttttttttacaaaataatattcgaaatagggtttaattttctggattaatgttgtaaaacatggcatttattttttgtacttcttaa

SEQ ID NO: 128968 - DNA, 2109 bp, Homo sapiens
ctataatggatatttgtatatatcggatgtgattcttatgtctcctaatattaaaaattgctaacttggaattctagtagagatttggggtcatgtaaggtctgccatatacttcgaattggaatatactcattaagatgagtatcaaagaacagtgaaggttagatttattactgttagctcatgcttccaaagggtattgcaaagatacctccaagacatatttactgttttgtattctatttataccaggccttcctagcattgtaaattgagttacctgtactgttacacaatggaaaccgatttcccttttagtttgagttagttgcaactgataacagttgtcactttttttactcaagggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcaggtatgttcttttttggtttgcattaatataaggaggttttcagcttagatttgaaaagctataataaagcaggtgttaaaattggtgtttcacacgtatctatcatgtggaaggttttatagtggaaattatagtacacattccttgatactgaaaaataaaaactgaaaatattttgtgttatactatttaatagttttggacacattttaataaaattctaaacaaaggatagttacaattgtggaactcttcaaattctgaaaatcttatctgattaagaattagatatgaaatcatgtcatctcctgcttcaatcctttggcttactgtgcctacaggataaagtctgaatgccttcatggaacgtacatggccatcagggatttggttccttcctgcctctccagactcatttctcaacacactctgccttgaacttttttctttctgtggcactgaactggagtttttgtatagctatcacattctttcttaccttggtagctgtttttctatctcaagtcctttctgccttttttgtaagttcgtttctctgctggactcttaatacaattttaattctgaaactccattctaatccaagctaggatagtttcccctttctcctgttttccttgtagcttgtgtaaacctattttgttgccttaatcacattattatagtatttccctgtttgtcacttttttgagtcccttggcagcagataaaagcaccagtagtttcctaatttgtaaagagcatctcaaagaaatatggagagagagaggcaataacatgacattagactatagtggatagaccttaatctagtagctttcattgacattagtataaaatgcatgcgttttttgtttaaaaatgataacagcagctatcttttgtaccatgctccattattttcaaattaccaacaaatctcatttgagcctcataatgctgagttggttttatttccatttttcggaggaaacatggtcaaagagggaacttttttttgttttgtttttcagtactcataaaggctcagtaatgtaaactggtacaactttcctggaaagcttcagaagtcatgcccttaatccagtaattgtacttgtagtaatccatcctaagaagacaaaaggggaaaaaaaaaaaagacattaagatttagtgttgtctcaacagtatggtttcaactatgtataaacaaaaatttgaaagcaaaaaggccggaagaaaatgcatcaaaatgttaatagtggttttatcatctttaaactcataatgagcatttatcattttgtaatcagaaaagaaacatcacatttgtttgcattttgaaatgaatttctcaagcttacattgctaggaaatggtaaagctgaacttagaagctgggcttctgttaagtctgtgttcctttctgcaaaaatatcaatcctattcttctgaacccagaattttactaaaattttataattttcatctccttttactctctaccaaatagtgatatcttcaaaaaataaacagtccggtagaggtcgaagaaggacactaaactgaaagtctt

SEQ ID NO: 128969 - DNA, 1961 bp, Homo sapiens
aaacctgattaagattagggatttttccagccaaagctaataaatttcagttcaggaggagaaactggcataaactttccacctcttgactgcagaagtggtgggggaatgaagcttgtgtttaaatggcatattcattatttgagaataatttaatttttaatgatacgcaatttagattgataattttatcacatacagaggtattaaatatgtcattaaacagttatagctttgaaatgaattttttaaattaagtatgattaaactgcaatatagtatataagataaaagtttgcatatcaaaattctttttacctggatttttcccattagaagagattgcttacagagataattttggttcctgcttattataataagtgtcatttttgtgatagttcataccttaaaactacgagaactttagtgtatcacttgattttatacctgtaactgaggcaaaatagggaagttgcatatttattgttacatataattaatatatttttctattgatatcttatattagtaatgttattatttcatgcttgtggaaattgagacctgaagatattaaattattagccaagtagtggaaaatttttctattagagcacattctttttccattttcttattcctctcacaaaaatgagtttttatgatcttgtatacttctttgaaagcgcaatgtattaagatactcaacattttaaatggatacctttgagtgtaataattttgtgttatcaacaagtaaatttagccgaattgtagctaaataatagagtgatgcctagattctgtgaaactgaaaacttcagttggatcacttgcctgctccaatatacactgagtatgtaaataagacacaatggtgaaattgacctattatgttaggttacagatttggttactcatcatcacagcacttttctgtgtgatgtatgagatttgataattagtagactatactggatagaccttaatctagtagctttcattggcagcattcagtttattctttttaacattaacaaaatatacaaacttccttttctgtaatgaagtccatattagcaaaagcaaaaaagaaattagcacttagcttatttctaagtgttgaaagattttcactgatttttcctataaaatgtataatattttctgtatattttatatgatcagaaataaacatggttcttagtaatgctaggtaatgttattcattaaagtttcatttttagtataaaatgcatatcttgatattttaagattttatttatcttggtaatattaagcttcttttctactttaaaagctctgaaatagaattgtctaaaatagaatttttagataatttaaagctgagagtaatgatactagctaataaaagttgtcatgaaggtacttcatcaatattaactttctggtcttttatgtattccagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggtatctggtacctaacataatttttcctaccctattatcaccttcttcatgattatctctggttgctgtcttagactgaagcatgtgccatatgaattttcatctgttctctatgtgctttcttgacattttatttaaaatttttgtatagcttaagtagcattaaagtattttttttgagtactttttcagtgttttgtctacttcctcacacttaacctgtgagggtagaaacagtacatttttccttccatctgcttttatttttgaatctgtaatataaatgaatgattaagcatgtatgttttatataaatgatgatcttattttcttat

SEQ ID NO: 128970 - DNA, 1034 bp, Homo sapiens
tcaaactgtacatttaaagtgagtgcattgtatattaattatatttcaataaagtttattttttaaaaatgcaaatgatgttgtgatgttttcttttctgatgtgagacaaccaggtagagtaagctactagacattgttagcatttggagataggagaatgtccctgagagtatagaaataatgtaaaatgttaactttgccaaattagaatttaatcagtagctgtctttgtgtgtgtttatctacataataaatattctgcaaggctacttatatcactgttctctgtgactctgtattcagcgtttaataactttggttatattatcatcttgtttggacagaatactgaggaaacttatgaatatcttttaagtgtacaattttatgtaaatacttagttatctctgttagattattaatatgaaattcttagaagtattagtgatttttgtttgttttactgtaacttaggaaacttttgagaagaactttgaaagagaaacccataaaataagtgagcaaaatgatgctgataatgctagtgtcctgtctgtatcatcaaattttgagccttttgcaacagatgatctaggtaagcagaattgtttataatcttagaaacaactttaagttgatctggtccagtctttgaattggcgttgataaggaaacaagtctagaaaggcgaagtgtgtgtggttgaaagaatgtggacttaattatctatcagtctaaaatcaagaatcttctgactcttaaccctgtgagcaaatcatccaacatttttgactctgcatatactaaggaaatgggaattttaacctaccttgctatgttcttgtgaaaatataatgtaacttacttgcttgagttcagaaaatgttaatttccttttccttaaaggaaaggtcatcgtttaaggtcatctagttaattcatgggaacaattcaggcctcatctaatcatatttttaataaaaatattaactttgtaatttgagttaagcagtcagttttcttaaataacct

SEQ ID NO: 128971 - DNA, 1085 bp, Homo sapiens
agtagacatagaattgggaaatttcattgataggcctttttcttacctaatttgcttgttttaggttgcgttgttttcatcagaatttgcatgacattttggaattcacttgtattgtttaaatgaaacaacaaaatgaaataaatatgggcttcagagtttgataactaagtttaaatccttgttcctacattgaactgtctgtgaaagcttgagcaagttacttaaattttctgcaaatgaaagtaatgtcatctactatataggattattttaaggattaaataagtgtgacaatgtatatgaagtgctcaagtagtatagtgtgtagaacttgttaaagctaattttcctcccttttgtttggacatttttttattaatgcattttgaggaatatatgaaaaagttcacttttacatactcaaaaaatatttttgttccaaatgtaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaaggtatatatttttgttttcggtaggtttttggagaacaggtggtgtttggttacatgaataagttctttagtggtgatttctgagattttggtgcacccatcgcctgagcagtatacactgtacccagtgtgtattgtttgatccctcacccccttcccaccctttcccctgaaaccccaaagtccactgtatcctgcttatgtctttgcatactcatagcttagctaccacttatgagtgagaacatgcaacgtttggttttccattcctaagttacatcacttagattaacggtctccaactctacccagatggctgcaaatgccattactttgttcctttttatggctaagtagtatgctgtggtgtataaataaataaacaaatatatctgtctatctacacatatatacatataccacattttctttatccgctcgttgattgatggacatttggactggttccatatttt

SEQ ID NO: 128972 - DNA, 1049 bp, Homo sapiens
tcacactctgtgggttgtctgtttactcagatgattatttcttttgccgtgcagaaactttttagtttaagttccatctgtttatctttgtttttgttgcatttgcttttgggttcttggtcatgaagtctttgcctaagccagtgtctataagggtgtctccaatgttatcttctagaatttttgtggtttcaggtattagattttgaaggtatattttttattgattacaagtaataataattctatgtaaaaaatttaaatatgtgatatctaatggtggttttattactactttattttaattgataggggtgcttaaactacaaacatgtttctttgtattatgttagcataaaatcatcaaatttaatatttttcaaatttcaacataaaggcatatatgtatatataataggctttgttaggctaatgtattttctttttaaaaattagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggtaagcaattattttaaaaaataaacgaaaccttctatgttttgttttttaattcatacagaagaccttattgtgataaagttcaacggtataggtaaacaacaacaaaaaaactatcacccataattttttcaccctaccaacattctctgaacctttcagtaatattttatacacatgtgcatattctgcctttttcatttactatatcataaacttctttctagatcattatttttctgctgcattttttcaggatttatcacctttatttttagttttagtttttgtgagtgtatagtaggtgtgtatatttatggggtacatgaaatagtttgatacaggcatgcaatatgtaataatcacatcatggtaaatggggtatccatcccctcaagcatttaacctttgtgttacaaacaatccagttatactcttttagttattttaaaatgt

SEQ ID NO: 128973 - DNA, 1131 bp, Homo sapiens
tttgaagaaaaatttaaattagaatggttgtcttaagtaaaggaggaagctttaaacatgatcctatatatcaacttgaatagaactaatgtttacttttgaagaaaaatttaaattagaatggttgtcttaagtaaaggtggaagctttaaaagtattctaatggtacatttagaggtggaagattttgtcttttcctttcatagcacttagtatttattactgtagtatatattgtatctcctgtactgtcagggaactttctggtattagaaatccctgtctgaattcatttgtgcccagcagttacatcaaatagggactaaatatagatgaccatatatgttcttcccttgtgtatactctttaagcaggactagcaacattcccacttagtaatatagcagtattctttagtaatactaacaacctatctttccttagtaatcataaacattagttttaagtttttcagtacttaaaagtaatagtattttataattgaagtttactgtctttaaaaattatttggtttatctttgaataggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggtaaataacgttcattttgatttttaggataattgacacataaatacagttcttgatcattattattaactgaaatcacattttacctcagcaaaagtagttgtttttagtaataccagttaatcacattataagtcattacatatgctagtcacttgtggaatttgaggactaacagcagttgctaaagatcaggaatgcgggcaggaattgatgttaaatgtacattgtcagataaccagttcacattattgtcctgtattcaggtcttgaaagatgagagaaggactgggatctgatcctgggccagtgccaggtgcctgccatgtctgttattgatccctgtagattcttcgagaatatgcattacccagaggtcactccca

SEQ ID NO: 128974 - DNA, 1511 bp, Homo sapiens
ttgggaggccaaggcgggtggatcacgaggtcaagatttccagaccagcctggccaacatggtgaaaccccgtccatactaaaaatacaaaaattagccaggcgtgtgcctatagtcccagctattcaggaggctgagacaggagaattgctagaacctgggaggcagaggtggtattgagccgagatcatgccactgcattccagcctgggcaacagagctagactgtgcctcaaaaaaataaaaagcctacaaataatgcttttgaaacaatataaaattattttaacagctttcaccttaatgtttgaaagcagactgtatcatcaaatgacctttttcctgacacttttttattttaaaaataaaactagactatcaaaaatggttctttgtattttttattagataatgatcattattaatacgatagacttactatataccttttacacatgtactttaaggaattaattactcaaatatttttgtgtctaggacaaggatgaaactgaaacagttaagcagactcaaacatctgaggtgtatgatggtcccaaaaatgtaagatctgatatttctgatcaagaggaagatgaagaaagtgaaggatgtccagtgtctattagtaagtttaaaggctctgtactatctttatactttagttttttgtaggtcatttattggaacagtttggtggagtgtaacaagtataaaattaagtgtcaaagaactctgattttgaatttcactgtgaccctgactaaattatctagactttctgcactgtaagtttttaatacattctgtttgaggatttcagatactgtatataaagcatctgtgccatgcaggaatgcagtaagtggtagctattgttaagattatgtgctgaaatttactaaaaattgtgtattaatcaacttagatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtattcccgtattgactgacacacttccatcagccttattttaactaatcaaacttccatcagccttattttaactaatcaaagtagatccttctaaatattcaggtttcatgaatgcaagcctcattaatatgcttattaaaatctgaaaaaccagtttattttttatgattgttttttagagacagggtcttgctcagtcttctgggctggagtgcagtggtgtaattgtagctcattgctcatagcctcaaactcctgagctcaagcgatcctcccacctcagcctcccaaagttctgggattacagacatgagccaccacacccatccaataatttatacgttttaaattatacactgtttttagtggtgtgattaaatttcacaccggccctctccttcctatttgggttgtgaatc

SEQ ID NO: 128975 - DNA, 2300 bp, Homo sapiens
gatatatcaaaaagcaagttaaggttcttttgggcttcactgcaggtagggcatttggggagacagccagcatattcctacaaacttctaaatgttagtatctattggtcttttctttgagatggtttagattcttcaaattagggtccttcactgtcgtcctgcctggagtgtatgagcttggctgctgatattctgaagctagattgggaatggggctgaggtcccaccgttatacaggcatgcactagattattctgttttcagtattctatttaggttggtgcaaaagtaattgtggttttggtcattttcaatagcaaaacccacaattacttctacaccagtctgatactttactgtgtcatttgtgtctccacctctactcccagtggccccaggtttggggctcactagtttaatttctctaaaatataatctgccattttctgttgaggtgggaggagagaacctacgtaggcacattttccttaaacagttttaaacaactaccaccaccgtttcatctccagctcctgccccaacatcatcatgtcttcctttctagatctgttacttacagttatgaggtgaatctcagtttttgtttcctctccctgctgaaggcatttagctttgttcatcttcctctcgtcacttcctccttcattcccttcttgtctgcattaagtgtcttttagagtctgaaaaaaaatgaacagtgcagtctgttcgttccagttgtattatactgtgtgtgtgtgtttttaaggcaacaaggaaaccctttaacttagccatcttgaaatcacaaccaaagccgcctccttgaaatagttttagaagatacttttaaatttctttgtatgaaggtcttgggttggacaaaaactacacactagtaatcatctcttttatagtgaccatatatttcaggccctgctattaaaacatttttcccttctaggtcctacaacgtgactttaaaaagacagcagaaagcaaaaatgtcccattggaacgagaagccactagtaaaagtaagaaatctaaataagtctttgattttaagataatttcctttatttgctttaaagctaaaaaaaaaaaaaaaacacacacagaaaacactaaaattcttagtttgaaagtactttggacctgatgtatgtttttcttctccctataaatcctttgtagaaaacataagaatttgtttctataaacaataaagaaaaggtgacaaatatttacctgcacagacaaaaattctgtcaagagcatcgcatctttagatacaaataatggtagatttaaaaaaaaaatctatttgtaggccttattactgaaagtcctaattttttagaaatcaggtggatttcaggaatctgagtcttaaaatgctcccaggtgattttgatcaactaaatttgggaaccattgataaggaaaatttgtagttgccttttctttttggtcttaaatatcttgattgctcttattcaggcgtattgtctttattagtataatagtaaaatttaacattttttgcattacactaatgttaagactttcttttgatgacagatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgtatgtatcatttacatttccaaatatttttacttttcatttctgtgcatatttcttcattttcagattagcattctccacatgtaaaccattttgtgtttaggtttagaacatgttggaacatttttctaattcacactttaactttagcagaagggtaatagtgaattaagatgaccatctcaaaacccacatgctgttttataattttgagaaccaaagggataaaaagatttcatcttaagttcggctctgaagtggtaatgatgcatgaatcctcctttatcctttatactacctattcttctcaactgtttagaatatattgcaaattttcaataaacttaaaggtttacacttgggataggaaataaaacagtttgacaacagaatctttatacagtgaatgataaaaaaaaaaaaaactaggaaatctgtactcatgatagtacttac

SEQ ID NO: 128976 - DNA, 1025 bp, Homo sapiens
tttttttttttttttttttgtgacaaaatggtaacagcttgacagtatgtttcacagctgtgattgtagcttttcctatgaactgcatatttctaaattattcatagagctgaatgtagaagaaaacgaaatgtgatagaattactgagaaaataattcactatttctttacatggatgactggtttggatctagagtatgtatttttttttttcattacattacaggaagcagaatctggtaatataagtcaaaagtctgatgaagaagattttgtaaaagttgaagatttaccactgaaactgacaatatattcagaggtatttagctgtctttaattaaacttgtctttacataacaaatactgttaaaatgaaaaatgatttgtatttttaattttcattccaaaggcagatctaagaaagaaaatggtagaagaagaacagaaaaaccatttatctggtgaaatatgtgaaatgcagaccgaagaattagctggaaattctgagacactaaaagaacctggtaagagttatcaatttaaatcttgccatattgaaaaatcattgaatcttcatactactattgtgttttattttttaaatatgctactactgacctgggagatttaagccaaatactagaaagaaagtgtaattctgtaagaattttagttcaactatttataaaacagtgtcagataatttttttctattcacatctttagttttaaaaaatgtagacatgctggctgggcgcggtggctcacgcctgtaatcccagcactttgggaggccaaggcgggtggatcacgaggtcaggagatggagaccatcctggctaacatggtgaaaccccgtctctactaaaaatacaaaaaatcagccaagcgcggtggcgggcgcctgtagtgccagctactcgggaggctgaggcaggagaatggcgtgaacccaggaggtggggcttgcggtgagctgagatagcgccactgcactccggcctgggtgaaagagcgagactcc

SEQ ID NO: 128977 - DNA, 1088 bp, Homo sapiens
ataatctgccctattcttgcacaggaataggacctgcaggtatctaaaagaagaacatcagacccaacagcagcaacactggcattagttggaagactggcctaatggatgggctttataacaaataatatatttctctaactaactcttaaccattgctcttctctgagcagcctaaagttatataaaacattgacttgctgtatagaattcaatataatttccaaaaaagatactttatagataagtccaaactttatttaaaactacattttaaattcgttaccaaacatcacaatggggaaaaaaatgaagacccaaaaaagaagggggaaaaaaaaaaaaacacagtgtgtcaaggcttaaatctgtccagaattcagtttctgatgttttaaactaccatggggagaaatgaccacacctatcaaaaaagcagtgtcaaactaatttacatttttatacagatcagatgtttatttagtattgttttcatatatgcattgagtatgtaaggacagagttagatgagcctctgaagacatctcatatactctgggctcccaccgtttctgaaaaacagaataaaaatgctttataaattacttatcgaattactagaatttaacattgttctctgtcattaaagcttttacttttaatataacgttattataaaagaaatcctaaattagcttgctaatacaattccctaatagcacacagtaaaaaaagaataggtgaggcgtttctgattcaacaaggcagactgagcagatacttcgtgtctctctaaaaacactccactatgaaaagaaaacaactatagaatagaataaatctacaccaacaaaagactggttgtgagaaaacagaagaggggatatcaacaaattaccagaatgctcaatgcagatggaagcatacccaatgacagtggaggaagctgcagttcaaacacttgcaagaggctgcaactgagaagggtaccatattctaacaggtagaagtgggctgaaaacagaaattaactgaaggtctgatatctgaagggtctttccttctcctcaactccatttccaggaaaa

SEQ ID NO: 128978 - DNA, 1519 bp, Homo sapiens
gttgaggagaaggaaagacccttcagatatcagaccttcagttaatttctgttttcagcccacttctacctgttagaatatggtacccttctcagttgcagcctcttgcaagtgtttgaactgcagcttcctccactgtcattgggtatgcttccatctgcattgagcattctggtaatttgttgatatcccctcttctgttttctcacaaccagtcttttgttggtgtagatttattctattctatagttgttttcttttcatagtggagtgtttttagagagacacgaagtatctgctcagtctgccttgttgaatcagaaacgcctcacctattctttttttactgtgtgctattagggaattgtattagcaagctaatttaggatttcttttataataacgttatattaaaagtaaaagctttaatgacagagaacaatgttaaattctagtaattcgataagtaatttataaagcatttttattctgtttttcagaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaa

SEQ ID NO: 128979 - DNA, 1594 bp, Homo sapiens
ttaacaactgaaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaaaaaaaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtatacaaccctgaattgtattttcttttaaattcacatgctcatttatgttttagaatttgttccacagtggtgacttgacagctttaaatgtcactttgggaggccgaggcaggcggatcacaaggtcaggagatcgagaccatcctggctaacacggtgaaaccccgtctctactaaaaatacaaaaaattagccgggcgtggtggtgtgcacctgtagtcccagctactcaggaggctgaggcaggagaatggcgtgaacccgggaggcggagcttgcagtgggccgagatggtgctactgcactcgagcctgggcgacagagcgagactccatctcaaaaacaaaaacaaaaaaaagtatatgttgaataatggtatgatagaagtcactggccacaggaagaataaacttcaaagaagtaagtttattatactcaaaggcttcagagtgg

SEQ ID NO: 128980 - DNA, 1010 bp, Homo sapiens
cctgcctcagcctcctgagtagctgggactacaggtgcacaccaccacgcccggctaattttttgtatttttagtagagacggggtttcaccgtgttagccaggatggtctcgatctcctgaccttgtgatccgcctgcctcggcctcccaaagtgacatttaaagctgtcaagtcaccactgtggaacaaattctaaaacataaatgagcatgtgaatttaaaagaaaatacaattcagggttgtatacaggatatatatttattaacagtgaaaaagcatttacccaaagtcaatgttacaaaatacaaagagtacctccacagtctggccagctcattattttaggcattatctcaacctgcataaagttctctctcactcattttgaacttttctccctctatctatctgtaaccaaaatttttaacttcaaaattaggacaaataggaatactgaatgcctaacccttcagcaatagttactagagaaaacagattaaataaatatatctgctctcaaaccctacgtattttaaaactaaattatctactaaaatagaaaaacaatagacttagattaatagcagctgtaacaccagtcaaataagcaattttgataaggttcataggtactatggtaataactaagatataaatacaatttttccactttaatatgcatgcagacagagagagaaacacagtatgtaaggctgggcttgagtaccaaaacagtttttaccctttcctgcttaaagtggagaaaataaagaatttgagtgtgcatgtaacataacttattgttccaatttccctgaagttagttagagcacctggataagaactccgaattctgaattggtaattttctgaataggttttattaaagttgaagatatattgtcttccataatttaagtagcaatacagtaaatgtcctcgcagggaaatcctcatttaatactccttgaatggacattacactgaggtatacagcaagttaactt

SEQ ID NO: 128981 - DNA, 1168 bp, Homo sapiens
tcacctgtttttgactaccctgagtctgaatcgtgctcagcttgtggggaatgcgttaagagctcctcagtctttctgtggctgtgacccaggagtacgtgaaaaatatgaatagttcagaaatttataaaaagtcactataaaacctcacacagtcattattgaagttagtctcacaaagtgaagcatagtttttgtttattggtgacaatttacaaaatacttgccagcttagcctcacatatgacagatgtgaccagcaggctccagaccacaccgagctgcatgctggccccgtctacaagcctggggaagtgtggctgggctcctcaaccttcacaacttggggaggttgctcagctcacatgaaaatcagtcctctctttttccctagggcactctgtccctcttatgttgataaagtgggtttcccagccaggtggcacaggggatgctagactggtgtgcgttgggcaattctctgtggcagttctggacatcttcaaggatgcttgtctaggcagaggacagatttgtttcctgactacggtaataaagatcatcatctacctgtagggcaaaggttggatgagttgattggagaagcagcccatcttataactcgaggggtttcctgagcttggggttcctcagctgtgatacagatgatacatcataaattgggttgtcacacatcacctccttgggggacttggggtggggggcaaatggcattcccagagcaatacagtcctttgcctttggcccaggagtctgccagcatccaggaagctgtggcaggctaggtcattagcttgcaagcagggtaaaatctcaggcccttcacagggccgcagctttggggcagctgggcagggtctaggcataccagcctccaggctgcctcccacagcccgggcttcctctggggctccttgaagggcagactgggacagtgatacggtttgggcctgtgtcctcacccaaatctcatctcgatttgtcaagggagggaccaggtggagttgattggagcatgggggtggtttcccccatgctgttctcgtgatagctagtgagctctcacgagagctgatggttttaaagtgtggtgcttcctggttctccgacttgcttctctcctgccttgtgaaggcgtcgtctcccg

SEQ ID NO: 128982 - DNA, 1343 bp, Homo sapiens
aatatatacattatataacatgctttgcatatattaagttatattatttaatattaaataacttctaaagcaaattctacaagtatagaaatgctaatatatatcagaacatctctgaattgaaaacgtccttaaagtaaaaataacttttctttcagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcag

SEQ ID NO: 128983 - DNA, 1057 bp, Homo sapiens
aggctgttggcttctgtatttaacttactgaacaaaactattttcttgtgttttagaatatctcatttgaaaccatgtatgatgtcctgtcaacaaaacctgtcctcaacaaggtattttaaatgttatatgtatatttgccttttagggaaagaatttggccctatgttttatctttctctgttatctttgatcagtttgagcacaaaaggtgtgttcagcttaggactgattttttattaaaaaatgtttttgtgtggctaaaactgtattttggaatacaagaaagaaattgatcactgaggcttgataggtcagaatattgtttatagctttatttacatagcatttgaattaaggctagcattttactcttattggtatctattaaaaatctcacactatataactaacacctaaatgtcaacaaaacaaagtctgcagtccattttcagacagagctctgtgtcttggtgggttcgggtttcccttaaactttactacatctgtttatcttttccctacactgtagttttaaaaaaatgcaaaaagtttcctatcatcccaccactcgctaacaatcattccctgaacgttctgaatatgcccccctaattttcccatttgttccttcttttcttggtccttctccacagctctccctaaagtaaacatgccgcctttaccctgccaggacaaatccctccggcctttagcatccaggtcaccctggctctcacaggaagcctgccttcagttcacgggccctgccatacttgcgttttgcctataccatctttgagcaagtcacaatctcgtgacttgtgtttgggtgtgtgccttgtgatctgggtgcctgcagtttcccccactgtattggaaatgctttaaggatagggatagccaaagctccacggtttttactccataggacaccggcaggtctcccaggactgccagctgtgcgtcaaggagggttaaggcagtcttaaagcattgggggtggagcaatgtgctgtcaggaataagctcctataaggagctggagattctttcc

SEQ ID NO: 128984 - DNA, 1138 bp, Homo sapiens
tcgagaccagcctgggcaacagagtgagagcccatctctaaaaatagaaataaataaataacacattccttagatacttgtttttctttagtttctacagagctaaacatttccgttctaagtcatctaaaaatgtttcccaccatcatcctcagcaaactaacacaggaacagaaaaccgaacactgcatgttctcactcataagtgagagctgaacaaagagaacacgtgaacacagggaggggaacatcacgcaccagggcctgtcagggggtggggtgaaaggggagggagagcattaggacaaatacctaatgcatgtagggcttgaaacttagatgatgggttgatgggtgcagcaaaccaccatggcacgtgtgtacctatgtaacaaacctgcacgttcagcacatgtgtcccagaacttaaagtaaaatttaaaaataaatgaagttatttactaaaattaaaaaaaagtttcatttttctttttaaatgtttctatatagttatgaagaagccaagaatttattgaccaagaccaagatattggccccagcctactttatcctgggaggcaaccagtctggggaaggttgtgtgattacacgagacagaaaggaatcattggatgtatatgagtaagtaggtttgttaaagcaaaagaagtagaaacaaaagcatacactgatatactttgagttttaaggcatgtagcctaagagggaatctctccttttgtatctagactcgatgctaagcagggtagatggtatgtggtacaaacaaattatgaccgttggaaacatcccttcttccttgatgatcgcagaacgcctgcaaagatgtgtctgaaccgcaccagccaagaggtacctttgcagggtcatctatagaaagaaactgttgccattaaagattcccttggttctggcatttttctttggccttcaagtaatttataaacgtcctatttttcatagtatctctagccactctccactgatttttttgtttcgttttcttaacttaaagagcaaaattgtgctgtactttccttttctggttctaatgctggataccactctgaagttgaataacaaacaggcaagaatttaaaaaaggggaaggagagag

SEQ ID NO: 128985 - DNA, 1034 bp, Homo sapiens
ttatattgatgataagtaagtcccaagtcacacccaaaatgtgatcataagtgaagataaatggattgcttgagtgctgagacaagagggacatgctcttctattttatgtgtccatcttgacctttctgaaaaaataagaatattgtaattagcattctatgtttgaatctgaggctcactatttataagctgtgtgatattgagagagttacctgacttctctgaacctcaattttatcatttggaaaacagaataaatataccatattgtaaaggtcttgttaggattgatcgtggtgactcggtaaataaagctcctagtgtaatgcctggccctcatcatcatgttgatcattactatcactgtgtttctgaaatgtcactgaaacatgtcttttataggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccagtaaggagtctgttgttacataattatacaggtagccttctgtcctgttaccgttatgtaaaagttgaaatctaagaatatgaggacctaaagggaatatgaagccccatttcacccccttgtacttcttgtcacttcataggtatgagatctcgtggtagagaagagtagaaaggaaacggaggtttctgagcctcttctgggataaagagcatgtggctgggtgtcaagggctgggagtcacaatctgatttctagtcctgggtcttccgctcacttaggcaagtcaggcgttcattctctgcccttcagtttcctgtccaaaaagcgttgccagtgataccccacctacttatctcacatactagaatcaaaaatgctttgaactttttaaaaagccttttatggttttgatttatttttgccttccccattacccaagctaggcctttatatcccactctgaagtacagtgagcgacaggg

SEQ ID NO: 128986 - DNA, 1706 bp, Homo sapiens
cagggagaataataattactaatatatatttcatatggtggttgtaagggttaaatgacatactgtgtataaagcatagtgcttggatgtaataagtgtttaataaatacccattacgtcacatttgtttgttaaatggctggaacattccacttggggaatgctttgagttcctagggagaaaaaaaatatgtttaggtgacattacatgtaattaccaagttggttaaaaaagtgagattcgtgaattttaagcagattatctcagcaaaaggccgtgaacttaagttgtgatctggatgttagtagttgccattgagaataaatatatgatgtccaccactgaatttgctcaatgtctctggtttgctaaaagaatgcagttacttcatcttagctgaagatcagccattaaccatgacacagggctatggatagaatagtgcaggtttatctctgtgagtgtgggaaggaaatggtaagaacggtatatgccagtggctagagggtgaattcgtgcagagagataaggagtgcttgttatgatgtttttgtggtgtgggtcaggttaggtcatccaagtggaattactctcgttcctgccttctctggagaatgatggaaaaataaggcaggaaaaacaatctgagaatctggtctctgtataggggcccaatattcagtattacatagaatctttttataactacatgatgtaaaaatgctttaaaaaataattcctatcacttattatgatagcagtatctagaaaaaattatatgtccaagaactagatttcaaagcatgcttttattatatttgtttatattatattatatattttttattgttattatgttaaatgcttttattaatatatttgttttccagcctggcctacttggcaactttcctggcccttttgaagaggaaatgaagggtattgccgctgttactgatatacctttaggtaaagttcacttagaagctttaaaaaaaaaagtaattaaattcttttacaagtttccattgaggtgtgatatacatacagcacaggtgctgtatgtcttagatatacagcacaggtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacattttgggggtgtctgggtactcattttctggatatatacctaggaagtgaactgttgtgttatagagtaattgtgtgtttagccttatagattctgccaaacagttttccaaagtgattccagcagttgacaatcagcagagtatgagagtttcagttttctcctcttgataattctcctctcgatagtgtcagtctttttttttcctttttttttgttagtgtcaatctttatttgagcctttttgttgagtgtcgcagtatcgcattttagtttcaa

SEQ ID NO: 128987 - DNA, 1044 bp, Homo sapiens
tggatcacgaggtcaggagttcgagaccagcctggccaagatggtgaaaccccgtctctactaaaaatacaaaaattagccaggcatggtggtgcatgcctgtagtcccagctacttgggaggctgaggcaagagaatcgcttgaacccgggaggcagaggttgcggtgagcagagatcgtgccattgcactccggcctgggcgacaagagcaaaactccgtcttaaaaaaaaaaatacaaaaattagctgggaatggtgatgcacacttgtaatctcagctacttgggaggctgaggcaggagaatcgcttgaacctgggaggcagagattgcagtgagccgagatggtgctactgcactccagcctgggtgacagagcgagatgctgttttaaaaaatatatatataaattgtcaaatagcactctcttttagctacatatgggtaagccaaaaggtaatcttgacagcatttcattatgtcttttagtaagcattttatttatttttcagctaaaggttatagtgaattctctgaagaatatgataaatacattcgtgccaagtggaaaaattatgcaggtggtggatgaaaaattggtaagagatattatttctcacaataaatgttaagcacatagaaaatgcgctgttatttatttaaaggcataattcagcaacctcttcgcagggacttgggcaaatctgcatgaatctagctcactgtcagaacttcagagggacttaaatttggggaattggtaatattagggttacagcatagcaaattatggtttcgtaaaaggggatgggactacattacgacattgggcaaataaccatatttcatctgggagtgtggtatttccttccctttatgtagtgagttcactattgaagacttggttttttttcttaagtgtctcagggacatccagagattttttttttgtagatatgagcaaatgacatactcagcctggccccttattctgtagagttcctcagtagctctgaccctgaaactcatttgggctgagtgtt

SEQ ID NO: 128988 - DNA, 1033 bp, Homo sapiens
atccaccagaaatatggcccagcttcactgataagtgactggatgttgctatatcctcagaaattgctgcacgtaagttaaagagtaggaagttggaggatatgacagaatacagcttgggcttggactttgtccaggaaaatgagaagagaagaggtatatagtagggaagattaggatggctgacagaatcatgaaggttcttgaagctgatcgtgggaagataatacatgttgccatctggggcttaaaaggtgatcttcctgaaggcaacactggagacattggtttggcaatagtgttacactctctgagagagaattctgaaactggaaaccaattggagaattgtctagagcccagactaaatctttgcagatatttaggagaaaaaaaaaatggcaggtatttcccgtcagtgataatcaggttagagctcttaagccatagttgattttttcatagaaaaccaattcacatgaaccttccctactagatcattctattccaggatttctgtgaccgcttatgattgtgttctcaacctagaagcactaggtagagaatgaactttctttccaaattttggtttgggtaaccaaattctacactgctgttaagactttgcctctcatatattcttatagatgtatctaactgaccctcacaaaaaaccctttcatcatttcaagatgatacacctctcattacaggtacagaggtgcagttccatggtacaccataaatcttgacttaccaccctacaaaagatggcatgaattgatgcttgacaaggcaccagtggtatgctatgatgcttaaatcttttatttctttatttttattttttattttatttctttatttttatttattgattgattttttttttgttttgagacagagtctcactctgtcacccaggctggaatgcagtggcacgatctcagctcgccgcaacctccgcctcctgggttctagcaatttccctgcctcagcttcccgagtagctggaattacaggcacctgccac

SEQ ID NO: 128989 - DNA, 1049 bp, Homo sapiens
acctatcatctatttaagtttttacctgccttaatagagttgtctgttattaaactgtttataaacttggggatagtaaggaactttaaataacattaagtaagttcattataattctgttttagggctactcgtgggttttgaagctgtgtctccctgtagaattcttttttgagggggaggaagtagctcttttttccaccctacccctaaaactaacctttttgcataaacgacttaggcgttcatgccatgtgagcccctgaaatactgtagtctcatagctgccaactttcttattttctgtcacacttatcctatttccttgcagccaggttctatgccaatttcacgtttgtttattgctaccaagagtcgttatcaacctcagactcactccacatgtattgttgctagcttgctctttagttcttacctctggggcaggtcacattctctcctaatactagacagagcattttcaactttgctcacagttgtctagtaagaaatgtgcctgtaatttgatgtttattttggctttggaacccagggcgtgcaaatgtcattattaggaagggataggagtcattacgtttcacttaatttgccgagttgattctagtgatcaccagaagccctgaactacgcgcagattattctgttaggaattaaattgaggcattggttttattatctctgtgggaagctgtttgatagaacagggaaagccattgactctgattctgtcaccagctgtgtaactttctacaagtcactaatggagcagggtcttaagtccacaacatgatcataaaattaagcacttgggttaagtacccatcacagtattcccaactcataggaaaacaatggtcagataaacaagaaaatgtaaagcggagtatctcctcacagcagaacttatttacaaattttacaaagtaaaattaagttgcaacccctataagtctctaagtagctcatttattagcaaaataaggaaagccatttaccaatggtggattacctaaattgtattcgattgt

SEQ ID NO: 128990 - DNA, 3351 bp, Homo sapiens
ggccgcttttctcagagggcaaagatgggtcagggtgggatgttacattagtgttgagactctttggatccgtttcgtgggtaccgaggacgcctgggtacgcgggacaggctgcacccgcctgctagaggcgccccatcgaggcgccacgggtgaagctcccggccccacctacggggcggggctccggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccggtgagtgagcttgagccgaggcgcagagaggggcgtgcaggtgcgggcgcggatggaggcgcaggtgtggcggcgcgagcgggtacaaggaacacctcgtgctgggcagcttctttacgggggtctgtggtttcgtgcacaggggtgtgggtgcagagcgggctggcgaaccccgtcctcggtagattcggtgctacctgcaactagaactcctttaaaggaaatcctagtctctgcaggatacctgggtgtgattcgcacattcttagatttgagtgagtgtacttgaataaccagttccaggcccttgcattttgaagtgtttaaataaaatgttccggtggacctgtgtgcattactcaatcaaggacagactgcctgatggtcaggtgctttctcccgaagaagttcaggagttcagcccaggatactgcagggccgtgggaaacgctgagtggtcccaagcttgggcggtgcgagcagcccagagcaggccccaaagggccccctgtggccttttgcacccaagtcatgggatcgcctgtcccgtggctctttcccacgagcaagtcacagggctacggacttcctaactgcaagagacagtgagggacgagcgtgactctttcattttacagaagaggaagtagacctagagtgagaaaatatttagccagaggttacactgttgtttactgaacatgcgtaacgtccgagcctcttgacgcccagtactctttcataattcatttctttataaagcaatcagactgcgtttgtctttgccaacagaatcggataagtaggaacctggcgcatctggcctgaggctagatggtgatggtcttgaatagtttaggtaggttattgaaagtggaagcaagatgtgcattgtcttcttttatacctgtaaggagaaattctttaaaatcatggtgggatatgatttagccattaaaattgatataatgttcagcagataaaagtagaatccagaatagtatatacagtttttcctgtaataggaaaatacacagaacatgtatgtggacacgattaaaggccttaaaataaaattgctccattgtgggtagggaattaatttgcttgacggtagttggttttatgggaattgggagagactttgatactttgatactgtcagggcccttcattgaaagaccaccaggaacacaccataagctgaacaaattgggtttagtgttctttgaggcaaaggagaccacacaccatgagcgacggacggtaggttatagaaaaaaacccattacagaatttgaacttcggttgcatgatttggggtaagactgaggaaccgggctttgctgtagatagaatgctgttagaaggtggggcaattctgactgagtaaagaaggaacagccattctgtttagcacgagaaggggatgtttggtgttttgtgcgttgcaggtgcccttgtttttgtctgttcttagagaaaatcttcaagtggcattgctttgtcttggtgtgtcatgtctcagaataatcttatccgacgtaggtatctgtgggattgttgatgtccaggaggaaaacagagcttacctggctgtgagtgtcagatcggcttgtaataatattgagagatagctgtgggactcagagcagtttcaggtgttggaggctgttttttcttctttctcaatagctttatttattctagcaaaagtattttgatagctattttcagaagaagaattaacaacctctcaatggatataatagttcttatctagaacagcgattatcaaagtctagtctggccactggtgtcactttgggaagctgttttcacaggttttcaatgaaactggaaaaataagaatgcaaaactaaaattattaatttagaatgttaatctttactctgattgtatggacttcaagttttcattgttgcaaacgtgttcttaaaaataacggcagaggtagatgttatgtgcatggaatttgttttgttttaacatctccatttggcagaataaaaatttggaccctcctgtgccaaggcctcattaatttttttttactggcctggaaaatcctgggatccatgcactgaaggacctttagaaccttacagaagtttagtgacttcattctctgagaagaataagcagtttttcaactggagtcattatatgataaactatagcctcatggtaacaaaagatatttcaaaagtactttcaataaatatgaataatgagaagcagctttaaattggaaacaagtcatttgatttagaacatctgtaaggattttttgtgtgtttgtttttgaggcttttcacaatattcctatgtgaaggtcctcctgagttattcttcattattgaattttttaggagtctattaagagatgatggtgaagacagtggcacaagaaatgtctggagagatagcgccagatgacatcatccagggttctgtagactcttattaaggattcagaaatttatcctaaaaaatgggaggatctggaaccagccaatgggaggccattagatggttttagacaagataacattttcactttaaaaagatgagtctggattggaggtcagcaagggtagatatgaggagactagtccagaaaagaaaacagggtgcgttgaaggatggtggcgccaggggtgagggagagaagtagatgttctagaaaaaaatcaggagggcgaatgagctgaaggaatcgttgggtgaggatgagggagtgaggtgtcag

SEQ ID NO: 128991 - DNA, 1344 bp, Homo sapiens
tccgccctccccaccctgctcagaattaaagtcaatgatcttttttttttttttttttgagatggattcttgtgctgtcacccaggctggagtgcagtaagtagtgtgatctcagctcactgcagcctccgcctcccagattcaagcgattctcctgccttagcctcctgagtagttgggattacaggtgcgcacaatgcctggctaatttttatattgttaatagagttggggtttcaccatgttggccaagctggtcttgaactcctgacctcaggtgatccacccaccttggcctcgcaaagtactgggattacaggcatgagccaccatgcccagcctaaagtcaattatctcaccacagaccacaaggctactttgatccaaccagcccatcttatatactaccactttcctgttttctcacagtgctccaatcacactggccttctttctggacttcaaacatgccaaatatactctccttgagggacatagcacttactgctacctttgtttggaatgttctttcccagatacccatgtggcacacccaaatgcttgagtggccccttattagtgaggccttcctatagcattatatataagatggatataaggtaggactcagaacatactccctatcctccttactctacttcacctgactccaaacactgtcaccacctgacgtagtacatattttattttttatttgtttagcatctgtctgcctctaactagaatgcaagctccatgaggacagagatttttgttttgtttaccgccatattgtcagcagctagagcaatgtctggcatgtagtagcactcaatgaatattaattgaataaatgagctacctaaaaaataactgcattgatatcataacccaagtagtgtctgaaataatgtaatgaattaccagaatgcaaatgaattattttccagatgtctttaagttgggtgttggaaagtcaatatgcatttttcctacaaatataaagtaagtgctgttattatccccatcttatggataagacatctgatatttagcttatgcaactatgcctgttttctgattttgaggcatgtacctcaccacttatactaaatttccaggtcagatcataaaaccttacgtaagccataaaattcagatataaagtagtctaaaaaaaggaaggaccagaatggaagatacctatcttacacacaaacagctgtatctagagtataggcttcttagctttctagatgtttcacccagttatagctgttctttgatagtgatacagtgatagaggcaggaggcagagaaattctaggcagatgggaagatccc

SEQ ID NO: 128992 - DNA, 1038 bp, Homo sapiens
atatcattaaaaggcattaagcagggaagtgatattatcagatttgcatttctagaagatcattctggttgcagtttagaggacgttttgaacagtgagagagtccacgtaggaatttactgcagtggtagaggaaagaaatgatggtaggctagactaggatgccggcagggagggtggaaagaagatgagagatttgagagttgtttaaaacaattaactgtcttaatgattagaattaaatgtaggtgataaaggaaagaaggaagtcaaggcaacttctaaatttcaggcttgagcatgaaagtagatggtaatgttatctactgagatggaggatgagcagatttgaaaggagggaaaactgatgaactcagtttctgacttgtctcaagtcacctatcaaatgccacataaatcagacacagaatctggacacagaagccttgggagggaatgaaatcactctgggagacaatgtagactaatacaagttagataggacagagaccaaggatttccaacactagtgtgatgtagtagaggaggaggtgatgaaagactgtggaaatgaagtcaaggaaggttgcagaaaaccagtagctggggcataatggaagccataaaagggaggctttttaaggaagaggaagttgtcaattttatccaatgtactgaaggatctaacaaaatgaaaattatcttttgccttacagagctcactgggtacctcagcaagagcatttttggcagaggttgttggtgcaatatccagatggagaagtattggtgggtgagttagaggtgaggaaataaatataataaagtcaattcaacacttttaaacttaaagcaacagtaataaatgcaaaatatttttgtattatatagacagggtaagtttttattttgccaagcagaatttttttaattctacctactagtgccattattttattaaaaagcattcaatttcagaaaaataagaaggatataaaagaataatgaacactcttcgggagaaaacagtaaccttaa

SEQ ID NO: 128993 - DNA, 1335 bp, Homo sapiens
ttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcag

SEQ ID NO: 128994 - DNA, 1030 bp, Homo sapiens
cccatttaaaggatcacttaaactggaaattcagaaagtttaaaattacttcaaggctgggcacggtggctcacgcctgtaatcccagcactttgggaggctgagacaggtgggtcatctcaggtcaagagttcgagaccagcatggcgaacatggcaaaataccttctctactaaaaatacaaaatattaggcgggcatggtggcgggcacctgtaatcccatctacttgctgaggcaggagaattgcgtgaacctgggaggtggaggttgcagtgagccaagatcgcaccattgcactatagcctgggcgacagagtgagactccatctcaaaaataaatgaataaatagactacttcaggtccaaaaggaataaataaatgtaggtgatgaaatgtcttaggagatcactggggaaggtagtttagatcatagttccttcagctgctcctcaaatcacactttaaggatttcctggaagaactgaccctgtcccattaagactggcattagcccttttggagctgtgagtgtgacacacaagctgacatggagaactctgggaatgtgcttctgagggatacccggtatgacttcggggaattccagtacaatcagaaggaaaagcaaagtgtaaaccaaaagattaaccacgtgccctatattaaaatgttgccataacaagctaccttttttgttttagaagatgtaaattacatagggaaaaacttaatgagtgacaaacttttatccttaggcaaaatttagtctcttacccagatagcagtacctctttagcccagattacttatcttgggtaagtggaagcttaaccttctatccttgtgtttcagaggctaatttttttttttccattttgttgaacaacaaactcggtaatcccattaatcaaatcagggtgtgttttcttttttaattttatactcagctatagtcaaaaccatcacaaggccaagctgggtgggacctttggaaacagccagagccagaggccttgtgggtggcaga

SEQ ID NO: 128995 - DNA, 1069 bp, Homo sapiens
gattttgttctccattcagtgttcgtgaagtcacctctgctaggaacctgtatcccataatcattttatgttcaaagcctatcatccttcacagtccagctcctattccatctgttttcttgaagttttttctgatcttgctaaccagaagtatgatctcagccttaagcttccattttactttatctgatgacaccagcagtttctacaccccattatggttatttgtagtaatgtgccattagattgtaagctctttaaggaaatgatacatgtctggatttgtccctttatctcctctgttgctgatcatagtgtttatatgtaatgaaggctccataaaaggctatagaaaggatgttaatggtaatgaaggaaccacatttcttaaaagataagcctacaatgtgtagtttagaaaatagttacaggaaaggtggtgatgctacaaagtttgtaggataatgcatggaagacttgcgcaggaggcatcttgatgtggatgttagaaccttagaggaaatcacgatagaattattgagtgttagaaccggagaatgttataactgttataaaccttataggtttttatatcattggttttctgactgggttcagtgtaaccttgggttacagggagatgccttggggccttacctgggagtgtgactgaaaattgttggggacccagttctgcttccttaagtattatgcctagttcagctgatcaaaacagctccacttttatctcttttgaatatatgtatagggttctatttcatatttttaaggtatatgttcttgaaaaattttttgaaaggtacttacgtagtccattgttgttactttatatatgaggaaaattaagtcaagaagtgttcatcaataggtccaagtccagtatggtgggaaggccaggattttccccagctgttatggcctcctatggcaccaccatgctgcctggcatctctgtagccaccccgtcttataaagtctttgaagagcagagagtgagtctgaatgtttctgtgctagcctttgatacagtgcacattaagagaatgtt

SEQ ID NO: 128996 - DNA, 1067 bp, Homo sapiens
tgacaaatgatttttcagtgcggagtatttttagaacatcaggaatacagagatattgtgtatgattttatctttcagttagttcctttttcctttcctcccctggtcttcccccagcccccagtctgtggagctgatgtacaagtatgacctggtcctattatactacattcatgtcaggtttagagtggttagccccaggcatatgtaatgaagagaaatttcttctttcatgttccttacacatatatgtgctgatgctatgctgccatgaaaccactcgtgtttttgcagctgtcttgaagataatataatctttgttcgtgtgaaatgtgaagggagtgattacgtagtgaagtgggcatttactacatgcaacatattcttgagattcttcccaccaccatctgtgtgagcagggtactcagaaacactcccactccacaggtttaaaaatggaataatagaatcataggatcacagaactccaggtctggagatggagatgattataacggagattcatgggcttgataatgtgcagagagagcgtcaggaggtggatctcagtgtcatttcagccttctcggggttatatccagacccactgagagtgacatcaggctttcttcaccctcccaccactccccactgccctcctcctctgctacctccccatccctgtgtgacataacattattgaaagactttggcattaacaggttcccctcaaaatatggcaggggacaggtggcaaaataccttagtgtgactttaagaaatatgttggcttcctattcacccccttacattatgacatagtggagtctgaccccctccgtcattagcaaattgcctggctccagtaagtcttcaaatctggctttttactcctcactgtttttttaaaaagctttatctttagagagaaacgtgtcttcaaagtcctttaatgtgacctgtatagggatgtgttggcttctactgaaagtgttatgagaccacctgtggtgtcaggactgcggtctcctgctgaaatagaccagaatggtttatcatattcttaa

SEQ ID NO: 128997 - DNA, 1225 bp, Homo sapiens
gtaaagaaggaagaaagagtaagtctgaggtttaaagtgagccccattaaaactgtaaattagtcaggattcctctgtctgttttccctttctcccctgtctccaggatcagactgggtacctctgccgagattgtgaataaatattctttacataattggccaacatttctttaaaagcaaggtggtttattacctggtacaagagcagagaaggaaatgtaggtggcattgcctaatctttcctctgttgccctgagcaattcagctctagccccaaactttgatgtcctacttggccacatactgcagtcattgtgacctgtcttctgtggaagacatcagtatctgtctgtttgattcaggctttcctttttgcgtctcttacttcccatcccaaacttttccatctcagactgtactcttcggggaagaagtataagaatttcttcctagcttactatgtttctaatgagccttattttattataatgagctaaaattggcaggaggtaacaaacatgggccctgaatcccagccgtaccacttctgacctcaagagtgttatcagtcatatgagctttgctgtctcatctggaacatgggagtgatgataatatctatctcatagtcttgcactttttgtttttataagatcattgattaaaaagtattcagaactgcctggcagtagtagcaagtgtgtgtgttgtggggctgtcaactgtaaatcccaatcctccaatctgccaagataagtaggataagccctgccctgaagctgttggattaatttagtcagaaatcaatttcatgaacacttcttgagaatctgctacttacctgttgctgtgggctgtgtatagaaaacttcaaggagctgatattcatctagaaaagtctcatagacttgacacaggagcagagcagtataaaggggtagtgctgctgttgtgaattgtcgggtaggttttctggaaaggggaagagggtgagctttgaggcgtttttgaaggatgggtaggatttggacaggcagagaagaatatgcaaaatcagcacaacgagagagtgagtatatgatgtgtatacatgtgtggagtggcagctgaatgggaataagcgtaataggaacatggaattgcaaatgagaagtagtcaagattgcattggatagaatgcagtatggaaaatcctgatttcctaaatgagaatttgacttagt

SEQ ID NO: 128998 - DNA, 1087 bp, Homo sapiens
cccaagcttcagccaccctggccatcttgctgctgtgtgaatacaccaagctcattcccactctcagccttttgtttcacccacctggaacacttcctttcattggctcctcattaatcaggggcctgcaagaatgttgtgttttcatagaggcatttttccatttattccactgcagagcccggaaaggtaaaaactatatttccctctcctcttgctgctcaggttctggttgtggtttgatgccaccgtcagacacaccatatgaggtgtgtaaggtgagtgtggaccatgagtggtaagtatggatgtgggcgtgtttcgtagacattcagccttgaagtttttctttgacctttccagcaatcaactgtttaatacctgataaatcatgttttaagctagctaactagattttgttctctgcactcatggcctgaccaacaattgggccatggccatcctctttgaaatagcactcacccactcctgccgttatgctctgtcctcttaccctacttttgttcgttaaagcacccagagcaacctgaagcaaccaatgtatttgcttattcctttgttagccagctccctcactcaaatctatgttctatgaagttagatgctttgcatttttactgctgtgtctgtctctacctagaacaatgcctgtcacatagtagggactcagtaaatatgcgttggatgtacttatttgctacagttttttggtagctgcctggagggttggagtaagaagaaattgcagattgcaatggggttcaagaaatgagcagtattattagtaagtggtgtttgccatgggttctagagcagcagagccctgttgctatgcctgccatagattataacaactgaggtagagcattgatgcctgtgtttgggaaacacttccaagcgattttgcttttttaaaaattatgttttatttagctccagagacaaaatctaaagccttctagtctgtaggaaaaacattccattttaaaatttctgtcagtttataagtcattaagttagagtttgtagagcacttactctttaataatttgaatgaggataattc

SEQ ID NO: 128999 - DNA, 1065 bp, Homo sapiens
gtgactcatattttgcccttaaagcttctagtacatacgaagacttccgtagtctttccaaacctttctccctctctcttgccagagtttgttttccttccttctcttcccaccttccaccgaaacctgaagtgctggtcctgatgattagaggcctgcaaaaggaaactcgtcttcttctgtgtctttttttttcttttttttttactcactttgataagaaaaatagccttttcttggagttgctctctgcatactgagcagacattggtacacatgtaattcatatagtagttaattggcactatttagcagctggaaaggaagcactaccttccttaccatgtggcagtctcattcttgtcactatccagccataatctctgctggtgttctgattaaagctttgtgctttcagattcagagacactgggaactgtttctggtttcctctttttccattcattttcccactttaatatgctaaggtatgttttctgataattcagaaagattgctgttgctttcacctgtagttttctcttcctgtttccacaatgcatctgactttgagaatacattactttgcccatctattatgtcagtcatgtccacttctggtttctttcctgtagggaaaattgattttttaaaaatgaaaccaaacctttagaaactctcttaggtaatttcttccagctctcatgttcctatattttccttgtttgtaatatctaattaaaagcttattataaggatccttccagtgtcgttaacttcaagtaaactgtgtctgtacacctgcaggtacccacatacatttttatgaaaaggccaagctccaatttgtggtacatttttaaatcgttagtattaagaattgaagatgtgggggcattatttacgtttgagaagcccttttcaatcttaaaatctatagggttctaagcttcacattatctcatatgaacaaaggtgacaccgccatttaaaaactgaggctatgcatacacaggtagagagagagagcaagcaggcacatggatgcaagcacaaacatgctga

SEQ ID NO: 129000 - DNA, 1060 bp, Homo sapiens
ctgttaggctgaatgtcatggaaggctgtgtggcagagtaaaatgagtagttacagatctggaaagtaatcccaatatcttaccttggccaagcaacttaatccttttcagttttctcaggtacggcatgggataaaaacaccttcctctaagagcggttaggagaattaaatatgatgaggtgtgttaagtggctagcagtgtgcccgtgtggaatgcactagttgttctgactgggttatggaagtcgctgggctctaagcctgtcttagtgttgctagtgactagtggtggcgcctccgggtgatcatttcactttgtgcctgagtttcctcatttgtaaaataagatatttggcctgtgcctatggttttcaggttttcggtttaggcttctggagcctgtgtccagtgttcactcctccctgtcaccgctccccttctgctccagaagttgttctctttttctgtcatgttctaacttcctctggtgatgtcttttgagcaaaatattatgtggcaaaaaagaaattggaacaacttcacagggtgatcttgtaaggatcgtttcagtctaagtgctgggcattttcttaacgtcattttgaatccaaatcgcatttctaaagtgttaactctcttagctctcaccttgtatttactggtttagacaaagaagtgtatacttaataatgaaaccagagaatgttcagatttaaatccaagaaaattgcttttgtcattgcagcattttcaaaagattattcccaaaggactacacaagaggaagaagcagacctcagtcagaaaaaggtctgaactttttataaaggaaaagcctgaactgaattctcaaaaatacttgatctgagttatattcggagtatgtagttgaaaataggaacttatgggtggtatttaagtgtagctaaaaaaagagcatcaactgttgcctagagtaggtgagttctttccaagagaaggtcatggaaacctggtagcaacagtatccatggaggaagagggcttggatgcctgtcctgtgtaagtcggagagcctt

SEQ ID NO: 129001 - DNA, 1047 bp, Homo sapiens
acgcacctcagcctcccaaagtgctgggattacagacatgagtcaggagccactgtgcccagccctgtatttgtaaatagatgtctagttatgttatttgtttgtttgtttgtctgttttttgtttttggtttttttttttgagatggagtctcgctctgtcacccacgctggagtgcagtggcaccatctccgctcgctgcaacctctgcctcccgggttcaagcgattctcctgcctcagcctcccgagtagctgagactacaggtgcatgccaccatgccaaactaattctttgtatttttagtagagacggggtttttactaaacatgttagtagtggacgggctttctgctaaacatagcccggttagccaggatggtctctatctcctgacctcgtgatccacccacctcggcctcccaaagtgtggaagttacaggcgtgagccaccgcacctggcctagttatgtttttagaaacaaattattggtctgcctcatcatatatttatgaatcagtcttaattccatgaatgtcatagtgatgtactgtttgcctctgtttcagaatattggaaagaagatgacctgtcaggagttcattgcaaatctgcaaggggtaaatgagggtgttgatttctccaaggatctgctgaaagtaagcatggaactattggtttttagtgtatgcttgtatttctgtttgctgcttacagcttaatcctaagtaggctaaggatcacttaagtattttgctttttgcttttggttttattggtgatgtttcttttaagccttgtccttgatttttcgtgctgcaaagtaccttaagttgataatttctagaagtctgcattataatcaataatactgaggtaagtaaatttggaatggttggtgatacaaatagtgagtggcagtttttgttcgatttatttgtaaatagactatcagaatttaagaaagatcccaaaggtatatgcactacggaaacagagtagcatttgcaggctataatggaaacagttccaactgtgttcaatcc

SEQ ID NO: 129002 - DNA, 1014 bp, Homo sapiens
agaccatcctggctaacatggtgaaaccccatctctactaaaaatacaaaaaattagccaggcatggtggcgggagcctgtagtcccagctacttgggaggctgaggcaggagaatggcatgaaccttggaagcagagcttgcagtgagccgagatcactccactgcactccagcttgggcagcgagcaagactccgtctcaaaaaaaaaaaaaaaagaaaagaaaaaagaaaaatgttatgatctaaaaatgatgaattgtaaattgaaattgagaatataatttactatcatattgccaatggtctagactttaataggaatccttatctaagtatgccatagtttaatcatgcactggtcaattttgttggattctatgacctcttagaatgaaagccttctttccttttttccatcctctgttccttcacctgtcccctttccccaccctctagcctcccacttttggtagttttgcttttttaagaacaggtttatatatggaaaatacctcagggtagctttaatcagttgtgtcagtggggcttattgagggacctcatattatctaacttacacattattcagtcttcttatcactgtaagctttttacattggcacagttctgttatagaacgtgatcaaggaaagcaggtcaaattctaagtcagtttcgctctttcttactttctgcaaattgattgtggaggaaggagggaggaatgaggatgatggtggctgaaacccctgactcttgtttccaatcctgttgcttactttaatgccagtcctgctacagcaatcaagttaaaaattgtttggttagtccttgtaatttgacagtgagttaggtgtgtttatcttttcaaattttaggggaagtgctttccatgaaatatcaatagaagtctgatatttcagtattctaaaactttttggtcccaggatagctttatactcttaaaatttttgagaagccccaaaatcttttgtttacatattaatattta

SEQ ID NO: 129003 - DNA, 1034 bp, Homo sapiens
actaattgtacctagcacagtactgttttcataggttctgagtgtatcctattagtgataataaggtggagtccaacagtgaaaagcgaattcatgcttttttttcttgtatctttctttagatggagtccattgccttacctgtgcaataatgcttcttaataccgatctacatggccacgtaagtgtggatttgtgaaacttagatccaaaacatgtcgggcttatctctgcttttatgttcaaacacatttattttctgcctccccgtttcccattctctacatggttcccatggcaggtgaataaaaagaaatctttgaaaaaagaaataatttttttatttcacatgctagcacagagtatgactttaaatccatcgtcctggtgtctggagttgttttagcagtaatgtgtgtgttctgtgtcttctttgtccagtagatggcagacagagcttttacttatttttgttttctggttgagaattacagttgatagataatgatggagagaatacaaattagatctgaaaatgtgaattgtgttttccctacataccatagtgagttgaataactcagcctttcttgtgcccctcagcttatctagtcttttactagttgaaataataaaacaaactaattaccgtctcatcatctacttaagatacaagataaagtgttaaaatgtataattatatataaatttgcaagttttgtagaagtagaattttagcatttactcgaactcttcataatactctttaaaataaatgaacctgggactatgaagtaatttttgctctaagtaagtatagattagtccatatttaacgaattctgattgtattttgaagagaaaatcaggtgtctgtgtagagtatattatcccttgatttgccgtaatatatcttacaatttaaaaattacatataaaaaattgatatttagatattctgctagtcacataatttccttttttggaaaatatagtgttcccttttaagaaaggaaccatggagctctatgggac

SEQ ID NO: 129004 - DNA, 1057 bp, Homo sapiens
acacacacacacagtttatagattgtagaattagaattagatttttttcctaagtatttgcttattatatttgcttactatagcccaatagccttttttttttttttttttttttggagacagagtctcgctctgtcacccaggctggagtgcagtagcaccatcttggctcactgcaacctccacctcccaggttcaagcagttctcctgaatcagcctcccgaataactgggactacaggtacgcaccaccacacctggctaattatttgtatttttagtagagatgaggttttgccatattggccaggctggtcacgaactcctgacctcaggcagtccacccgcctcagcctctcaaagtgctaggattacaggcgtgagccaccgcacctagccccaatagccttttaaggtgatactttggaattaactcttcagtggaataaaaatgaatgtcagcataatcagtagaaagtatctataaaactgtttgcaacaatatccactttttctgaccttttcaaatgaaggtgtctaaaactcactgattctcactttttacattatattgtattacaagtttctaagtagctgaaggtaaaacctagtcagcatttaattttcaacactatttataaaatgtccatgtctggaagaattctgagatcatctagtgtaaccctttaattttacaaatcaagaaactgaggtctgggaggtgaagggaggatgtttggactggagtgtagtactgcagtgatttatcgtggggctcttttcatgcagcaaaggtactcagattttctaacaaaaacagttatcagtggatgaaagatctgtatttttgccttgcattctgatgtagtttattaaagttatgaaaaattaaagttttgtcaatatatagtttgttaatcttaattatacctataataaggaagaaggcaaaattttcatagaaatgaggctcatggtatgttttttaccatagtaagatttcttagacattttgaatgattttttttttccttcccatctcatgtttaggaaaatg

SEQ ID NO: 129005 - DNA, 1025 bp, Homo sapiens
atgtctgtcacccaggctagagtgcagtggcatgatcatacctgattgtagcctcaaagtcctgggctcacgtgctcttcccgcctcagcctcccaagtaggcaggaccacagacatgtacagataagcctggaaatttgttttatttaggcaaggtctcacggtgttgtccaggctggtctcgaactcctaggcttgagcaatcctcccgcctcagccacccaaagtgcagggattacaggcttgagctaccatgcctgacctcactttttctccactaagtttatagtgctttctaggccgccttgtcagcgtattaggaaacacttgtgaacatggaatggggtgtgtgtgtgtgtgtgtgtgtgtgtgtgtgtgtgagtgtgtttaagataaagcaccatgtgtaattgtaaggagagaggaggtatggtgtcctcattttcccaaaaacttaggcaagttttaaatggtatcaatgagagttacatctgcaagtattttagttgctatggagtgactagcatgtgacagtactgtgtgacaaggtgtagaaacgtcatctcttgggtgacttgcagctggtgacattgcagaattcaatgataagttgcggaattcaggatctcttgtggcaggacccagaaggcggtttgatcatcaatagggcaggacttttcatacctctagtgaataaaggggaggggagaattcacgcctttgctattattgccactttacttgtattttgttcttattttgagtggctagggtaaagatcttttaactgatttaaaggatgtttagtttttattttatcagccctagttccaatgataggaattcaaaatgtaaaacttagactgtctagatgacttgattatagttgaaggagaaattttaaagcgagcttgaagaatggtgccaaagtgcatcttattttctgcagactccgaagaaaggagtgtatcctctgaggggaagttccagactggcaggtctattttggcttcaggtatgctttt

SEQ ID NO: 129006 - DNA, 1026 bp, Homo sapiens
tataattgctggttcttaggatatgcatattttaagagttgttagacctagtccaatatatatcagattgtacttctgcctttaatgtatgagtgcctgtatttcttcgcatacttgactgtcctttgtctaagtgcttttttatcttaaccaatttaatggctgaaaaagctatctgaataccttaatttgtatgtctttgacatggatgagctttatttccacatgtctaattcttatctgcttaccctttttttacgaattgcttgctcacatctgttttggtctagactctggttgcagtggactgtaaacctacttgaattaattgtattggatggatgtcacaggcgttgggtttatatccaagaacaggatgcaaggaacagtgagacctcccagacacaagaactgaagggtctgcttctctctgccatctctactctccctttttttcatggcgtctttgttcctctatataactcttcattctacctggctttggtgtgccatgccacttagttcagcccctactttatgtgacctttcagttcacgtacccagtcatagtttaagtgcatgggtatccgcggcccagatttctagggtgagcagtctgttggatcagttttatcagctggtcactcctgttccagtcagctgaggtcagcatagagagctgaggctcttggggcctgttgccaggggctgtggatgaattgacttctctagccctgacacaaggatgcagtgattagaatgctcagtacaatgtattttgccgattttttgatttgttgtattaatctttctcttatgggtacccaaaagccctttccatttgaaggatagtattgccttttgtataatgggtgtttttctatccatttatcattttaattttgcttagtggtgttgccatgtaatcaaggctcaattaaatcatgatttctgctagtttctaggttagaaataccttctttatgaggaaattatacattcaaatatattttcttcaagttctct

SEQ ID NO: 129007 - DNA, 1017 bp, Homo sapiens
cgtttcatttcttcatgctcgtcatcctcaggttatctacctgtgacaattttatgaattttgttttggtatatgtgtgtgtgtgtgtgtgtgtgtatgtatgtatgtttgtgtggagctggtgggaggtgttaaatggtgatcaactattttaaagctgtttaaagctgtattaaataataccagtgttttttgttaaaaaaaaaaaaagccagtattaatattacaggttttcaatggacctctctttttgagcagtctgccctgtgctgagcattttctataaccagtttgaaggtttatagttcattagatgagcaaattcaggattggctccttgtgacattgtagctatgcattttcttgtgaatatggattgtggatattggttgtcttactgggtcacagtgagaataaaaagaacaaggtgtcaaaaccacaagactttggtctgaagtacttgggcaagccacttacgttctctgaaactggatttatttatttgcgaaatggggttaatgatccagtgtgttgtgaggctgtgagatttaaagggttaatagagactaaagcacctcgcacaggacatggtacaaagcagagcctgggtaagtgtgtgcatatgaactggttgcctggttagtccacatctagacttcttgtatctctgagatcagagtgtctctcagtggaagagtactggcgaggaggcattcctgaaagcagtgtccccgtgaggcggtgctcctcagtggagggtgccaccttagtcctcccctttcaccttcgtctctgaggactgcaaattgtgataaaacgctgtaggaaaggtatgcagataattgcactgaaattcccactcagttttctagggtgagtggaagttgtttatattacagaccaaacatggtttggggagtggaagagttttgggctaagaggcttcactgcaaaagccacagggagtggttgtaagtgaagccgagagatgaacaccagtgaaggaactgggtgaaa

SEQ ID NO: 129008 - DNA, 1050 bp, Homo sapiens
atgaggcatgctagacaagttttagtccctgggatagtaccacaccaggaagaactattctacattctgtatggcctcgaatgtcctgttggacattcatgtaggagaaaaatatgtttctaatgatccggccttaggatatgtcaataaaaggttttttacttaaatggttttaagtatcagtgagttttctaggactgtaactaccatgtaaatcgagagaagattatactttgttttgtttgcaaatttactaaaagttgtttactatttcaaagtatcacatccaagaaagcagcgctcatgctcccgcatcaccatttcaataccgctgtatctgtccacactcgaaccttgctttcagcatgattctcctttaggtacaagcaagtgtctgactaacctgagcatttatgtaatgaaaatcattttaattttatttcccctttgtgatatttagggcattatatggattattttgaattttatatttaggcagttatattgttgatggatttcactgtaggataataaagaaggcattgcaaaatgttacgaaaaggtatttttgcccttaaagagttgagaattgctgttttaaagcgatggttcctaagcatcagggcacattagattgtcctgtagaagttttggaaatgatcattgtgaacctgccctagaaatactaatttagtagttctctaggaaattctagaaactccatgaaacttttttttttttgtgattgttttttttttttttaatttatttatttttttattatactttaagttttagggtacatgtgcacattgtgcaggttagttacacatgtatacatgtgccgtgctggtgcgctgcacccactaactcgtcatctagcattaggtatatctcccaatgctatccctcccccctccccccaccccaccacagtccccagagtgtgatgttccccttcctgtgtccatgtgatctcattgttcaattcccatctatgagtgagaatatgcggtgtttggttttttattattgcgatagtttactgag

SEQ ID NO: 129009 - DNA, 1050 bp, Homo sapiens
agtctcacaagacctgatggttttatcaggggtttccacttttgcatcttcctcattttctcttgccgctgccatgtaagaagtgcctttcgcctcccaccatgattctgagacctccccagccatgtggaactttaagtccaattaaacctctttttatccccagtctcaggtatgtctttatcagcagcgtgaaaacggactaatacatatgttgtgtaggctgaaagaactcttccaaggaccatggcatatcttggttccaccaatggcctgacgtgacctttaacctttctgtgtctccttatctgcaagataggagtgacaagagaacctagatcttcaggtggttgtaaagattagtgtggcaagataaagttgttagcccattgcctggctcatagtatatagtcatgcatgactttctttttttaagaaaaaagatttaaaacaacaaaagctctctaggcagagttaattcttcacagtgggaggaggtatttaaacttctgggcaggatgctgtggagggaattagagcttgatagtgaattggaataactctaacccattctcaacctaacactgatctttttactttgtaaaaaaaggcatttcactggagctgcattagcaatatagtttgccattttttttccaaaatattatctcctcctcccaccaaaaataccttttgctgtgtgtgtgtgttgtcatatattcccaactttaatgaaagccaaagatttctaagttttttaatgttgaggaaatttttaaaggcaattcgtggtatttacaacaagctattaaatttatttcatcaattattttccttttcttctctgttgataactttagtctacaacaagattttaagaattgcaatggacctatctttcttttttttttggagatggagtctcgctcttgtcacccatgctgtagtgcagtggcaccatcttggctcactgcaacctccgcctcccagattcgagagattctcctgcctcagcctcccaagtagctgggattacaggtgcccgccacc

SEQ ID NO: 129010 - DNA, 1094 bp, Homo sapiens
ttttttttcttgagacagagtctcgctcttttacttagggtggagtgcagtggtgtgatctcggctcactgtaacctccgcctcctgggttctagtgattctcctgtctcagcctcccaagtagttgggactacagcctcccaagtagttggtactacaggtgcacaccgccacgcccagctaatttctgtatttttagtagagacagggtttcaccatgttggtcaggctggtctcgaagtcctaacctcatatgttcctcccaccttcacctcccaaagtgctgggattataggcacgaaccaccgcatccagacctctcatctttaactgattgattttcagaggacaattctaggaaagactaaatgttttcaccttttcaaaacaggtgctgttaagagaaggaagatggacggggagcatgccaggatgttggcatttaggacatgggaagttgtataaaggtgaaactatgtctgattgtctggtagaaaaattacagtctaattagaaatgctgaagtttttccagacctttagggaattcatcgaattgcaaataaaagaaaataaggaatgttggtttgccggtaattagatatattgggggaaatgaggttgtttcttttcttttctttgttttttttttttttttttttttttgaggcagagtcttgctctgtcgcccaggctggagtgcagtggtgcgatctcggctcactgcaagctccgcctcccgggttcatgccattctcctgcctcagcctcctgagtagctgggactacaggtgcccgccaccacgcccggctaattttttgtatttttagtagagatggggtttcaccgtgttagccaggatggtctcgatctcctgacctcgtgatccgcccaacttggcctcccaaagtgctgggattacaggtgtgagcccgcacctggccgaggttgtttcttgtttttccttttacctagcgtttctttctttcttcaaaaaactagatagtgtttattaattttactgtgcaagcaggaatatacataaacttttaaaattcttaaagctataggtattttgcgcactgttttaaaaa

SEQ ID NO: 129011 - DNA, 1084 bp, Homo sapiens
cacttaaggaagtacactgcttacagaaatggggttctgtgtatctccattttcaacttctcttaccagactggagctttcctcaactccttgtcaatgctttgttcttcacctgcacctccttctatccatcattccctgggtgtcacccttgacatccttactcccgcctcttccaacaccccaggtatactccctgcctgtgtttcccccatttaaagaaatcgttcagccaactgtgctcttgaagtactctttctgtcccttgggtctatggagcagtggtgggaatgtagcagacactcagtaaatacttgctgaaccaataacagggaatcctccttttcctcttcacaataaacgccagagcacacgctgactgccgacaccagttctcaccatcccttccatcccgcctttgtagcctgccccactggcgtccccagaatgagtctctctgaagtccgaggctgcctgagagctttctcagtctatatcatcctccgcttcatctcagcagggcttgacactgccctgtccctttcctctctcagcaacatggcaggacattctccctggtctcctccactgtttggttatttggggcatcagaatcctccatgtttttcgtttgtttattgtcaatcaggactctcttttccctcccctttcttctgccctctgaataaagcacctgcttttccaaggttctcttcttggcttcattctctctatgagctcatctgtaccagtggcttcaataacgccacctatagagtcattcccaagtctacatggctaatctcggcctcacttctggactccaattctggattccagatgtcgattgaaagtcctcatatggatttctagtaaaagtaaaaataacgtagtctacgcttccaaaacagcttgtttttttttttactccttaagcaaatgaattttcttgtcactacttctgcctgtccgctgctgtgttcccagttagcgagtttcaggattctggcatcatctttgagtccttccttaaatccagtggcctgaaccttcctaaattcttgaatactgtcatttcctatgc

SEQ ID NO: 129012 - DNA, 1057 bp, Homo sapiens
ctgccagaatctagtgggatggaagtttttgctacatgttatccaccccaggccaggtggaagtaactgaattattttttaaattaagcagttctactcgatcaccaagatgcttctgaaaattgcattttattaccatttcaaactattttttaaaaataaatacagttaacatagagtggtttcttcattcatgtgaaaattattagccagcaccagatgcatgagctaattatctctttgagtccttgcttctgtttgctcacagtaaactcattgtttaaaagcttcaagaacattcaagctgttggtgtgttaaaaaatgcattgtattgatttgtactggtagtttatgaaatttaattaaaacacaggccatgaatggaaggtggtattgcacagctaataaaatatgatttgtggatatgactgctttgtggagtaagaatgtcattttgtttagtttttggaaatagtatattgtgcatggaccatggtttctcagccttggcactactgacacgttagactagataactctttgctgtggagggctgtcttctatactgtgggatgtttaaccacatcccgagcctatacccactagaggccaggagcatctcccacccagttttgacaatcagattgtctccagtcatgctcaaatgtcctctgaggggaaatcacccctggttaagaaccacggggctagagggagaagagaaccataatgaaaaacctgaattattaatacattaacttgtctgttttcattagaggaaattgagaaatgatttccaaggcccctttcaactctgtgcttaatattgtcacgtgtggctgggcactgtggttaatgcctgtaatcccagcaccttgggaggtcaaagtgggaggatcgcttgagcctgggagtttgagaccagcctgggcaacatagtgagaccctgtctctacaaaaaaatacataattaggtgtggtggtacacacctgtagtcccatatactcaggaggctgaggtgggaggatcacttgagtccaggaggtcaaggctgc

SEQ ID NO: 129013 - DNA, 1025 bp, Homo sapiens
atcggatgtgtgcttgagggcacacactcccgccagactgctattgagcgcgtccttccagttagcgacccagcacagctgtgggtggtggaacctcgactgagggaactccgtcttgccctgaaattacatgctgtgggcatgaccagatgagtttccacaaagggctaaatttcaacaagctcttcagatagtggctttttgtggcttgccaacttccaaactgactttaataaatgtttacacaactcactccccagctcataagccagactgcctccatcacgctgttcccatgtgagggtcccccttcaccttgttcaacctcgaaaggccctacatcagtgcagcccagagtctctggatgcctccctcttgtcttccttcccaaggcttggccaattgtttttcctgttcggagcgttcctttttaaattccatgtgatcctcagcgaaatatttgaagattggatactggcacttctctttgactccatttttacccataagcttagggaacttgtctaggttgccagcagaaggaatattagtctattcgctgcaatggaaaccatgtacctggtaaggcggggatggaacaaagtccatattttaaaaaatgactccgtggagacttttccagactttgccgccttacaaaatctttccagttgatactaatgaaattgacttgtcatttgggagatactgtataacggtcccgtactctgaagtagaacttgagaatacttgctggggacaactttaagcaacagaaactctcttggttctactttccttgagcagtcctgatgcttgcaggagagggtggcagcaggtccccattccctgtggaatgtaagtgacatggtggaagtgacatctacctgtagattgtagtgaaagtaagacagtttcatatgttacagagttaaagaacatttaagattcatcagcccttctgcaagccatttatcaaatataattagcctgtggtgaaacttcaggaagggggaagatgtgat

SEQ ID NO: 129014 - DNA, 1014 bp, Homo sapiens
cttctgtatgttgctgtagtcaatcaaagatttcaaactctagataaaatagcaagtagatgcataggtcatttgaacttcaacaagcacatgctctctatctcaacctgcaacaggcattcttgtgaccattcacatacatcattgttttttgaatttgatcagtcttgcaaatattttaccattattcagcaaacatcctgtgccagatactattggctccaaaaggctgccaggttgtaggtgaaacttaactgcattgatttcacatgtagtgtttactgttctgtacatgaaaatgccttactcagcactgttgctgcagtcttttctgtccgcaagaaacttttaaaagtgaaatatgtttcgtacaggtttatttgaaactcttcctggtcgggtccagtgtgaaatgttactaaaggtcacggaacaatgcttcaacacgttagaacgatcagaaatgttgcttctacttttgaggcgcttccctgaaacggtggtgcagcatggggtgagatttgattcttccccttcttttaatataaaatacaatgggtcatcaacagattcatcggtatggtgaggagctacaaagcagaagtttctgaagagtactggttaagattgaactgaaatagaaggttctttgttagtaaagctaaaaggacattcttttcaccatattttgtaagtttccaggagaagctgttttatcaggaaaatcaccaagctctgacagtactgtttattgcaatccatatggtaaaaagtaatctttttccgttgtattctacaatgtgcttttgaatttagcgtagagtttatagtcttaacagatgcgtttttcctgtgcttctgccctatggagactattttcattctattcctgcccctttccttcatctgtaataattatcgagtgctattggcaggcatgggaaagtgctaggtatctcctatcttcctaaatcccctgaagtaaatagtatcccactttacagatgacgaaac

SEQ ID NO: 129015 - DNA, 1027 bp, Homo sapiens
gtaatggaaaggtagccttaaaactctgacttttctgtccattctacaccagactgtatgactggctacacctcagaacttatcttgaacgtgatacgttttgtctatattgatacatcttcatgtagagaataaccttagtttctttatttcttagaaaatctctctacctctgtattatcatttgaactccagttccattgcttcctttacatttctatagacattttgttaattcttgttcatcgttaattagaatttgctaattatgaagagaataaccaagacagagtggtcagatgttcaggtgaatttggccttctagggtgtgtggctggtgcattcttttattttccagtctttaaaatgtgattatttgtttctcagataagtttgattatgcaaactgtgataagtaaaaaaaataccccattacttcatatagttctgacaacttatgctgtaacacatttaaatgagtaattttgttttgaaataggttggccttggggaggcactattagaggctgaaactattgaagaacaagaatctccagtgaactgctttagaaaattatttggtaaggaaaattgtattctctattacttctatggtaaattaatatgctggggtaagtgttggttcagggataagctcatatatgaaaggcaaaggagctttatgtgttatggcatttaagttcttttttttttaatttagaagcattttagctgggtgcggtggctcacgcctgtaatcctagcacttaaggaggccaaggtgggtggatcacgaggtcaagagatcgagaccatcctggccaacatggtgaaaacctgtctctactaaaaatacaaaaattagctgggcatggtggcgcacgcctgtagtcccagctactacggaggttgaggcaggagagtcgcttgaaactgggaggcggaggttgcagtaagccgagatcgcgccactgtactccaacctggtgactgagtgagactctgtctcaaaaaaaaaaaaagcatt

SEQ ID NO: 129016 - DNA, 1301 bp, Homo sapiens
gcctggctgtactgttctccagcatcttagaccttgaatggagatagtcgataattcacgaatgaggtggtgtcggaatgggcaggttgctgcttccatccttcataaaggagaagtggtgcttgtagtaaaatatttctaaagaaatgttatatccaaatgtgctggatcacagggcctggttattttctttagtctcgagacctaagaccagaaagaaaaatcttcatccttataaagtaccgccagaaagaactcccacctggctttaattaagttgatttgattctattgccaattctccgtttcttcctcagatgatcaaaccaagctaccgtctttgtatagttgcttgctcgttgcttcgtgaaccctggaacggtattttttaaatttctttttttaacagcgatgcttttcccctccttgctattctatctttcttagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagagtgagtactgcacacatacatgcctgccgcaggtgcacggggccacctggcctttctcctttccctagcgtggcttttcattcagtgcacgtttatttcaatttgatctttctgcctagatttattacttaatctgctagtgaacatcacaatgattttgttttacgtaattttctctttactacagcttccctgaaataaggcatcagtactttttacatttcttgttcattgttccatttgttggaggatttttctttttattattatttttctttttattattattacactcttgtctcttctgttgtacttggaaacacaaggccattattaagtgggaaatggagatttatatttagcttactcaaacttcagattctctctttaaatggtaataacacgcccgggtgtggtggctcacacctataatcccaggactttgggaggctgaggccagcacatcacctgaggtcaggagtttaagaccatcctggccaacatggtgaaaccccatctctattaaaatacaaaaatgagctgggtgtggtggtgggcacctgtaatcccaactacttgggagactgaggaaggagaatcacttgaacctgggaggtggaggttgcagtgagccaagattgtgccactgcactccagcctgggtgacagagccagactctgtctcaaaaaaaaaaaaaaaa

SEQ ID NO: 129017 - DNA, 1037 bp, Homo sapiens
cagctgtaaatgtctttcttccaaagctctcttcacttcctgagtgtgttatctctttgacaaatttcagtgaactctttttcctgtctttacaattctagaaaaatgtgtagatgattaattaggaggtatctgtcagcacatccctctgaaaccattctgagcttcagctcaagcttcgtgttgcttgaaaaatgaaatgtacagctgatctgagtttgttagaaaaagatacataaattaaacttgaagaaaatagatgacaggaaagaataatgctaagagcagaagtcaatgaaatagaaaacaaaatagagaacattaataaaactggaagttttttttttgaaaaatattataaaattgataaccccctaacaagatcgataaggaggaaggtgaacataaattaccagtatcagaaatgaaaaagggagtgtcactacaaatcctactgaaatcaaaaggacagtaaaggaatacattatgaaaaactttatgccaataaatttaacaacttagatgaaatgaaaaagtttcttaaacacaatttaccaaaattgacacaaaaaataaacagaaaatcagaatgttctgccaggaacagtagctcatgcctgtaatcccagcattttgggaagccaaggatggcagatcgtttgagcctagaagttcgagaccagtgtgggcaacatggtgaaaccccatctctactaaaaatataaaaattacccgggtgtggtggtacacacctgtagtctcagctactcaggaggctgaggtgggagaagcatttgaacctgagaggcagaggttgcagtgagccgagatcacaccactgcactctagcctggtcaacacaaccagactcaaaaagaaagaaaagaaatcagaatgttcaagaaagaaagaaagaaagaaaataaataaatcagaatgttcccttagctattaaggaaattaaatttgttatcaaaaaccttccacaaagaattcaggttcaaatggctttactggtgaattctatcaagaattta

SEQ ID NO: 129018 - DNA, 1026 bp, Homo sapiens
tttacgtgtgtaacagtcataggaatgacaaccactgccttcagaattatggcgacctctgcgatggaagagaatgggatcagagaaggatacacaataggctttaactgattttgtgattattgatattagaaatgtttaaaattaagatattaacatttcatgaagctgagtggtgagcacaccagtgttatattctctctatataactttgtgtatatttgaaatgttttctcataaaaagtatttaagcaagtttaggaaagaatattgataaatgaaatctagagaccatcaaaagccaatttcaccatcacaaagtataattgtgtttcaaatataattgaaattgtgtgactgttgcatattctcttttttgttgttgttaatgaaagcatcttaaacagttgcctttcaaagctgttatctttgataataacatacattaacctaacattgtggacttctgttaggttcggatctgaagctcctgccttgtaccagcaaggctatcatgccatactgcctccatttaatgttagcctgttttaaggtaagcttaaagttgattagcttgaaaaaaaatgtaatttcaaatattattctcatgactcgagaacttgagaaccttgctaaggattgttattttagtacttttgagggcaggcccaaacagttagaaaagcacatgggctactaattaacaaatctatattaaataatgactgcgctaggcaaagagaagtaggaagttctccccgtcctcaaaaagtgtaatagtgggacagatatgcaaataaccttgactgttgtagtgtttggtaaatattttatcaatataaatatattagctacaaagaaagggaatacaaattgcggttaggttcatggagggatgatgagtttgtcattgtaaagatgtgctagattaagcatgttaggtgttgagatcaacaccagtaacagcccaacagttgggaaagttccgggacttgaaagaacgccaaggcccttggctacaggtag

SEQ ID NO: 129019 - DNA, 2054 bp, Homo sapiens
agaaatgatggtgggagtggttggtctccaccatgctcccctgaactcacaagatgttactaaaattccgggttggcccagatgaaaatgccaaattagtgaccatttatgatttttaaatagctcataaatcttgcttctctccttcaatcctcattgtagtttgggtaatatatcctctctgctgtaaatgccacgtgtagttttattttcatacttcctcctttgcttcctgcacattcagtgtgtctgtaagtcagtgttagagtttctgcaagagactgaatcctgaatgagaagaaagtactgctaaaactaaaaacatttttctttttccctcagttgtggaataaactagttttcagtggttgaaagcaaaaatccacatcttgttctatcttgatagtcttagaagtgcctagggaaagaagtaagaaatgttcattttagatttctgtaacctcagtagtttgctggtagcaaacatttctttttgtgtctagcaagaatagggtcttgtggactccattctcaagaatggaaagattaagtggttttttctccttcatcttataagtgttattaaattataaacttttaaaataaaagaacagtgctctttttaaaaatacacgagacctttctgcattggtttgcttaagcaggatggacaaggactggcatcttccaatccccatttacttttctaagatcgtgaatcgaaactttgggaagaataactatgttgttcaaaatattcttaacagtgtttggggataaagattacctttggatacggaagcccaggtaaccccttttgtattgtgatttgttttctagactttgaaactggatatacaaatacaccctgaatcaagctttttagttaattcccatcagcagtcactatacgagttaatatagagacagccatagtggaaccgaagtctgtgtacataggattaaacctgcagatgattatcactttacctagataatgcctaactgttagtgcaggtgtgagagatggattgtcaaaaaatcaacagttgaacctcagacttcattgtactgaacctttcttcttctaccagtttttactgagctgaagagtgacataagtccaagtggacaaaccctaggatgaggaatgagagcaaggggagtgttgggtaccagctagtatcacagggaagagtgtttggagttgtttgtgtaaaggatacccatcatgcacttctaactagtgagggagaactccagggtctcccaccttgatcaatacaacccttaatttcttctaactttctatagaagacaagcctcttaggaaggctgcagtttcatcagtttggaagcaggaatagggattattccttagtgatctgacctcgtagggatttgcccagtcttcactgtgtgaatctcaaggttaattacttatgcctaaattaacatggtagaaagcacactgcttaagccagagagctcttcctaactgaggaatggttggaatctttattaaacaatctgaattccttttccctttgggttccaaacaagttttctgaagccattacagaccttttgggtggtccctccagatgagtggcagagatgttgtgagcagtgtacacttctccccgggggtaaggctgtgagtctgccctagctgtggcatctgggatgcaagcaggtacagtaccaacactgagggcacccggtgcttcactcaaaggagggagaagctcttaatctgttatacagaccttttgctcttaagtattttaaaatagagaaatgtttctgtgctgataaatgcagtatcttagttgtattagagtggattaaaatggaaaacaatgtcctacttatactctgaatagggtggataataatgttctatgaggtgatcaccagctaatacactaaatctttgttgttacagaattctgcacagccatgggtcccggactcttattttcccccatctgttctcaatacgtttttgaaattgaaactcaccctttttttaaatcaaaaacattgccaga

SEQ ID NO: 129020 - DNA, 1111 bp, Homo sapiens
tgtttgaatgctgctgtttgctgttttttaaaggccttctagccctcccatggggttactgcagcaggaattcttacctgtgcttcagcccagcatacagactgctgacaggtaccaagtggaatcaacgcccgctcatagtgtgctgtttgtcaacatgttcgctgcccatggttctcagctcttcgttcctcagtgctctttttcatgctttctttcttttttaatttgttccgcattttggcaaaccatctggttgtaatattgtaacatttcttattttttttccataagttgccagtgtgtttgtgttcgatttaaaaatcattatggatctggaaaaaacaatgaaagctatataaatctgtattcaattaagtgcacattagcttaggtgcaccatgattctcttttgataaaacgttaaggctttcggtcatatatatttaaggatgctgacgtttattttaagtacatttttatttgtggatactcatatgagtgaccagtcattatggtcatattagcaattagttgcctggtatctaaataggcactaatgtgttttttttcctgctactgatgttttttcagaccttacctttctgaattgaaaatatttgataggctaaaatgccacatttattagctggtttatcctgttcttaaaccacaaaagcttactaattctctttttcatccaaacttaccaaagtgatagtgcttctaatagaaatataattgaattgtgccactctttatatatggagataatacaaattggaccctgatctgcaggatgtagcatttagttatatttttagtggtattaaaagcagggtttattagccaggcctggtggcatatgcctgtaatcccagctactcgggaggctgaggcacaagaattgcttgaacccaggaggcagaggtggcagtgagctgagatcattgccactgcacttcagcctgggtgacacagcaagatagcaagatgccatctcaaaaaaaaaaaaagaaagaaagaaagaaaaaaaaaggagggtttgccctttagctaactgtctgcaagtgccagtaacctccgcttggtcagagggtcagctccagtt

SEQ ID NO: 129021 - DNA, 1026 bp, Homo sapiens
tgatcttgaaagccaactacaaagggtgcccaacaccccaaccttgaagggaggcgaaggtgagtgggactggaccaattcaacagggttctgctcctagccaggtgctcctgctagtttcctcaaagacccactttgcattcagaccaatctttccttttaatagtataaatgatcaaaattttattgaatgtctaaaatatactttttaaatgggaagcatggtgaaccccaatctgccgttcctcaactcaactcaatgccttcctggcttacttagatctgccttggaagggacagacctgtctctgaacactgttctgttatttgatttttctatctgtgccaatgggtttccaatcaagtttgttttttccatttcatgcaggtgtattgggctgatgtatctatgacaagtggtaggtgggtattttaagaaagcttgtgtcatcatcttcaggtaacaggaatgtatgagagttgggtgccaaaacttgtggccgccctgtacaagagagaaccagactccaatgtcattgtggtggactggctgtcacgggctcaggagcattacccagtgtccgcgggctacaccaaactggtgggacaggatgtggcccggtttatcaactggatggaggtaagactgggagaaggagacttatgtgtccaaaacagtgtttttgactggagccagaaaaccggctgttctttcttccttttctcttagatttaaatattttctgggggcattcaaatcttcagaatcagcgtggatattattttatatccaaaagcaacattttgataagaatagactataaggccaataaatagtcctgccctgctctatcgtttgatattttcacagtgaatagatctgctgagaccaataactaagtgggcccaacagaaaaaagcttgtgattttcggacagaggaaagatggcatgttcagccagacccttccctaccagttggctggcctgtggacatcttatcctcaccttgacataccaatctctt

SEQ ID NO: 129022 - DNA, 1361 bp, Homo sapiens
cctcgggccgcgggccgccttggtatatctgcgcgtgcgcggcgtcgctgctgggccagtcgggacagaggagacaagatggcgctgcgggcgatgcgggggattgtcaacggggccgcacccgagctacccgtgcccaccggtgggccggcggtgggagctcgggagcaggcgctggcagtcagtcggaactacctctcccagcctcgcctcagtgagtatcagagagtaatacgtctccggtctttgctccctagcctagccctttgctcccagtcacctgcttagccagcgggtagggggtaggatttgtttttccctcccgcgtctcccctccgaccctgacccacttgtctctttagaaggagatttgcctgtacctaatatttccaggagatgggctgagggcaagagcaccagcgggaactttttcctggggttggtgggctcctggctgttgccctaccccctcccctccccagcttccctaggctggagccttcttaggcacttgcttcccgtccccgagggccacttcttgccactccgatcttaatcttcccctgacttcatttggatatctaggggtcgagggaacgccccttctcccctccccctggtgaggacctcaatggggtcttcaactcctgcggagggcagacggtagagccttcgctgacgtggtcaggcctttcgtggatggaggtcaggccagtagccagagggagatgtggcttggtgtttggtggaggggctgctccgcagaaggacacctagatatcagagaacgctagagctgaaaagtaccttgcaggtcatccagtccaaccctatcattttacaggtgagaagcctaaggttctggaaggggtaggatttgccatgcttcagacacttaattattggcagagcagggactaaaaatccaggttcttaaattctcgctgggcctttttctaccgttgcctcttcatttactgaccagttaaccaaacttggttgagtgcagggttctttggggaagccaggtggctttgcccataggtggtgtgtgtgcataggcttgtttaaatgttgtgattttttaaataaaaaggccttaatgaactaggtttaagtggatagctcagcaattccaaaagaaatggttcttgattactagagaatgcagttgtgtagcatccaacttcttcacagctttcttcggaactggcaatgagccctcgaaatagactttttaaaaaactgggaaaagcacatgatgtttccccaggtggtgagactgcattttcactggttaattgccagagtgtctgtctctaggtggccgactgattaaaaaggatttcagatgaagggtg

SEQ ID NO: 129023 - DNA, 1952 bp, Homo sapiens
gaagagataccataagcaaaattaaaagatatgaaggagagtaagaaaagatatttgtacaaggattaatatagagaatctataaaacttctataaatgaataagaaggatttacttgataagtaagaaaaggatattaataagcaattcataggaaatgaagtctgacttatcagtaatatgaatgaataattgacaatgataagcatgggaagttcctcagtattggtacaagttaggaaaatgcaaactaaaatgatgctgtttttattaaaatggcaaaaattacttttaaaagcatagattggcaaagatggagggaaaggatacttttttatatagctagggagagtgtaaattaataaggttcctttgcagagttaatttggcagaaaatgggcatggcctgtatgtggcccaccaaatggctttgggaaattctggcatgcttgtatgaggagccccatacaagaatgctcattgtaacatttctgtgctagtgtaaatttggaacaacctagaactccactggtaaaagaacagctgaatgaaaggtagtgtagttatctgatttaactatatctgctctgttttaacattaatactaaggtgcccatatctccaaagggtcttaaagcaatggcacatcatagtttaattggcaggtttctcttttcacatcacacaaaataatgatgcatctttcaataaattatgttgataaaataagtattaacatgccaaatgtcatgttaatatcaggtcaagtgaaaaacaaattgcggagtgattagtacgttgccatttatgtaaatcaccaaacttcattttttggagacatgtctttttaaagagtaaaaatggattagaggaatatatatcttgttaggagaactagattgaggatgagacttaagcattatcttattataatagtaattattatttagtaactttcttttttttttttttttgagacagagtctttttctatcagccaggctggagtacagtggcacgatcttggctcactgcaacctccgtctccccggctcaagcagttctgccccagactcctgagtagctgggattacaggcctgtgccaccatgcctggctaattttttatttttaaaaaattaaaaataaaatttcaccatgttggccaggctggtctcgaactcctgacttcagattatctgcccatcttagcttcccaaagtgctgggattacaggtgtgagccaccgcgcctagcctatttagtaacattttattcttcccctgtcaaccacatctggagcacacagttgattacacacacagcctagaaagcaatcatcatttctaggtggtgagaacatgtttatctgtacttttctgtagcctcaaaactataaaatatgcatgcagaggaaaagcaatacatttaattcccatgttttcatggatttaagacccttcttctgtaccttatgctttgtttgctagtatatgtgacagtgatgtttgctgtaaggacttaaactacctgagggtattgaaagctctcagcaaaaacctgtgtctgtgaagagtagagggttccatattcagacacaacatgggagagacagagcatgtgtagtaatttggggggcttgtaaaatgtcggatattgatcctttatttttttctctttagtttcccaggtatgctgaaattgtccatttgaccttaccggatggcacaaagagaagtgggcaagttctggaagttagtggttccaaggcagtagttcaggtaagtttcagctggccagctgaactgtttcctagttgcctacacatagggaacactgcttgtttctttctgtgatgatcattgcataagtgtttttagagtctttagagattggttaccggctgcagggaaagaaactattattgcatgtttttttgctcagtgtcactta

SEQ ID NO: 129024 - DNA, 1066 bp, Homo sapiens
ttgtccattgagccattttcttcaaagtcagatttgaagaaccgggcagtttccatgtttacctaaataacaataacttcatcagtgctgggagaagaaaaatccttaacatttatttctgatgaaagccaagctacagatttgaattgttccttcttttaaaacctcaagtaccccaaaaatcttcacaaaaaccaacagaacaaagagccggtttggggcacaaacaatattattcttaaatttcaaattagtcaaatgccaaattttagtccttaatttggccaaaatgccagattgcaaattctttacctaaagaaaaattcaactatatatgtacagcttactacaatgttctcacgacacaagcaaaattttacatatcatactaaaacaaaaattctacttacacccatagcagcaaatacaattgcaaaattttcctcactgtagtctactacatctttggatttctttaccaaaccagcctggcgacagatctgagctgcaatctgatgaacaaagtagaagaattcagttgaaatctaaaataacatttctacaacaaaataacttttaccataaactttttggaatcgtaatcataaacgaaaccaggatgttttagggtattcattcaacaaaactattttgtactttttgcaaagatatgcaagggtaagcaagaagacatgtgcagaaataaagatgtgaggtaactggattatacaaacaataacactgagtatttattttgaaaaccctttattcggtttctcagtaacagtgatgcattatagaaattcttgtctgctaaacttcatagcaaaccgatcccagtcctcacctcattgtgtggtagcccagcagcagagaagataggaattttctgccccctagcaatactgttcatcccatcgatggccgaaatgccagtctgaatcatttcctctgggtagattcgacattgagggttgattggctgacctaatgtatttccaaaaaggaaaatttcaacaagttgccgcattattcatgaatgaaattagatatcatatcaaattaa

SEQ ID NO: 129025 - DNA, 1004 bp, Homo sapiens
tgttattttagatttcaactgaattcttctactttgttcatcagattgcagctcagatctgtcgccaggctggtttggtaaagaaatccaaagatgtagtagactacagtgaggaaaattttgcaattgtatttgctgctatgggtgtaagtagaatttttgttttagtatgatatgtaaaattttgcttgtgtcgtgagaacattgtagtaagctgtacatatatagttgaatttttctttaggtaaagaatttgcaatctggcattttggccaaattaaggactaaaatttggcatttgactaatttgaaatttaagaataatattgtttgtgccccaaaccggctctttgttctgttggtttttgtgaagatttttggggtacttgaggttttaaaagaaggaacaattcaaatctgtagcttggctttcatcagaaataaatgttaaggatttttcttctcccagcactgatgaagttattgttatttaggtaaacatggaaactgcccggttcttcaaatctgactttgaagaaaatggctcaatggacaatgtctgcctctttttgaacttggctaatgacccaacgtaagtaacagagctatttctttctgtggcccagactcgggatcaaaagtgtgtcttaaggttggggaggtaaaatgtggtaataacagcatttggacctaacaatgaggtaaccctgtatttaaagtccagccctgcttcttggtagttatctggcactgggcaaattacttaggttctgaagctcataagatgtgacagctgatacttgtctcatggagttgttttgcatattaaatgagatcatacttataaattacctaatacacaatcaactctctgtaaatgattttttcctcctacctcaaaaatctggctttcatttgtttcctctctctctccttcctacctgcctgccccaccccagtgttgagaaaccatacaactgagaaatttgggacatttataaata

SEQ ID NO: 129026 - DNA, 1581 bp, Homo sapiens
cttcagcacttttttcttcagaaaacccagtgtttatttaggaaaaatattaagattctagcaggctgggcacggtagctcattcctgtaatcccagcactttgggaagccaaggcaggagggtcacttgggatcaggagttcaagaccagcctgggtaacatagcaagaccctttctccacaaaaaaattaagatattggctgggcgtagtggcacacacacttgtaatcctagttgctcaggaggctgaggtgggaggatagcttgagtccagtaatttgaggctgcggtgggctatgattgtgccactgccctccagtctgggtgacagatcgagacctgcttcttaaagaaagattataacagttacccctagaagttttggggtatttgttcagtaatacaaattactgaaattttgagtaagttacttttttaagcacataaaaagattctgaagagacaggcttcttaaaattccttcagtgccctcaccatatcttactctgctatattgctgtttcagactaactctagtcaaggactagtttttctcccccatccatcacagaccaatacttttgtaaaatgcaataaaattgagttattagaaaagtgaaattttaactatatatataatttacaaatgcagattttagaattgttagattcaacaggcataaaattattctgccaaattgccctgaaagtttctaaatgcttatcttgctttctgtgtgatcattgcatgttgataacagttggtctgcagaccgtgctgtgaggagcaccgctgtagcacgctcctttgaagatgtcagagtagcacttagaagttggatttcataatgctttagggttctagttgattgtaggtgaacatgcacacctatagtctggtatccatgtctctaagggaaagatcgtttatcaccattcttattttgtgcagtgcaatggactcctgactttgtgaccttcagaaattgtttaatttttctgacccttgattccaactgttaattggaggtagcaccttcctcatagggttgctgtgaggattaagttaaataatgttgtaaagcgcagcagatgattcctcgtgtacatttccttcccttttgacctttttgggattaggttagataaatatggctagttccaccacgtggaataaatcttgtgaaccaagaatcttttctgttttaaaattaacttcctttgatttataaaattgcaaacagattttcttctagcaaactatttgaaaacttacattatggcaatacgattttagcaaaaaccttctggtgccccattgtcaacatttttgttacagaatactttgaatttatgttgccgggagatttttctaaatcattcttaaggacagtatttaaaatgaacatgatgggattttcaactttgtactttggcatgttgaaacaaacatgttgtaagcaagcttgttgtaatatcgtgcatgatactcttctgcttgacctgctgtcaggtttcagcagccagggaagaggtacctggtcgacgaggttttccaggttacatgtatacagatttag

SEQ ID NO: 129027 - DNA, 2017 bp, Homo sapiens
tggaggaaaagcaattttcttcataatttaagtttttaactttattaggtactattgagtgcctgctgtttgcaggacactgttctaaatgtaaagaatttttgaaaagaatttatggtctctacttaatgtaagttactcagtctaattggggatgttttttatgtgtgtgcaccggtaatttaacatggccatgttcagtgccacatgaggagtacaagtgggaaactccacaaaactgagagacagatttttttaaccaagggctggttaaaaatgactttccaatgcctgtctgtgtgtgtgcccaggatggggtacgactattcagaattcctctcctgtgttgcctctttgtccttatttcagtttttgaacaacactttgacaaaatatggtaagttattacttactgtaattgagcactgttctgagtgctttataaatattcactcatttgctcctcatagcaactttgaggcagatgctgtttgaggcacagggaggtcaaatgatttgttgagattagcaagtgatagatttaggacccagtttgagttcataactcacactgttactctgtactgcctctgacgtgaaaatgatttgttccaagggagtagctacaaaatgatgtaatttaacagatttggaaatgtgttgctttgtgtgacctttttggtgcagcctgtgtagtgttgtttacttgtctatatgcctgcgttttgcatggtgaaatgttgtgtatccatccgacatagcttatgaactaagaatgttcttagtatacatcaggttggcaaatttctataagggaactttgggtttaaaatgaaactttacttatattgagaggggagagcgcttacctaggggagagagtatttttaatgaatgcagccagtttacctcatagagccaacacatgtctaactgctgcaaccaaactaaactggccagtatggttgccgctagccacatttggctgtttaagttcaagttaactgaaataattgaaattaagtttttcagttttgttagccacgtttcaagtgttagatagccacatttggctaatggctaccgtactgcacagcacagacacagaacattggcagcatcacagaaaatgactctaagaacactcttctaagtaatgttacaggtagtacagagggactttttgtgggtttggttctgagagatggccgctttaaaactcataacctaaagatgccatgcttaatgccaactgtcttcctctggtagatatcactcaccccatcccagacttgactggctacattacagaggggcagatctatgtggacagacagctgcacaacagacaggtactggacgggagcagtgctgggaagcttgcagacctgctcatccgttattctttagtgacttggattttgctcttaggaattgctttgcttagaaagtatcaacttgaattgtttttaatatggttataaaattgtcatttctattatcttaaattctggtgtcggcagagcgccagaattaagaatcttcttaacactttcctttattgtgtcttaaaacagagtcacttgtctccaagaacttttttgggaattctgttccataatggtatcatctaccaatcttgttattgatagaaaaaaatgacttttccatgcctctctagtagatgctgacttctaaaatcagcttttaggaattattgttaattttttttattttgtgtataattttttgagtcagttcagaagaccattttgactcgataatgtggtagtacttatcaaacagatgttgaaagttgagttttttaaaatagtcttgtacagtgttatagatgacacttttttggatttgattctcgaaagaaatgctatgctataaagtgtttcttactaccttttcttgccaggaagagacagtaggattcatctaggagacaaatgcagcggttgtctttgatttaagttgtaataatgagtttcaaatgtttttttattac

SEQ ID NO: 129028 - DNA, 1681 bp, Homo sapiens
ttaccctcgagactctgcaaagcattagctgctgcttctgcattgctccgcgctcttgtgaaatactggttctgttttctttattccttttgcactctcggttcccacctttgtgttggagtttaccatgttaccctgtaattaaaaacaaagaataggtaacatattgtgccagtgttgcaacgttttaaactgctaacagaccttaaaatatccccctacctgggtcctcagtgctatgtttaaagtgctgcagggatggagtggcgttttcttattgctgtatgtattgtacatagtggagtagttagttacctgataacagtcttgttatttgggtctcttagaccttacctctcaactccctcaagagtaccagtctctgaagttataatgctttggtctctacattaggggcaagatccagtctgagagaagtctcctttgagaagggccaagaggctctttcctgagtgtttgctttcggtttgttggtatgcctgtattgctgggctgtgctgctgctcgaagcagatggttttgactgtctttttgctctttcctatataatgaatagatgagtgaaaggagttttctttttctctttagtacttacgtattgggattcctgtgtcttacagctctccctctccaaataatacacagaatcctgcaactttttgcacagctggtatctgtctggtagcagtgagaccccttgtcttggtgatccttactgggtttccaagcagaggagtcacatgattacaattgccagtagagttgttgtttggggtacaagatgagaagaaagaaaaacctacagcctttctacattctgacatgctaacagtggtttaagtttctaaagtgtttaccagatgctgaaggcaaggggagggagcagaagcacttatgtttacggatattttaaactctgttagagagcagcctttgaaaatccccaatttggttctgctttttgacctctctctaccttttcagggtaatctttgtggcacaaacgatagcatttccaagctttagagttttctgaattcctgcgccttcctgacgtgagccctgagcgatcttctatgcagttctgccatgcgtcctgttggtctctctgtgttctttgttacttgggtgcaatagcaacttccctaccccgtgcattccatctttcatgttgtgtaaagttcttcacttttttctctgagggctgggggttgggggagtcagcatgattatattttaatgtagaaaatgtgacatctggatataaaatgaaaataaatgttaaattaaatggaccttaactaaagtgactctctatcttctaacgaggaaagcaacaagcaaatatgtaatcacacatctcttcaattcacagctctgagcatcataaccaggattgggaaccagcccttgtgttgcagggacatggcttccacactgcccttgtcattctttttggtactgtcccttacagcatgctgtagtttgatccagggctgagcattcctacaggtgctccccagcgttcctcatttcaggcctagtcaggacctctagagcccatctgctgtgagcaaaagagggtgctaaatagtgaaatacagcttgaagcaagccaaaacctgtttcacataaaatctcacatggatgtcctgtatat

SEQ ID NO: 129029 - DNA, 1104 bp, Homo sapiens
tatcataagggcaagttagcttaattcagtattaggagccaacggaaaatagttccccagactacatttaaaatagcatttagagactacaacaagaaatacttggcaaggcagttcttgagggaaaattatcctttgtgggaaaacttaagaaggaagtgggtttttttaaaatgaaacagtcatgttccttactcagctaccaactgtagttttatttcaagccatttttccagtttggggttgaacacctgcctcacactcaggcaaaccttgtggtgtccccagctgccccctcctccatatgaagccctgcagtggtaacaaggagcgggtgactgatatttggaaacaatgagaaatcacttccagtcactaatgggtcacagagctttgtatcctgagctagtggcaaaactcgtccagaaaacttagtaagtgtttttcagacacgtgtgaaggctaggaattgtgggaccctccctgaacagtctgccacatttctacttaagggaaaagcaaagcatctgaccatggctatccctgaggctgaggcacacatgaacaatgcctaggtctcctttgtaggagcctgagggtgcctaacctagaatcaagcccgtggctgtttgctgtggttagcagctacaagtagtgcacatgtgatatgccactgttctccacagaatttcatctctaaactcctagagcattttctaaatccaataaattacagcgttccaggtaccagtggtcatgtagccctttatccacagatgcaactggaaaatgactcgtccagggtcacaagggaatggcagaacacgagctggaacctgggtctttaagcgtgggctagtgctcttcccacagcacaatgttaacatccaaaggccactccacacatcaaaatggtcttcacaaatgtcaatctcgctagaaaccaggattttgtattgtggctaaagttccatatcctggtggacagaatggtagcgtgaatgtaaaccaaaggccctgactgtctggacctaggaacttcagggctcacactaaaaagttaagcttagggctcacactaaaatgttaagcttttaggggaag

SEQ ID NO: 129030 - DNA, 1002 bp, Homo sapiens
tgcccaggaatgggggagccgggaagggaagatgcttcgtagactagaagacctttggcttcaggcaaggctggagaacaggcagccacagcgggggctttcctcctttcatctgagctgccacatccatgcacggtgcagcaggtggctcatcggggtgcagaggcaggttccttgctgggcagaagtacctggttcatttggcagggctcaccaactgatgtgatcaatgcagacccctggggccgctgccctgcagccagccagaggagccctgggaacagtaacagttctgagaggaggaagctggggagggggtgggcagaaaggagccaagagaacattcagaaggagtttgccatctctcctactagactgcaaatgttcaaagggcagggttcatactttacccagtccattgttctatccttgacacttaacacaatgcctggcactaggtaggtacaaataactgtttcttgattggaaaaataaacgaagcccactttgcctttgaggaacacaggtgatctccagtgtgtaatgagctgtggtgctctggaggactctctctccataaatacacccctacagatgccaagaatcccaccatttacattttgggaagagtgccttccctctcctagcaggcttcttttaaaatgcagatgccgtggggtgaggcatcactggagtgaatgaggtctccagggcccccagagggtgagaatggtctagagcaggacctgcagttggggcctgcttggtgctgcatctctgatgcactctcagaacctgggagccaggcttgcggatggaggcacagacagggcatggacacttttcccacctctctccctgttcctatgtcctcacctcggcccccatcctgcagtggctggggccttctggaagccccaggggctgagaaactcctcatcatggagatttcaaggagcatgatgtctgatccagaaaggtcctaatagcacttcagcctga

SEQ ID NO: 129031 - DNA, 1097 bp, Homo sapiens
actgagaaaagtgatagacttaatggagaaagggtggggggctacaaatgaagctcaagagactggcattgtccccctcccacaccccacagtcagggaccactgggggtggaaggggcagggatggggtccttcagaatacacgctcactaattctttcgctcagtccttcacccgtctcaggcccacatcagttctctgcctatcctatacgtacttacctgttgtgtgcccagaactaccccttagctagcttccctacctgcacatcatttgagggttacctaatccccaagccggcccaaggagtcagacacagtctcctctcctccttcctttgttgccccaaagacaaggtcccagccctcttatgttaggattgggttgctaatcactgcagcagaatagtaatgaaaatttcttggagctgtggttcctgactcctgctgagagaaactgttgtaagggacaggatcccagtggcttagaatgagccacaggtggggtttggagtgccttttcctttcccgtaaaaacaaagacaagccaagaggcaccctcaactcctttacagtgctttttctacacatcattggtgcctgtggaccctaagggcttctcattctgtgcgcttctgctgtgtcttggagcaatgtctctgggctcctgtttacagggtttccccatggctaggcagaaggtactggggttagtgcttctacatcagggtcgccacaaatcctgctagggacagttgaaggggcctagaaggactgcaagggtgttgctcttggtatatactctgctgccctatcttctgcagtcaacggctaccggagaactcctccagcttccataagcaagggatgacaagggagtgtctggattgcctggggttcaggcctccgggtttaaacaactttcaagtaatctggtaaacttgggtgcccccctgtggttctgagtggaatgtgtccattttgccttcagggaaggcgatcaggttagcaggggacatcctctgtcaccttgctactcagtgtgctttgacccacccaccaccggcagcatctcagggctcattccagacctacttt

SEQ ID NO: 129032 - DNA, 1032 bp, Homo sapiens
ataaccaccgaatggtggtgatgatcaaaacatacgaaggcacagttctggcttcccaaagacattgtcctcgttgccaatactctagactgcctcccgagagggtcagatgctggaagaggcagcggggctggtggttaggacccctaggctcggtcttgtggaggtatgagtgggaaagccatctctctgggtcagataaggtcagcccctgcatgctgaggccaattccagtcttcctcactaggaattatctgttagataatgccggttcctgttttccattggattccactgtggcttccttttaaggcccccaggttagatcatagctggattctgagagcactgattgtttgaagtttgtatttacaggggactaccatcatatgcaaatgatggtggtagtgaattacacacccttggtggatgtagtggaccggtgctcagcattcatttcgacttccgtcctcctagtaggtcttcctggtttgcagaggtagggcacctggaaactacattacccaaacttccttgcagctagggttctgtatgcaaattaggctctgccaattaggctgactcagagaagatttaagaggcagaagatttaagtggcagagcttttgactgttaacttctagcgagcatagaccttttcagatgttgggtttttgtttttccccaaaacctcccagcgtccaatcattagctccgagcgtataaagaggcggggtgatggggtcagtggctttctgaacctggcatcgggcaatgaaatattctcagagtcacaattgcaatggaaattctttggattccctactggactgaatagaggtaacagtttcacagtgggccaggcccaaatttctgtccaccctcccttcccccacccccgcaccccaacctccccgtgtttctccctgtgtcttcccttcctcagtaaatggtaccaccattcatccagttgctcctaataaacactcaggagttggttcttcaagtcttatcagtccccaacatgcaagt

SEQ ID NO: 129033 - DNA, 1329 bp, Homo sapiens
gaaacacggggtggaggggggtgtgtctgaaatgagagatgcagggttgggtgcagacgttgctcgggagggtcttgatccggctcaagagctgctcctagcgtgctgtggggccaggccactctcctcaaagacaggcacaggccctagaaagggacagcccataccaaacccagtagcagatggaggactgcagggtttaatttcttgcaaactagataaagtttttcctgtctgtgccagagatctgatatttttatgacagttattgatgcacatccattgtggggaaccttccaattttctaggtaaccaagtgcacaggttttgtgttgtggcaaggaaagattagagggcaagaagtgtcgcctttatattctgtggcatcattcctcaagtaagaagaatgatctcattcttaatacgtctacaagaatctggagtggtgtgacttctgcccctttctttggagagaagggactaaataaaagacttaattttcaggccagagatcagtaaagtagatcttcggagtgtgcgggacaagttgtcaggacagaattatagcaagaaacgtaatcacaggtggaaaaccacgggatttgtgtttcaaagccagtaccttggcttaattcagaagtgacagtaaaagttgatacaaggagatgataataatgataataataatagtatagcaccttgcgttttatagcagtcatttctaagaagcatgaaatattttatgtgatttttaaaaattcttggatcttacaagactcaggcaggaattacttctgtcatttaaaggaacaaaaaccaaagcacaagaatgataatgagatttggttaaggtaagtctaagtgtcccaaagtctttggagtttgggtccagtgcgcttccttactgggggttggggggatgtctatgagcattctagaacaggctttgaatagatagcctttgtgaaccatgcttcggaatgcagagggagtcagtacttttatgaatatacatcgtgctatttgctgtttcccgtaaagaaatatctcttaatgtgatctcccacattttcgaagcataaaggttgtcattcctgtgaaagtcaggatgcatcaaagcaatcttcacagcatttgtcgctccaacgaaggtctgtcttatttttagtaagatgttgttctcccactcaccactcaaaaatctacggaagtaagaatttattaacttttcaaaacaaaggggagcatgttgatcagtgttttattggtaccctttatttacttttaagagctgcaatctgttggtctaaattagtgcttagtggtctt

SEQ ID NO: 129034 - DNA, 1398 bp, Homo sapiens
tctctcaggctgatgtcttggatatctctcttctaaggatatgtattttatggacgattttaagtgctataaaactttagtaatgggaaaattataatatttggattgccctttagctctgttgatgttacaggcaagtgtctgtagaagtgtgcccttaagcagctcctcgatgtgatgggtttcttactcttggtcttagataaccttatctaactttcaccctgaaggcagggtggttacaaagctttgcgtgggagaaaaaaatcaaacttacttatgtgtgtttaattatgtttagttgcccttcctttcatgttttttttaacatatctaaagctggtaagttatcgcaaagagatgaagacaacgctcagtgaacagtggtgatgaagaagattaagaaggatcagatgttagttttaatagtgctagctggtgttcaggagctcgagaggaaaaggaaggaaagaatatgatttatatatcgaatatgctatttaatatgaattatattagttttaccataaataatggaaatgaagactgattccaggattttgctggaattactacgttgttgtgttgggtcttattatttactgggctttgcattatgactgtactaggagaatgtactatttgcaaagtagtcatagtttgttttaaattccaggcacagtaattaaatattgactaccagtgtaactccagggagttgtgaagaatcattacaacttgtcaggttaaattttagcagggtgcaaaaagtcggcctgattatagcaaaagtgatggttgttttttcagcttttaacaatatgcaaggaaatgataagtgctatgggtagtccattttgaaaagggagttccgtacaacttttgagaattttaaatggaaaaaacataacttttctaacttttttccagttcgactaataccagaatgcttagtgtgtgcaaggccctttctgtgctgggcacttcagaggattcagaatgagaaagacactggagccagactgctgaaatatccaattctgatgctcttttggcaggcttcaggagcacacacgtagatacaagaaagaatacattgatttcaaaacatgctacatctgtgttgggtgataagcaataactatatcccatcacccactcccaccctgattatacctctttcgtgggtttatacaaataatatgtgtgtattttatttcattattttactcctattcaacaccacactggaaatgtctgtatttaaaacatatatatctatatatttacttgattactctgactttagtatatttcctgagaagccttgagaaaaattaagggatgtatatatacgtgtgggatcattcaaacacttaacacagaaaaaacaaaata

SEQ ID NO: 129035 - DNA, 1050 bp, Homo sapiens
aatgttcctggagagttacatgcaagctgaatttttaaatattgaaataaattcttgaggatgattaatggtgaccacttaagcatctactaatatcccatttttgttactgtgcagacacatagaaggaaatacaagatgtgatattctacttccagggccttacattgaattgagcatcacaacaagcctggtcattgagttgtgaatttgtagtgagactggttttgtcgacatgtccctgaatggggggcagtcactaccccgttatcttttcccccattccaatacatgtctggaatacattcattcctaacatttatagtgactcattactaggaaattctcaatggaatgggattggtacccaggaggcatatcaaaatcttgggggagggagagagttgtaaaaaacctagatcctaagtatttctgatatttgcttcaatggctgttcaccccttcgcacatgtgtgcatgcacacaaggacacacacacactcctactgccataaaatgggaaggatgtatttaagagaaggcagaattggaaacttcatgctagcattaattgatatcatttaatgctcaccgcagcaatgtaacatcggtatagagataatagtaatagaattttccttgaaataagctgattaaaagacctggtatccctggaagactggagaactcgctgttggaagatttagatgatgttcatggtggtggttattgtaagacttactggagtgtgacttggttggtcatagggaaagggggataccagtattaactgagtgtctgttatatgccaggcaccatgctaagccttttatagtgttatgccatttaattgggaaactcgtttggtctctgagcctggattaagtgatctgtgaagtcccttgtacttcaagcattctggatgggatttccagttgtcatccttgtattctctccccaatatagcaccgtgttctcaattcatatgtacatgtttgtaaaattccttaaaatatttatgctcaaaccaacatttccattttatctatc

SEQ ID NO: 129036 - DNA, 1068 bp, Homo sapiens
gttttagaggcacccagaaggatatgttttaaaacaacttctgccatttctggtttcaaacatggtttttgtcacattctctaattgaccaaatgtattttatgtacaccctaaatgttcacctatttaacagaatagtattgtttagaatggtattatccttctggttatttggtgagatacacacatcagtaaacattccctcatttggctggtattgtttgatcatgtactgtgtgccagattgttaggcaatgggaatataaatgtgaataaaatacagtgtccttgctcaaggacctgaatagctagaaatgtatgccaataagggttatagagtgagatcggtgataggacacatctatgcatagaacataagacgtaagggtcagtcctcccttggagatccaggaaagcctcttaaagtggtgaataattaagccagatctgaaaaggcctggtgtcctccagattgataagagcacaccaagcagaataccatagataaagctatatgtatgttcacttaacattccaggaaagcaaatatggcttctgtggaggaaatcaatgtaatggtaggaagagaccaggacatgaagtgcctgttgtagcataataattgtaccgtaggtgtgtggttgaaggtttttaagtagagtaactgaataattactgcaacaatgttataggaagttgattatctgttatcaagttgaattagaacccacatttttttcatagtgaaattccatttcaatagcctttagatgttgtaaatatctcagatgtcagatactgttgcccaagctagagtgcagtgttgcgatctccgatctcagctcactgcaacctctgccttctgggttcaagcaattctcccacctcagcctcccaagtgaggctgggactacaggcacgcaccaccatgcccagctaattgttgtattttttggtagagacagggtttcatcatgttggccaggctagtcttgaactcctgacctcaagtgatctgcccacctctgcttcccaaagtgctgggattacagccatgagccactgtgc

SEQ ID NO: 129037 - DNA, 1775 bp, Homo sapiens
ctgttgtttcaagggtatctagaaaaggcttcttttttaaaatcttctattctgctagaagattactttatttatttattttgagacgaagtcttgctcttgttgcctaggttggagtgcagtggcgcggtcttggctcattgcaacctccgcctcctgggttcaagcgattttcctgcctcagcctcccttagtagttgagattacaagcacccaccaccacgcccaggtaattcttgtatttttagtagagacggagtttcaccgtgttggccaggctggtctcgaactcctgacctcaggtgatccgcacgcctcccaaagtgctgagattgcaggcgtgagccaccacgcctggccagaagcttcttttaaatatgctgtttgcctggtcttccttatttgctgacttgattaataaaaagcattttctatagatcatacagcagtataaacttgaaaagcaaattgatattttacaaaactattaagggaaaaatgatttagaattccagagaatgagaaaactagcaatctgtggggcgtgtacgtcaaaacttcttaagaaacatttacttaatattcttttttacttttttgtttgtcagagggtaaatatgaaaccctgaattctttgcttctgtaaatcaaaataaagggttccaggattaagtattgtgattgcttttatctttcttccctttaatgttctgtttcgagtttcttatgcttctttcttgccgaatcttctaaagaagtacacgtggtgttttgggttttctcatgcgaaaagggataaggagggccaaaaagctttcttttgaatttttatgcaagttaaaactgtctgtcttcttcctttatgcctttatttcttatctcttcttttattatttctaacgtttaaatgtttagatgacaattggaccacaggtcagtaggccaggggggatgctaaatgttaatatagtctagcggctagtcgtcaactgtaggctattcattgtttatacctgtgatatagaggtgtatacatgagtaaataacatacagaatgggagcattcaaggaaagttggctgtaatgtatatttaatattcacattgacctctgtttaatatttaatattcacattgacctttgttagagaatcaaaggtgtgtttctacgggcaaggaaatattcattggcatgtggtatatggtagtattttactgccgggattataggcatatatcacattctaaggttttagaacatgatggaaatttacttctccttttgctggattttttttttttttttttttttgagatggagtcttgctctgtcgcccaggctggagtacagtggcgcgatcttggctcactgcaacctccacctcctgggttcaagtgattctcctgtctcagcctcctgagtagctgggactacaggcatgtgccaccacacccggctaattttttctctttttagtagagatggggtttcaccatgttagccaggatggtcttgatctcctgacctcgtgatctgcctgcctcggcctcccaaagtgctgggattacaggcgtgagccactgcgcccggcccctccttttgctggattttacagtgttattgttgttactgttatttaatagataatataatacagtttgaaaatttctctaattttaggcctcaaggctatatatatcattagtttcctgagtacatgtacaagtctgtttagcattgaaatattaccctgactcttgtttttaaacagagac

SEQ ID NO: 129038 - DNA, 1034 bp, Homo sapiens
ctctctctcaatctctctctctctgtctcgtctgcaaatcccacaaactcaatcagctttcctcattttttggtagttgccactattctgtcccttggggttttcttttctcaaaacctttttgtggagtatttctctccaaaacaaccttgtagaacccttttttgccccaattgctacaggaaagatcgactgggcataaaataacaacagtatttattgagctcttaccacctatcagacaatttgctaagtgtaaattcctttagtttccagtcttttaatgtctgctaaccctacctctgctaaaattgcctgggaccactcttgaacctactgaatcagggtttcattgtggcatgttaattttttttaagatcagcaccctcaagtcattccgattagcagccatttgtggatcactgataattattccttctaccatggcctctgtctctgtgtccagaagatgcagtcaatcaacagaacaatttttgcccttttgtttcatagatgtaatttgaatctcatagtctgcagtcttgcccagtatccatgtcactagatttctgccctgtgaagaatgtttgatgcttattttcaccaatgttactatatgtattaaatgatacatactctaaagatagtctcaaaagattaatctcccaattttgatgactcttcaaatttcgtgaagccacaaaagcagaatttcctaagtatttttttggctcattggtctatcacctgttgcccacaataaggattatttgatcttaaaagttggaaactatgtattgtatctttctcttagacatttttggtgtatattagcatactaaagactcttaggagttcttctgtttaaaaatgattttactttggttaactgggcagttcccaaactggaatttttttatcatgtaatcctattagtggccagtgtgaaacactcactcctttataggtagaattttctgggggtttttctcttcttttttcatttgaaaaagaggaataatatttacttcata

SEQ ID NO: 129039 - DNA, 1015 bp, Homo sapiens
cttctagtttctgttttactgttgtatcacatttttcagaaaaatctcatgaactgacacattagttccagaaattaacattatacataaaattgtttattctcaccctgtgaagtttaatttctgcatttataattaagtgactttacttcctagggtagcacgagtcatggggattccgttattgctctgtcagccatcaaaatactgccccaggcattcttagcccattgcctgcctagaggcagttgcccatatagctgcccttgtctgaagcctacatactgatagcatggcactgataattcttggattcttactatgtgtgatacttctcccattattgccactcagatggaaattctttttatgcattaattgtgtcagagtagttacagaatgggttaacatttaagaattcagttaaaagcaatgtggtgggggaagaagttttagaagagcaatatggtgaacattatgggagtgttacctatagtgttaaaggccacgtggttcatgactttctttcccccatataacaacaaaggcatggcagccactgccctctgccaggagtcaggtgaagctcagtcatggccaggctgtttgttgttgttattgttgttgtttgtttttgagatggagtctctttctgttgcctaggctggagtgcagtagcaccatctcggctcactgtaccctccaccttccagcttcaagcgattctcctgccttagcctcccgaatagctggaattacaggggaacaccacccagctaatttttgtatttttagtagagacagggtttcgccatgttggccagactggtcttgaactcctgacctcaggtgatctgcctgccttggcctcccaaagtgctgggattacaggtgtgacacaccgtactgggccctaggctgtgtttttaaaaagcacttggccttggtgtcttcagtctcttgctctcaggtattgttcagttctgaacttgactgaccactgttggtcattttt

SEQ ID NO: 129040 - DNA, 1048 bp, Homo sapiens
tttgacaatgaatgtcagtgttataacgcctgtgttttcagctagagaattgtaaccattctgttgccctgtcaggtggtagggagtgggagttgggcatgaaagctaagatacaaaatgtcatgttttagtattaaatattggttagtaaactagccagcattaagatcaaactgcggaaggaagaataggacttcttaaactggcaaattagatgtttttactagactttattttttagagcagttttaggtttatagaaaaactgagcagaaagtacagagttctcacataccctgttatccgcccctccccctctctccccacccctgcccccgcccattaacgtcttgcattggtatggtatattaacaattgatgggccagtattgatacattattaacaactgaaggtcactcttagtgttgtgctctgtgggttttgacaatttacagtgacatgtatctacaattacagtatcataaagaacagtttcactgccttagacatcccctgtgctctgcctctgcctcttcatccttccctccctgcctctgtcaccatcatttctccccccctgcaaactcctggcaaccactgctctttctgctgtctctattgttttgccttttccaggatgtcatatagtagttggaatcacccaataatgtagcctttcagattggcatcttaaacttagcagtatgcatttaagttcctctatgtctttttgtagccaagttttggtaattatgaataaaactgctataaacatttgtgtacaggttttgtgtagacataagttttcaagtcatttgggtaaataccaaggagcgcaattgctggatcatatggtaagagtatgtttagttttgtgagaaactgccaaactgtcttgtaaagtggctgtaccattttgcattctcaccaacagttcctgttgttccacatctttgccatcatctggtgttataaatgttttgggttttagccattctaataggtgtgtagtagtatctcactgttactttaatttgcagtttcttg

SEQ ID NO: 129041 - DNA, 1929 bp, Homo sapiens
agatttttgtggccttacacccccaaagataactttgttctactcacacatgattccttccttggctaagtatagccttctatgctggagctctttctctagaggatttcgcaggaattgttctgttggcttcttgtttccagtgttccttttgtgatgtccagagccatgtgattcctgatcctgttttgttttctgtgtttctctctctgctaaaagcagcatatggaatcttctctttgtcatcaggtttctgaggtttcccagtggtgtgcctcgggtgtgggttgactttcatgtattatgctggcattgggtggacactccattctggcaactgatgtttttcagttctaggaagttatctcaaattattttattgataacttcctttccttcaccattctctgttctgtctttctgtaactcctgttaattggatgttaggcctatggaactgggtctctgatttttttaaactttgctctttccctcttggtccttttgctctgttgtctgtgagattttaacttttattttcccacctttcaatagaatatttttgtctctgtcatcatatgtttattttctaacatctctttttatgttctttgaatgtcttttttttttttctttttgtgcatcctgttattccacacttgcaattttgggcttaattgtatgttttcatcttttgttttttggtcaagtttccttctccctatatagtttttacttgttccagattgctttttgcatgcttgtttagctgtctatcttccatgttaaaggctttcttcagatttctgataatacttgattatttgctcatgatcaagattaagataatacagagttgactggaacctctgaaagcgtggcgaggcttgtctgctgaggcatcatgggagagtaatcaggtgtgccatttgtggagtaacctgcatattagtgtatctgcaactttttgctttgtagctaatgagattctcgggaaaatcttccaaactcctgcctaaagagtatgtctgcacactgaaatttctcggtggatcctagtgagggaagactcagcggcactcccacttcattgacctatttgttacagggtgcccatagcttcagatgtgcttttgactggcttggtgtctctcagtccaaagagagggacagttactgagaggcatacagtgaggaggactatctgggaatcttaacttctcaaagatactttcaccctgtttctccttctttgggccaccccacttcaccttaacatctgagcatgtagcataaatgaagtttgttcagcttttctcactgctggctagggatttggctttcttagttcatttaagtcagttaccattgatttttctgtatcccaaaattatgttgctgttgtcctctttcctgtcttccctatctatccttgtgggatcctgagggtttagggcttggttttgttttgaatacctttagtgttgtgttagttgggtttggggagggaacaaaattagatatgtgatcaatctgccattttaatatgaatttcctttggaagctttaagagttagacttatccaatgttaagacgttcttatgaagctcctactgtgtgccagacactcttgtactttgcatttccatcccagtccatgcactgtgctcactgggattataggcatgcacaaccatgcctggccttgctttgccttcttgtttcagctttcacactgtaaacaactgtaaggtcctttccgggttttttttttcccactgccatgtttcttgcagttttgtgctttttgttggtaattccactgcttaaaatggcccacagagtgctgaagtgctgtctatgtctagttcctaagtgcaagaattatgaaaagtcataattcatgcataattaatagaaatggcgat

SEQ ID NO: 129042 - DNA, 1048 bp, Homo sapiens
actgaagttcctggaagttaactcacccacagtcatacgttaagaccggtatctaacgatccagtatcaaccgaactcttctctgcctaagttttacatagttccttgtgttttaaccgaatttggtgaagcagtagtacccaaagttcagcccaaatctgttgtcctatcatgcatgacactttttaagtttgacatccaggaatgaaccactgataggagacagaattgcaggagagcaaggggagaaaacagctgtctacagaggagccgtggggaactggagagagcctgcccaggaaagcactccctctgtgaccctttgcagacccagtgctttcagagcttctcatttttcacaggaagctggaaaaccagatagtgtgaaatattgccagctgtgtcactttaaaaccacagtgcaagacaaaaaccaaaaatgactgtgggcccgtttcagggcgtcagattgaaacctctcctttagaggattcaccttgccctgcagctttctttcctctgcaccgttagagactatgagaaggaatccaagccagtttctggtgagcacttaagagaatgcttttgggttaaacttaaaagtcaataaaccattaagtgactaggtacattctggctatttacttcatgaaataatttgtttgcatgtgttttggccacatattacccacaacacaaagatcatctgtgtttattacaagttagaattgattagtattttgaagtaaatgtagaattttgcagtctcatatggtagtggacttgccatccttatctcatgcacgccaggctctggcatagcattatcacttgctgaaaataagtattttatcttgttttaccgtagtagacatacacagcatctgcaaccaaaagtgttactcactctcttagtcttaccttagttcttcctgagaaactaatgggagtcgtggttgtaaaagcatttagcgttgtaaaactaaagcattctgaatctaaagtgcagctgtaggttgttgatgaaaacttcttttccattagtatt

SEQ ID NO: 129043 - DNA, 1931 bp, Homo sapiens
agcatagtgtgatggtttcctctaatacttcttttcttttttccccaatatcatgccatagaaatattttgaggtgaaactgtttgaaatatcattataacagatactaaggggagatttcttggtttaaatgaggggagagattttttctaatctctatttttctgaaaagatgccctctagtgtctgtccctcagagtgaagcagatacctgtattagattcagcttgatcagacggttcactttatcttccccgttgttcattgttgaagtcagctaataaacttatgctatgtggttcatttttcctcagagcagtagaccctctaaaatccagaggatcaaatctgccaaaactgattgccttttcttgaatctgagcagagatctccaagttaaaaaccttgtgactggcttactcaatacaattttaagtcctttttccctctcttttcacagtcctcttactcccagttactggcagctacatgccttaccaagcttgtatcacgcacaaacaaccccctaccattggaacagcgaatagatattcgtaagtggagaattttctgttctgtcttgaagaaaatagtttgtttagtgatgtgctagtaatagtcaaatgtacgtgtttgttcaatgatatgctgagattgctaaccatacaaaatgtctagaatccagttcgtttccagaatttggggcttatgaaagtgaagggcccgacgcaataacttctggataaagcctaagtcctcccttttgttatcgggagatttcttcattcatcttttctttactgccactaataactaagaaaaacattgttaatgattttgaattctgtgtagaccacgttctttagctacctagggatagagtcaaagcagctatactgcaaattcttcatgagacaaaataaaattctgaattagaacacctactaatcttaaatttaaagtcccatttggaacagtagcataaataattaagacagtttgggttaaatagtctaaatttataatttcttggccatttagcatgtctaaagatatacacccttctctggcagagctttctattatgtggattggttttgtttcttgtttttttttaatagggaactatgtgctcaactaccttgccactcggccgaagttggctactttcgtgacacaagcacttattcagttatatgccagaatcacaaaactgggctggtttgactgtcagaaggatgactatgtcttcagaaatgcaatcacagacgtcacaaggtttttacaggtacagtgtatatatttgatgtaatgggaatgggagaaccagcatatacatatatataaacacacacacacacacacacacaacttaacacgcttatctactttttaaacatgacacaaaatagaattatatgatatattctcttctgcatgttttttacccttaataggtcttggtagtgtttgcatgttggcaaaaacaaaccatgtctcagtctttcaaattcctacatatggtcccaagcaaaaatatgtttaattaattagttaatattttatagatgggcatttctttcgagtgttaaattaatacttcagtgaatagcccagtacatatattttgaataagtgcgtttgtagggtcaattcctagccttggaaagatatttccaagttatcctcaaaaaagttatacagcttgcacttcatgatgatgttttcgtcaacagtagaccacatatacaacagcagtcccgtaaaattataatggaactggaaaaaaaatggagcctagtgatgtcgaactgtcttaatgttgtagcacaatttattttttaagtaaatttagtgtggcctaagtgtacatatttataaagtctgtagtggtgtacagcaatgtcctcggctttcacatccactcacca

SEQ ID NO: 129044 - DNA, 2033 bp, Homo sapiens
gggatacacgggtgaacaaaacaaagtcttagcccacatatgctaacagaagaagacatatcaggaaacttacaattaaatatactggtagaatagattttaaaatagctgtaatatttgctatatcatataaatactactatatgaataaattacagtaagtgatataaatatatgaaacatttgtataactttgctaactatcggttagttgtgctgaatgatcagtttgacagacgtggaaatgaaaatttcattagatttcctttgattggtaacaataagaaaacaagtcagtcacgtcttaggtcgtgcccacttctgctataatgagctttacagcctcagtgtgatcctcctgggcttctgtttcaaactctgtccattgaggctaataatgtcatctcatgtgattattattgtgaacatatgagataataaatgtgactgtcccttttcaaagtgactttaaaaaattgtttctgaacattatgcagacgtatcattctgaatcatgacctgcagcccagaagttaaaaagtagattctaccccttcccccatgccatctcaagtatacatcattcttgaagtatgttaaggcacattttacattttatttttctcctctgctactgccagagtttatcagacccaaacaattaccatgagttttgcagactactggcccgattgaagagtaactatcaactgggagaattggtaaaggtggaaaactaccctgaggtcatccgattgatagccaacttcacagtgaccagcctacaggtttgtctttgattacttgtgtcttccttcctaaatactggaatctcttgcttgttggttttaaccatgtaagaatatatttttttttcttggcaaaggtaaccataagtccagtatagccctacagagtagttactattgtggcctgtgatttacatttacacaagtgcaagtagtgtggggagaggaacatgtgggaattactaggataatatttagattcatcccagagagaattagctcatagtcaccccaaaaaagccaaggtcggaacagggagctagacagaagagtaaaaagagagttgatgccctctctttcttagtcatgtaatatagaacaatgggtctcaaattttatggcttgtatcacagtcatctaggggactgatgaaaaaatatagattcttgagtcttatccccataatttctggttcagtaggtccagggtagagccttggtgtttctaacaagttcttcaggtgattgtcatgcatactaatggttgagacccacttacatatggctttccttatggtaaggcttacacagccagcatagagtagcccttctcattagatgcttaatcttgaaaatactaataaacacattaaactagatgccatacacagaacaaagcccacaaaagtctatcctctttttttaaaaaaaagaaaaaagtctttatcttctgtgtcagtggcatgggactaacacgtacagaaatgaaaaatatgccttctgcttttctacttttctttagcactgggaatttgctccaaatagtgtgcactatcttctgagcctgtggcagcggctggcagcctctgtgccgtatgtcaaagccacagagccccacatgctggaaacttacactcctgaggtcaccaaagcctacatcacatcccggttggaatctgtgcacatcatactgaggtaaggaaacttagcctcattcattcccgcaccagtggcctgttgtcacacttcctagagatcagacaccccattggcaaagaggtactcgaagcgtgtctcattggagccactactgttcatggttcttcttccttgtcagcagagtagcatgagagcataaagcctgatagaatagtcttgtctcttgaacatttatattctattcatattcccccttttcactgtccatagcaatatctttgaatagagtatatccatataatgtttgtccttgccgctgtttttctttcaatgtgagaaacattta

SEQ ID NO: 129045 - DNA, 2890 bp, Homo sapiens
agtgattttagctttttttcctggccctcctaccacccacacatacactttctcgacacataaaggagatatgtaaactgaggtcccgggtattgctacagcaaagacggtggtcctgattcccacgatactgccagattatacttacgtcatcagagtggctctttgagatccagatgatgtgagttatggtgaagtcacctactgctactcatactgcagataaattagtagtagtgacaacggtagcctgccttcaaaaaaaaaaaaaccttcagatcctcaaggaatgactacataaccattggcttgaaagggctcagtaattctctgattactggcttgcattctgcctctaactcatgtttttacctttaacttcttttctttttttcaatagagcgagcacttttcatttttgggtattaacaatcagtccaacctgacagacatgcggtgtcggactaccttctacacagcacttgggcgtctcctcatggtggatttaggtaccgtaagaaatcgtagtggctcatgaagtcatctggcactcttctaaatttttatttgaggactgaaaactagatgttggggaggccttttctgttttttcaacagtaacaaaactatctgaaataacagcctgatttcaccaagaacagatcatgctgtcgaggtccttataactggaagagagtaacagtctgctcctgaagttttcatctgatacgcagtggctttaaaattctcttcacattcttcgggtgttaaataagggaattgagattcctaaatgtatctttttggccagataacttctccaccccacaatgaggtgtaaacccacttgaaacagtcaacaccactttttattatccagttttctagcacagatgagccagaagggctttatcacttttgtagcagtagtggtgatattagcagtttcaggtcagttaataactaaagctcagtggtattactctaatttcgagctgtttaaatttaatcctactaaaatgacataaaaccttctaggtttatgagagatgactttttaaaaaattaagtgtgaatgaaacctccgtacccattaaagtttgagtctcatctggttctcatgcacaagcttcagtcctttctccactgactcgctaattctcagcaaggataaataaataacatagtaccttacacacatatgaatctcttgatactgtggctcagcatcaacaaacctagcctagactaggtgatttctgttgtcatcttctagtttaaaaattctgtttctatatatacatgttgctcttacattgctactaatacctgttgggataataaagggacccccttgagttcccctgggtttgctcctctttcatcccatcttcccatatatgcacagctttgaattcttggtattggggttacaccctgggatgtttcctttacaggagaggatgaagatcagtatgagcagttcatgctgccactcacagcagcatttgaggctgtggcccagatgtttagcaccaatagtttcaacgagcaggaggcaaaggtgagtgagtctttcacccagtaattaatcagcttctggtttagggcagtctctgattgaaaatcgtgcttgactgtaaactatccactgccatagctttttttaatgtcttggacttctagggttttggaattgcagaaccagtatagatttgtaaacttctgtttttatattacaatgtatttacttaagtagttcttaggatttttttttgtctgagttttcaaatatattagcataaagttgtttacagttttcttactgcatttttaatctcggttttatctttaattgcatcccattttcatttttaatactgctcattagtgacaagttaggttttcttaaaattgtggtaaaaaacagaaagtttaccatctttaccatttttacatgtacagttcagtgatgtcaagtttctacattgttgtgaaatagatcttcagaatccataattttaatatggaacattttcattattcagttttttgtgatttctaatttccattgagatttcttctttgacacttgagtcacttagaaaggtttaagaatttccacatatatgggtttttatttttgattttttttagagacagagtctgactctcttgcccaggctggagtacaatggcatgatcctagctcactgcaagccttgaactcctggctcaagcagtcctcctgccccagcttcccacgtggctaggattataggcacgagacacgatgcccagtgaatttccacatatatggaattttaagttcttgttttctagctcttagaattgtcatttcttgattgttgctttcttcatctttttacttcatacatactgttctcttgacctgtatagatctgtgtccaaatcagaagacaccaggatgttactattggtaggactttttacagtattcctcagggcaccaaggctgaatggtagaactaccagctagccagggtattgccagaaaaaaatgccaggctttacctagcattctaaagctctcctttttcatctttagccttttctttttccatctacaaatcagcagggtagacagaaagcaacaacacttaatgcaaccctctctcccctaattatacttgtattttagagtctgagataggtaccattcaaagcttgggttattgtggaacatattaccaactttaggctagagtatcaaccaatatcaaggatttagggatatcagtgaatatcagccctttttcccattatatggtattagtttcatgtaaagcaagtaaaattaaccaaaagaacaaccttggtaatggactacagctgtcacccacttctt

SEQ ID NO: 129046 - DNA, 1079 bp, Homo sapiens
tagaagtgatgaaaggacaaataacagtatgaaatacatcatgctcttcagaagaaaggccctatgtaaactaaaatgtattatgagatgcctttcacaggttaaagaacacaaaatcactttagtatcttctggttagaaagactccaagattagcaagcaagagacaggaacttaaagaactgtagtttgacaagtttttgcttggctagtgctgaaaaactattttaaattctgtacctttctggaatcagaaatctttccttagcttctcatttacagatatccatcctatatgccaattctccaacgggcaattgagctctggtaccatgatccagcctgtactacacctgtactcaagttgatggctgaattggttcataataggtaagcaggaggcagagcttgcaagggcacatctgccctgttatctgagagaatttgctgtatctagtgctttgggcagattgtgggaaataataagattcactactgcattttaaaattcgaaaagtttttgtgtttttgtttgtgtgaaagaatagtattcctaactacacaaaaccatagtcaactgcaggaaataagtcactttttttggtttgtttgtcttgttttttttgaggcggtgtcttgctgtctcccaggctggagtgcagtggcacagtctcggctcactgcaagctccatccccctgggttcacgccattcccctgcctcagcctccggagtagctgggactacaggcacccgccaccacacccggccgattttttgtatttttagtagagacagggtttcaccatgttagccaggatggtctcgatctcctgacctcgtgatccgcgtgcctcggcctcccaaagtgctgggattacaggcgtgagccactgcgcccatctaataagtcacttttaaaaagagtctccagtggggcatggtggctcatgcctgtaatcctagcttcttgggaggccgaagtgggcagattgcgtgaatgcagtagttctagatcagcctgggcaacatggtgaaacccacctctacaaaaaattagctgggcatggtggcacaca

SEQ ID NO: 129047 - DNA, 1034 bp, Homo sapiens
tgggattacagacatgcgccaccacgcccggctaattttctatttttagtagagacggggtttctccgtgttggtcatgctggtcttgaactcccgacttgaggtgatccgcccacttcagcctcccagagtgttgggattgcaggcgtgagccaccaggcctagcagaattaataagttttaaaacaaccttatggagtgggtaatatttaaagaggctataacctcccaggagacttatattcaagagttactcatttataaaatagatacttgagagcacttactctttgccaaactttcctagccactatgccagacaaaatctctaccctctttgatgttacaaatggtggggaagacacacaataaaaacaagtatggaagatctttccagtgattaagtgccatgaaacaaaataaaacaaggcagtaaaatagaggggaattgaaggacaggagggtcagggaagacctctcagagaaggtaatattaactaggatctaaatgacaagaaagattctggtagccctgcaaagataaggagtcttctaaacagaaaacatctgcacgagtcctgagataggacaggcttgctgggacttgtggcaggagcctggttggtggggggaggctgtgggagcaggtcagaccagtgagcagagccagatcatctagtgccttcgcacagcagtagtgaggagtgggcatttattctcattgctgtgggaagccgctagagtgttttcagcaaaggattaaaatgatctcatttaagttttttaaaggctaccatgtgaagaatgggactaaaggcaggtaagagtagaagcagagagaatgtaagggaaaggtggatttggggtttattttagagttagatgttgatggattcagtgtggtgggggggaggaaggaggaaggactcctgggcttttgaggtcttaccaacttgaatctaataaagctcatcaaaatgtggagcagacaaaagagtcaggaacttaaaaccaagatggttacaaatggcctt

SEQ ID NO: 129048 - DNA, 1642 bp, Homo sapiens
atgagctgacacctccttggactctacctgtacagagcagcgtccctttggtttggcccagaggggcgaacaattgcaagggagagggcctggctgatcctggctcttttctccaggggtgtggggaaaatggcaaaggtcaactagctgcttccccagggaataggggtgtgagtacactcactagggggcagggcgctgctggttcctgggggactgggtgggaagggtggtgggaggagataagagatacaaactgagactccagcctctcctcctggggccacccaagtggggagaacccctagtgtcctgccacaacctgccttgtataaacatgtacattttttcataacattttgaacaaggtttatattgactcaagtttaaaaacaaaaagtgtgactgaaaaatttttacagagtctagtgcaccaatgctgatgtgaggggttgtgtatgcgagtgaagaaaatgtgtattctggtggcctgaagctttactggacaaggatgtgtgagagtgcagagatatatttagtgacacagtagagaggcaaaaaaaaagctaaaattccaaatgtatattttttcgtattgccctgtcctcacccagaaatgatcaattcctgttactgtattaacccttgttattaggaactctaagccatgccagaacaccgtccctccccttggaccgtgtagattctgccctgggtccctagccccttgcagtgataaataactccagctaaaagtgtttggtgttcttatctccaccctctttcctactttgcttaccctcatcctcagacagatgcctcttgcttttaaaagttggatttaacgacgtgttgtagggttcttggtctgtgtgaaggcagagaccagagagaaggaagtgagcccactgctctcctgggagcaatgtgggtgagtccaccagaggccctgctgtgtgtggccaataaattttagtcttccccagccctcgaggcagtgtgtgtggatgtatgcgtgtggatatttatatatgtaccctgcactcatgaatgtatgaactggaggaagttactacagtggaagggttcttaataacaaggtctacctagcatgaagtatttaacattctcccatcccttaaaaaatatacatttttataaaatgaaaaccataataaatgttttgaatattaaaaaaaataataacctacagaggaaaattaatggagacagctatttgccttgtactttttccacaattgttgctgctagttgtacacatctctagttcagctcttgcccacgggacactcatcaattaggttttatttttatttctttcctctacccccagaaacaagcctgttaattttttttccttctcctctggcgactgtgtgatgaatcctttcttgcgtgatcaggttgcggatagacttgtaagggtgtttgctgcatacagtgtaagcattgtgaccgccaataaacttcaatggtttctactgacctggcttcagcaatcatgtccagtgtgcgtccaaggacatgtctcactcaaaacacatgaagctgtgtgaaacattctttaaaagcccgtgaatgacaggggccccttcacctgatcaaattgacttgtttctca

SEQ ID NO: 129049 - DNA, 1013 bp, Homo sapiens
caacataagaaataagtttttcattctctaaaacattggctttattaagggactttttcccctccccccaactccccactggaaaaaatgttttagtaccttttgaaatttcaactaagtacatcaacagaccactttccaaaatatccatgcttgtggggtaacatgaattaaatctagaaagccagaaaaactccctatatcatatttgccaccagccaaccctgtccaggccaaccctagcccaagatttctggctagacctacaagcctaaattgacatataatgctgccaaaactctcgaatgccaaaggaaatatagttatagggaccctgtaaaagccacaagtttgttgattaggccttgaaaaatgtaagtgattataactacttaaaagtcctggtggttctttaaatattttttaagtatttgaaaggatgaaaatgtgttcatcagccataattagatactaggtcatgtgtaaaaagattcttgcctctgtagcttgtcctctgggtccattacatttatcttgggtgtcttcaccctgaactcactggtcgcctgccacttgggtgcttttcaggaagagcagatcaactaaaggaatcagctgccagacaatgggacgtgagactgtcaaggtagaggatgacatcaagtttggaaaatcattccccttcctcagaaaagccttctggttctcaggacagcctgactgctaccctttgtcatctgttcatcaaatacttattcagcatctattatgggccaggtatctttttgatggtcaggaatggaaaaggaaactcaaaagcagaaaaagtcacttgcaaggcaaatttgcctccattcttctgtttcatgatcactcagtaatacaaactgactctaaaacatagtaaacagtacttacaaaagcaccatgcacaattattttaattctacttgatagccatgaagacaactcagcgcacttaagcatacggcagcatgcatatggcctaaaag

SEQ ID NO: 129050 - DNA, 1024 bp, Homo sapiens
actctccattgggattcttcctagatctccatctgtacctgccaacccacctctgacccccaacctgttgcgcccagtatttgctgccgatcaggacagccttaacccctccttcccgggcaatcagctgctccaagccaagcccacccctgccccctggagggaggcggctccttttaaggctgcttctgggaatttccactccagagccagaaccagagaccccagccccacttgacacctgcggctcacccttggggaggtggggcgccagacctgagtgcaggagacgcagacctggaagggctccccctccctgacctgccacacatcgagtttgtctgcgtcgagtttggccagtctgtgagggtcaggaatagagcaggagacagcagggccacctccttcagaaggcccccaccgctccatccctgcactgggtggcccaggagagactggcagcccagagggcacagcgcgcacgcccccacccgcatctgctttgcagcctcactggccaggaaggtggacacctcatacctcagtctcccaattacgccctcctcctccccctcctcctccctcttttctctcctcctcctcccctttctctcctcctcgcccccctgaaaacctgtggctcggagagaccttggcttctctgggactctacccctggggacttcccacatctgctcctgagcttgggggcaggggggcaaccgcctgaggaacctctccagcgatgggagccgcccgcctgctgcccaacctcactctgtaagtgtgctacctctcccactggagtttcgttgccatttccagcctcagggcagccctcctcttcccgggactcccacgcgtgcgtgcacggggctggcagggcgggggcgggggcctgggtgcaccctaggcttgcagctggcacccacacctgggcttacctcctctccccacacaggtgcttacagctgctgattctctgctgtcaaactcaggtaggcgggcattcccaccggctttc

SEQ ID NO: 129051 - DNA, 1090 bp, Homo sapiens
tctgtcctccctctgaggaccctccccacttcccctgggtctctgctcctcttcctccctctccatcgggttcccccagacttgagggatggagcctggagcggttggaagcaggtggaggtgatggctcaggtgaggcttgggtttgccagtacctgaaaggacaggttttgatgcaagaccacttgtatgtccttctcgccaccccactcccatcaatatggatgcctggggtgggggtctcgtgagcatgtccagaatgcctggccagggtgaggtgactcctcacctagagggcacagaggtcaagcccaaagaggtttgtttgggacgggatgcagggttcgcttctccacactccccccaccccaagtcggccccccacctccctccatgcacacctcccacccccaagtctcagcccccagtgcgaggcttgctcccttttttgtgatcctccataaaagtgcagctattaaaatgcactggtccagaaccgctctggggagagatcgcttggctttcccaggccagaggcccgcttctcttcatatccagtggggactttttttgaaggtaaatgccttttctctgggagagggaaaggggcagcctttgaagcagtgggggggtgggagagggagagacaattcccccccccttccttcccccttttgctccagccccgttccaggccttttgcttcacacatccagggggagccagaagaaagcccccagcctggctgggagggggctgggggtgggcccaacctgttctggaggggaactagcacaatggtgcggctggccgggcgtttatggcctggctgaggccccattcaggactcagggaaggtggcaaagcggtcctttcccccttgaagtgccccctcacccccctgggagggggggccagcaggccggaccacagccatgcttgaggggctgtctgacaagcagctgtctgcagtggtggaaggggaggtcctcccgcagcgggaacatgaaagggacaggctaggtcccgcggggagagggacttgtgggttgtgggctgtgggggggcgtggggctgcttttgtgaaaag

SEQ ID NO: 129052 - DNA, 1173 bp, Homo sapiens
gtttttattttagagtccgggtcttgctctgctacctaggctggagtgcagtggcacaatcatagcccactgcagctttgtactcctgggctcaagcaatcctctcgcctcagcctctgaagtagtagctggcactataggtgcatgccaccatgcccagctaatttttttttttttttttgtagagatagggcctcactatgttgccctggctggtctcaaactcacgggctaaagcgatcctcccacctcagcctcccaaagtgctgggattacaggcgtgagccacggagcccggcctggtttctctatttaaatgagtccccgggactctattagccctctgaggggactggcaagccactgggatctgtggggctgatgtcaggagtatttctccagcaggcatcagtaagagcttagcatctacctgacactgcagcctctgggtggaggactaagagctgttgagggtggaaagtggggcacagatgtaagacaggaactcccccaagttcagtggggccagtgggctccagctagcaagatagacactaagcagctgcccctgtgaccaaagcacacggtaggccgggccctgctgggtgggagaattccacttcgtttgaaaccaggcaatcccagcttcccattcggctgtcgctgaccaaataacctttggtttgcttatctttgtcaagcctcaggcttcttgtctgtagaaatgggcacagacccctgattgcagacagagtgggatgggtggctgcactggcacccttctttcttctcattggaggctgctgcctcctctcccatgcccagcagcacccctcacctaggctgcatgagcatttcagtgctaagggcccgtgcatgctgggaaatgccgcaggtccttgatcttcacctacatctcaggaagctgaggcccagcctggttcaggaccgctaaacgacaagcctgcaactcagatccacaaagcgtgttcttgttggccactgttgcctctctaaataggatgccatctcaccaggcagagttccctgggctcacggccccgttgttcccgttgtccctcctcagtcgtccaaaataggccgtaagggcgacaccccagaccagggtaggtggacaaatgcccttcctgtccttgcttctcccgcagccca

SEQ ID NO: 129053 - DNA, 1021 bp, Homo sapiens
cccacttcatcaagcgcctctaccaaggccagctgcccttccccaaccacgccgagaagcagaagcagttcgagtttgtgggctccgcccccacccgccggaccaagcgcacacggcggccccagcccctcacgtagtctgggaggcagggggcagcagcccctgggccgcctccccacccctttcccttcttaatccaaggactgggctggggtggcgggaggggagccagatccccgagggaggaccctgagggccgcgaagcatccgagcccccagctgggaaggggcaggccggtgccccaggggcggctggcacagtgcccccttcccggacgggtggcaggccctggagaggaactgagtgtcaccctgatctcaggccaccagcctctgccggcctcccagccgggctcctgaagcccgctgaaaggtcagcgactgaaggccttgcagacaaccgtctggaggtggctgtcctcaaaatctgcttctcggatctccctcagtctgcccccagcccccaaactcctcctggctagactgtaggaagggacttttgtttgtttgtttgtttcaggaaaaaagaaagggagagagaggaaaatagagggttgtccactcctcacattccacgacccaggcctgcaccccacccccaactcccagccccggaataaaaccattttcctgcaaatgggttatctgaagcggggcgggggatccgaccaccgaacacccctggaaacgagcctgcccgtccccggccgggcgtggccacggcaggtgcaggcgcggcccgcagcgctggggcccccaggaggccgcgggctcggccccgcgggaggcgggcgcgtccaggccgggcggcccctccctggcgcgggctcgggtttcctgggctcgcgcggcgcggcccgtgctacctgttggggaagaaaacccgagcccccggaggggccggggccggggccgggacgtgcatccagccgggccccgggccccaggccccaggcccgag

SEQ ID NO: 129054 - DNA, 1002 bp, Homo sapiens
ctgcccaccgacgccagcctgcttggatgacttgcctcgtttcataattcacttactgtctgcaccagccggcctccagcctggctggaccctgctgcctgtgtggcccggagccagaggcccccacactcccagctgctcttctacagatgccatcaacgagcaggactctgggtggctccactgtctaaggttagcacgtgggacccccaagtcccacattttgattgaactgggatctttggtactcattgaaaagagcacttggctttggcctcaggcaggccggggtagggattctggcttggcttctatttggggggccttcggcaagttcacctctcagcttcatttttgctcatctctaaatgaggagaatgtcgttttgtgtgaggtttagagacgatgtatgaaagtcccaagtatacaggggctgccaccaagcaggtagtggttggctggaaacaggagcacagctagaccaggggccctccaccccgaagttgccattctgcctgcggaggcttcatttctaaaagtccaggggagccacagtctggatcagtttctgcctggaagaagagcgcgccaggatgagtgggcacaaactcggagggcccagtgggcgggtcttatcacccacatcctggggagctgtggagaggagagggtggtgggtgaggtggggctgggctggtggctcagataaggcagggacacacagctgggggagggtggggctgagatggagggcgagcggctggctggcgtccgaccagggccaggggcagctgagctgtcccttccgtcacctggacctgccttcctctgtggtgctctctcttcctccctccctcccctcttcctgctgcagctcgccctttctatctctttgtgcacggaggtcgctgggaccttggggatgcaggcacagacaggcggggtgcatggatgggagaggggtctggatgggaggaggtggagtgagctggcacttgacct

SEQ ID NO: 129055 - DNA, 1597 bp, Homo sapiens
tccctgcccctcaccccagagggtgaggaggaatgaggggcattggtggttaggccggttggctgtcttgaacagctggagggaagatgcaggggtgggaagcggccaggcagaaagagctccaggctcttgtgtcgcccacccagccctcccatactcactcctgacagctttcctgcactgcagcctcctgctcctctgactctagtgggaacaggccccagctcagcctccggcagggaggtcacccctccacttcagcttgccctgacctccgctcgcaaaccccgagcttccaagccttttgctccagccctgcggcttccccagaagcctgggcttagggtggagatgccgcctacacacgatcctggccctccacctgcctccaggccacgaaatgggaattccagcactaagccaggcaccgggcagaagctgggccttccgcctcccttggatggggtcaagaggccaggcctggcacattttggagtgtcctggctaccagctctcacctacacccacgcacccccccacacactatgctctctcaagaatgtaatttattggggcccccccagctgctttcctcacctgcccctgccctaccttacacccccagcttgacttctttccagtccacgtgtgtatataatgatatctatatttttgcccaggtctgggtattgctcctgcccagaccctgacatccctttccactgtgtgtgtgaccatgctgggggagggggactctgcttggaattaaaaggttgcattgggtccctacatctgtcttttccttatgagccaccagacctgggtgaacgagacaagccatatcaggcagagggaagccctgggagcaagggttccaatgcaggggccgcctagggctggagggctggagacacagccccgcagtactctttcccccaagcctgggccacagaagcaggggctgtctagacaggggcctgtctgcctctccttcagggactctgtgatgggggcaggaacccttgtgtttggggccagagggaactcacacctcagggaggaggctggtagagaactggctgggaggaaagactgccccagccctccaccaaatcccaacgtgctcgccttggtagccaagctcaacatcagacatggttgtccctcccaaggggcagggtgctcatggttcaatggggaggccgaacacagaaaaggtcagcaggatgtgagtgtgtggtgagctgattgccaagaatcaggcaggggaaactaaggaatggagaaatggcagttggaggacgagtcaagtggaggccaagggaggaagatgggaatttggtcttggttgacttggtaaggcctcccaaggggaaaagacagggaattgcgtgttgcgggtgggaggtgggagaggggctgcggatctgacgggaagaccagaaggaggactgcctgcaggtgtgggtgcttacgtggggaggggccagccccacctggctggagcagaaccatgtgtgggcacatgaagaggcgtgcagtcagagggaccaggtgagttggagggtgcgcaacttgtgaacctgcgactggagct

SEQ ID NO: 129056 - DNA, 1035 bp, Homo sapiens
cacttgggaagctctcccgcattcccatcctcacccttccctggcattttccatctccagcacccgcctcgtggtgccacagtcatcgctgtatttatgggtccatctccctacctggaatgtgtgcactgcgaggcaggggcaagtcctaaccacctctgaggcccctgcacccaaaggcaaggcgttcgttgaattgtactcagcgacaccttttccacctaccaacaatggcttagtctcatacttggttcttagaaaaccccactcctggctgggcgcggtggctcatgcctgtaatcccagcactttgggaggccgaggtgggaggatcacttgagtccaggagatggaggctgcagtgagctgtaatcacaccactgtactccagcctagatgacagagtgagaccctatctcaaaacaacgacaacaaagtctcctggaggaaatggcacctgagcatggttaccacttctggtagcacctagggcttggagggaaggaggtggaggaaagaatgtgctagaagtggtgtggattaataattcagggccagtggggaagtccctgggggcagagctgggtgtggggcaggaatggtggagctgaggcctccaatgtccctggaaggctttgctggagaggatagtttctacaaggaggctctcgacagggctgtggagtaagcagggggtagctgtcgaggggcctgtctcccttccctgggggggccctctccatggaagctgctccttgcttctcctgcccctccttggatccttcccacgtgaagccttccattggggcctgttgccttcaccctctgaccctgttctctccgtggtcagcaggccaagggccagccgtgacagaggacagcccaggcattccacgctgctgcagccgttgccaccatggactcttcaacacccactggcgatgtccccgctgcagccaccggctgtgtgtggcctgtggtcgtgtggcaggcactgggcgggccagggagaaagcaggtaggagaggggctggg

SEQ ID NO: 129057 - DNA, 1685 bp, Homo sapiens
ccgctgctgtgcaggctgccaccaaggtgctctgggcccccagccctccagcagcccccatcccacccctaaggccctttgggctcattcagctcctctgccagggagcccagagatggcagccggggagcaggggtgagaaggtgacgggggggtattggcagaagcgtggagctggagtcagaccttccttcctggctctggcactgagcgtaagcagcggctcctgctctctgactttggtttcctgttggtgccacattggcgcggggccagaagcttgctgagcagttttcacttctgcgtctcagctccggtgattagctggttggccaatatccctgggcagcctccccgctgaagcctcttccccctcgcagagtcagggggcgctggccggcaggctgcggagcttctccatgcaggacctgcgctccatctctgacgcacctgcccctgcctaccatgaccccctctacctggaggaccaggtgtcccaccggaggccacccattggtgagcgggcagaggggcccagagccatgccaggagggatggcttccttcactcacaccatggcttcccccaaggctcgaggaagggctggcctggtcgcaggctttcagcttcacctcctcctccacacagggtaccgggccgggggcctgcaggacagcgacaccgaggatgagtgttggtcagatactgaggcagtcccccgggcgccagcccggccccgagagaagcccctaatccgcagccagagcctgcgtgtggtcaagaggaagccaccggtgcgggaggtcagtgtgggaggacgacaggagggaggagggctctgctggctggtgctccccacaccctcatgctgtgcctcccctttccccagggcacctcgcgctccctgaaggttcggacgaggaaaaagactgtgccctcagacgtggacagctagggtctgctgcatctgcccccttcttacctcgtgccctgcagggctccagggctatttggagggaccttgggctgcacatctggcctgcctgcaccagctgcctgggccccaccctcctgactcctgctgatggttaagggccgggagcagatgctgccaaggccacatgcagggatgcacccacaatgtaccaaagcaggctgggcccagggttctatttattgccttgctctgccctctcccttccccggttgtgggacaagagccctccctgaacccctgcaaccctccctgaacccctgcaaatgaaaccaaacgtccacctgggtgtgttcattccttcctgtccttcaaagtacttgatagcctttcataaggcctggcacatgtgtcctggttgtgtgtgtgtgtgttggtgagtgaggtcaggtttgcgagtgttttgataaataaatacataaaggggctctgtttctcctgattcttactcccgttgctcgcctcacacccttgaaatgggacagcccagtcctagcctaggtctaaggctgaaggagcccagtcctctgggggagacagaaccattgacagagagttgtgatgcagcacatggtttcacgaaggagcttttggggagttttgagagcactgatgggaaagtggggacgagtccagaggactggtcagaacccgaaacttcagttaggccttggcaggaaggtgcagctat

SEQ ID NO: 129058 - DNA, 1050 bp, Homo sapiens
gcctcgtgaccttcatcccttcttcactcactcattcaacacggagactccaggaggcatattgataccagtgagaccccagggctgtgcccttaaggagctctgggctagctggggagaagaggtcccccaatgtggattagaggcaggacctgctgtatgattcagggaggaaaaaaggcagttggaggttttttttacctgtgtgaccttgggcaggatattctccctgaacctcagtttctcatctgtaaaatgggcacagtaacagtccctccgccacaggcttcacatgaggattgaaggagaaatgaaagaggggtccttagtcagggaacagcacgtgagagacaccagcccagtccatgtgctctgaaggaaggctctgtggggttccagccatcggggagctgggtgggtcttggggctgagtggacaagtgaggctcacagccagcttcttcccttgaatgcctggagtctgtgacaccctttccttcccaccacagaggtggacgagtgctctcggcccaaccgcgggggctgtgagcagcggtgcctcaacaccctgggcagctacaagtgcagctgtgaccccgggtacgagctggccccagacaagcgccgctgtgagggtgagtgcccccagactgcctctgaccctgttctttccctggcaccagcccacctgcccagaattttttttttttttagacaggcttttgctctgtcacccaggctggaagtacagtggctcaatcttagctcaccatagcctcccattcctgggctcaagcaatcctcccacctcagcctcccaagtagctgggactacaggtgcacatcaccttgcctggctaattttaaaattttttttgtagcaatgaggtcttactttgttgccgaggcttgtctcaaactcctggcctcaagtactcctcctgcctcggcctcccaaagtgctgggatcacaggcttgagtcactgccaagatttcttatgcccttggacagaccccttcttggaaaagctagatggataccccaacact

SEQ ID NO: 129059 - DNA, 1049 bp, Homo sapiens
tggacccccagaattccatagatgaaccatgaggtagaaagatgtctgctggcactgagctggccaggtgggggtctgtgcaagggggcctattcctgatccccatcaggactggggcccaagcgctggaacatgggcttccagaaggtcctgcttctccaacccaggatcaggtaggttagacccctaggggccatgggaaccaggccaagaggtggagtccccaagtccttcccaaggtttcttgctcagttaacacatcagagggggcctgatcgagagccctccatgagctgcctttgaatcagccctgcagaaaatgtgggggtgaagggcaccctatgagccatcctggggttcactaaggacaacatctccagtgactgtgctagaagctttggggggcccagcttacggactgagcaaagccttcgctccaccccttcctcacatttgtgccctagaaacctagtccagtgcctggtacacagcaggggtaaaattacacctgccaaatgcgagtgaacgcgtaagtgaatggctggatgaatgagtgggggaaagtgagtcctgaggaaggctgcttcagtgtccggggcaggagtgggcagcctcacctgggagctggggggagcaggttgcaggggggtggggtggaggaggtgggcatgggcccaggcaaggagatggcactcaccctacagtgcccaaatgccccggaaggtggcaggggtcagactgaaggtcttcaggctctttcttctccttcttggcttagggtctcctcggtgggtgtcccaaaagtccaaatagctcccctcctggggggccagagtcagatgccccgggccctgagggctgagcctcgatgcccccagtgggggtcctctgcaggtttcttgtgcgatggggcaatgtgtgtgcacatgtgtgtgcgtgtgggcgtgtgtgtctccgtgcagggctgagggtggggcgggcacagtgtcgaccagggcatgggggcagagcagtaactccaggcctgatagatgtgagtgtcggtcccc

SEQ ID NO: 129060 - DNA, 1057 bp, Homo sapiens
accccgcccgcccccgcaaaaagaaattgagttggggaagccatgcttttcagaggcagaagtcagattgccgtggattgaggagacctgccgtgagagtgtggccatagcgagtgttctcgaaggctagctggaaacaaaaggagagcgatgggctgtagctggaggggcctgggagagctctttcaggatgtgtgaaggttccgaggctgcagagctgagtgagagcgtgaggctggatcatttgtggtgtgagggttcccacgcgtgggcagcaatgagctgcacctcccagaagggcagtccatcctgacggggaggagggacacttgctctgaggcttcagggcagcagggtagcagggtaggtgggtttgcaggtcggagtccagaggttgaagccattcatggtggaaggccctggctttgtcaggaggtaggagagaggtggtctgccactgggagctgacacagtggcttgaggagggggctggatgtttgcagcagttactaaggaggtgagagatggagctggtaaaggccaatccaaagagtatcaagtggtctgggggcccaggtgaggctggagccacaggtggagttttctaagatagtgctgtgcagagccggggatgcagggccacgcagggtgcagaggagcaggctgggtggtcagccctgcagtcagttaagtcaatcgaggaggaaatagtgggagagaatagaaagatcaagaccctggaggtctctctaaaattaagaggccagccaggcacagtggctcatgcctgtgaccctagcactttgggaagctgaggcaggaggatcgcttgaatccaggagtttgacatcagcctgggcaacatagtgagaccccatctctacaacaagcaaaaatgaaaaaaattacccaggtggcatgcctgtagtcccagctacttgggaggctgaggcgggaggatcaattgagcctaggagctcaaggctatggtgagctatgatcgcactactgtactccagcctgggtagcaaagtgaggacccatttttgtttttgtt

SEQ ID NO: 129061 - DNA, 1032 bp, Homo sapiens
agtgtggccgtgcagacggcagtgaagcagagcgatggggagtacctggtgtccggctggagcgagacggtggagttctgcactgggggtgaggccctgctatcacacccctgtcctgctgcttggcacgtcgggctttgctgtggtcaaggcgggtcttcctcgtagtccagcaaacactgatgaacaccttctgtccaccaggcagcgtgcttgggccacaggggagatgcacgggcatgacaccctccctgcctccaggagcccaacctttctcttctctcactggaggcaaatgcgaaccccactaatcacgctggcaagaccacttccattaagaaagggagttacttttcgggcttggtaccagatcacaggcatctttttaaaccttgtggtcaaaggtgcatgacgtaaaatttgccgtctcgaccattttgaagtgtacagttcagtggtattaagtatattcacattgttgtacagccagtctccagaacctttcttcctggaaaaccaaaactctatacccattaaataaccgccccccatttccctctgctagctaccattctactttctgtttctatgaatatgactcctctaggtgtctcatatcagtacaattgtataggatttgtctttttgtgactggaatataccaaaatttccttcctttttgaaactggatagtatttcattgtatggatagaccacattttgcttaatcaattatttgtcaatgtgcacttggtgaggcaatcacatttcacttgttctgagccttcacgtagcctgggaaaatggcccctggtcaatggccccgcaaactctcttagcagaacttaacttgtagactccatcacaaacaaacagtgggcctatgtgtgcttggtccctcacgactcagggtctgcccccacaagattacattcttttggtgttcacggtgagagctgctccagatctctctgtcacacagaagagacacggaacattctcagccccgggcctctgaggctgctggctcta

SEQ ID NO: 129062 - DNA, 1071 bp, Homo sapiens
tgaggggtagaagagcttactgatgtcctggaatcctggggagcagcggaatctttggttagaaagggactaaagcagactttgatccaggtgcatgtgctagcaggctggatgacccagactctctttggcagttcctcgatgaccccggcctgaggaacgacactcgaaatatgcctgtgcagctgccgctggctcactcaggatggctttttaaggaagaaaatgacgaaccagatgttaaaccttggctggctggccccaaggaagaggacatggaggtggacatacctgctgtgaaaggtactctgtcggttaacttctcatctccaattccatggctgctccccaggaatcccgtgcatcaggcatcccttgcatgtgcccctgactgctgctcgtgagcaggtcctcccattccggctgtaagatacatgagctgaacaaagatgctccattctccctcgcagagggttcctgtgttgacagggagcagtgggcctagcctcagatgtccctttttagataagtcatgtgagacttgaacgtgttgtctcttgcccctctgtataactggtgcctccttcccactccctggctgagtgacagtggagcagacaggggcaaagggctggtaacagtgagctggtatggagggtggtcacttgatagcattccatgtctatcacccgggcagtgaaagaggagccacgagatgaggaggaagaggccaagatgaaggctcctcccaaagcagccaggaagactccaggcctcccgaaggatgtatctgtggcagagctgctgagggagctgagcctcaccaaggaagaggaactgctgtttctgcagctgccagacaccctccctggccagccacccacccaggacatcaagcctatcaagacagaggtgcagggcgaggacggacaggtggtgctcatcaagcaggagaaagaccgagtacgctcagacagaggcctgcgggaatcaagtcggggactgggacgggaagtggtgacctgtagtgggaagcaaagccgtgtcaccctggctgaaatgggacaataa

SEQ ID NO: 129063 - DNA, 1044 bp, Homo sapiens
agagtcagaccttgtctcaaaaaaataagagaacgtaaaccgccatgtaccagaactcagcttcagcagtaactgatattttgtccgtgtatgtatttgtttgctgtgggttttgtattttaaccatagcagacagccctaggagaaggcactctttggggagctcattttgacctttgctgtgcctttctcttggggagtagaagggggttcatgaaagatggaggaaagagctcctagcccagtgtccatcctctggttttctccgcaggaagccaaattggcagagaatgcttgtaccctggctgacctgacagagggtcaggttggcaagctactcatccgcaagtctggaagggtgcaactcctcttgggcaaggtgactctggacgtgaccatgggaactgcctgctccttcctgcaggtaagagcctccttaggggcaaggagggaccctttcaggagtgaaggaggattgaagagccactgctaaataagggagggggtttctgggagtatcatgtccccattcacagctctacacgccgggcacgtggtggtggttctcatcactgtctctgttaattggcaggagctggtgtccgtgggccttggagacagtaggacaggggagatgacagtcctgggacacgtgaagcacaaacttgtatgttcccctgattttgaatccctcttggatcacaaacaccggtaaaatgagcaggtggaggaggacggcgcctgtgcccacggctgctgcctgctccagacattttgttcttgaatctgtgagacccagaaggggcccactgagcccactcactccagcctttggcaaccattgttccaggtcccccagggcttcctcccacagcagctgtgaatggcacagtgaccttcctgcagcgtggagatggcacatccttgctgctggggacttggccctgctatttatttttgtatttatgtcttaatctcttccactgatgcatcctccaagggtagatggggagggtctgtgtgaaggggccggcttctcttggt

SEQ ID NO: 129064 - DNA, 1052 bp, Homo sapiens
ttgcttctgggtcctctcagcagacaaagctaggaaacagataattcagcacctatctgtatatatgtatgctaaagaatatgagtttgtactgataacgcttattctgatctaacctcaaaaagttcgttttattttagtctttcccttttcatgatgacttctttctccaacagtgaaaaaccctctcagtcattttcttagttggggtgaaggttattttccactggttttgctcctattatcgtggccctgattaacacacatttccacatgtggactatagattatttgactcaactcgcctttgagatgataacatctggaggcagaggcaagtgtttctgattttacatactctgtgattctgcacccagagctgcactaggatgtactgaatgcttgatcagcatcttacctgctgaataccccatttggatctgtgcccgctcggctatgctctccctctctgcagttcacaactctcctgccaattgtatttgtcttaaacaatactcctttcccgttcctagctttagaattctttgtgagatgagaactgtagcctaatgttagaagctctaaagcctgcccggtccaagatcagaaaccactaccactcatttccataccacctgctcttggtaggcatgtgtcagtagaatggattaattggaagtaaactggaataggacagagtgcagagacccatactgcctggccctgccacctgtgaccagaacttgtcacttcactgctctggggagtggaggtctatcagagcaggcaagtgtgttagtatgacacacttagtggcttgaaacaacacccgtttatcatttctcaattctgtaggccagaaggctgagcattgcatgactggcttcattgctgggggtcctagaagactaaacttagggtgtcagttgggttttcagggcctctgccaggctcagatggttgtggaaaattcagctccttgtggctataggactgaggtcccctgccccctcacccctattttccattgctggctaccaggcaggggccac

SEQ ID NO: 129065 - DNA, 1051 bp, Homo sapiens
tcctgtgccctgtcatcccaggcccatgtgactccaattggcgtatctgtattccaattccaatgctgaccgtttctccagggctggctgttttccatctgatgggctgggtaattctcaggataccaggtccctgggcagcaagccacgctgttcccatctcccttcccagaaagatgcaaaaagtacaaagtcacccactcccccaggcccgggctgctgaccaagtgccagctctcagaacagaaattccatgtctcagttcctgttcccagctcctcggccgccccctaacacccagcagacgctctgtggtgcctcccacggcagaagccttggccgtgggtgaactggtgtgtgcagtggctctgctggccagctcccggctgtggccatggtgactctggcatcactccctcttggcagcactgggccccctcccccagcatttcaggatgtgtgtgatggcagggaaactcaaaatttccatgagccactgagaaattctagaaacagcctgtacttgtggactttcctttttcttcctctgccacagggaagagtgggaatgttatttttggtgggattatcagctggttgaccttctcagggatgtggaaagggaggctgcctgcccgcccgggcctctctcccactgcctgcctttgtgtcccccaccccacctcactttatgttttaaaaaaaaaaaaaacaactctggcgggcgcggtggctgacacctgtaatcccagcactttgagaggccaaggtcgacagatcacttgaggtcaggagttcgagaccagcctggccaacatggctaaaccctgtctctacaaaaaatacaaaaattagccaggcgtggtggtgggtgtctgtaatccagctactcgccaggctaaggtggaaggatcgcctgaacctgggaggcggaggttgcagtgagccgagattgtaccactgcactctagcctgggcaacagagtgagactgtcttaaaaaaaaaaaaaaaaaaatcttggccgggcacggtggctcatgcctgtaatcc

SEQ ID NO: 129066 - DNA, 1093 bp, Homo sapiens
cagcctcaaactcctgggttcaagcaatcctcccacctcagcctctcacactgctgggattacaggggtgagccaccacatccagcccttgaaccagtcttaagtgtgtaacagtcccgcggggagagcctggacaccttccggagggtggatcctgggacatgcatttccctggtgtggctcatggcaaggacagtgtggttctggagcaggcggcttcttgtgccatagctatctggtgggagcacaggcagcagctccatggcatcccagctctgcaacgtgatctttgcaaataggtagctcctgggacttagcctagagtcttgttaattcagctcttcgaaggagcctctaggccatttaatatcctgtacaaaacccctgtctgccaaaatagcctaactgcaccctgatctatacatcccccttgtcatcatcattcaggttaggttccttgttgaattgtttgctttccctactttgttgagggcaggtgctaggtcctttgcatccccaatacctagcatgacttctggcacataattggtaagcagtgagtatttgttgaatggataaactcttggagtgagtttttaaagccagcaggtaatatgctagcttttagttcaattaatgtaaatgaaattcaaggtcagggagttgtttactctagagaagtgcataataggtggtcctgacacctgacttcagatgatctgggttaaagttggtctgtgggccaaggaggatagaatgtccttggaaagtggttctgagctccctgttcttttttttttttcttttgagatggagtctttgctctgttgcccagggtggagtgcagtggcgcgatctcggctcactgcaacttctgtctcccgggttcaagcaattctctgcctcagcctcccgagtagctggggttacaggtacccgccaccatgccctgctaatttttgtatttttagtagagacggggtttcaccactttggccagggtggtcttgaactcctgacctcgtgatccgcctgccttggcctcccaaagtgctgggattacgggcatgagccaccgctcccggccagggct

SEQ ID NO: 129067 - DNA, 1142 bp, Homo sapiens
gatggatgtgagtaccgcgtttcctaagccacatgcccggcctcacggtctgacaaatgggagtgaacttggacgacagggagaattttgcaactgtctgggaagtgttgatggatgaatgatgagaagtgaggtgactctggccctggcctcgggtggggaaaacaccggctggccactgtgggcccttcccgggtccctgcccacctgactcagttgctttgggaagtcccctttgctccagctccagctgggctggagcaagcctggcaaatgtgctccctccctccctccctcctcctggctccagcgcctgggcctggctgtcattacactcactccgcgctcagcgtggggctaaataagccattccctgtttgtctgtgccgctgcctggggccctgaccacccgtctctgcctcataacctcctcccacaggcgctggcacacacagtgggggctcagtaaatattagttggtgaacagcaggctcaaggttctaattttgttccctgcttctgggtcaccagagtttttattattatttttcttagttttcccatcctgcccctcccatcagcgcgaggtttcacaaggagagtgagtgggctccgctggccgccctcctgcactgtctggaaatttcccaccctgggtgcgctttgactgtgccaaggcttgaggcgaaggtcctgggagcaggagctggaggaagataatgcatcctttcagggtatggaggagagcagtaggtgggagggcaagaggaggcagggggagaatgggccgattaagccccggggcagggccaagcgagggttggttttccaactgtgagatttgctgtttgcctgagtgaaggtgtcagcctaggtcagcttgtctgaggggagagtggcttctcacacggtgttctttgggtgagtggggtgggccatgggctggatggtttttctcaaagctctttctacccccagagaagcctgtagggcagtattcagttgatgaccaagctggcagatgtttgggtttctgatttcgtaaactgggactcacacagatgactgtatcgttgttagtttgaccatgaatatccagagtgtattaatcaagcatttgtaaaacatttggcagtttccgt

SEQ ID NO: 129068 - DNA, 1054 bp, Homo sapiens
tagttgggtgtggtggcgggcccctgtaataccagctacttgggaggcctgaggcaggagaatcacttgaacccaggaggcggaggttgcagtgagctgagattgcgccactgcactccagcctgggcaacgagtgaatctcccgtctcaaaaaaaaaaaaaaatcataaccgcattgctgtttgtttttttttttttcatttttcaatctagtcaaaactgttgaatttgtcctttttattcgtttttattctgtgctttcaaaagaagggtttttctcaaaggctaattcaagaaggagcagagaagcagagactgagggatagtctcaacatgttcagtgtgtggcgggcgggcctggcgcagttgccggcacacagggagaggcctcagcttcacctgcctttttctctcacaggtttattcagtcaccatgaagctgctgctgctgcacccggccttccagagctgcctcctgctgaccctgcttggcttatggagaaccacccctgaggctcacgcttcatccctgggtgcaccagctatcagcgctgcctccttcctgcaggatctaatacatcggtatggcgagggtgacagcctcactctgcagcagctgaaggccctactcaaccacctggatgtgggagtgggccggggtaatgtcacccagcacgtgcaaggacacaggaacctctccacggtaaggctcccctgtgagccagcagctctgctcagccccgtctctggcctctcagggttccctgtctagttgggcccagggcagcctggcagcttggcagaggtaggatgaggcagacaagtctcgatgatagagtggacaggctgattctttctctctcattgtctgaatcagcaaattctgagtcttctgcagcaccttctgaccccctgcataggtgttctgaagcccttaacaaaaggcagcctggggctgggcacagtggctcacgcctgtaatcccagcactttgggaggccaaggcgggtggattatctgaggtcaggggttcgagatcagcctggccaacatg

SEQ ID NO: 129069 - DNA, 1036 bp, Homo sapiens
caccatgttagtcaggccggtctcgaactcctgacctcaggtgatccaccttcctcagcctcccaaagtgctgggattataggcttgcgccaccgcacctggcctacttgtatggtttttaggcttccattgctgtttgcatccgtctctccatggaaaaggtgtttctcttggatagcaattttgatagtttccctaggcttctccgcagcatctggtgagagatggactcagcaaatgtttactgatgggttggtggatctcagtctgccccatcacacctgaattcagaacagggccgccccaggcagcaggagtgtccccaccctcagtaatagaggccctcgtctgttcttgttcctccacagtgtggggctttggttttctcagtgtctcactgattaacctggcctctctcctgggagtcctcgtcctgccctgcacagagaaagcgtttttcagccgtgtgctcacttacttcatcgccctgtccattggaacgctgctgtctaacgcgctattccagctcatcccagaggtgcagtagaacagaaacttgcgcgtcctctttccctggggcggcacagctgagccaatcccctcctcccctaccctgggctccaaggcacccaatgactgccacctgagaaatgaacctgtccctcgtatcaaagccacaaacgacttctaactctggatctcagggcccacctctcactcctctggcctctgcaggtgctgtcagatgcaaggttcttccaatttccctcctcctggggacttgacagtctcccctcccttgttaagccccatacataaggcatcaagggaaagcagcagctatcgactgccgtccatgcctttggtgctaagtacttgctctattctaaggagaaatcctggcagtactcaggtctgggcaccaagagcttatccatctggaatgagatggaaggaaaagaggttaccaagtgatatgtagaattggcctaaaaagcgagtgttctttaattttgagcaggccatcgtttctagc

SEQ ID NO: 129070 - DNA, 1210 bp, Homo sapiens
tcaggctttcccagtcaaaagactcacccagaaaagacagcagatgggatgccatgccttgcctgttcttcctggttgaatgtgaaccatcttggtgccatctcaaaattctgcatggctctgacaaacactttgcaggggaggcctcaacttgggctattttttcagctccagcaatggaatatattaattttttaaagatttgaaatgaaaggccttgtgacctcctggaatggaaatactgtaattgtgtgtgctccacccctgtggcctgccagggagtgtctcatcctggtctggttctgtcttgccctcttttgggcctggacagagtgtcacaactgggaaatgttcaaggaaatatttttgtgacagggtgttcctggaactctgttctttgtgcttgagcccctctcagagcacatggaaatgagcaaagaagttgagaggttaagacactgaattttatgggcattgggcatgaattaatcgttctccatcccttctgccctgcacatctggcttggttgtgtcttgcacaaagcaaaccaagtggtcgtggtgtcacccgagcctgcgccgtgtgaattggacatgcaaaagcaaacgcagcagcagagtgatcagcctctttccacctgcttgcatgtcctataaagagagccctcgagtccaaagtctgtcctggacagcctctgtgataggtctgggcagaccttgggtgtgtgacgaggcagcaccctgccctgccagtcacaccactggcaggaacgatttggggccaccagtggccacaggggcagaagtcacagggttccaaggccaccttgaattcctctttcttctgaactgattgaaggaaatttcatcagatgtgaatcactaacaaattttctatttctctctccctccctacttgtctctctctgatttttcttttttgttccgttaatatccaccaaacttttccttgcgacctccctatctgctccaccttcctcccgctaaatggtggttgctgtgcaatggggcatgtgccttctctccctgccctgggtggggctggccctccctccgcacggcagtgtggggatacggtctcctctgtgtgaccgtcatctccctctgctccctcctgggggccagcgtggtgcccttcatgaagaagaccttttacaagaggctgctgctctacttcatagctctggcg

SEQ ID NO: 129071 - DNA, 2800 bp, Homo sapiens
tgtattcaggacagatccagattgggtagggctctgccaagagcctgtgggactggaagtcgggccctgggctgcccgatcgccagcccgaggacttaccatccacaatgcaccacggaagaggccgttctatgaaaaactgacacagactgtattcctgcattcaaatgtcagccgtttgtaaaatgctgtatcctaggaataagctgccctggtaaccagtctctagctagtgcctcttgccctctcctcacctccttttctctcagtgactctggaacctgaatgcagcttacaagacaagcctgacttttttctctgattaccttggcctcctcttggaaccagtgctgaaaggttttgaatcctttacccaacaatgcaaaaatagagccaatggttataacttggctagaaatatcaagagttgaatccatagtgtggggcccatgactctagctgggcaccttggacctccagctggccaatagaagagacaggagacaggaagccttcccattttttcaaagtctgtttaattgcctattacttctctcaaagagaacctgaagtcagaacacatgagcagggtgagaggtgaggcaaggttcatcctgaatgggagaggaagtcgaaccactgctgtgtgtcttgtcaggatgctcacttgttcctactgagatgctggatattgattttgtaacagcacctggtgtttcacggctgtccgagtgagctaacgtggcggtgtggctgcctggacctcctctttcaggttaacgctgacagaatggaggctcaggctgtctgcaagaaaacagttggtttggctgtgattttgacctcctcttccccactgccatcttctaagagactttgtagctgcctcctagaagcacattctgagcacatttgagacctctgtgttagaggggagactgcacaaactatcctcccccaggttgagacgtctgcagagtggcaagctgacttgtagaaatggggtgccatttatgctctacttagacaagggtaatcagaaatggaatcagtgcaggcaaaatttaggatttgccgcttccataaatcaaagcatgactaatagggggtctctgaaatgtaagggcacaaacttcacttagggcatcgcagatgtttgcagaatggttggcctaatgattatgctacagatgggttttaaatgacccgtctaggttactgcttccttgcaaaaaaagtcgaatcctgcattgaattgaatatgaatttctctaactctctccagaaaatggatggagataacttgtctttaaaactgtaggccagccttagccactgtggagcccttgcctccgagctctggcttcaaggggagctcttctccaggttcactaggtgaattgatttattattatcatattgataatgtgagattctttagccactttggggagcctgtctctccagaagcctttcttagtggtgcccacagttggagcccaggggccatgtttgcaaactgattcatgtgcatggctgacaggagtactggttcactaccaatgcctgagcttttctcttacatagaaaaactgtccgctctcagtaatcacaagcagcatccgttttgttttctcttcttgggagacatctgtcaaaccaggaatattcttgaaaagaacgtgagcaggaaaaactgctggtgatactttttttaagttttgtttttatcttgcctgttggcttcaatacatttgagaatacgctgaagagggaaaatttcagtgatggagattctagattaaatatcaggactgatttcctggtgggattatggtccagttttaccaaagaaccaattccttgaatgttggaatctaactttttatattgtcattattattgttgtttttaaacggttctttgtcttttctgttttatttttctcaagctgctttcaggagctagcagaaaataactcaaagttgaagactctggaagattttgctttaacctaactcgcattgatgtattaaatttataattttagcattcccaatagatcctatcattccttaaacataataccctttgtcttggagtagaatactaagttagagttagtggatttctagtttaggagaggagctcaaaactataatctttaacaaattgaaaaatgaaatagggtgttttccctttttgtgcacacctatattaccttaagaaatttccttccatagacagctgcctcaaagggaaatcctctttaaaccgtagttggcgcagaggtcagtcctagtcggagcttaggaggggcggagacgctcacatcgtctgacttgagtcgccactgattgtggcaacagctttgcctcatgagtcaaaaattggcaatttcttttgatttttagttgttgaatttgctgtttcaagcatttgtacatattagaagtctaaggagtagcaagtcagtgggaggactttttcacccctggcattagcagcttcgacctcattttccagatgcaccagctcctattaataagttagcaaggaaagtgtatgtcacgtgcaggaacagtgaggcagggacaggggttctgctccttctcacttcaccaccggcacacagcttgcccctgtctttgcccccaaaggtattttgtgtctagtgtcaaattggagctattcttcactggtccttaaccttgggttttaaaaagaaggcttctctgtttgggtagcgtaagagctgagtatagtaagtcctcttccaaagagatggcaatatgctggg

SEQ ID NO: 129072 - DNA, 1048 bp, Homo sapiens
agttatttaactagaatataattactgctctagtattttttccctagcactttcaaacgttactcaaagaatccttctagctctttgatacaaattttagaacttcactattaacaaatatcagctgggctcggtggctcacgcctgtaatcctagcactttgggaggccgaggcaggcggattgcttgaggtcaggaatttgagatcagcctgaccaacatggtgaaaccttgtctctactaagaatacaaaaattagctggccgtggtggttctcaactgtaatcctagctacttgggaggctgagacaggagaattgcttgaacctgagaggcagaggttgcagtgagctgagatcatgccactgcattccagcctgggcaacagagcgagacaccgtctcaaaaaaaataaaaataaaaataaaaataaataaataaaataaagtaaaataaaaatatatatatatcactactagctaggattttaggaaggctacctatagaaacttagatatatttagttatggaatgttttgtttttcagttggtaatgtacactctttcagtgtttcaaaggaggatactggataattcgatttgaattgtaaatctccccaactggtgttggagaaaccagaggagttgatgattttatacacagtctttcctacctcttattattgagaaaagagtgttaattgtggtcaatgaatttcttcaaagtttgctgcttttaaatcaaattaaggaagtcagcaactataagtagaatgatatgaataaaatgtttcattgttatgaagaagtgttagtagcacgtggcattatgtgtttcacatattgaagttgacaccagaaatatacatttgtaattttttttttttttctgagacagagtctagcactgctgcccaggctggagtatagtggtgcagtcatagctcactgcagcctggaactcctgggcccaagtgatcgttccgcctccacctacacctcccaagtagctggaattacaggcacatgccactgtgcccagaccatt

SEQ ID NO: 129073 - DNA, 1033 bp, Homo sapiens
aaaatgcaaaaattagccaggtgtggtggcatgcttctgtaatcccagctactcagaaggctgagacagaagaatcgcttgaactcaggaggcggaggttgcagtgagctgagatcgtgtcactgcattccagcctgggttgacagagcaagcctccatctcaaaaaaacaaacaacaaaaaccattataatttatgcacacacaaatatttaaaatgactgtcacctttttatacttagaattgatcatttatgatacatagtatcttagaattttttccccacgtactggtgctgtggatgtgaaatcatggtgatttattaggtttaatttgtcatgtaaaagaattgtgttctgtttgttctctatacatttaaatattttaaattattattattatttttttgtagctgtcccctttcctccaacccaacggcttactttcaaggaagtatttgagaatgggaaacctaaagttgatgttttaaaaaaccatttggtaaaggaaggacgactggaagaggaagtagccttaaagataatcaatgatggggctgccatcctgaggcaagagaagactatgatagaagtagatgctccaatcacaggtataaaaagtctttgcatgatacttttttacagtatagatttgcatgagcagttttgagaaataattacaaataaccagctaaaaagtggtgtggtaatttttctagaaattatgagacagtcaggattggttaggatatttgttgttaattgaagaaatacaattttaagtgtctcatatttccagtagaactatttagtatgagtagattgactacagttttacagcagtcctgtcaaaagctggagtgatttaagttagaagttaaactgtgatcccttttggtgtaatgcccttcgtcttctaaggtataatttctcacatcactttatgctttttttcctagtatgtggtgatattcatggacaattctttgacctaatgaagttatttgaagttggaggatcacctagtaacacacg

SEQ ID NO: 129074 - DNA, 1049 bp, Homo sapiens
atgaaagcagccctcactaagttcaggagagctagctgggtgttgtgtttacatacagaagacagctgctggaatgatcacttgccatttggcaggccgaaccctgcaccctaaggtggcccacagcattatcaaaagacatctttgctgtagcagctttctttgtgaggtttgtttatgtatgtgtgtgttttattctttgctgtgctctacgtttcacaaccacaaataagttcctacctctcatagatccacccagtctgtcttttttgtggcctctcattttttacttcatctttttatcttctgagtcattttttctcttgctccttagaacttcctgagatttttgtttgtttaaacaaacttaagccttcatttctgttttttaaaaacaattgtttctttaacttaagacacttcatcctgaattttttaaaggcagcctattaacacatccctttaacttacttattctttgtattctctaaggaagcactacagttcgtaaggagatcatcaggaataagatcagagccattgggaagatggcacgggtcttttcaattcttcggtaaggatgtctgtcattacagtgcggattaaaggcattttgagagtaaattagacgtcgaattcagaacagtttttttataattggaatgtagtattgaaactgcaggtctttaggttgagtgcaaattcaatgaacatgtttaagcgactaaaaatgttccagcaaacattgatttgttagtagcttagatgtagtgaatgtagtggtttagtgtggactttccaacccgattgcctgtgttcaaattctggctctacctcttcttacctgtgtgatcttgggtttcatctctgtgccttagtttccttgcctgtaaagtaataataggccctagcgcacaggttgttaggtgtattaaatgggatacaatatgggaaatgttagaacagtgcctggctgttaaacacttctaattgaaaaacaagaactggctgattgtttaaaatgaaaatatttgtggaaaacatccctt

SEQ ID NO: 129075 - DNA, 1095 bp, Homo sapiens
tgggacttgggtaagaaggaggccagggttggggagtggattctgagttgggagaaacagaaacacgttgtggccaaccatagctgctttaaaatgaaagggctggagagacgaaagagagaggtcctttttattgtgatgggattccctcccttgggaggggaattccttgttatcatcagagaccagaccagacatcaaaagccaggctttctcctggggtctggaattattaaatgagtaaaagccaaatataagtacctccaccaggaaatacaggaaataaagacacagggagccaataaagttatcatttaagggtgttttcttctttttttaaatcttaagattacctctaatttatagtacaaaagtcctaacaaattaatttcttgttcacaaaaaagacattagatgatttcggccaataagtaacatttccctcgccttctttaacataactgaaagcaagaaaaagtaggcaatctctaagcacaagcaaataatccatcattcagaaccttgaaaaaatatcacaccaccaactggtctgacgtcttgaccacctcaccatttaggaaggaatactggggccccttcttggaaaatgcctgctgacagaactattgggaaaaacagctatgggggtcaccatgcactgagaaaataaaagttagggatttacagtgtcatcctcaaaaagttctgtgacaaaaacacatctttattgccccaaatcaagatctatgacaggcctgctcctcattacatgcatttcatgttaagagtatttggagacatctacgtcaagggagtgaaggaatgtgggcaagaacttactggaaggcagtgtgcttggccctacttcagagctgctcagagggacagtccgcctccatgtcctcacttcttaatcttaagccacctagacttgccatgagggcatagaagaggagatgatgcataaccctgtctcagacaaaggtgttatttagcaggtcttgccaaggtggcaggggcgtgaggccaaggcctcccgggagggaatatactctccagtatcatctttacctttgtgactgcatagatgaaggc

SEQ ID NO: 129076 - DNA, 1044 bp, Homo sapiens
gatggcagctgggaaaccagagagggctccccggggaccctcggcggcccctcccggcgccgcctccccgccggccaggcctcctcggcagggggccaccagtgtccccgcgcgcgccccgacggacggagagcactcgcacgtccctcctctccggcccagccccggcccgcagtccagatccgagacccaaactccgcccgccccgccgcgcgactctcacggtccggcctccggcgcgcgccccttcggcctccctcttcctgcgccggcgcccggcccggcccggcccgtcctgacccggtcacgagggccgcgacggcccgcgcttctccttgcccttcctcctcgagcgcccgcgccaggcagcagccgggcagggatgctcctgcgctcccgggcggcctcgggcccagccacctgctcgccggggaaggtaggtccgggcaaggaggggcggggagtaggcgaggccggcgggagggatccgtgcccaaccccagggaatcgcacctagcccctccccggggtccgcgtcccaaactctgggaagtacctcccaccagccctcataccagaaaaagcgaaattcaagaaaagctgtccttgtccacgtggccttgtcgctgagaaatacctgggaaagctcttagggccaggcacccaaggtcagggcagtgttcagagcagggaggccagtgcccaccccagcagagccgcctcccctctcccgctccaggggcctctccccgctcccggggctggctgcctgcctggaggggaggtctgaattctgggaggacccctccgctctctgctacatgggggaccagtccccagatgctgccctcttccttgtaagtcctccctaagtctcctgacctggctgccaagagaaggactcggaccacccttccctggaggttcctgtggtggggggcgacacaaggggcagggttgagaaggggcagatgggggcaccaagggtaagcaacctctgactacgggtcgtgggggacctcctgccctacccatcctccaaga

SEQ ID NO: 129077 - DNA, 1022 bp, Homo sapiens
ctgtgcgcatccaggagggccggtaccgccaccccggctgctacacctgtgccgactgtgggctgaacctgaagatgcgcgggcacttctgggtgggtgacgagctgtactgtgagaagcatgcccgccagcgctactccgcacctgccaccctcagctctcgggcctgagcccgccatgccctcagcctgcctcactgctgggccagggtcatgcctatataagttggcatggcagggacaatggtgggcagttgctcttacatgagctaagtttggagacctgaggcccctttgtcctcgctgggtgggccaaggtctgggacctgtcttggactgtgggagactcaccctcaccttgccaggcctctcccctgcaggactggcattgcactagtctgaggtggccactgcctttgatcaacctttgtgtgcgagggtctaagtagggtcgaacacagaagtgggaaggagaggggtgggccaggggctaatggtgtcactgtgtaaagtttttgacatactagctctataaatatatgaatatggacaaaataaagtagatgtcccttccttctttttcctaccgccagccctgggtatgacctgctcccaccactgggtggagggtctttatttatgcaacatacgtttcttcttcttttccctccctcaaatcccacccctgccagttgcctgcacctgacatttcccatggaagggccttgcctcttttaggttgggagtcatgtcattccttaacctttttgtaaagatgcccgttttacaggaggacgcttgtgctatggagggaatgagattgtcactggaagctttggaggggatggtggagggcgccaagcggagggacaggaggaagaccaggagacccatccagccaagctggtgagacaacctctgatcctgaggaccggccgcccaccaagggttgggcccccggggccaggttgatctaccgacaccttccacttctttcctgggagagactgctggcttcattgg

SEQ ID NO: 129078 - DNA, 1109 bp, Homo sapiens
catttcttgaggacttggtctgtagctttcctgttgtgtcttcaaagcttggttcgcagtgtgtgctcattgagtgctgactggaaactgaagcccttgcctgtgaacgtggtgtctgcgtggagttgtcactaaagaagttagtacctccttttgccatgtgcaggtggcgctttgccgagtttcagtacctgcagccgggacccccccggcggcttcagacagtggtggtgtacctgccggatgtctggaccatcatgcctactttggaggagtgggaggccctgtgccagcagaaagctgcagaggcagctcccccaacccaggaggcacaaggggtaaggctgtgccttagccagcagcgggggatataggtggcctaatcccgggacccagagggtctcatttcagctgttgtcacaggaaacggagcctactgaacaggcacctgatgccttggagcaagcagcagacacttctagacggaacgcagaaactccagaggccaccacacagcaggaaacggacactgatctcccagaggcccctccaccccccctagaacctgctgtcatcgcacgccctggctgtgtaaacctgtccctccatgggattgtggaggatcggaggccaaaggaaaggatctcttttgaggcaggtgtcaagagtcttggggaggctgtgggctgggatttgtgggcctgaagcagtctttcttcctgatgctcatggaccctcccacctccccatcaggtgatggtgctggccgagctgtttctggagatgctccagagggattttggctatagagtttataagatgctactgagccttcctgaaaaggtcgtgtccccacctgaacctgagaaggaggaggcggccaaggaagaagccaccaaggaggaagaagccatcaaagaggaggtggtcaaggagcccaaggatgaggcacagaatgagggcccggctacagagtcagaggccccgctggtgagtaccctgccacctcgggctgtcatagtgcttaccgtgaccgcgcacctttaccccgggctctgttccgagcgcttcctgtgccttagctcattccctgcacccttgctcggcat

SEQ ID NO: 129079 - DNA, 1113 bp, Homo sapiens
gccttttccttataacctttgtctgcctctgtagaaggaggatgggcttttgcccaaaccactctcttctgggggagaggaagaagaaaaaccccggggcgaggcttctgaggacctgtgtgagatggccctggacccagaactgttgcttctgagggatgatggagaggaggagtttggtatgttgagtggtgagaggggagcttgcaggcttgggatgtggctttccacctgtggccaagctggttttcatttttgtactgtggagttgggtgggccctgctctccatttatcttggcctttctgtagcaggagcaaagctggaggattcggaggtccggtccgttgcctcaaaccagtcagagatggagttctcttcacttcaggacatggtgaggcctcttctcgaccactctgggtctcagtggtggtgaggcttggcaaggcctctggcccactcctgggagaaggatgcttaccagtgacttcctttcttgatggacccaacacacagtgtggtccttggctcatggaagggcacgttcataggctccaggagaacatttcagtgtctgttggggtgaatgggagaggggtatttgatcctctcctgagagaggagcacaggagcttttgccaaagtgggccagagaggaaggctggcttgggcgtgatgaacatcaggcaaggtgcttgatgttttgttttttagagacggggtttcgctgtgttgcccaggctggagcacagtggttattcacaggcatgaatatagtgcactgcagcctcgaactcctgggttcaagtgattctcctgccttagcctccccagcagctgggacttcaggcatgcatcactgcatgtggcccaagccactggattctggacaggctgaatcctgggcgatagagccactgagggaactatttgcaaatcctgctcatctttgttttctttgcagcccaaggagctggatccctctgctgtgctccccttagactgtctgcttgcttttgtgttctttgatgccaactggtgtggctacttgcaccggcgagacttagagaggatcctccttacccttgggatccggctcagtgcagagcaggta

SEQ ID NO: 129080 - DNA, 1049 bp, Homo sapiens
catcctgaattctttttcacggttctctctaggaaacctggacctgctgccccctcctgggaaaagcacgaagccaggtgctgcccccacagaacacaaagccttggtgtcccacaatggcagcctgattaacgtggggagcctgctgcagcgcgcggagcagcaggacagcggccggctctacctagagaacaagatccacacactggagctgaagctgggtgagggcctggggctgcagccaccatggggtcacatgcagaccagtagggaacctgctgcttaggctcaggccctgccctgtgctctgggccttgatggagcagccgtccccgtttccttctccaccttgcagaggagagccataaccgtttctcagccactgaagtaaccaataagacgctggcggcagagatgcaggagctgcgagtccggctggcggaggccgaggagaccgcccggacggcggagcgacagaagagccagctccagcggctgctgcaggagctccgcaggcgtctgacccccctgcagctggagatccagcgggtggtggaaaaggtaaggtgggggtggaccaggaggcagcacagctcctttccctgagctccaaaagtccccagaagggcgcttgcccgtgtcgggagtgaccagagggccagcaggcaccggcttcgtctttccatcgcttgccaggcagtgtgcccctggttgcaggttctctgggaattgagcagtcagcagcgtgcagtgggagcttcccagcaggaggcagtccgcagtccgcagtcctcagatcaccttgccaggcccgattctgggtacatcatctgtttcaaacaggctgacagctgggtggagaaggaggagccggcacctagcaactgacggcctcgcacggaactgccatcctgtgagggcagcggtggcgcccggcaaagttggagcccttgcggtaccagaaagcagcgagagcgagacctgggagccagggcaggggtggctgaccccatgctcagcctctaggggacggcaggccatcaggctgg

SEQ ID NO: 129081 - DNA, 1020 bp, Homo sapiens
gggtgggatgcaagttgggagggaacagaaggctagacgggcatcccctttcttgcctgtgcctctaaagctggcttagggctttgggagccatcagcctaccatgctgtctttctgccatggacaaaagccttgggttctcccctagcttacaaaaagcagtaaaactccagtcatggtgcccatcattccacagtcgccctaggaggcccatgccttcctgcacctgctgctgggggaaccaggagcccgaagcaggggcgcctccacctccagccactgaggccctgttgctccccggctccttttggttcagtctcagctagagcccttccgtgccctgcatatccccaaaggcacgctgctgcacagctccagatgggtaagggcagggggtagcagagaagtgtgagcctctggccccctgaagcacacggttccctggagccagcacgtgccaacccctgtcgcctcccccaggttgtgtactactcggaaatgcacaagatctttggagacctgtcccatcagcttgaccagccaggccactccgatgagcagcgggagcgggagaacgaggccaaactcagtgagctccgggccctctccattgtggccgatgactgaatccccgtcactcttggaggactcctgtgacgtggtcagcctcattcatccttgcccttctcagggctagctgctcctctcacaggctggggacagaggtggccctggttcacttgccggccctttgcaatgaatgactcttcctgagcctggcaccaggagccctaggcaggccgccgtctccccactcacagccccagcaggtaagcagtgtagacaaacccttggggcttttttatttggagaaccgtccagcatgcatcctggcccacggcctgagcaagctgcagcccttctgaggccatgggcttcgttggctaagttgggggtcttagccttgcatgcgttgtgggcatcaaatctacctccaaaagacccatcctggggagccct

SEQ ID NO: 129082 - DNA, 1054 bp, Homo sapiens
tccttgaggttctttctccaaggccttgactttcccaccccggagcagcaagcacttgaccaaaggttgatcaatagcttcagcactccctgcgcagctctggacagctgacttagctctacctcagttccgtcacccgagaagcacaggtaacgccaatccgagtggcacaggctgttgctgaagatgaagttggatgagcaacgtaaagcactgagaacagggcctggcacgggtcagctctcggggtgtccgctcctgtcatcaccgtcgtcatggtcggcagcaagcctccctgactgggtggactcctgcagctccttccctgggtccagtggggaagccgtgtctatataccacactgggacgaggacctgaaagagacttgggtatggccaggactgcccacttcctctcactcagcagatgctgaccgagaacccacgtgcaccaggcactctcagcactagagactcaacagcaagacaagatgggagcttacgttctaggaggaagacctgcaagaggtccacaagcggatcggtatataatgacacgtcgtggcgtgcaaggtcaataaaaataaggaggtggagagtgacagggtcaagggaggccttcgtggggacgtgatccctgggcagagtcctgaaggaatgaataacccacacaggtagagccaagggaagagggcctgaaacacagtggacagcaagcgcggaggccctaaggtggtgcacgctgaccagagatgcaggagaggcagcaggagggtggagaagccatcttcagtcccctcggccactccagctgctgaataatgccatgttatggctgtgaagaaatttcacctccctgagcttttctgaccttgagattggcagggcacatgacacacccattttataaatgggcatgtccatttgataaaggaggaagagttcagctcctcttctccaagtccagggccttgtctccacagcgaagcctccccatgccccactcattcctttgcccacccccgtgcccgccaccaaactagaaggtgaccgaa

SEQ ID NO: 129083 - DNA, 1044 bp, Homo sapiens
gcaacaagtgcagccccgggttcaggactcacccatttggtttcagtgttgctggctctcaagagagttgatacccggtcgggaatggagagagcctgacctgagtcagtagtcacagtgtctgtgtttgatgcatcccaatcacaaagcacaggtgcacgattgttcctgacccaccctgagcccagcaggggcaggtggccctgagtggagggccgcgtaggaggggaggtgccctgcatggacctggaaactaggaaaaggcagagacagacccccaattccagacccgccctctcctctgcactctgctgccttcctggatggggtccagtcacgttctgagcaccctgactgcctccagcctggggtgaggagggcatgcagcgagtgccttgctcccagctgggaagagcagagccacagtccgctggcacctgcctggctggaccctctgggaggggagccttcctccgtaattcaaacacttaattaacttgggatctcagaaataccgtgtcaggagcgatctgtcggtgcttgtgtgaactggaccatgttgttttctgcggactggggcagggtgtggagagagtttcaggaggctgggaggttttttccaccgtgttgtcatttctccgataattgagttatctctctcgtttcaggtggagagagactttgaaagggagtatggaaaacttcagcagtgagtgtcaaccccagaaagatgaggtgggaggcagggagggacaagggccccctgccaggtctcacctgtctgccccgtgccctgccccgtgagcaccctggaagctgagggcagctcaggtcaccaggctgctggaactgttccctggcaatggccatgtgagagtcattcactcatagcctttgggtgtagtggcacttcagtcagcgggaaaagtccccgtggagaagatccctttctcctcctccttggcaggccctccagagcacctgggcttcgctcaggtagggggaaggaaggggaccccaagcagcccgtcccctgccttgcag

SEQ ID NO: 129084 - DNA, 1076 bp, Homo sapiens
agtccggcaaaacgggtcagacgcggagtcccaggctaagaggatcatccgccactctccccgggagtcctgctgagagactgcgactccggaaagcaccgagggaacgaccctagggcaggggctgtcgggccttgctctggggcggaggggtcgcgcgggaccggagggagccgggacgcggcactgacacagggccaggggcctcgcgggtccgcgggtccagcagctcccgccgcctgggcctcactcaccagctcatggtcccgaacctgcgtctgccgccggggtcctcagccacaactcgtttctctagggtcacttccggattcaaccagtctccaggaagtgacgtaagcccgcctctctgcccggaagaggcggttgggaggcggagcccggcgcgttaacccttctgctgctgcgtgctcgccgcggagtttcccttgccggcgactctctggctctggccaagcgcttagacacacaggctgcaacgggggatgaggggaacctctgggggcgttttctgccttcaacactgactcctaaagatctcttcacctgaccatgcagggcccttagccgggctgtcccctctgtcaagtggtttctaatccagagacagtggcagcaattgtctgtgggagaagaagccatttgggatggagaaagtggaaaacttacattctctgaatgctctttcctatcttttacagtttgtacaccacacatgcattacctgttacaaacaaacggacgtttcccttccaagatggcacagggctctgaatatcaatagataggtgcttttcaggttggaatgtttcctagagttattcaacacaataagacgcagagtatgagttgttccctgcctttcagcccttccctttggtctcctctacaggactcaaatgatgtaaattgccccattcgttctattccttcatttaactaatactagttgcactaatattagtgtcaggtaccgagccaaccttaggatacagctatctcagagaagtatctgccctgctcttgttccttcccagagctactttcctggagggaga

SEQ ID NO: 129085 - DNA, 1058 bp, Homo sapiens
ggagacgtttctaggtggagctggaagcccggtctgaactcagtcactattcttattagatcaggtgagaagatcacacaggattcagatggctccgaggtgacaagctcaggaataatcccagcttcactgttagaaactgcattttctgggtcttaagacatggaaatctccatccaatgaggatgtagatcattgaacagatgtacaccctctgtactgcactgcatcaggagtcaggagacctggcttctagtcctggctttaacatgaggacaaagctctataacatctgcaaagtcacagcccttctctgggtcttgaagtccctgttagaaaatcaagtggtcccactagagaatccatacgatatcttcagccctaaagtgcagaagtcccaagactgtcactctgtgcaagacccacccccatctcacagctggggactgagccagggctcagcaatgctggcatgagactcaaatgcaaagatcctgcttcccgttgcctcaaagcaccagctctctcgctccatcctcccaagagcctccaaggcgccattggcttcctgggactctgagtctgccggcctcttttcctgactccagtttcttctggcctgagccaatggggcatgttctgtgactgcatttgcatctcggattgtgtttttaaacccattttctcccatatttgcctgaaaaatatatagaaactgatatacaatccaatcctctggtttggggtcccattcaacccaatgccagaaatgcttcgcagtggtttgcggtactcggatcacttcttctccatggactggaaagccctggggggtggcaggctcctgaatgtagctcctgccctagtgagggagcagcaggggccccagaaggctcagaatctctgtctttggggccctcctgagaattcctactgctgggagtcccccgttttgggatttcagccttaaatctaccatctgaaccactgccctacctgctgggttttcctcccagatcaccaccacaggtccctccatcatctcaggaaaggaccca

SEQ ID NO: 129086 - DNA, 1034 bp, Homo sapiens
gagacgagatttcccaaggcccaggccatctgaggcttgaaaagtacaggctgtccaggccctttgttctaggtcgtgcgattgccaaaaatgtcacaccgtcttgcagctgtgtgtgtgtgatagtatctagcacaaagctgcccctgaggaatggtagctggtgagatgggtagatgaatgaatgaatgagaggccctgtgttggagatagaaatttaattaagacacaggtcatggtataaggagcctctgatctgctagaacagatagatcacaaagaaataataattacaggcttaaataattgaggcctagaggccatgctggggggagcagagatgaaggaagagataactgcttgggggtagtgatcagagaaagttattgaaaggaggctagatatggggccttgaaggatatataggagtttttcagttctccagtagacaagataaaggagatttctcttaggttgagaaagctgcctaagcaatgtataaatgtgtgcatgagacatgggaagatttcaaatgacttgggtgtccgttgaagccagaaccagcatgtgagtcttcaagaatctcaagagaaggctagaaatgcaggatggggataagactggaatggtaggcagtgcctctgatttctgagactcaaagctctcagcaacctaaaccctgggtccacagatcccaggcaaggcttcttctcttctccaaatgatcagtaactgtgtcccaggagggccaccagagttggttggctgagctgccttccctgtcaagagaggaggagggtgggccccagctgggggacactgcccacgtggcaggtcagagcaggatgctgctgaattttgtcatcgatggcctcactcagagcaggtaactcttggacccccaaacccaaacacctcccttttacaaacagtaatttttgtttcaggtaataaaagggctacatgttccttgtagaaaaattgtaaaacacagaaaagcactagaaagaaaaagcattccctggatcctacca

SEQ ID NO: 129087 - DNA, 1038 bp, Homo sapiens
gcagttactttatttctgaggggaggtgggggtggtcagccactaccctttgataggccagaagaccagatgaatagagatctaagctgggtaatgttgctgcaccattgccctaaagggctgcctcttcacgcaggcaaccaacctccccaccccagacacacacagaaagaactggattccacgggcttctgggggtgcaaggggaaggggctgccatatctagtgggctcctggagaagctcgggctgaggagcagagaagggagcagcctcagagcttctcatcttgtctccggtcctgcagtcttctttcctcacccgcaaatggtagagagaggagttttgagccgtacaaataaagcaaattcatatctgctcattgccatcctgtcctcatgctcaaccctctctcaaattttaatttggtagcttttagaaaggcaaatttatttgtgacaccatccaaattctattttattggaatcctcttctccaagggtgcgatcgactaccgagaaagctgtgggcttctccttttgatattttcccaagctctctgtgcgttcgcgcgtgcttgtgtgtgcgcgcacacgcatgcacattcattttagggtcctctacatattttacgtacaaacacataatgcatattcacaaggcagccgcggaagtgtagatatattcatcacatatatgtgtaactcagtgcagactcctagaagccaatatttaagttatcatatttaatttattcaacaaacatttaataagcacttactcttcattaaacactgtcctaggccctgagtgtacagcaataaacaagtcagacaaagcctgtgcactagggggctaacatttaaaagcactggattcttttttttttttagacagggtctcaatctgtctcccaggctggactgcagtggtgtgatcatggctcactgcagccttgaactcctagactcaagtgatcctcctgcctcagcctctagagtagctgggactacaggcacacaccaccacgcctggctaa

SEQ ID NO: 129088 - DNA, 1062 bp, Homo sapiens
ggctcacatctgcagtcccagcactttttgggaggccgaggtgggaggattgcttgaggccagtggttcaagagcaacctgggcaacatagtggggccctatatctataaaaaataaaagtaaatagctaggcctggtggtatgcacctgtagtcctagctacttaggaggctgaggcaggaggatgacttgggcccaggagttggaggctgcagtgagctatgactgcaccactgcactccaccctgggcaacagaatgagaccctgtctcctgaaaacaacaaaaatgcaaggcagtttttaccccgtgttggaagtcctcccacagtctgtgtgccagactccttgcccaggcctggataaagaccggacattggcggttctcaaccccagatgcacattttttctttctttctttcttttttattatgatgaggtcacttaacacgagatccaccctctttacagtttttaagtgtacagtatggtactactaagtataggcaccgtgttgtacagcagatctccaggacttaatcatcttacattactgaaactttacacccgttgaacagcaacgccccatttcctcctcccttcgcccagatgcatattcacatcccctgagaagccttaaaaataaggatgcctatgctccacccccagagattctgacttagctggtctgggtgcagcttccttggtgattctaacaaacggttagaacctccatccttcctggtctcccttgctgcctcatgacctcatctcttccatgctgccccgtgaccaccctgctgcagccacaccagtccccatctgattctggaacacgccagctccttcctgctgttccctcggcccggctgccctgtcctcgcagggttgcctggtgaattcccactctgctcacaggtttccttctctggggaactttctccccgctctccttctcatctccacggttctcaggactcaactccatcctaacactccccactctgtaatggagtcattgatttttctcctctgctcccctcaccagagagggagctccttaa

SEQ ID NO: 129089 - DNA, 1001 bp, Homo sapiens
ttatctggtgaaaggagtagaaatagagtgttcggactgaagaactgcttgtgcaaagtcccagaagcttcctgtatccttgtggggacctgatggtgtcccttaaggcctggacagggaggctgagagactctaggctttccagattcagctccttcaccctgctggggctctgcatcttgaaatgcctctgcttttgctcatggctggttctgaactttgccccagctgcagggtaggaacaccacgtgccccagcctgcacatggcaggggatggggggcggagctcatgtcacaaggcccatggggtgggctccgcagaggctgtagtgttccaggagaggggtgccatgaaagcgcggttagtagcctgcaaagtgttgaagggtaaagctgcctgtgaagcaaagggaaggtgcaggttggaggatggactgagccaggcggtctgcgttgggctggcactgggaaggggccttcacagccacagggagagcaacgctggtgggactggccggggagcctgctgcgctttgctaagagccaggatggaggtttctctttccccagaaaagcctcctgttcacaggcaggcatctgcccggcttcaggaaaacagcagccgcgtgatggcctggaggagggtggtgtggggaggcatagagggggtgccttctggggacaggttccaggggtttatgtcactggggaggtgggtcacaagagggatttggtgagggaagagatgctggggttgggcaggggcaggagattgtagaatggaacctgcctccatgctgccaggaagcccttgggctacagccacgcagccaggcacatggcaggacattgccagacccaccagcagaagcagatttgggaagccagcaatggggggagtcagtgctcaggctgaactgctcctcggaatcacaccagtgtttccaagctgcagcaaatgggcagagagggctggtgtgtgtgtgtgtgtgtgtgtgtg

SEQ ID NO: 129090 - DNA, 1070 bp, Homo sapiens
tacatcatctcaaactgtcactttctcatatcctatcaacttgcagcctcacaaaaatcccaatgtttcatgatcccatttttcagatcgaaacagcacggagggtcacctatccaagctgtgcagttagttggtggcagagtgagtgggaatccaggtctcctgagtgtagcacttggactctgtcactctctccctcagggaagtagagctaaggttgtggtcagacactgcaaggctgtgtgtcaggaatggcaggtgcacacaactcaggttgcccactccccagtcctgatccagggcagacattgctaatcaatcacagcactctctcctctaagcccgaataggatctcagaatccttctcaacacagtgctccaggaagatgttactggttgattggaagtggtgggagagaagaagaaatctatttgcataggtcaatcattagacatgttataaagacgaacttctgaatttagacttttccccagtttaaagagcaattaatagagtagttctgcacagaagctgaggagatccgaggcttaggatgctgggatttatttggcccctttgctctatgggccttcgaaatactgttaggatttactctcacacttcagagaagtttccagcagagaaaaatgaggagcagaattgggatcgtcaggtacagaaacgggatgagaacacaggtgctgtgttcctcaggtctctcgggcttggaggctgaggcaggattagagctcagggaggtcttctcgggatcgtcagagacagaccatcaggataggaagggccttggaagtattagtatctcatctaaactctcctgtgatggttcattttacgtgtcaacttggctaagccacagtacccagatatttggtcaaacactattctagatgcttacgtgaggctgtttttagatgagattaacattttaatcagtagactttgagtaaggcagattaccctccataatatgggcaattcttatccaatcggttgaggatcttaaggggtaaaaaaaaaaaaaacccaaaaaacctgaggcctcccaag

SEQ ID NO: 129091 - DNA, 1011 bp, Homo sapiens
tgtcttaggaatgagctgactgggaagaaaaatatctggttgaagactcccttgaaatgtggcaccgtttttccactctccttggagatttagagagtgccctggcttgtcataaacaatattagcagaaacactgcgttgcctggggaggccaagctcccagagggcgtaagcagctattttaaaggcctgtctcttctggatgccggaatgaggagccacagggcaggggatcccaggcagcttctgctcagggctcaggacctcccattggagcaacctgggacccacccagcccatgggagacagtcaggctcagtaaggatgcaggaattctcctcttctctccctaaacccctttcttaggccccaagaaggaccactggggaaggagagctggagtcagggttaacaacacaagagcagggtctccaagcatcttcccgttatgtaagctgcttaatggaagtgtttacaaccaggatactgaggtcttgggattattcattccatgtcacagggaggacaactgaggcagggaagggtggctgctttgcctcagaccattacacagccagctggtgggaatgcgtcgggattagacccagagcctcctattttgttgctgctctgtgatgggggcgggagggtgggaactaggaccagagctcagctgttctcagctgagtcactctctttggagagggggcagtgggaggaagtgcagctgatgtgacaaggcttggagattccctagcgtgtcaatgggagaatgcattaggcacagatgccagcggggaaacgtgttcagaccagagcgggtttcaagggagcaagctaaggcgtttagcgggggttgagccttgggctgggggtcaccacctccccgaaggactgagttggttccttctgcacaaggcacatcaggaacccccaggatcagtcttgagcccagggtgaaccccagtgtgcagagcaggagtggaccatgaaaagcagagcccagcccct

SEQ ID NO: 129092 - DNA, 1032 bp, Homo sapiens
cccgcgtagctctttccagcggggtctgctgagctcctccagccaggccttcttcctcctcctgtggtggccaggtgctgggggtcacaccttccctgcagcgagcctgcactgctgcccaacgcaggggaaaggatctgtgaactgaaggtcagcccgggccgcctgccctgtgaagtgcagtcttgatgctaggcagtaactttccttctgggcatgacagttacacactggaattccagcccagcctcccgaggtgggaagagacagaagagggccggcttgtgggctgggtttagacctcaggccctttcttggctcacccctgtccacgtgtcttggtggcacgggtcctgcggcctgaatgagggctgtaaaggatccaggatccaggctggaaggcataatcctgcccctggcagcattccttctgctgtggtggaaaggaaacggagccaagtgccatcactccaggcccacatactttccaccgccttgcaggacctgagagtagggcctggctgtggaccctgaagcccatggcgaggagacgtgaatccctgggcacccaaagaatggttctgttcaaactcgtggttcatttgcatctcagttggacagggctggggcagtcggggtgctgggttcctcctgccttccagcccggcttggaccagccccacctcccagtccctggcccgcccacagtgtgtgtgtcttccactgcacctcggggtggccctagggagggaactggagtcagctggtattctcatctgtaaggtggggatggcagtagctatcaaccacctcattacagcgtgcgagggttaagtaggagaatgcaaggaagacacttgacatagggctgggtacctggtgcatgctttgcggtagctgttgctattatatactgcaattcatggtgtttgtggatccatgtgaagctggggacagtgagggggctggaggcataagtggaatcagtcctgaatggccgagagcatcttgctcaatattagggtattacat

SEQ ID NO: 129093 - DNA, 1025 bp, Homo sapiens
cattccgcgattctatttactaagagtctatatgtagccagggcttgccagctaccaaaagggacacacaaagcaagtagttctaaggtgacctattttcccaactgaaaatctgaaatgcaaaagggtgtgtatgtggataacagatgggaacctggtttctggcccaggtgttgcagatacaatgctttgaaaagtataaataccattataactctgtgagatgaaataaaccaatacataacattctatttatttgttagattgcacacatgaataaggaggcttataatttgttttagatgaaataaataaatgaacaggatgtactcaaactttgaagaatgtgattgggtgcttaatggcatggcagtttggagaagagagaggtgaatgaggaaacctgtgggacagttgctatctggaggaagtgggggcttgagctgggctggaggaagcctctccctgccctagatgggcaggtccgctctgcagggaggtctggtgatgtgactagggcagagtgggcagcggtcagcctggttctgcaatgagcctaagtggcttatttgagtcacctcagccatgctgggtgtcagtgccaaggaatcccccgaccccatccccaggagtccgttgctaaggatctgtttattcattcactcaatacattttgattcagcaccagaccctacactagacatgaggataaagggagtgatggaacggaccgtcttgcccatcctgagcttaccatccagcagtggagaaacagtctcatgcctcatgactgtgttaccatggtgatgatggctgtgaagagaactaccagattcaccatgaggttgtgtggtgggtggtcaggcctgaccaggacaggaggaactgctgggtcacaggggctggttgttggagcaggtgtcccgccgacttcctgctgacagcagggcttgcccgttctccaaaaaagcagcctctgttacctacccaagtggctgcctgcttggaaaatgaaacacagagca

SEQ ID NO: 129094 - DNA, 1042 bp, Homo sapiens
agagacttagggaactttcattgatgatcagtcccctgcaacttcttccctttggtagccgctgaaagtaggtcatgaaagggcctagacctcaggatgtctggggagaacctccttgagttgccagaagattcttgcatccagggctttgtggctaaggctcatgcttactggcagtgctggcctgatgggtagagaaccgcctggaccacctacgtgggatatttatgggatgctgagacgtttctccaaaataccttctggaatggcctgtatcagtagctgaagtcataggatcattcctcccagctaaagaaatgcctgctattaaatttttgtggataagaggaagagacatagcttgtggacgtgcagttgggtgaagtcatgaacatactgactaatgatacccagggtgaactgctgactaatttgtgtaaacagagtggatggtctctgatggtgagccctagggctctgttccggcctccccatcatgtatcaggaatgttcatggaaattaaaaggtatactgataaaatctatgggagatacaaaactaggagagattgctggagtataaaattatggaatgaactttcagaaaaactgctgtaggttgaaataatgggcccaagctgtaacatattagggatgaatagaaggtcctatatcaaagttcatggggaaaaaaacagtcacagagtgcagactttagggagagtaactgaaaaactattgatctttttttttaaaaggcctgttgggttggctcacatctgtaatcccagcactttgggtggcagaggtgggcagattgcttgagcccaggagtttgagaccagcctgggcaatatggcaagaccgtgtctctaccaaattaaaaaaattaacgtggcatggtggcatgtgcctgtggtcccagctacctgggaggctgaggtggaaggattgattgaccgtaggaagtggaggctgcagtgagccatgatggtgccactgcattccagcctgggtgacaacagggcgagaccctgtctca

SEQ ID NO: 129095 - DNA, 1151 bp, Homo sapiens
gaactaggcacaggcttcgtagtatctctaatctgcacacagctgtgcagctgaagtgtcattgttagccccactttactgataagaaaaagggcccttgaccaaggttatacagctaagtggctgaacgagaactcaaacccagcttggtacccaaagccccgctctttccactatcccatgcaacttctgggcttaaatctaacttctatcctaatcatgttaaatctactacattcccagatcacatcaggtgcttactgtggtccaggaatccccatggtttagagttatgtgcaatatcttaatataataaaaatggatggccacacacagctgccaaaattagagaaaaattctctttccatgtgagacactggtgccccgcaaagactcagacctgcattgacgcagcacttggtttctctcctctctgcctccttcagggcccatctggttagacaatctccactgtactggcaacgaggcgacccttgcagcatgcacctccaatggctggggcgtcactgactgcaagcacacggaggatgtcggtgtggtgtgcagcgacaaaaggattcctgggttcaaatttgacaattcgttgatcaaccagatagaggcaagtcatgtgctcttgatgtttccttcatgcaaacatttttcctcttccatgcaactcgctttttgcgtattgatttcaagaagtgtgtgtgagcaggaaggagggtacctcacccaatgggattagatacaagggcagtttagggaaggatttctggagaagggaatcccatccatggggaaagggcattccaggcacaaggaacagcatgggcagaggcacagaggtgtgaaggttgggctggggtaagcagagcgtgatctcagggagagtgcatctgggagtagggttaactgaagctggaaagatgggcatgaaacacctccggtgccatgctcaggagcttgccctttgggtgggaaaatgtattagttatcaattgctgcgtaacaaattgcccccaggttttgcagctgaaaagagtgaatctttattatcttgcacagtttgtgagagtcaggaattgaggaagggcttagctacttgattctcctcagcgtctctcatggagttgcactcaggctgt

SEQ ID NO: 129096 - DNA, 1020 bp, Homo sapiens
cacgtagcccagctcccggcagacgacgtgggcagcgtggatggagaagtcgtcatcgcacacggtgccccactggccatcatagtacacctccacccggccctcgctgtgcttcctcttctgcccagccaggcgcagctgaatcttggccacgttggcgggggcctggggctggtgatactcaggagccggttgctggaagtactcggggtaatggggccagctgtcatactgtgccaggctcaggggggacaggagggccagcatagccaggcagctgcagaggtgggagcacagaggcctctccatccctgtcttcgggctgatgatcccacgaaggggccctgcgcagctgggagggacaggcggggtacagaagcagcaggagctttctggaagagaggagagatgcgttaggatgggaacgtggggctacggagacctacatagagaaccagcgatttcataccccttggcttaatatggaaagctcgtccattctcgacgccaatccagccccactcctacatttccaccatgcagggctgggaggtcccacctcctttacctactgccttgtcatctctctagaatgctttttccagtagagttcctggcagggaacagaacacactccaacttaatttaaggagagttttttaagactacggacatgccggcagagttctgcagaactaacaaaggccggtgtcacaccctagggctggcgactcagagggggctgtgaccaccctaggcttgaagggagcctgcgggggtgagaactggagactggcagagggagctgtctcttaggagctgtggccctcactggagggtctcagagccaacccatggcaacggcggggacatgggagggagaataaatacctgactccctttcctcccgtctttgaatcattctggtgcctcctattaggcaaacccagcccccttcaactcgaagccactggcaagggagctgagcccattgagggagcccgtgtgggacagcctcct

SEQ ID NO: 129097 - DNA, 1090 bp, Homo sapiens
gctaggcagtcagctccatgggaaagaagacctctactcccagcagggcctgaggtatagtaggagctcaatgaattcttgttgaatgaataaatcaatttagtactgtgagctggatggagatgcatgataatagatttcctcatccaacattcccaaatatttggggattttctacttgttcttttattaatggtttatagctgaattctgttgtagtcaaacaacatattctgcataatatcattgtatcttaatatcttaatatgtttgtatcattatatgttccatgtgtccctggagcatagctgccttctgcagttgctgagtacagtttatagaaacttgtgaattaggttaagtttgttaattatgtcattcacatcttcaaccccaggatttttctgtgtcttctatccgttactgacagaggtgtgtaaaaatctcccactctgattatgaatttgtctattttttccttttagttctatcaatatttcttttatatatattgaagctatgcacgtacgtttagaagagttacattatcctggtggattgactttcattatcgtaaactgtccctttttgtctctggtaatgtttcttgtgttaaggtcagcttgatcgtacaagtttccctctggttaatgtacgcatggtatatctgtttccatccttttacattaagcctctgtgtctcttctaagaaatataaagctggattgggctgggcgtggtggctcacacctgtaatcccagcactttgggaggctgaggcggatggatcacttgaggtcaggggtttgagaccagcctggccaacatggtgaaaccccatctctactcaaaatacaaaaattggccaggcgtggtggtacatgcctggaatcccagctactcgaggggctaaggcaggagaatcgcttgaacccaggaggcagtggttgcagtgagctgagatcgcgccactgcacactccagcctgggcaacagagcaagactccatctcaaaaaaaaaaaagaaaaagaaatgtaaagctgaattgttttgttatattcgttctgatgatctttgtcttttaattgg

SEQ ID NO: 129098 - DNA, 1009 bp, Homo sapiens
gtgcaagtcatgtaccttctttaagctggtttcttcatctgtaaacgtgaacaaaagtacctacaacatggggttattagaaggtttaaatgagataatgcatccagtatatctaatgcactgccaggcagctagtatgttctcaataaatgttactgacatctttattaagttccttggaaaaatgctttgtaaattcaagtattacaatttgtttttcctacctcccattccagacatgcctctagagactgttacactctttgtaaaaaatcatgtttttccctctcaatataaagtaaaaaatacatagaaataacgtttggaataaatactgaaaaatcaagattaaaaatttcccatggattcatcacctaaaaaagccattgttagccttttagtgaatttctttttttttctactcatagttttaaaaaatatggttgttataatcttagtttatatgatttttgtcctttatttaacagtgcatgagcatgttcctccataagctattgattactgtaactaaccttcccttgctattatatatttagatgacatctagttttttctgtcacagaatgacaaaggacatctttgcatatagaaacatttccatgtttaggtgtatttccacagcataggattccagaaataaattatgtcagagggtatgaactattttgctgactttctctttcaaaaagtcataacagtatcacaaatttgcagcccatctgaaatttcctaaatcagaattgtcatattgaattatgagtgatgcttagaagggtccttgggaagtgcagaagcagacatttttgtcccttttagatgagactatttttagacttttctttttagtaggaggctaaagtagcttaagctattaaggtttgttatgcttatgtctgcaggaagaagtagctaaaaacttgttagctgaatttaacttgggatgtgatgttcaccaaactgagcatgtgtatcgagtctatgtggccac

SEQ ID NO: 129099 - DNA, 1732 bp, Homo sapiens
cagtgagagcaggtttgtagtgaaagttgagttcagattttgccatgatgcattgggggtggctgtgaggacaagcaagggcagtgtctggtggacagttaccccacgctcacctggaggctaatgagtgctgcatggctggtggcacagttcggagttcatggcatgctgatggtgatagcagcctcaggagggactgagctcacctgaggagagggggagcacgtttctcgagggcaggcaagagcccatgcgcatggcagtgacacacagcagatgctcagtcaggtctgtgtgctttgatgaagaagaaaaggacatagcactgaatagtgccaccaacatttaagtaaggtctgcagaagaagttgctagaaggataggaaaaactaaggaagtgtaatgtgtagcatgatttccctaaaattagccactctgaagaaacatcacatgttatagctaaaatatctgcttcttaactaaagtatcctgtttctctaggcatttcagaatttgctacctctccagagaaagtcagtgattacatttctccacttttgaactttgctgcagagcatgtgccacgggcaaaacacaaagagacacctctctacattctctgcacggctggaatgagaatcctccccgaaaggtgatcctccacagaagggcaagggtgagggtgggttcctggaggggagagggggtgttcttctcccccttcctccttctcctctccatcatcatcatcatcattgaaaggaaaatattcaaaattctttcttcaagtctgtaacagtaccagaactattcctttagccagaatccaccaaatagcctttaattgacttaggactataggcaacggtaaaggtgtcatttttaaaaacctaatctattttacgtagttaaggaatgcttgcagttgtagttttacatctagaaatcacataattcacacaacttgttcattttgaaaattcattcctaatataatctttccaacgaatttcttttttaaaaaaattaactgtttcatacaagatataccagatccctggttttgttttttgtttgtttatttttttccttttctaaacagaagataccaagctgtaatcttttgatttgtaaatgtttttattactttacagccagcagaaagctattctggaagaccttctgaccgatatccccgtgcactttgactttctgttttctgactctcatgcagaagtaatttctgggaaacaagaaggttggtatattggtcttcagtttaaaatttgggaagctgttcctttaaatcctccccattttcaccaatgtaccctttgttatactcctattgtcttaacatttgggaaataatagccttgaaatattacaatttttaaattactaaatcagtttcttatatgactagtctttgttgccctaacattaagccactgaaagataaccgtttgtcttcaccacatgtagtgacatagcttgatataaactcactttgatagaaaaggcttgtgtgccttgcctaagttgtgtggcttcctgggacgttgatcattattgagctgttggagcttcttctcgactttgatacactgagaaatatcaaatctttgttctattttcaaagaaatgattctccttgagaatgaaatgtcaagtcaatgaaattatttggggtatagcttgctagaaatgtataccaaaaagtatttcaaaa

SEQ ID NO: 129100 - DNA, 1072 bp, Homo sapiens
agctagttaactgctaactaccaaatccatatcataagaggtcctggaataattatttatacataagcgtctcgtgtaatatgttttaagctgatttttgagttggtagtttagaaatagaattttgcattttggaatttgtttgaacttctgtaatggagtgtgtgtctgatttagatgatctttatcatcatcacttgttttgttttcttttgactcttcaattattcaacagttgtattgatgttatagtggtgctgctacatagcttagaaattactgacttggtatttgctgcattttctctgttagacttcaggtgatattctttgtctaaatcaaagcatacgtgtgtttctatacaaggtacctggcacgagttaccgacattgaagctacagacaccaataaccccaatgtgaactatgggatcgtggtggactgtggtagcagtgggtctcgagtatttgtttactgctggccaaggcataatggcaatccacatgatctgttggatatcaggcaaatgagggataaaaaccgaaagccagtggtcatgaagataaaaccgggtatgtaaatgagaacatctgcctggtaaccagggtgtgtaccttcattctctgtggcgtctttcatatcgttccctttctacaccatggccctgagtcaaacctcacaccaggacctgatgggtctccttgtttcactttcttttcccttttctgtccattttgcaaagggtgactaacaccttgataaaacatccaaacagacatgtctttttgtctcccatagcattttaaatagtgccttactcatggtatctacgcagatgttgctggttggcattaattatggagagttttttcctatttagtaaccattggtctctatccttaatgacaaggtaatttcagataactcatgaaaatctgtaatatattggcatatatttgtcacttttaaaaattgctggccacatgtagttctagtcatctagattatttggtgagtgtgaccacagaacttagagctaatcataattatgtatagtttttaaagatactgt

SEQ ID NO: 129101 - DNA, 1048 bp, Homo sapiens
gcctggaggctggaggaggagtgataatggtggagtcggagaactgactagggacaaagtgccttgcacagtactttgtacataaaagggcagtctaatagacatttatcaagtgaatggatatttcaggttcacattcagcttattctgcctttctcctacctccaccccaaatctcccttgtaccataaggtatttaaggcctatttgatatcctgatattttggggtcacagacactttaggttagacagcactaactagtaccagacgattatcatctcttttgatttaggtctatattggacagtatgaaattaacttagaagtgtgttgctcagaataaacccttccaacagcttcagtgcaaggatcatgtatagattatatgtggttggatttaagcacacacttaaagaacgtagatgttttctttgatgatgctatctttgtgatttgtctcacttcctggaacaggagggctctaactccgtgaggaccccagcattatttctataattgtttgtgagaaggactgaatcccagagcattgccttgttgctgacctttcagtatggggaggtaagtgatgggcctaatcaccatgaaacatgaaatcttggtgatgcaaaaacaggtcttgagagaaaaaaaatctaaatcgcaagtgaaaaatgtgaagttgtgctgtgcttctgtttaagaccttttttcttccagggcccagtgaggtattttaatgcatgaagcactcttcaaggtgaagagtaaagaaattaactgtaaaataatagaatttatcccaaaggcagtgaaatttttttaaatcctaatcatatttctagaatgagcctctcattcttgacataaactgaggggaaaagttcttgattatttgcagaaatgtcttgtgggaatatttctaaaagtacaggacatagaaaactcatttattgactttgttatggggatgttgttaaaatgctgttttctcccattactcaagtcatctgggagaaatttgccttggacttcagtgttgagaaaat

SEQ ID NO: 129102 - DNA, 1058 bp, Homo sapiens
aatggttgagagcatctttaatttttccaggttctcttgaatcctttgatattcaaatcattcttttctgaagtacccttccctgtggtacctttgcttattcagaagctgagctctcccagaggctgacttctctgtgattttgtttgcctgtgatttgagttcactaacatctgtttccttgcatcttgtgtttttccaccagaggaaccatttccctttgtggttgatttgcattgttttcgtcgttatctgtagaactgtcagtgagagactgacaaagacattgacacctgactgtaggctttattccaataatgttcagccaagtagggccccactagctgaaatcatgagaattaatgcatctctctggtgataggtctaacacaatttaggcttttttaaaacatgtcagttttatgtggtattactgaatttgcctcccagtgccctggtgcgaagattcttagctagaaggacaattggagtttacatttgaagatcaaattaccatttaactcttaggcaataatccattgtacttttgtcctgagttaaaattacagtgcttcagcagttataagctgtcctattttctctgcttttaaacacaagctttgtaacttaaaatatctgtttgtccttttgatcaaaatcatcacatatctcaaaaaaaaaaaattcctgagacaaacctcagatgacacaaagtttcctaagtgcgctgtgatcattctctcggtcaccttcctcttcgaagtgtgttctttctcaccccatctagaattgacctcccacctctaggaatcttttcctgctaaagctagccttctctgtgctcttctctgagctcttataacaagaatcccagtaatttaacattgcctttaattagtatcttgactattttctgggcattagtattttctctgtagcaatctgcaaactccatgaaatttggagttgggtttgttactcctcatgtcaccttcgtagtcctgactttcttcctcaaggaccagtttgcctttaaccatgactttaagctgttaaat

SEQ ID NO: 129103 - DNA, 1107 bp, Homo sapiens
ggggacgcgatcgctgaagctctgcacagtcttaccacgctggccgttcgggctggctggggccgcccacacgtgcgcggtttccgagggagctccccgcaggggaagccctcaccacgctggagctgagaaacgtgtggccctggcccggccgcgcgccctcgggacttggtgtgtggctgctgctccccgggttatttcgggaacttggggccggcaagtcttctctcgactagtggcagctctttaccggttcgacagcggcccgtgggatcccctttctgagggttcctgcacttcttcccccgactttgggtcgccgagccgccgggaggcaatgacgtttgccttctccttttgcttgcggggaggtgggtgggcttgtgccttacagcccttgctgtggattgtgtgagaggcactcagtttcctttaaaccctgtctgtcacttgccccggtagttttaactgcatttctgtaaagaggcagcgttactaggtgcgttttgcctggtagactgagacctgccctctgtcagcctgcccagaacaccccagggccaggatagagtagtgcaggaagtaatgccagtattgactgttacacgttgcacttttataggcataactcgcctaattcatgcaacagccctgggggttaacagatgaagaaactgaggcgcagagaggcgaaccgattaccttgcccaggctcctacaccacctcctatcctctggctgcagctgcagtgtgctttggaggattcggaggcctctctaggtggcaattattttgcaaggcaggtcccacagaggcacccccagcagctttatcttgttgctgatgctggtcctgcatgagcaggtatgaaggccagaaagtataactcagagggttttcccggctccggggagctcgcttggagccagcagtcagtgtctggacaggcagaagtccagtgaggaaagacatgggcttccaaggtgctgctggacctaagcctgagccatcacccatatgtccctccagtgtcccagtggggagttagaggaatggttctcatctccaggaaagacactggactgataccaggtggcatttgtatg

SEQ ID NO: 129104 - DNA, 1080 bp, Homo sapiens
acttcatctcaaaaaaaaaaaaaaaaaaaaaaaaaaccagaaaaaaaaacttgccattaaacaaattccagttttgatttttgttttgcattggttttgaatccatgcatgttatggccacaaagaagactttcttggctccgttgtttgtcgtgtgtgtgtgtgtgtgtgtgtgtttgtgtgtgtgtgtagaacccagcaagcagcagctataccccgatgaggcaatgtcttcatttggccactcatgtcattccacgtttcctgagtgccctcttggctaggcactgtgctagacactgggctacaaaaataagaatgcctggtccccgttctcaaagtaagcgtgcttcctataattagaccctgagctaaggcgacagaaccagctccctttcaagacaagagtcgcctgtcttgacggactttcagatgggctggaagaacaaggtctggcgtgtatggactctgaactgctcaagctgctgccgtcttgcaggtctagagcctacagggtagcgtcattctagtttctttgctgggcactctggaatttgttctttctcctgcgagagacagtggtcctcagttgtgttccctccccaccatcctcaccctccctcccacggtggttagtcattctggaggctcaagttggctcacagaaggtgctcttgaaaacatcccccaccctcctcgtaaccccagacagtcaggaagggccgttgtcgggtactaagaggtgttatggtttcacattcatgctttctctctgaagagaaaacaaaacatgttgaaatagggagaaatcccagcagcagcttgcttgaagcaagggttgcataacaggtctaggaaacgtctggccgtgtgggtcaagttgagggactgcagccttgtgtcactgagggaacttcttccgggtccaccgagcctctggatccattagatccatccagagagccacttggaaggctctgggaccttgagttctggctggccacgtggtctgtgatggctgtcactggtgaaagagagaccctggctgatatttagccaacagtgtttattccctggcat

SEQ ID NO: 129105 - DNA, 1063 bp, Homo sapiens
ctgattttatagttttagtagacactgggtttctccatgttggtcaggctggtctcaaattcccgacctcaggtgatctgctcacctcagcctcctaaagtgctgggattacaggcatgagtcactgcgcctggccaaaggcaagagatgaggaccatatagatggaaacacagcattaagggtaaaacactctctctctgctctgtctggtgttcagggcccagcatgggctgtatgtcctacacttcgtttcaggctcatcttcaggtgacaccagccttctcggagcctctgtccacatcccacctgtcactacctctgccctaacttcaccttcagtggtcactgccaggacccctccccaaatctaaatgaggtccccctgcatttgccctcattgcaccttctacttttgcttcatggcatttagagtttggaattttttatcgataggatttttagtactctctctctcctctactagactataaactccttgaaggcaaagacgacacctgctccctcagttccagcagcccctaacactgcgctgacatttaggtagtagcagcgttttcttgcagaacgatcctgtagttttaccagctgagacttctgtggtctggggagtcactcatctctggtccctgcctcctcctctcacttttggaaacccttctggccagacggctttggtttaaattgtatgccggagctcttggttccagggagagggttttagcgtaaaaatctcactcatgatggaaggttcctgctattaccttttgcatccaatacaacttaaattgactcctccaaaagcttcggaagtaatttgtacctattgtctagcataaattcagcaagtgggtcccggaggctgaaagtcgagtcttgcggttgtttcctctggtgtttctccctgagacccttagaacggcaagcctggtgcatctggtgtcctgtcatctttctctgtgattgtcatcagtgtgaaaggtgaaaggtgtgtggagaaagaacatcccttcgagctgtggcttagagctgtgacttggcacc

SEQ ID NO: 129106 - DNA, 1021 bp, Homo sapiens
cctagcaatagcagtgcttcctgaagccccagtagaccctgaaggtttcaggactgtgtctggagagcatcagtgacaggtggcaggaatcctctgtggtccacttcagaggcggcagatgaccaggaggtcagactgtggctggtcttttcagaaggacaaacgtgacccttctgaaaactgggaccattcggggacattggtggaaagacagaggagcctttatggtttgttctcacacatatgaatccactttctcccccctccaacatcagggtgacctgaacgctgaaggaagtctaggccttcctgtaggtgaggcagggaaagccacgtagacctgatttagttgaagtgttttccaccaggtctcaactcttcattttgtcttggtatagcttttctggctgactttctagcaagctggttgggctctttgcttgttccaaaatggtagttttcaccagagacttttcagatgagcaggaagcttttttcagaatgtatgttcttctaactctgcttgagtcccccgccatgtattctgataggcatttgttttcccaccccatcccccacttttttgaagtgggggcaatgactacttttaggggaatcatttttctgttgctggtttcaaaacattaagagcaccaattttttttttttttttgcaacagagtctttctcaggctgaagtgcggtgacatgatcatagctcactgcagcctcagtctcctgggctcaagtgatcctctcaccttagcctcccaagtagctaagaccactggcacccaccatgcctggctaatttttttaaaaaattactttctgaagagatggggtcttgctatgttgtccagactgggcttgaattcctggcagcaagtgatccacctgccttggccttccaaagtgctgggattacaggtgtgagccactgcacccagctcaaattttccttttcattaaaaacatacatatatgtatatgtatgtatatacatatgtatatatgcatg

SEQ ID NO: 129107 - DNA, 1034 bp, Homo sapiens
tcttcacaaccagagtgggcaccacaggacaattctacatctatctaggactctgagtttttgaagggtttccatatgcattgtttggtttgctgcttgcaacaaccctgttgttttaactgaaggtcttagggcctagggattccccagaggccacacaacttgccagtggcaggggaaggtcttactcttccacagccttctctgtctttctccctttatggagcataatgaaatgtacgtgcacacattcatgtagatttcattatgtccatgtagaattcattttgatttcaaatatgtttccttcccagagaaatcctgtgaaactatgacattgtttttctctctctccttctccaggtcttattttccttctttaccatcctgattaactctatttttgtttgttttctcttcttgcccgctcccagacacgaatgcagagtttgagtccagatcccaaagcccagtacacaagtatctacggagccctcaagaaaatcatgcggaccgaaggcttctggaggcccttgcgaggcgtcaacgtcatgatcatgggtgcagggccggcccatgccatgtattttgcctgctatgaaaacatgaaaaggactttaaatgacgttttccaccaccaaggaaacagccacctagccaacggtattttgaaagcgtttgtctggagttagaaagttctcttcttcaacacgtccctccccagggtgttcctccctgtgacccagccgcctcgacttcggcccgcttgctcacgaataaagaactcagagttgtgtgtgcaatgcacacccagacacacgcacgcacacacacgcgcgcgcacacacatgcttttttctgttcccctccgctttctgaagcctggggagaaatcagtgacagaggtgttttggttttattgttatgtgggttttcttttgtatttttttttgtttgttttgtttttaaacattcaaaagcaattaatgatcagacataggagaaaccctgaatagaaacaaaacttttgaatg

SEQ ID NO: 129108 - DNA, 1019 bp, Homo sapiens
ttgtaaccagattttcttttttcccccttctcagctgtagatatgatatctcctttcagggccccagcttaagggcaaagtgagttaatgtgtagacaaaggcgagggacaagagagagttaacatctagacagtggaaaaagccatggtgtgtggtttctgggaaccaccaacacttgcaggtttagctttttcccagggttgactacaagaaagaaaaccatgtttttgcaagattaaaatgtggttgagtgtgcctaaattaaccatccccatttttatcatatttccaccatcacttcagggttttaagagtcagtgctcacctgggcggagctggtagtacattttgcttcttagaaagctaagtcctgggttccgtctgattttaggttccaggaacttcctgagaacacccgatcgcagagggtaattttctggagtttgttttgcagggatagctgggagtatggccaccctgctccacgatgcggtaatgaatccagcagaaggtaatgtttcatggtcccagggaggggcagtaggggatgtgcaaaggggcacaaaaaatggttgtgggagagtggagaggactgaaggtgggcagagcggctcctagtctccagtcagagcagacaggagaattgaattttttactacgttatcaaaggcctcaagaaaggacgtgaacataagagtttttggtattcctgtgctcggagctactcaaagtgtgttctacagaccagcagcatcagacatcttgaggggtgttggaaatgctaattctgaggctgggtgcagtggctcatgcctgtaatcccagcattttttgggaggccgaggtgggcagatcacttgaggtcaggagttcgagaccagcctggccaacatggagagacccccatctctactaaaaatacaaaaattagcctagtgtggtgtgtgcacctgtaatcccagctactggggtggccgaggtgggagaatcgcttgaacccagcaggcagaggttgcag

SEQ ID NO: 129109 - DNA, 1018 bp, Homo sapiens
gccaccttccaggcgtgagtcctggagataaaaatggattttaacctaggactgccgggagctggccctccgcggctgctcagactagggctgtgtgtgctggctctcgcctgtttccggtgtctaactggcttgtttctctttatggcttggcttcattccgacctggggtggggccacatccaacccactgcccactggctgtccgtctggcctgccccgcggttccaaccacagtggtgaagcagcgcttgcagatgtacaactcgcagcaccggtcagcaatcagctgcatccggacggtgtggaggaccgaggggttgggggccttctaccggagctacaccacgcagctgaccatgaacatccccttccagtccatccacttcatcacctatgagttcctgcaggagcaggtcaacccccaccggacctacaacccgcagtcccacatcatctcaggcgggctggccggggccctcgccgcggccgccacgacccccctggacgtctgtaagacccttctgaacactcaggagaacgtggccctctcgctggccaacatcagcggccggctgtcgggtatggccaatgccttccggacggtgtaccagctcaacggcctggccggctacttcaaaggcatccaggcgcgtgtcatctaccagatgccctccaccgccatttcttggtctgtctatgagttcttcaagtactttctcaccaagcgccagctggaaaatcgagctccatactaaaggaagggatcatagaatcttttcttaaagtcattctctgcctgcatccagccccttgccctctcctcacacgtagatcattttttttttgcagggtgctgcctatgggccctctgctccccaatgccttagagagaggaggggacggcacggccgctcaccggaaggctgtgtgcggggacatccgaggtggtggtggacaggaaggacttgggaaggggagcgagaaattgctttttctcttcctccctgggcagaat

SEQ ID NO: 129110 - DNA, 1070 bp, Homo sapiens
agatcccagaggagggaagaaaatttgcagtgactgaaaacagtaaaaaaaaaaaaaaaaaaaaaaaaaaaaaaaaaaaaaaaaaaaaatttatgtatataaaagttgcattacacagtacaaaatagatggataatgtttatcctttatttttctatgtagaagtttttgaatttgtgtgtgtgcttgtgcgtgtctacacctagtattacggctgggactctccagctgtttttgttgttgttatgtttttaagagggttgaattcttccatcaggtgaacgaaaaaggcaacaaagtaataaatcagtgaatgtggccggcagctgtgtttagcccctccagatggaagtttcacttgaatgtaaaataataaagtttatattttgaatttctcttttcatgggggaaaaaaggtacgttaaaaaaatcaaaataatgatatgtcacttgcagctacctttttttttcttttaaattcaatcagccaccttcatgtgcctttttcctttgtctttccccaaaattccaggaccagagatctggccctggcctattttctcttgctgtgtacacacacgcacacatgctgggtggcaggatctcgcccgctggagggtggtggagcccagtagaattggggtgactgggcataaacctgctgagactgcttccttccctggttgtgagtgatgtgaatgcctgccttccccggtcagcacttagaagcccttgataggcagcatttggcgacttgtggggcaggtgtttgggataaatcctaccttcatcctaggacttatttctgcatcagccttttaactcaggcacttcaggtaacgtgatctatgtgtgttttgactgaatctcatctcctgtgtttccctgtgcagtctagggaagcatgtctccagtctttgtccctgtcttgtcccaaccattaattctcatgtcacagcttctcactgcatgtgacaagagccaggcctatctgctagggccctgcggctgaggtctgacctggaccctcatgcccgagtcggaagacccctctccagaagccattctgc

SEQ ID NO: 129111 - DNA, 1014 bp, Homo sapiens
gttttaaggattctctgtatattttggagatgaatccttcatcagataagtgattgcaaatattttctttcagtctatgacatgtgttttcattctcttaaatgtatctttcaaagagcacaagtttttaattttagtgagatctaacatcagttttttctttcatggaaatcattcatggattattcttttggtgttgtatttaaaaactcatcacaaacccaaagtggcatagattttctgtgttctcttctagaagttttatagaattgtatgttttatttaggtctatatataatccactttgagttgacttatgtggaaagtattaggtctgtgcctagattattattattttttgtatatggatatctgattgttccagccctatttgttgaaaagactatcatttcctccattagatttcatttactgctcttttgtcaaagatccccttgactgtatttacgtgggtctatttctaggctctctattctgttccattgatctatgtctcctttaactaatgaccacactgccttagttaccgtagcttatagtaagtcttgaggtcagatagtgtcagtccttcaacttccttcttcttttttagcatgttgggtattctgggtcttttgccttcatattgcattttaagcttcattgattcatcaaggtctagcttagagccttacttaattacaggttctgaattaattgtctactgtttgtttacttctgagtacaactaaagtcatttaagactactggaaaataagttaccttagctttttcatctgaaaatttttctacagttataaattgtatatttatatagtaccattatgatgagtaatacattattaccataatggtaataatgtattaccataatttaccactttatgacaataatttataaccataaaattttcagatgaaaaagctaaggtaacttaaaatatttaggcaccagaattcttctcagggaaaaatgccattgtttggaaaaaa

SEQ ID NO: 129112 - DNA, 1150 bp, Homo sapiens
ggagtgacctcagcgccacgagggttccactgctttgatggccacacgcttttgcaaacggtttgggggtggagagacaccaggtgatggtagggaagggcggtggtgactggcacggctaagacactgcggagggtttcgctgtggagatgagaaggtggaggttctgggcactgtggctgcgagtgtgagcgatgcgtttgtgggaatcagaggagcggatttgggaaaagtgaatccttgagattcagggccttactttcgttaggggtgtgtgaagcacactgggtgtcaggagaggatgggaatgggattcgagaggcctttttttggactcctcgagagaaaatggagagagtctcgaacccaggagataggaggcgtattttccccatgcacccatggatcacgcccccgcccccacattccccccgtaggaggcaagacctgagcgcttactcacgtggctcccccatccgttccgcgtccatctccaagactgcctcacagggacccccaggaggctccgaaccatccagctttctgtcaccgccgccgccaccagcgttgtgaacctctgaccctcgcggctctgcgtccattctcaggtactgaaagttttccgggctcttccgcacccgcggatgtggcgaagccgcggggcagctccgctcgcgctccagtcgcaggatgtccttgaccgagaagggggtggaggtgacggggctcagcagcatcccgaaggcggatggggcggggccgaggaggtccgggtgaggagcggcaccctgaacttcccgtcttgtcgctgcaggccccgcagacagacccaagctctgggacagacgcccagcgtcccagacagcgccttcctctgggccatgctggtaggcccgggtccagggccgggtgacgagaccgtagccccccattggttctcgcagaaaccacgtgctagctctgcaccttcctcccccagcgctttcttcccgcgcccgtcgaatcctctccagtccccagtcgccttcctgggaggtttggttcgtattgacggttctcaaagcaaagaaaacgtggagagacagtgctgcgcgcggcttggatctccgtcaatacggtactagcgggagcttccgaggtcaacctaggg

SEQ ID NO: 129113 - DNA, 1027 bp, Homo sapiens
cacatcccatgagagtgcataaccagggagaggttattcacaacctcaccaaactagtatcattttaggggtgttgacacaccagttttgagtgtactgtgcctggtttgatttttttaaagtagttcctattttctatcccccttaaagaaaattgcatgaaactaggcttctgtaatcaatatcccaacattctgcaatggcagcattcccaccaacaaaatccatgtgaccattctgcctctcctcaggagaaagtaccctcttttaccaacttcctctgccatgtttttcccctgctcccctgagaccacccccaaacacaaaacattcatgtaactctccagccattgtaatttgaagatgtggatccctttagaacggttgccccagtagagttagctgataaggaaactttatttaaatgcatgtcttaaatgctcataaagatgttaaatggaattcgtgttatgaatctgtgctggccatggacgaatatgaatgtcacatttgaattcttgatctctaatgagctagtgtcttatggtcttgatcctccaatgtctaattttctttccgacacatttaccaaattgcttgagcctggctgtccaaccagactttgagcctgcatcttcttgcatctaatgaaaaacaaaaagctaacatctttacgtactgtaactgctcagagctttaaaagtatctttaacaattgtcttaaaaccagagaatcttaaggtctaactgtggaatataaatagctgaaaactaatgtactgtacataaattccagaggactctgcttaaacaaagcagtatataataactttattgcatatagatttagttttgtaacttagctttatttttcttttcctgggaatggaataactatctcacttccagatatccacataaatgctccttgtggccttttttataactaagggggtagaagtagttttaattcaacatcaaaacttaagatgggcctgtatgagacaggaaaaaccaacaggtttat

SEQ ID NO: 129114 - DNA, 1139 bp, Homo sapiens
cttcaaatttgctatttgtcagactgtcccaaacctccttgcttcttcctcgcagttcctggactgtgccatccttgggttcagtgaatcagaccattgtggttttgtattcctagcactcaacaggtgtaccaggtattagtgcattcagtttgcttgtccttgatgttggggtgccgttctaaagtacactaacctagcttgtctggtaattgaatgcagttttttcctcttctttttcttcccattaggcataacatctcattcaccccaatatgagttgaattttgtttggttagatggaggaagggagagcctccactctgtctttatctctgcaagtaagagaatgagatattctgctgagaaaacaaggaagcatggagcagacagactttcttaaatatagttgggaaaattggctttctggacttctctaagtgtgtactggtcagatttggtttctggatgaaggaaccgtaggatagtcatgttgaagcatttggatgactcagagctagctatgactttgcctgttgtgctctaagaggagtgtgcctctgcagagctagtctgtgtgaggatagagctttggactcagtatgaattgtgcctgctgaagctggcagtcgctactgtcatattttatcttggtgccactcttggctgttcctgacatatcctagatgtttctacagggactgaaatgcagcctgtctgggctttcttagttcttaaacagcagtgttggctcaggctctagcattaagtggatctcaatggtttctgtgtgttatcaagtgaagtgactgatctatttgattctttaaacttatggtgctctagtaccccagtgttaagtgctcagtggctaagtgttcttccctggagacgtggaaaatgtgcttttttctcatcttttttctttctttgtttctcttttctctctcttttttctgtttgagcatatgaagatataaaacacttttaagcaaacattagtgataaatatccagaatagtctgattataaaaacatttatttttaagtttgcttccacacaagccattatgtaaagaatagccccagattaggttgactatggattctttgcaaagcttttttttcttttcttttct

SEQ ID NO: 129115 - DNA, 1063 bp, Homo sapiens
aggcctggccttaacttggtcatgggtttttttttttttttttttttttttgagacggagtcttgctctgtcgcccagggtggagtgcagtggcgcgatctcggctcactgcaagctccgcctcccgggttcacgccattctcctgcctcagcctcccgcatagctgtgactacaggcgcccgccactgcgccaggctaattttttgtattttttagtagagacagggtttcaccgtgttagccaggatggtcttgatctcctgaacttggtcatgttttaacagcattgaggctaagaacaaaaggaagagagaattagtattcattgagaacttctcttgtgaggtaccattctgaaccctttattttagtatgttccagggacatgtggggtcttggagacacgttcagaatggggggggtccatgaaattaaaactttctttttgcaataatgctaagccgttattggcctgtttacattctcattctctcgttagtggagttttccagaggctttgcaaagtgcgatatggccaccgatggaatgcaggggcagctataaagacccagctgcctatagtgaagtcagacattaaagagacttccaaatatgcaaaacaaagccacgcttccaagtgtttttgtttgagaaaatagttctgttccttgaaaatatgtatttttacaaacatgtattggatttatcatagttattttaaattaattaccaactactttttgaatgtttcaatttgaatttctgatatggcaagttgtgatagatgtcacccacatagaagctctttggtggttctcagtaacttttaagcaagtaaaggggttctgagacaaacatttgagctgctttacctgttatttcattaaatcattgtggcagtgatatgaaatgctgttgtcccctgtttctgatataggaaatgaggtttgcagaagatgagtttctcatccatggccatataatctcactccaaaaacaaaatcttttttttaaaattatatatatatatttattatactttaagttctagggtacatgtgc

SEQ ID NO: 129116 - DNA, 1184 bp, Homo sapiens
gaggagatgcagcctcttctcatgcagagacaatcactgtcattctccatcgggagcaaactcctgaaatggggcaatatctacccacgtggaaccagaggtgctggtgctggtgctggtgctgagctttgaacttccttcagaacaaaagtaaacagcaagttgcccttgttctttaccataagcagagaaggcctgtctatccaattgtgactgcatgatttgttttagatttgttaatttacattttgcagaatactgaggcacattttctgtgaacttatgtggttatatatactttcaatcagtggatactggaagcattgttatacatttgatgtcttttataaaagaatcctaagggccaaaaatgttgggaactttggagtaactgaaatggcaatgtgctgtatcttatcataatactttggagttcattgtgacttgaaaattccaattaaagttggtataacctctatcatgtattgattaaaaatgcacataccctttgacttagcaactccgtttctctgagtttatcttacaaatatactccacatgtggggaataatacatggacaaggttattcattatagcattatttataccaaaaacatggaaactctcaagtgttggctaattggggatggatttagtaatttatagcacatgcatacaatggaaaactatatagccattaaaaagattctgacgcagtgatagataaagtgttgacaaaggtgagagtggcatgtagtggttgaaggatgatcttttcaaaaaatgatactgagtcgtttgtttatctatactgaacaaaatgtatcaggacccctacctaataccacataaaaaattgattccagctgtatgaaagataaaacagtggaagctcttagaagaaaacataagagcacatttttgttaccttagaatagaccatctgtaatttaatacattttgctttctgccattcagttagttacttatgaccatctctttgttaatcaacaaaaaccaaatccaatattttacttcaataaagggcaaaataaaacatgcctgtgctggtctcatctctttataatcctactttttaaaacttgtataattacatcttattaattgtagtgttaatttgttggttgtttaaggatctaaatggctatttcttcttcttctt

SEQ ID NO: 129117 - DNA, 1040 bp, Homo sapiens
tgattataccactgcattccagcctgggtgacacagtaagaccctttctcaaaaaaaaaaaaaaaaaaaaaaaaaaaaaaagatacctgtgatgtcttagaaatcccacatttctatagtacatttccttgttcttttcttttcagtctcagttcaccagaaatgtacgttgtggatccacagtctcatatgaggggaaaatgcagtccactaaccagattaaccccagccatgtagacgctggtgattattctagaaaagaaaaatatttgcctagctgtgatttatttttagcagttatacggtaaccatgtagaataatcataaatatgtcttaaaggggaggggagtatgtacacagaacagaggtgaacccacttatccaaaatggagagaacagatgactccccccgtggtctctctgttccttaggtatattattattgttttctgttggattatcttccccagtgggtgttggccttatgctcaggagaggaagcgggttttaggagacagacactggcccaggaattgggaagctgagtatcctgtgcgggtcctgttctgaccagttctgtggccttgggcaagtcacttgaacacttcaagtctgctggatgttgttcctctgcaaaagttgatgtaaaagctgccgtgttgaccgcgtagaactctgagagtatggaaagagagagtggctgtgatctgtgctgctgacagaccacaaggactccgccaatgggagcatgtgcttttgatgttatcttagctggaagcagtagccatctggacaccctccctctgggaagccttggcatagcttctctcttacccgactgcctgcccaagactctgaagctcccttctgtatggccccttatccaaggtcgcttcctttggaacaattatcttaggcaaagtggccttgagcactcagcagccaagctaaatttctcaccatacatagagaacctgcttggtttaaattcaagtccaggaggcccgggtcattccaaaatacagagaaactgcaaatg

SEQ ID NO: 129118 - DNA, 1034 bp, Homo sapiens
gcctataactgggaagagggggtaggggaacttgcagaacatactgaatggccctttcttcccatcatcgcatatccaggcagtttaaagctgctggattctaatctctttgaaccggtggttattactggctgctggaacgtaatctctgaagtacaattaagctggtctcatggtttgaaaccagcatcttattccttattaccaagaacagaaaattcccatagcaaactttgtcctcttgtcagggcattttatctgggagttgcaagccctgcttcagtgtggctctaacaagagagccaagatgtggcgtgggactgactgatgggcaccagacatgggtggtgctttgggtatttttccagttttgatttcctctgacctggttgcctggctgtcaggatttcttttccttcaggaggcaaaaaatggcctttaacttgaatggtttctttaaaaatcagacctttgctggtcagactgcacttttatctgacacagagaaaaggcactagaatggataggaagcgtgtttggggcagtgggaattctcttcttcccggggtccctggagtcagtgtagctcaagaacacagaaggacccaaacaccccatctggacccaggtgttacagctacgtggaaaaggcatgagattgattgcaatgagctcgacaccgggaaaatttgattcaacgccaactgagtgtgcaagcaagtgagatgatcagagtcagatgcagttaatcaggaagctgcctgggaggagtaattgagtttaatgtctcagtcatagactcaaagacgcttatccttgggaatggattttagttccagtctctttattttacatgtgagtttaccctagagggaatatgcccgaagccacatagcaagttaatgatagaattcgagatagaagccaagtacccatactttcagccaagcctgtttccccctaagtcataaaatctgcatggaagaggaaaggttggtgaacagagtgaatattgattcttttatacatggaat

SEQ ID NO: 129119 - DNA, 1455 bp, Homo sapiens
tgagcttcaaacctcccagtttatatcttttgcaattctgatcttatatggaattaaatgaagttatgcacatatacacacaatatttatacatgatatgctacttttttaaatcctacagctgatttgttttacataaggatcttactttgttttcttcattcttcctagatcactaacttagaaaaaatacggatacataggtctccagtgcccaagaataaccctaaatctggattaatgtgttggacccatttctttctctttccctctccctcttttcccaggttttcttttaattatctaataagccccagaacttggctctgtgtgggtccaaagggacaggatttagactgaaagtttagcctcagtttgcttctttataactctgcatttttttctgaagctaacacttttatctaaagagccgcattgcaggagatgtactaggttcccaggttcctctaggctgggcatccatacgaggcattccagaatgttcagaggatgccctgagtgccaggccttagggagaataaagacataggaaaaatggtctcatacaactaattagagtcctcacagagcacacacgaaccttttgagcaagggtttgttgactgaataaaacacaaacaaaaacagacattgaaagaaggacattgtgtgctcagattctaagtgatgttgggacttgagctgagtcctaaagaaaactggaactcgagtccacaaagaagcgcagcataagtgaaggtcacaggataggaaggtgttgcatgaggtgtgtgtgtgtcggcttaactgtgtcacttaatatctaacattgacgttctgtgtcatcaaatcctgccccagccactgctgagaccctggtcagtgctggtcagtgctgctggaatgatagcatggaacctgggcttttgtctctccctccgcccctccaggctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctggtatgtgacatgcctccggtgtgatgggagggtactgtcaggccgcccctgcaccctacagctcagctctaggtagatcccacaaacacagaggcgccctgaggcacctttgtggagccggtgtcttcctaagtctaattggaatggctggctcagctcacaggtatcagcagccacagaccctgaggataaatttggtgtgtttttgattgtttgttttaatttttatttcagtaggtttgggggtacagtggtttctggttacatggataagttttggggatttttttttttttttttgagacggagtctcgttctgttgccgggctggagtgcagtggtgcg

SEQ ID NO: 129120 - DNA, 1013 bp, Homo sapiens
tgaacggaccacgtatacgactgcatatacctttcctgggattctcaagtggtttgaagtcaaacagatttcaacagtgagtcatttgaaattggcatttagaaaaaaactttctgtttccaaatataataacagcctttgttgaattccctctgcagttcacaccagcttggccagcctcctctggccaactttgtttttcaaaagagaaataaaaggcatgcttatataatagagctcctttgtaaaactgatgtgacaacaccagccctaaaggtcaatcacagtgaatgactcttttatgtccagaggagtggtgtctgctcagcgatcctgccagcacccagaaacatttttggaatgctgctttggagtttcttgtcaattacatcttccctcccaaagcctgttctcttcttttattctctgctaatcatatccacagttaccctagactcctccctcttcatctcgcccaaaagctgcttattttacctgtttagtattgattaaatctgttttatttcccacctcctcattggcctccctgccatgcatggccttctcaggtccagttacctcactgcctcagtgggaattccattaaggaaatctcaccatttcgtccattctcgtgcttaaagtccttccatggctccaagtacctggagtataaagcctgtcctccttagcacacacacgtatggcctaactcttctgccccatctcctaggcaatctgttggaaccatactgttcatcccatgctaatttcagtcctctgtgacactggatcgttttctctgcctgaaacacactcttgcaatttctgcacctaactaactcccatcaaggttcagtttaggcaccagcttctcaatgaatccatctctggaacacccaagttgggtgacctgccctttgtctgtcccctgtggcatcctgggcgtgtttctaacctaccatgtttacatgtcctgagaccccgctaacaccatcagctcctccaagcca

SEQ ID NO: 129121 - DNA, 1036 bp, Homo sapiens
aggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaa

SEQ ID NO: 129122 - DNA, 2591 bp, Homo sapiens
ctttggaattaaacccatttggtggaattaaacccatttggtttcaaatcccagttatgacatctgttaactttgcaaactcacaaaaattatttgaaattatctgagttttcattttctcaccttccagaatggggataatgcctcctgcatcggttgttgtgaggtttcaatgagatgaaatatgggaaagaagaggtactcacctgatggtccctgctttcctctgctaggcctgagtaggaactggaactctctaagagcattactcatactttttttttcttccaaggtagtttggaatgtgagtgcaagttagttctgcacatacagcccttctccaaatggtggtttcctttgaggtcttttacatgattatttatgactagagacaaacttaataagaactcaagaggattttaaatggagagaactcaagctgtagagaaaggaggaggcaacagacaggatatgtaggggcttacctagagcctggcacgacttctgagaagtcacccagcagaccggctagaggggatttgtgtgccacactctacttgccgggctgccattaaaatagaaagatataaaactgggtcaccaaaaaaaccaaacctcaaggctatccttccagagcagtagaaatgagtcccacagcctggtctttgagcagaggctgggaagataggatacatcactgtctggataccttctctttttaatagaatatattccgtatgattccctttccaccttaatggaaataatagctctctcctgcctgaacaaaagggattccaggtagtattgtggctaagagattacagcggacgatggaaggttcattttttagggaaggtgttgggtaggaagagtcacatttgacagaattcataaataatgtgtcctgaagtcagaggatgactgcaaagaaacacctcatgattccattaaatataaagagataaggagcaaggaggaaaaaagagaaagaattggtctttatttttcttgctaagaactctctggagtattgaaagacattgaaattatccctaaaattgtcacaacttttgtgaatactggtatacggttggaggtgtttttaaatctttatttcctctctttctttgttctagtgacttgtcttgctttaagattttttttaaaggattgttttattcaacatatatcaagttcttatggaatgccagtcatggtactagccccttgggatgtagtggttgagtgtgttcaatggaaacagccccagtatacaaagacagttcactctggtgtgctgtaggattggaaagggagtggtaccagatgaaaatgaaaccctaaagaagactgctgggccatgagttgcttcctcctcctccaccttaaccctctgattccagaattgcagtcattttcttctgccaaggaaatccattaaaaactgcagccacactgcaatttcctaatgtagaacaagatataaagcaggctttgagacaacaacctacctttgtttactctttccaagctggaagagtccttctcctctagttgcccctaggtcactggctaatttattttaaaatttagatggaactcatgtatagttaagtgcacaaatcttagccgtgcagatgggtaattttcacatagctatttgcccacatccgtgcctctaagatagagacatacactgttttcagcaccccagaaagttcccacatgcccatggtgccattttgtgaaaggtatttataaggcccttcaaatttgtggcttcctttctcatacttctcaggtataatgaaagggggagaaaaaccccaccatcaacacaaaacaaggctataaagactgtgcaccttttaacaagtcaatttgtagtcagtccctgggcctgtctttttttttttttaattttgaagctacctgaggtttagaattccttcagccctagctgcttttattctgctttttatttaaacaaaaagagggggaggatctgaaggaaactagttttctgtacaaaggctttgaggtccatggactatacttgtcccatttatcatcccaggtggtgctttgaccctgccataccctggctattaagataaaaagatttgtggacattaaaattatgaatatgtcagtaataatccagcacacattgaaatattgacacagattaccataatttgtgcaacatcttataaacaatgtcatttccatagtagtctaaggcttcaccagcctggcccactgtatctagactttaggttcattttaataattatgctttccttctctgtatcatttgggaagttgataaatatcacttccttagataccttcattcagtgatatatctggcttttacaattaaattggaaaaggtaagtttctctttggtgggttgagagttggaccatcaattctaatctacaaaaggaaattcatgatttcactctgacgcctaggatctagccaaggctggtctgcagtatcagatgtccaaactcatctactattagccatattttgtgagtcgtttgtctaaactttgtcaaaaatgcctttgccatgat

SEQ ID NO: 129123 - DNA, 1043 bp, Homo sapiens
gaacagccacatactggtccagccagaaaaagctgattcagctccagtttctctgggattataactttatcttcgaccatactcttcagaagttgaggtggggccacggccaaggctttcttccacttggaaagaagttccctcccttgatcgtctccaaaccctttgaaagtttactggaacccaaatgaggcctgggggtaaggagagggggcctccaaggactcctagtccagcgctccttctggtcccacgcaatctatccaagtggtgcacactgagggttgggactgagacctaaaaaataatagagtgttcatctgcttgatctgtttggtttgcatttaagaaacacaatggagtacagacagaccgttggagatgggactctattgttcctatgtcccctggtcagatagcattgccaccattctttctccaaaaagaccaggggcaggctttgtgctacatatgtgcacagatatttttactaaccatcataagaaccttggattgtagttagtattgcctttgctttaaaatgaggaaacgggctcagagagtttaagagacccagccatgtttggttccatgttcactattctagtattgccctatgatgagcagctaacagaactggactttggaggctgggttattttgtccattggagctgaaacaggaaactagggttcataggtcaatgtagatttagcaatgactaatcctccataaggccccagacactatgacattgatgttctcatttagccacataacttccaagtggctatgagaccattggaaaaaaaaaaacaaatttcagataacttgcccaatgtctcagtaacaaactgacctgtcaaagatctaagccctttttcctcttttaatcaaatgaactcgcctccctaccccctaccctgctccctcaaaaaaggaaagacttatgctaagaaatttgaacaggggtgagaaacatcccgtgggggaaaaccgcctctttttaatacaaatatttgctactgcacaatgacaggttt

SEQ ID NO: 129124 - DNA, 1591 bp, Homo sapiens
gcttttaaataggcatgatgtggaaataccatcttggtttgagatgcatttgaggattttaatttatggaaagcacaacatatgcaattatatttattgaattcctagatgcagtatggatatttaaattgttaaaactttatgaaaacttggaaaaggttgttcaggtttataaatagctttagtgatgcctcccctctttaaatacctgtcacaccgtatgaatatggtgagatcagactccctaagactcttttcaggttcatttttataatgtttactttttaggacagaacagtagctaaattaaagtaatatccagttcttactgattgagacagagtggaaagaaagacatcattgtacatcactgtcattccaaaggtacagtgtaactctggatggaggaataacttacctatcactacaacacttacaaatgagaatttctcagaatttcattctaggcaagttccactcaacaccagatcaagcaattctatctatttacactattagcctagttttctcatacagtcatcacaagcataggaagatacttcaaaaccaaaaaaaccaaggtgcatcattaatattcatttaattcaaataccaaatagtttacatagggccagcttagaaatagatactaaatccagagctactgcaatcaaagcttatatgagtgaatatggtagagttgcctgctaaaaggcaatgtaatataattgcagctagaaccctacagtggggaatgaggaattttaaacacacatttgattacagccaccaaaaaaatagacgtaaaaataaaggcatttggctggtccaagatgtaattatcaatcagtcagcacctgtgattcttttacttatttttttgtggttttttttttttaaacaaattttagcccaattttcttgagtcattctctctctgcagcagcagaggaagggcctgtacctccctaccaatgacttggtgtccttattttctaccccaagagcagggatattagctgtgtccaaatgggttctgaattctacagactcatcaacatgaggcaaggaatcattgaaaaccacctgtgtctcctttgggagaatgacatatctttagtatttacgtagcttattcttctatatctacatatgcaaagctttccttaacagtaaagggtacatatgcatagtgggaggagatcagacctttacaagtgaaggaaagcaacttcagaaatgaattattttctttgctttattatttttaccaagacagagaagtattgtattgagagataatctattttcataatcaatatgtgcctaaattatatttaaatcatttcactctgtactatattttcaggaattacagaatgtggtattcattcacttaaaggtacctctgtagaaataacctaaaactgcagaaggatctgaaagatctaaacatggtgtgcttagaaactgcagattttagatctaatgtatactgcattaataaatgatataaagtgtttgttgaaaaggagtttcttctcttccttttgaaaatcatcactttctgtattttgcttacatttcttca

SEQ ID NO: 129125 - DNA, 1085 bp, Homo sapiens
tcagaactgcgatgccaggtaattagcaggcttttacatcaattatttctatcagcaaatctatgaataaaattttacattcttctagtgttttgggattatcttgctttgtttttcttttacatgcaagatctaatttaattatgagtcatagcattgatttagttctgaaatggttaacgaaaaagagatgcaataatagcctttttaaattgtctaattatacctcatgcaacagtttatgaataatgcatagaaattgcagcagttttttaaaagtcagtatttgtacatttgcaatatatgggctgatcagtggcaggtactttacttatgtgtactatagcatttcaaattgtaaagaccacagtactcatttttgcctaataaactgttttgaattactgaattaataaaataatttaaatataattaggtttaaatacttattagcaggtataggactaacagggatccctctttagaagcttctacacagaaatgaattatagccgggctatattctaatgtatatattgatagagtttcttttatgaggaacctatttaaggacacttcttttatgtatctaagttccattttatcatgttctgtaataaactccaagtgactgaactgccaattgcttctaaaaaaaacttggtggttagctatagtaattaaatttaatacaaacagacgatttagttatggtgacaatttgtgcttttttatttcagggtttgaacttcagtggtgctgatctttctcgtttggaccttcgatacattaacttcaaaatggccaatttaagccgctgtaatcttgcacatgcaaatctttgctgtgcaaatcttgaacgagctgatctctctggatcagtgcttgacgtaagtatcattttaggctacaagagaaaattaaatgtttagtctattgaacagtctcaaagagcctttgagacaggaattataactatcttttactggagcttttacttgaaaacagataatttattatgttgatataagactaaaggtctgaaagtgaaatgaatttggttttacaggtttgatatcctttat

SEQ ID NO: 129126 - DNA, 1069 bp, Homo sapiens
ggtcaggagatcgagaccatcccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggtgacagagtgagactccttctcaaaaaaaaaaaaaaaaacatgctttttagatattgagtaataaacacacaatataagtaaaaattaacactactgaaatttgtggagactacaactgcttttattaaagggcagaaaaatgtaagtttggaagatcaagaatattattatgtaataatttgcttacaggatagacagacaagtatttaaagcaaaggaaactaaaacaatgtttaaatcaaaggaagtaccctattagaagggatctgataaatggcaacttactgcacgtttttgtttcccagcgttactcctaccaggttgtagcatgcatctttttgagagagcagctgggatcgagtatactcttgacttaaatatgtttgtttataaagacaaatggagaaatcaatttttttccctgaattcttaggagcactttagtgaataaagaacctgacagtatgctggcccacatgtttaaggacaaaggtgagtgtaacacgttgttttcacatttcatcttacctgttttatatctgtgctgactttataactcctgaccttctgtacttactaattatgtcagtttttaagagtaaaaacttatatttagcaattttttcctcatacatttctgactttattttttgtttatgggggactttctttattataatggtgacacaggtgtctggggaaataagcaagatcatagaggagctttcttaattgaccgaagtcctgagtacttcgaacccattttgaactacttgcgtcatggacagctcattgtaaatgatggcattaatttattgggtgagtttatttagactttcaatataattatgtaactactcacatttttgtaagtt

SEQ ID NO: 129127 - DNA, 1096 bp, Homo sapiens
tgaaccattcaaataaataaataataaaaggacaacataatagggacttactaggtctcaggcactttgctaagctcttatgcatgaactcatttcataataccttctgaagtaggtgctactattttcttcatttctagttaaagcaacagaagcatcagtaggttgactcaagttgacagctagaaaatgtcagactctagatcgaagtgtaggtctatcttacttcacaactggagcgctatttaacacaccttaggattgtagattgttttggtcagagatgatttcttatgttctagttgaggagtcggcaatattaggcaccaagtgaataaatgagtcatggaagaaaagggggcactgttaagaaccttttgaagtctccttttatatgataatctttttagcactgttctagtgtggtagtttataacttatgggggataacatgtattaaagaaattgttcatattattctggtgtgtttacaggtggttgctgtatatggaactttatctgatttgctttctgtggccagcagtaaactcggcataaaagccaccagtgtgtataatgggaaaggtggactgattgatgatattgctttgatcaggtaaccttcacctttttataagctgtcaacagtgtgcctcaacttcttggtgctatgctgtttcccttaagcagtaatttaatcactgttaagagtacaggattttggcaagtgtttacctagaatttgctctttggaatttaaatcatttgggcttaaggtgaattgatcagctagaaaacccttagtacatttcagtatactgatagtctttctgcatagttcatatatagctatgaggaatttcttctttgtggtactagagaaggatctagtaagacgtgcagtttttaacattaaaaatctaattcatctcttcacttttatatgcgcctgcttgttaatcatttcctaagaatgctttgcattttataatcattacaaaggccagattttgtaaaaactttataaatatgatagaattctaagtagtgatatcaccagtgatccaccataattataggcttatgtttgtacctt

SEQ ID NO: 129128 - DNA, 1040 bp, Homo sapiens
ggggcattttcttgttgatttttgccctcctctctgagatgcctcaagcccccacgccccgccgccgccaaacttctctgtactctttttattattttgccttattttgattccctagaggacgggtacagcagacccaaaagggatcgatttgacagtcgcctttgctgtgttaggcctttgcggagagtgtggtgctcagtgttcttccagcgctggagcaagccaaaacgaattctcttccttcccagccttttgccccacccatgaaagttgttctgctcctttgggaaattttcactgttcgaggcagacatttattgcgttgctaaatgatacctagaagtaactcagcctttacgagtctaaggtaaaggtaaatgggtctcgctgtgttggttgccaaaatactctgctgcctgcacattcggggaacactgtaaatttttaaatagtgaaattgtccagtggcattaaaaatggctttccgattattcagtgtagagtaaacatgctccgaaaattcgaaccagagtgtggtttgttggctataattttatgttcttttggtcttagagatttaatactcatttaaaatcagaattcgtataaattcgagttcttgagttatcatgaatgctaccccgaaaatatgttcacgaagtttacatttctcatcactattaactttttctaaacctgttctgtacttagctactacctgttatctaaaacgtatgttgttactctaagaaagatttagtatgttcaaaattggtaatatttctcaaaaacaaacttctggttgacctttttaatgcagtatctctgctatgttactcatggaagacaaatatttaaacctagtcataaatatttttgctctaaatctctcccaaatccactcaatttggttgtcaaaaattaactgagttggtctttccatattgttgttcacacggattttttttttaagctatctagttttgactagattagattcttggatttaaattttatttactttaaaaatattctgc

SEQ ID NO: 129129 - DNA, 1586 bp, Homo sapiens
caggagttcgagaccagcctgaccaacatagagaaacctcgtctctactaaaaatacaaaattagccgggcatggtggtgcatgcctgtaatcccagctactcaggagtttgaggcaggagaatcgcttgaacctgggaggcagaggttaccgtgagtcgaaatcgcaccattgcattccagcctgggcaacaagagtgaaactctgtctccaaaaaaaaaaaaaaaaaaaaaaacacaaacagaagattgattctggctaatgtccttcgagcagtagaaatgaagtttacttgtgaagtctgacttagatggaaaagaaggaaatactatatgagaatggaattggatcagagaatagcatttagaattggaggataatggaagtcttgaatatcacagggcactagaccaggtaatacataagacaaggcgaaagtggcacgccaccctaactttcattctcaaaaacatcactcttagacctttaaaaggctggattcattttgtgtgcttaggcatatgtccaaaattcagggtagtgctgatggtaggtatcagaaagaaacaatcatcttgaagaattaagaacctgagactgcatgtacctaggtggagatcttacctttcagttgctggggataaaactgacttatttagaaaaagaaaaatactgagtcaaaagcaaaagccatctgtgtgtaggaaataagaaacaaaaatgaaaacttaaaatgtgttcatgtatttattcaacaacttttaataactgttctatgtaccaggcactgttctaggagcatagactaagtcagcagacaaaaagattcctcttccactgattgtatatgaatgactgtgccagtaactctccactgagttttttgtagcacatgtttatcatgttttctctctcaggctggtacatcacgagtattggatgtggttactgatgattgccttgttttgttccaatttataagagagtttcattacaggaaagtcatcatcctaccttaaaaaatgtagacgacgttctgcagtcggtgctcggggctctcctgaaacaaaccatctgattcgtttcattgctcggcagcaaaatataaagaatgctaggaaatctcctttggcacaagattctccttcccaggtatgattttcttctaagttctgtcgtgaattccgttaatgaagcttttgtgctttctttacaccttctagtgcatctgctctgtttcaaatctggagggagattttctctgtgttttagagaacatgcagttagcggccgggcgcggtggctcacgcctataatcccagtactctgggaggctgaggcaggcagatcatttgaggtcaggagttcgagaccagcctggccaacatggtgaaaccccatctctactaaaaatacgaaaattagctgggtgtggtggcaggttcccgaaattccagctacttggaggctgaggcacgagaattgcttgaacctgggaggcagaggttgcattgagtcaagatcatgccactatgttccagtctgggcgacagagtgagactgtctcaaaaaaaaaaaaaatgcag

SEQ ID NO: 129130 - DNA, 2006 bp, Homo sapiens
catgacaaaactccatctctacagaaaaattttaaaaattatctgggtgtggtggcacatgcctgtagtccaagctatttgagaggctgaagttggaggatcgtttgagcccaagatatcgaggctgcagtgagctgtgattgtgccactgcactccagcctggctgatagagcaagaccttgtctcaaataaaaataaagtaattttccctagatcctgagcccctcaaacagtttgtggtgcatggaaggaaggttgttgactgaccgacacaattcctaaaacaaaaacatcaaaaaagcagtacattttgaatgtttcatttgctttgtatgtaaacattgttctccttctccagtagaaaatagagaaaaaacaattttgactagagaaacttaaaatttttttaagcagcatttcaaagtgctgcatgttcctaggatattaaatctgcccctaccatgttcaaatatgtgtgcaaaaaaagcacattcaaagtaaattgtatgaatttgagatcatcttttccctgtcgttctgttagatgaattgacataagccttttttgaatattattgctgtttatgtcgtgaacgtttgtgtcatcaaggatatttcaatgtaaaatgttctcattatgtaatagagaatttgctttatatttaactgggaagagaatcaaatgtgtgaacagatcaccatcaaacatggcttcacgatatgaactgctttttctccctgtgatatatatatattttttctgagaccaagccttgctctgttacgcagcctgaagtacagtggcatgatctcggcccattgcaacctctacctcccaggttcaagcgattctcccacctcagcctcccacatagctgggattacaggcatgcaccaccacgcctggttaatttttgtgtttttcgtagagacatggtttcaccatgttagccaggctggtctcaaactcctgacctcaagtgatcctcccaccttggcctcccaaaatgctgggattacatgcatgagccactgtgcccagcctactctgtatgatatcttaaacggaggtaatttttacttcactttttgcccattggtataatttttaaacattgccacaaacttcatatcagtggaaatgttagtagtccaagtaataaaaaaaaatctagatagagaacttcatttgtaatttaatttttatgtaaagggaactctcaatttttatattacttgtctttaactggcacttctatccctgctaatataaatttcattttatcagtctttggttggaaccctgttaacggggtttccagagagcttctgtgcttataccatcaaactttgtattttaagagaatggctggctttcaaccctaagaaggaaatatcctccaggtcccatacaatcaggaaaattagctgggaagagccaaaaaggagagcagtgcaagtgtagtatctgagcatgtatggaacttctgtgtctcgttctggcccctgggctggagggcatgtgtagacccgtgctgagtagaaacagcttggactgaaggaggtatgctgagacttacctgtgacacaagcaccatgcagatggcttcctatggatacatccagcacaacatttggtaaaaattgcaaatagacaggttcctcctgtcccttttttgttgcaccatcccagagcgcaatgtttttttggcaccttccatataatcttaggctggcctctcaacatttttgtgttaaacttccttattcaaactgaaaatgggtaattccagggtgaagaagctctgccacactaactccttaccgctgatcttcaaaaagcatatgtgtactgtatttaattttggattcaatggctgtaggcctagaatatagaaagtatgaattgattataatactccttgtatattttgcactttcacagggcagccctgcactgtatcgaaatgttaacactttaagagaacgaatatcagccttccag

SEQ ID NO: 129131 - DNA, 1029 bp, Homo sapiens
attaagctcggcaagcatttagtaaatgaaataaattcatataaattttatatgagtaccaaacacccaaccctgatgttaaaaacaaatatattcagccaggcgcggtggctcatgcctgtaattccagcactttgggaggctgagacgggaggatcacttgaggtcaggagttcaagaccagcctggccaacatggtgaaaccctgtctctactaaaaatacaaaattagccaggcgtggtgacacatgcctgtaactccagctactggggaggctgaggcaggagaatcacttgaacctgggaggtggaggttgcagtgatcccagatcgtgctattgcactccagcctgggcgaagaagtgagagtccctttcaaaaaaaaaaaaaaaaaaaaaaaaacacacacacacacacaaatatatccaatctgataatctgctatattctttaactcttagattgtaattcatttggttgttttttcagtcttttttttttcccccccaatcacgaagcatttcagataccagaatgtgacaaaatcttggtcttactgtaatcattataaccattctctggtactttacacactaaggtttcaaatgattctgttttgaattcttgaaccatctttaagtgcatttcagcacctcccatgaggattgctctgttagcccaagacaagtccccctcatctacctctagagtgcgtgacccattcagatgtaccgatttatatttgtagtttgtgactcacttattgtttcagttttttcctgggttttaaaatttatttacatcattataattctgcagacagttccttttttttagctagaaaaaaacaggtacgttgtggttgtctttttcataaagtcatacagagtattagagcataaccacatctttcaaaataacaggtgtcatcatttaaaaagcgtgaggtaccatattagacatgcaaaagtattttagtatatctttgtaccttttaaggcctgaaaaaacttaattctaataatatga

SEQ ID NO: 129132 - DNA, 1053 bp, Homo sapiens
aaaccccatctctactaaatatacgaagattagccaggcatggtggcatgagcctgtaatctcagctatttgagaggctgaggcaggagtatcacttgagcccagaaggtggaggttgcagtgagctgaaatcgcaccattgtactcaagcctgggcgacaagagtgaaactccgtctcaaaaaaaaaaaaaaaaaaaaagaaaagaaaaaaaatatatataatatatatgaaaacatttatgcctgtgtcgttttgtttttattttgtgtttatagccagaaaggaaggtctcagcgcttgccagcagtctgggttccctgcagtgttgtcctccaaacgtcggagaatatcctatcagagagactctgatgaaaatctgacggatgctgaaggaaaagtaattggtctccagatattcaatattgatacagacagagcatgtgcagttgaaacttctgtagatctttctgaggtaattcacttactttacgcataggaaaatgaagttgttggttttctgcataggcagttttaaggctgtcagtgccgttcttcaattttagtaccttgttctgccctgtggttcctggggtgtgtgtgtgtgtgtgtgtgtgtgcgtgtgtgtgtgtgtgtttcctacctgttaattttatggttgctggtatttatcacttattagaaacagtttggataatgatctcacttttgactactaaccttacaaagagagtaagccctggggtcttctacgtatgaggtattctagagggtgatgctccaagaagggaggaagttacagtcttgcccttaggcagtattttttctactggggagcagggtataagcagatggcttcagtggagctggtggatcaggtggagattctgtgtggggtgtactccacaggcttgggagtcttgcacttatacctgcccctgactgctttccttctgatggaaatcagggtgccattcagcaatttctcctttgctcacttctttcaagtagctctagggatttttgtggcttataactacctaaaccctgtcaa

SEQ ID NO: 129133 - DNA, 1020 bp, Homo sapiens
tacgatcaataagaattagtgaagtattttcaagctcatggaatttagtataaagaggtagcacctatgaacatattaacaagtattctttgttataggaacactacttgtaatatttttatttgtttttaagcatgtaaaaagagtcttaccaggatgtaaaaattattctttctcaaaatcagtatgcttgtactgggtgaacattactagcaagggtttagattgactttttttctacttgggtctttaaaactcttatgggcatataattggatcttgtgttttattaatccattctgataatttattgtaattggaatatttcgcctattaactttttaggtaattacttaacatggttttattcacatctgtcattttatcatatgttttctattcctgattattgctctgtaatctttcatagtctggttagttgatattatacaatttcacataaaatacagaaactacaaactctacagatcaatttcctctcctttccagccatggcttttatgatcctttacagatacacacttacttcattataagcctcacaagatgttgtttttggattaaacagctgtatgtgctttgtttttctttttttttttttaaggcagtttcttactctcttgcccaggctggagtgcagtggtgtgatctcagctcactgcaacctccctctcccaggttcaagccattcttgtgtttcagcctcctgagtagctgggattacaggcgtgcaccaccatgcccagctaatttttatgtttttagtagagatgggattttgccacattggccaggctgggcttcaactccttgcctttagcaatccacccatcttggcctcctaaagtcctgggattacaggcatgagccactgtgcccagccaaaacagttatatgtgctttaaataggttaagaggggaaaaatagtcttttatatttacccagatgtaccatttcttatgttgttttttcctaaagatctgagtttctctgtctta

SEQ ID NO: 129134 - DNA, 1045 bp, Homo sapiens
tgaggatatcattttcatgttagtaaaacctagtataatatatgaaattttcaatgatctataatgccttagtgcttctgaaataacacgtgaatgaagaacagttgagaaggttagaatctccttggagagcctcagaattggtctgtccatttcatggatccatttttacttagtggtggtatttgtaaagaaaatttatatttcaattttattaacgtttaatatgcaaatttttacttggaaatctgttgccatattttaattggaaatgtgcttatcttctccattttgaatttgctctaccaacaattattttatagctttgctttactagctattatacaaataatagctgaatattatcacattaaaagattctagtatatgccttttagataagaaatatagcttaatttttaagttactctcatttattgtctaattatagaagatgaagaaaattttgaagcacctgcctttctaaatatgaggaagaggaagagagttacttttggagaggacttaagcccggaagtgtttgatgaatctttgccagcaaatactccattgcgtaaaggaggaacacctgtttgtaaaaaagacttcagtggtctcagttccctgctgcttgagcagtcacctgttcctgagccattacctcaaccagattttgatgacaagggggagaatcttgtaagtatgaaaagcgtggaacaagcttgccatatgtattttcatcaggcttcacctgctttgcatgagcaataactatgctttgaaataatgagatagactaaatgatatgccatggtttaaattaatctattttgtatgtaggtttttatgagtttttgcccattacaaataatacttccctgactccttgtacatattgaacagatttatgccaatgaatttaacaacttaggtaaactggatacattccttagaagacacaaattaccaaaactcactaaaggtgaaataaattacctcattatccctatatcaacttaagatatttaaattttagttaaaacct

SEQ ID NO: 129135 - DNA, 1996 bp, Homo sapiens
ggaggctaaggcaggcagatcacttgaggtcaggagttcaagaccagcctggtcaacttggtgaaacctggtctctactgaaaatacaaaaaaaaaaaaaaaaattagccaggcatggtagcgggtgcctataatctcagctactcaggaggctgaggcagaagaatcacttgaaccggggagacggaggttgcagtgagctgagattgcaccactgcactccagcctgggtgacagagtgagactccatctcaaaaaaaacaagtggtcaaaataaaattttcctatcctacactttaaataaaatttaaaacaaagtattttcatggttatcttaatgtcctttattgcgatttcattatacaaaatgtatcgtggaataaatgggtgttcatgaaaatacatgcatttattgtaatgtgatttattctgctatcttagcttggtaatatgttaagcagtcaccatggaaagtggcgaaagtttctgagtatccagtaaacttaaaattttttaaaacaaaaaaaaaaaattggatttcaaaatttctgctgcttggctcctcttttttttgtttagatatggtattaaaggtggatatcctaaacacagtgtttccaaaggaagatgtatgttatagtttttggtttcctaccctgatttagcttttgtcttgtttatcaggcactgatacctttagttcttcaaataaccatgagaaaatatcctctcctaaagttggtagaataacaaggacttctaacagaagaaatgtaagtgtttgtgtttggcacaacgtatttgtttttaaatcgtgcaatatacttttctgttttcatggccaaatgataatgggtgaaatcttagtttaatcagtgtcattaagaattaatactttggccaggcaccgtggttcacgcctgtaatcccaatgctttgggaggccgaggcaggcggatcatgaggtcaggagattgagaccattctggctaacacggtaaaatcccatctctactagaaataccaaaaaaattagccggacgtggtggtggacgcctgtagtcccagctactagggaggctgaggcaggagaatggcatgaactcaggaggcggagcttgccgggagccgagatggcgccactgcactccagcctgggcggagtgagactccgtctcaaaaaaaaaactaatactttatcctacctagcatgtaacctataaggtgatagtgtgtttctgatttgattttaattctattagaagaaaaatctagaaagatgctttcagagctgtgttaacatggaagttaacaaaatttgtttgggatctatatgattttatgaatttcgttgaggtgaaaatggagaagatcagcatgtaattaacagaaccagaaaataatataagtataatcttttttaaattgtgcttcagtctgttttttaacactgggtttcaactgggagttatatataagcataactcccattgaatgcatgtcttttgctatttcgttaaattagataaaatttggatttttgtttataacatcataaagtataaacatatactgttatggggtatttagcttatagggttggatattaaacccaggattcaaacctagataatctaaaaattcatgatttttttccccataacccagtagttaggtgctaaattgtaggttcttaatgagtagttgatgagtgaataaattaacgaattcttaagctgttttttctttcttccctaatataattgggtaatatatgtatacttctgggtctgcatttgatagttcagaaattggtaattaccatttccaccaattttcatcaaagtgcttttaataaggtttgtgaattaagaataaatgggatctaaagtggtagaagcatcctgggaagcacaacaagagtgagagcagcacattaacatgtaattgcttgtgctttacggtatcctactttacactttctttatagcaattg

SEQ ID NO: 129136 - DNA, 1042 bp, Homo sapiens
gtcacacactcttgataaaatgatgaaagattatcttgctgaaaaaataccattaattcaaaaatatacatacaacttattacattagaaattgatttccttcgtgtgtgtgtgtatatatattttaaagcactcttacaaagaatatacacctattcatataaaattacggccagaaagtacaaaaaggattgagcattaagtcactgcaatccctcccaggaccttgctgaattaataccatttaggtactaaaaggaatacacttagaatagcaatgagaggaggaaagggatgaggaggggtattgagaagccgacgacagccttcaatgaatttctagaagaccaagcagatgggagcatgttgacagataaaaaaaggtggaaagatttacagttcagaatgtgctaggagggagctagagaggagctgggagccggcctgttcatgggaatcccaggagaccctggcccagaattggcaggtacgatggatggtgagagtgagaggtggtactgaaaaacagagaaatgaattgaagtcctatacgtgggacagtttgcaccagttggcacaccagcctcctcccaccctgatgctcagaacagatgttgtcatctagattaaagccctcattctggcatttggaaagtcccacagtcttgacagccagctcttgccctaatgcaaatcctgacagttgaccctccagtattctgccccaccctaggtaggatttccacgcaggaaagagactgagctggaaagcagaggaaacctatataccaacttacccaatcttaaataagaaacaaggcaattgaatagaacaaatagcatgaaagtgaaaagaccaatgttaataaggttaaaaactgacttcagagaaataggttattcaaggaatagaaggaaattttacatacataaatactccactccaatttaagaaaatatcatctgcataaaagtaaggagatactatgaaaaaggaattgcaaaaacataaaatttagtagttggacaaaagaattaaagt

SEQ ID NO: 129137 - DNA, 1074 bp, Homo sapiens
gttattaatttaaaatgagatccatagggtgggtcctaatccactctgactggtgttcttataagaggaggaaattcggacccacataaggacaccagggacgagtgtgcattgagaaataaccatgtgaggacacagcaagaaggtggccatctgaaggccaaggagagaggccccaagagacaccagccctgccaacaccctgatcttgcactgctagcctccagaactgggagaaaattagtttctgttgtttgaactacctagtttgtgacattttattacagtagccttacaaactaatacattaccctttgtctaagaaagtagagtacacatatagttttgatttttcagttgaagaataaaccaaagagaaataaaaaactggctatagggagaagggaggagacaggagagaatgtgaatgcaagctagacttcgttaagtgtgtactgtttttcagttttgattgtgggaccatttaaatgttttacctgactatgaaacaaaactaaaactagtagaaagagaacaatctctaataagcgaaagcaaaatttgacaaattcttactatgtcaagttggtggcttaacttcattaagaattttttcaaacctagaaatttgaatataagtgggataaatctttttttttttgagatggagtcttgctctgtcacccaggctagagtgcagtggcgtgagctcggctcactgcaagctccgcctcccgggttcatgccattctcctgcctcggcctcccgagtagctaggaatacaggcacctgccaccacgcccggctaattttttattttttattttttagtagagactgggtttcaccatgttagccaggatggtctcgatctgctgacctcgtgatccgcccacctcggcctcccaaagtgctgggattacaggcgtgagccactgcgcctggccctataagggggataaatcttaaggacaaaaataactgcaaagaaattataaacagtatgaaacactcaatagaagcactgaatttagaataaagcaaataagcaatttttcccatcattaagaatc

SEQ ID NO: 129138 - DNA, 1015 bp, Homo sapiens
accagttaaaaggggttagggtcccttggtgaaatggctgctttcagatttacaacaacaaatttaataagtgagcctggttgggtctgtaccagagtacaaggaaggatgctaaaaaaaactactggtgtcatgttaacagacacaaatccatcttcaagggacttacactgaccagatatgatcatcagcattgcaaagcattgaagtacaatcatgaaataacacataagtttattacttttttttaattaatggacactttagaagcttgctaggatacccactcatttttctgataacaggaaaataaaatttgagctctatttcaggtaaacaaatagttgatgagggaaaagttgtttatagaagaatttcaggtaataaaagaaatgctcaacaaagctgcttaaaacgtttgataaaaggctgatgtgacatagtaacaatcaacagaggaaagaaacaccgtatagaatgggagaagatactgtaactacaaaccatacatctgataaggggttaatagccaaaatgtataagaaactcaaacagctcattagcaagaacacaccaatttaaaaatggtcaaaggtccagaatagacagttctcaaaagacatgcaaatggctaacatcactaatcatcagggaaatgcaaattaaaaccacaatgagatatcactggctattatcaagcagatgaaagattacaagtgttggagaggatatggagaaaagggaatcctttgtacactatcaataggaatgtaaattgctacagcctgttttgattggcaaagtcaactaaaaatatagaactgaatctctaaacaaaatgttttatttgggaaaacgtaattgcagtttggggcaaacacacagaccgaggtggtctttgatatgtcctaagaacgtagaaagttggggtttttagtagaaaaagaaatgttacatattatttagaaaaaaaactcactggccctaagcaaaattttggggagctggtaaactc

SEQ ID NO: 129139 - DNA, 2718 bp, Homo sapiens
ttgggtgtttgaaattttccataatcaaaagttaaaaatatagcagtatgagccctttatcagagagagggagctaactgcaagagctaaaagtggagccagcagataagtaagcaccaggggcaggcaagtgtgtgcttgatcaccgtaacctctcctatatggtgtgatttgttgccatgtccatgaattttttttttttttttttttttttttttgagacagagtctctctctgtcacccaggtggagtgcagtggctcgatctcagctcactgcagcctccgcctcccaggctcaagtgattctcctgcctcaggcttccctagtagctgggagtacatggcttaccaccacacccagctaatttttgtatttttggtagagacggggtttcgtcatgttgcccaggcttgtctcgaattcctgagctcaagcaacccacccacctcggcctcccaaagtgttgggattaagggcatgagccaccgtgctggcctgaattagtttttaaaaattttaaagctattctctgaaaataatttaaagaagtcttaattatgcaaataagacaaaagataaacatttacttctgcctcctgacctccttcactgtgtgagaagaggaatcagtgattttggagtaaacgaaattgctttagggacaatcccttcagttgttctttggcgattctaagccataatccaccctaaccatttattgatcaaatggcttcccccgggggttccaagcatatacaacttcttctgttattacactatcagcaaggcttttgtactgtggtgaattcagattttgataagtttgtggcctttgctgatgaaatcttctcatgactaagatcagctctgccagatgtattttcaggacagacagacaaacctgaggtgctttaattgttcttttttgggagaggtggggtggtaatatacttctcttggcccatgaccatgaaaaaacagaaatttagtctttcaatcatgttgagcaaattttatgtaagcttaactgtacttctttgaccattcattcattcattcattcgtatttgtggagtagccactgtgtgcttggcactgttgtagatccagggacataacttccaaaatcatgtgaagaggggatctttttttttttttttttccccatatatcagaagctattctggcgattataatctggtggcattgcccacagtgtattaactgaccacactgggtctatgccctacaataatactaataacataatttaatattaaaaattaaaagtatatgaagtaatggatatgttcattagcttgatttaatcattccacagtgcatacatatatcaaaatatggtgttgtatgccatacgtatattcaatttttgtcaattaaaacttttttttctatcttttaaaaagggtcactctgttgcccaggctggagtgcaatggtgcaatcataactcaccgccgcctcaacctcctgtgttcaagcagtcctcctgcctcagcctcctgaggagctaggactacatgtgtgtgccaccatgcctggctaaaaaaaataaagttgtcatgtttttcctcatattaactctcaagtaatggaaaagaatttgaaagaacaagatagcttttaccatgggtcaggccctacattaaccagctctatcacatgtcaactcatttaatattccccacagctttatgtggagtgtgctgttgtgatttctgttttgcagaggagaatgaggtacagaaagttgacttgcccagggttataaaacagttaagtaacagagtcaagactttaacccaaagtatctgccaccagaggccattttttttatttatttattttttgcaacttatctgtgagccccaagttaagatttttcttttctcttggctttcaggttcattgaccaagccagcatttccccaactgttccacggaatgtcaacagatgttccatgaaaaaaatatttactggaaaaatatttaacccagcattttcctaatgtgtatagagattatttatactgtggacttctcatagaatttcatgttaaatgtacactgtaaatcaccaggaggaacattcatcttgtacagttctaaaattatttttccgtggaatgttttgttttcacaggatatctatagatttctcaaggagcacatagttttgtgccatttctgtactcttgaatctcaccattagtttcacctatatattctgtgctgtcacccaaatgacctttcttaaatttaagatcaaacgttgacactctcgaagtcaccatgcagtgagccttcattgctttcattcaagtcactggcaagggctctgctcctgccactcctgcatggatccacgggccgggccatgtcttgctgcatgcagccctgcacctgtgctgtgctgtctcactttgagttcatgcacatggcattcccttctctttgaagagcctttctgcatcgcccccatagtaggccaaaacagcccttgcttgtttgagatttgacttagacattacattttccgtggagccgatcttgaacacctcctacaggccaggtgcccaccttcacagttcacacagccagtcatggtgcgtgtgtatggtcactcctttactttacaccagcagctccttgaagaatacatcctctttgcttccagatcccacacctggcaagt

SEQ ID NO: 129140 - DNA, 3947 bp, Homo sapiens
taaaatacctaaagcattttttgtctgtaaccagtggtatcacctgctacatgggtttaaagcaattcagctccttgcttcctttatcttctctatctctttctctttttcctttcctctctccctatatcttctttaccttccttctctagtatgttggattttatgcgaaatacatatctttttgtttgtttgtttgttttttgagatggagtctcactctgtcgcccagcctggagtgcagtggctcaatcttggctcactgcaacctccacctcctgggtaccagcaattctcctgcttcagcctcccaggtagctgggactacaagcacgcgccaccatgcctggctaattttgtatttttagtagagacggggtttcaccatgttggccaggctggtctcaaactcctgacctcaggtaatccacctgcctcggcctcccaaagtgctgggattacaggcgtgagccactgtgctcggccataaatatcaatttttaaagctgtctaaagagcccaactaacattggttggcactgagtgggcactgacctgtttaatctctagctttaagtgacatgattttaagtaccttaatcatggatatatttttaaatggaaacattgtttttttagacttttggctcaacttatgttttatactttttttagtttttattttatttaaaacactttattcatttgactggccacttaaaaatatcatctgaggtatcaaaaaagattgcatctaatagttagttctaagatttagaactcataaagcctgaactcatgtgggctgtgttacttaccaatctgatgatggtttttccacctctgatgtgccagaaatacatgaaagcctacccacacgtgtcttcctggaggatatttagtcaaaggctgaggaattaagggtcgatttttataatattgaaacaaacctggttctgtttcggagtacagtgcactttatagtaatttttaacaaagggcatgagacctgagtgtcttcaggcatgctgttttagctcataagtcctcaaataccccagaattccaaattttccctcccctgtttcggaggatacattggtagaaagtttcagaagcataatgttgcccatttgcagtcattcattttcagggaaatgggaaatgtcactgcctcatactcatggaccttgtagcacgggaagggtgttagaatggaggaagctgtttcagatgctgttctcattttcatggtttgaggttatatgctttattaattcatgcgttgaatacctattttcttaacctgtggatcgttggagaactaaaagaggaggaggaggatgacagaagggcaagcacagtgtaacatttgtgggtcttgtgaatgcttaaaacacaaaaacaaaacaggtcacctgattatttaataaatgtaaagttcattcccattgttactttttaattagatttaaacctatttacatgcccataggttatttcagttcaaatggcaaactggaagaagtgaagactcctaaaaatccagtgaaaagaaaggatcttttgcgtcatgacccagatttgcatatgcatcaaggctatgataaatatgatgtctctgaattctgctcttatataaaaagttcctcatcgcttggcaatgctacttctgatgaagatccaaatacaaatataatgaacattaatgaaaataaaaatattccaaaagcaaaaaataagtcagaaagtgaaaatgaaccaaaagctggaactgacagtcctgtttcttgtgcttctgtaactgaagaacgtgtggcatcagatagtcccaaacctgctctgaccctgcagcagggtcaagaattttctgctggtggtcaaaatgcagaaaacctttgtcagttctttaaaatttcaccagatttaaacataaagtgtgaaagaaaggatgacttcttaggagctgcagaaggaaaactgcaatgcaatcgtttaatgcctaattcacaaaaagactgtcattgtttaggagatgtcttaattgaaaatacgaaagaatctaaaagccagagtgaggatttgggaagaaaacccatggaaagtagcagtgttgtgagttgcagagacaggaaagatagaagacgttccatgtgttattctgatggtcgaagtttacatttggaaaaaaatggaaatcacacaccatcctccagtgtgggcagctctgtagaaattagtttagaaaattctgaactgtttaaagatttgtctgatgccattgagcaaacctttcagaggagaaatagtgaaaccaaagtgcgacgtagcacgaggctacagaaggatttagaaaacgaaggtcttgtatggatttcacttccacttccttccacttcccaaaaagccaaaagaagaacaatatgtacatttgacagcagtggatttgaaagtatgtctcccataaaagaaactgtgtcctccagacaaaaaccgcagatggcacctcccgtctcagatccagaaaacagccagggccctgctgctggttcttccgatgaacctggtaagaggaggaagagcttttgtatatctacacttgcaaatactaaagccacttcccagttcaaaggctaccggagaagatcctctcttaatgggaagggagagagctctctgactgccttggaaaggattgaacataatggagaaagaaagcagtaattgacatttcctgcagagtctgtggcaagagggaaagtaaccatctatgctgaaatgatctgtctagttcccattctctgttcaacctcagtgtttcaaaagttcctaataaataaactcatttgagttgaacctacttttatgtagaaataaataagtttcttcatcattcagatagaaaacattctattaaatatattcttcttccgccagagagtaaatgctttattactactttgctaaaaaggttatttttaggcacaagaagacatctctcaatttttagacttttttttagcatatatatttttaagtacatatttaccactgaagtcttagactctgttgttagaagcatcttttagaattggctgattttatctggataagaggtttgtttttttgtttgtttgtttttcttttttttccccacaaaagataaattgatagaattaatggaactttatgaaaattgaaggaaatataaacttgaagacttaaagcgggtaagatatgtatttttctttagaaaaaaaaaacctggctataaattttaactaacaaaagttgaaattataaaacttgttttccttttggttaaatttaagagaagacttgatgacttgttttatctgtctcaaatgagatttttattttaatagtttaaatcctaaacaagaaatttcagaaaattatttcagtaaccacaatcttataaattcatcattataaatgaatatataatttagaaataactctgatgtgaaactattcattcctttaaacaagattcctttatattttgttgtgtgttggggggaggaattttttattttttattttttatttttggtgaaaatatagctcagttaaagactgggctctcagattattctaattagtcacaggcagtttgggacttaattcatggttttccattaaaagttttgaaaaccaaaaactcactgataaaattagtttactaacctgaagtgtggcagtaggtcactgattttttaacactgagttttccagcggttctttttttttttttttttttttaataatatctggcacttgacttggtttctctagcttttgcaacatctcctatggctgttttggtgatagcagtttgaaaaactaaattgctatatatctggaatttatgaatgcacataaatcattatatcattaaacaattgtctttgaaatcctttaaa

SEQ ID NO: 129141 - DNA, 1189 bp, Homo sapiens
cgctgggaatgaagattgcagaagtattccctgactcaaacctgaaaaacctggtgttagtcttgggtgatttccagtgaccctctgcctcccttcttcctgccccctgtgtagatttggaaccgggcagccatttttgtttttggaagggaaaggagacagatataatgaatggcttttattgtgcaatatttcagactctcttgaatgcattcgaagggatggaaactgttctgccctatgtcatagccaaaacaaacaaaacatattccctaaacctggatatgtgtttctctcaaactggctgtagttaagagttcagctctcaagcaagaattcggtttgacaatttttagcccttgttcaactgagtattcggataggtcacagccaaagcaaatactatggggaaaaattaatgcacatatttacagcttgcaggtggcattctttctaaaaagttggagatttgtcttaagaaattgcatttgtggtaatacttttaaatagactactttttgcaaatattttttaaatgaactctgataatagtaactccaaatgtaaataaattctacagaggtccccaaagagtgataaatgcttgaatttaagtatttaaacatttagagaccactaagaatctgagaattctagaaatatcagacccagcgaatatgcaccaaaacccccttgacagtagccttctaccgtccctaaggcctccactgtaggaagcatcaatggctcctttctgatgcaacccccagcattgtttactgactccaacccccctcacttaggctgttaagtgttccctgctttggatctgcggggagaacatattctacaccatcaagatgattcattttgtaatgtgccattgtgcttcatgaccctgacaaaatatatttattattggtcacaataataactttgaatttatggttgcctataaccagctggctctcggtttgtgtcttaaccaagaaatacgggaaacaaattgtaagccaggcagcctgcctcgcataatggtagcaaagacttcaccgttggtcatccctttgaaacataaaattctagccttcattgaagttttgctgaacaatattagacacctgtgtgagtggaaataactggaaattctgttggctgctacttttccatctaataaacagcagatgaa

SEQ ID NO: 129142 - DNA, 1058 bp, Homo sapiens
ggagcattctcacaatgtcagccagtctcagcgttgtcttgtcttataaatctccaatgggaatattagcacagctccccagctcactgaaatctattcctctgtcctaataaaagccctgcagtggctccaaccaggcccctgagtcagcctccgggaggccagctccttttctgaggtgtgcaggtgaggaaatggaaagcccctcttggactctagtcaggggagatgcaacgattgaggaaattggatgaagggtacacggggcctctgctgtttttgcaacttcctgtgaatccatcattatttcaaaatcagttttaaaaagtaatgtgcttaaaaccacaaaagtgtgagcctcagttacttcatctgtaaaatgggaatattagtaatgcctcctttatgggacctctatgaaaataacacagatattctgtatttgttttcatcagaccagcatcctatgccttgctcacctattcccttgatcacagggtacctattcccttgatcacagggtaaccaaaagatgaaaaatattccattgtattgttcatccgcagtgtcgtcactgcagcaggtgttcttccacatgccctcattttatgtgacttcattatcacacccacattactgataaggagctgagacttgtttttttaagagacagggtctcactctgttccccaggctggagtgcagtggcaggatcatagctcactgtagccttaaactcctggactcaaatgttcctcctacctcagcctctcaggtaactaggactacaggcatgtgccaccatacccagctagcttttttaaatttttggtagagatgggggtcttgctatgttgcccaggctgatctcaaactgctgccctctaacaattctcctgcctcagccttccaaaatgggactaaaggcattagtcactatacccagctggaagctgagacttttaagaggtcatgtgacctgcccaaagtctcagagctggtcagtggctgagctggaattaggagtctctcttcccctcaagttgattcttctttga

SEQ ID NO: 129143 - DNA, 1048 bp, Homo sapiens
cattattaagagttggcacattttctttcttgtttctttttttagatgtgtcacagatcaatgtttgtttttttgttttttgttttttttttttttttgagacggagtctcgttctgttgcccaggctggggtgcattcacagatcaatattttaattacccattctgtttgactagagatttcatgttgtttcttatttacttgggaaagtcatgaagatttctattatgcctctgattttccacttatgaaacaattattagaaaacctgccttgaatatatataaaagacacgttattatgaccaaataaaatgaacacggcccacgattctgtctctcctcaaggagaaagaaatgtttttctttcatttcataaatatggcaaccacgtttagaaggtggtgaggagggtgggtgttcgtaattcctgaaagacaccaggaaattctgtctgcccctcaaagctgatgcccactttggggaaacatccccagatggccaacctgttgctcttcccccaacccagcactgaaggtgttaatcccccatctcaccttctctgtgtcccaaggctggagatgtgagtgactagggaaacccccagtaaattaaaggtggtagtctctctgaggagggagaggtagcttgttcagctttataagccttttagctagcatcctttatcactgattgatttattggatatttatgcagcaggcagggggatttgaaatataacataggcgcttcctgagatgtcagtactctaatgttagtggtctgaacaaggatgtaattcatatctgcaggtgcttactctagtatcaaatacttcaataacatcatgcctgtggaatccgctgttcccaagggccctatgtgtattctgatatgcccgtgtcttttcctatgtgtgttttcctttcttaaggagcgctcatttccttcaataggatatgttttatttcatcccttttcctgcatttactcatattaatgtcaccgcgttcactggtaatagctgggcctggatctaacccgcata

SEQ ID NO: 129144 - DNA, 1036 bp, Homo sapiens
gacctgcaggaaaaaaaaataaaggcggggggcaaggtggggaggtgggagaagatccaccaggctcccgagcgggagggacaaatctgcacgcacccccaccccgccccacccacgcctcaccccaagctcgccggcacaccccacccccacccccgccacggcgccagccccgttctccaagcccagtgactctcaccgtgaccacttgcctcccgggagccctccccgcccccaccccacccctctggaccctactccctcaaacccgaggggcgccctgtggctctgcgcgaggcgcgggcggtcgctagggggtgatggagggaggaataaggaagcggtgccttgtcagggggcgagggggatttctcctttacctgccatgttgcgctgcaaatggtgaccctgctgggttcctcggggtctccgcttcctgaactcacccccctcacctggggatgggggggtagagagggcggatggcggcggatggcacctgcggggggaggggacgggggccggggggaaaaggaaggaggggcgggcagaccagccggcaggatgctagatttcactctggggcttccccgctcgtgctctttctccggcagcggcggcggcgactacgacagcgacggcggcggcggcagcggcaggggcaggcgactccactttcaaaatggcgccggctggcctggccagtgacgtcacctagggggcggagccgccgggctggggcggagagcggagggggaggggcgggggagcggccgggcggctcttggccacgcccccttcctgctgcgcctgtgccccgccctccgtgtcccggccggcagggcctgcgccgcgccagcgtctcgccatggcataccctctgtccgcaccgcctgcgccaggccgcggctgtgtgcacctagcagtgtcccagcctcgagcactagcgccggggctctggggcgggcttaggagtccagtttacgtgctctcctgcaaggattcatggggtcctatgtcttctaggaatacctgg

SEQ ID NO: 129145 - DNA, 5349 bp, Homo sapiens
ccgcccctccttccttttccccccggcccccgtcccctccccccgcaggtgccatccgccgccatccgccctctctacccccccatccccaggtgaggggggtgagttcaggaagcggagaccccgaggaacccagcagggtcaccatttgcagcgcaacatggcaggtaaaggagaaatccccctcgccccctgacaaggcaccgcttccttattcctccctccatcaccccctagcgaccgcccgcgcctcgcgcagagccacagggcgcccctcgggtttgagggagtagggtccagaggggtggggtgggggcggggagggctcccgggaggcaagtggtcacggtgagagtcactgggcttggagaacggggctggcgccgtggcgggggtgggggtggggtgtgccggcgagcttggggtgaggcgtgggtggggcggggtgggggtgcgtgcagatttgtccctcccgctcgggagcctggtggatcttctcccacctccccaccttgccccccgcctttatttttttttcctgcaggtcttcatttaatttctatttttccccctgctgcaagccttcttgggtgtatatacacatttattttgcctcgagaaggaagagcgccttataagttaaaatacagtgggggcatatgtgtattttttccccactgtagatgccaatatttttgagactggaagcctaaattttttgtttcgaaccatttcgtttccgtttcttcccttttaccgccgaagagtgcaaggcctttcatgtacagcaagttgcatgaaaataatttaaactttgcgtttagcatgttagcttttttgcagatgtccttttcccaaaagggtttggtagagttagttaaaatagttgcggagttcagagatataaatagcaaggaggagagagatttaggtagaagctttgaaggggaggggaaaggatgtagagagaaaaccagtttggaaataaatttagcaaggaataggggtgatgggggagagagaagtaatgtaattgctttgagaattctttttgtacatgttggtattgctaaatcttttccttcatgtagtagaatcagttgcagatttagattcagtttctttctccctagagccccaggacattttcaatcatttcgacctcagtacttgcacgtgaaatagaaacattccgagatgagaccagttttccgtgctgtattcattatttagataattaaaccttttgaaaaagttaacatgtcggattgacttacggtttgctataaacaagttgcttgttggccttgttgaaaaatgaaatgagattaaaattgttttgcacgagatgacattagcaaaatgaattctttgccaggtcctttggagtcaagggatgaggtgaagggaggcagaacaagcttcctttgacagtctctttagcagcattcatttcggtttcttttcctctctgtctggagccagtgatttgctggtaatgaatgcaaagaaatgggtgtagtgtttgctgtgtgtgcactttggtgataaggttcatatgaatcattactccttacccaggcagtaatgttcccgaagttttctcttcgttctatgtttcatggtagtttaaccttattaactcttctgcaggctttttgtacacttaagaaaactctttaactcttggtatttactttttttctggtaggtcttgcctgaatgtaaggcttttactgtatttgacaggaagtttgtgaacagatgtttaatgaccacagaacatgtgcctttaaatatttcgtacctggaatcttttttttctttctaatgcagtaccaagtattggggactaacctctttccaaactggtgctcttggtggtagttgtatgtgtgggcagaactaggctgttagtatcatgccaaccatggataccatctttgtgtttacgagagtcaacataagcagaactcggttttaattggtatgttttctttttccaggagctggaggagggaatgatattcagtggtgtttttctcaggtgaaaggagcagtagatgatgatgtagcagaaggtaagaaagcgtttaatgcaaaatttggatatataatttttgcagaaatgtttcctactggaggatttccttgaagccgagactgctataaattcaagatgattttgttgtccaagaaatgtaagaacagttttaaaagatacctttctgaaaaacagccttaaatttcatttgttatttacgccttgtttttattattttttcctctgaatttacatggaaggagcggtagatgatgagacatataagatcctcacatgaaagctctgagctccatataagggtttctttgttatgtaaattccacatacaaataaatggtgatgcatttttatgtttgtacattggttttagataagtaaattgaaataggtgccatcaacatttggctcagaaacattcttaacggcatctttgatttttatgggaagattttttaactacttttgaatttgtccactttgggagtgtgatgctgcttggcatattctgtgaagagatgatagctcagattattcattttgttgtctttctggtatttaggtggataagacagtaacaatgctatgcatatatcgcttgtcttttaggaatcgtatattcttgtgcaggtagaaactgtgtttgatcagttgaagtacttacgtctaattttctccccaaatttattttctaacgtgtttcagaagtttaagttttgaaacttcaaggttttgcattcatttgagatggtcttaggcagcggaggcattttccacaaagttgttgcattgtttcattcctgagaaatgttgaagtttgagttttaatggtattgtgtgtcttgaattacagtaggaattttccaaacaaaactcagataaatttaaacatgtacttgtgagttttaaaaatttggtgaaaattcataaaccttttttccctagattgtgttgtcctcatatttctgacctgtctgtagggtactgtttgttctggagattttttttcaggtggtgggtggtagccgaactctcttatttgcttgtgtcagtgtcatccttaattgtctgttttagagtgtggtgaatcctatggcaagccaactggtgtagattatacttgtcatattttgcagagctctctcacgttccttttctattggatcctcatctgtttcttagatgagaaaccagaaacaaaagagactgactgatggtcatgcacatagtgtaaatcaaggttttctgatgaagtcagtggtgtttgacttgttcagagaagtaagtcctgacttcaagggaggagttgtgtattactcatgttgtaactacattacctgttgaatagtaaacactccagtattggatcattagttctgtgcagttgtgtaatactcaccaagttatgaaagtgctgtatacttggaaaatgttctttggttgaattccatttattcccttaggaaagttcccctaaatgctgagcactgagggtacttggtgtctggaacataaactctgcccacaaggagctcatagtttgcttgttaaacattacgcagaaagatcacatggcttttatttaatcagaagaaattgatagttcaaagtgaacatcatttacctacctgaaccaaataacttgtgatatacattaagtcctcccttaatgtataggttctgtcaataatgtaatgtcaataggttctgtgactttaagcaaagaaagcaacttataacaaaaccattttttatccataccataacaaaagatgctgagcagaaaacaaagtcaaagttttcaagaacctattgacgtgaagttaggagataaatcagttatagttcccctttgctgatacttagtagctgcatttttctactgattggttaaataattttctttagaggttgttaaatattttaacgtaagcatattcttagcatcgtaaaatgctgatacttggtatatacattttagtaagataacatatcttagtaaaaatatgactagttctaataggtattgctgtacaaatgtattaagtataaaaataatccagttttcaaatgacactgctttaatttggatatttctgcatactagagtttgcatattatagtcttgcttatttgactaaggggagatttgcttttctgaagtaaaataaggttattaacacattccccacccccctacctttagactgatctcttcaacaggttacatgtagctcaacttttacttgcctgttttctgttaatgatacattttgattgtctccatattgcctgcctttctcccgtctacatgcagtcagctgccagggcataccatttttactctgtaatgccttaatcttctttgcatacctgctttcacctctattcaggtttgcactctccctcatccagattgcagtaagttcctaaattattccctgcttcttcgtcctgttttgcttcaaagttaatcttaaatgcagtcccagttttgtcattttcctcataagtctacaagtggatcactgtatccactggattaggaattaagttcaaacatctcagtctagaatgtatgacctttgcccaatatggcctctgctctcagtttatttgctgctatggctaatgacccagctaaacagatactgttcttaaaaggcgttctatgctctctcactttagggtctttgtttttgctgcttccaccttggaatgcctgacaatcatcccacagttctcttaccaggatcctgctcatctctcaagtcacgcctttaacctttttgctaatttcctcttttggaaataacctatttttaaagtcttcctttatagcactttgttacgtagatatcatatggtaccccacatctctactgttacatactacagagtttagtgtaggactgatttatcttcgtaccttatgcaggcatgaagctgctctgtctagaacagtgcctggcacacagtagttgaatatttgtttgaatgaaggaacgtaaatgttattgttcttaggttttgaaaggggaagagaaatggtaaaaggcaggatgattgagatgtagttctagcagtcatggatttatttacttggtaggctttttaaaataaaaatttaaaacgctttctgcagaatcatcggtaggctttttataaccagattgatgttatacaaccgtataatgcaaagaaatcaggagaccttgggtttttaccctagctccagcacaaactagtgtatgtcactggggataagtactctcctgggttcctgt

SEQ ID NO: 129146 - DNA, 1087 bp, Homo sapiens
atttctgctcttccttgtactttaatcttgttaatttccaaaggcatgtaaaaacagcccaaattcttttggtgtgtgtgtgtgtgtgagacagagtctcactctgttaggctggagtgcagtggcacgatctcgactcactgcatcctcagcctcccgggttcaagtgattctcctgcctcagcctcttgagaagctgggactacaggtgcaccccgccatgtccggctcatttttgtatttttattagagatggttttgccatgttggccaggcttgttttgaactcctgacctcaagtgatccacctgcctcggcctcccaaagtgctgagattacaggtgtgagccaccggccacaaaattattactactggtaattaatactactggtaagctagattgtttgagataccgtactctctagaggccttaaataaaaaataaattattgctagtaatatattttacatttttaatttttcttttattgaaaactgtctgtcatgagacagtaggttaagagcacagactcaggtgctaggctacatggtttgaatcttgctcagtcatttatcatttctgtggtcatctctttgtgcctagctcccctctataaaatgaggataacaataaaacctgtcttacagtgttgttttgatgattaaatgagtttatacacataaaacagaacagtacccagcagaaaagagccttatgaggatttagatattattacttgaaccttcatattattgttactttgaaggaagagtctttggagtatgagtatattgaggatttgtctttaaagcctactaaaaatttctcaaagtgaaggaaatagcatatatgtgtgttatacatactctttgattccactagtaaattacaaaatacattcaaaattaagctataggtttagaggcacatatgcagctggtaaaactatgaagaaaagctatgaagtaaaaggaaaaaaacatactgtaaaaagtactataaaagtcagtatagtggctacccttaagctgttggaaaggagttgtgatcgggaagggctggggaggcccttgtgggctatcttg

SEQ ID NO: 129147 - DNA, 1039 bp, Homo sapiens
ttaaaaattcaaatacatgtggataatctgaagtgtgtaataattggtcaaaataatagaacaggccaggtgcagtggctcacgcctgtaatcccagcactttgggaggccaggcgagaggatctcttgaatccaggagtctgagaccagcctggacaacatagtgagaccttttctctacaaaaattaaaaatattagcagggcatggcagtgtgcaactgtagtcccagctactaaggaggctgagacttgagcctgagaggtctgctacagttaggctgtgattgtgccactggtctccagcctggacaatagagtaagactctgtttcaaaaaaaaaaaaggaacaacttaaccattcaagatagttattttaattattttaatgtagatttttcattgtttagtaatcttaaaatatcagatgttattaaatatttaataatgaacctcatctgcatatttgatagtcttaaactttcacaggaaattattttaggatattatcttataaagtcttattttatgaaacttggatccaagtacattgtgtgttttcaactctttgctttctgtttacttttggtaggatttagccttgtggactgggtcttgaaaaaatattttttaaatggtagaggctaaaatatgccccaaataaggacataagtaaaaatttgaaaaacagtccatattatgatatctcacacaatttaatggttttagtccattccatatgtttaatgctataatgtaaacaatttaaaatcatttctcttctgcatctcttttttttttttttgttagagacaaggtcttgctgtgttgcccaggccgtcttctgtgtttcttagagtagtatgcatgttagatttaggcagtaaggtaagttagtagaaaaagtagaaccctgttgttttgtggatttaaaaatagtggcacattagctgtattccgaaacctaatgacctatggtaaaggtcttatttaatatccttaccttgtatgacatgtgacacttctttttcttaacactag

SEQ ID NO: 129148 - DNA, 1967 bp, Homo sapiens
gaactgcaactcctgtttataacaaggtttatttgtaatgcctagtagatactttttattttgaagtaattaaatataatttggagatttgttgaattttcagctaatgccattcttttttttttcctttttcttttttttgttttttttttttgagacggggtcttgctctgtcatcctggctggagtgcaatggcgtgatcatggctcactgcagcctcaacctcccaggctcaagcgatcctcctgccccagcctcctgagtagctgggactacaggcacaggccaccacgcccggctagtttttaaaaatttttttttgtagagacagatctcaccatgttgcccaggctggtctgctgatggcgttcgttagctgagatgtgctatatatagatgggttataagggctttgtgaaccctctgatgatgtgtgtgaaattgtgtgtgattgtacatatgtgcatttctctggtcggagtccgtagctgccatcaaaattgatatcatttagtccagtggttctctaaatgtcgtctggcaacccctgaactcattccaaatgtctgtgaagtaaaaactattttcacagtagtactcaggtgatacttgcctttttcaatacattgactttgcagcagtgctgcagaagccatcttagcatgagatcaagacagtagcacaaaagagtacctgtagaggtaatcttcattaccatgtactagcagtttaaaaaaccatcagttttaagaatgtccttgaagcagtgaaaacttaatttgattaaatttctacttgaacacatgtctattaaacgttctgcatgacagaatggaaggtatacctagagaaagaacttctgcaagggggtaaagtggttgtctggaggaacagcattggtgcagctgttttgagtttcaactgcagttttcatggaacatcacttttatttgaagtaactgatgaactatagttattcagacttggatatttggtggacattttctcaaaagaacagtgaaactgatacttcagtgtacagtgtttgttgcccatgatgaaatttgagctttcaagcaaaaattagaattttggaaaacacgtctctgccattgtgagcttgacagcctcccaatacttaaaatattttttcaaataaaatcagtagtcatattaacgaatgtgattttttgatactatgtaatgtgttaacatttggaagatctgtataactcagtaaatcagtcttttacgggtgaccgatgcatgtgatgttaaacagtcatacatcagtaaaagtgcgtgctagagcattgaattttaatgtgacagactaccgatatgttttgagattccacaaaccttcaagaatccaccactgtggaattttggtgtagtatcaaaggtatatccataactacctgaaacacctattaaaatattcctccctttctaactacatatctgagtgaggctggattttcttcatatatttaactgacagaatatattgtggtgcagtacattgaatacagaagcaattaagagaatcttcattctgttaggccagattaaattaaagagatttgcagcagtgtaaagcaatgtcattaattttgttggtggggagggggatgtagtcatttttcataacatttttgttaatgtgtgaggtttattactattttacaatgaagaaatattttaaagtttaaaaggtctttgatggtctaagattttaagagttaaggggatcctgtcattcagaaaatttgagttgttggtttagtctgttcatagatttcattttagtaataatgctttacaagtctcatgaaccacaaggtaagtgatcagaatagtgtactgcttttgtggatgaatgtcttaaaaaattgcctacgaaagtagtttctgtgacttgaaattgtttcagtctcctccctccctgttcttttagatacca

SEQ ID NO: 129149 - DNA, 1164 bp, Homo sapiens
tttttccagttcacagggtctgtggaccggtgatctggtttaagaacttctgctctaatcttgagttatgcctgtgtttacacacttactgaaacttctgtgctggattctaaatttggaagaatcaaggatatttgtgtggtaataatggtgtttagactatttaggagggtattttttcttaccggtcctcttattactttttcctgagataatatgggagggattaatcatctgtaaaataccagacttgacagatttagtgtgttcccatcttttttttttttcctttattaaaaactgtctctcatgggtaaaaacattagaaggatatattggattttgaaccagttgcttattttatactttaatcagaaggaaatttaagtttttcagtagcttgtattaagagagaaatcagagtaggtaaaagggattgggggcaaaattttaaaaattttctaaagatccagaagaacatggttagatctggagcagtgttacttttcaaacctgccattgcaggctcattgtaggtctgtctgctctgtatgaaagtagaaatagtacctttttggtgttaccctgcgtgtctgttttttcctgcttaccacaaggtaagattcttaagggtggatgactttctaagggaacaaaagaggaatctttccttttggctaatagagtgggaaggctctaattcaagagaaacaggctattgtaggcaataaatagttctgaccaaatttcttatcaaggcatgcaacatgcaaaaatgtttgttaaaggaattggtagtagcaaaggcattgcttgttctgtctttcttctccttgacataaaatgagcattatttttttttctagcaacagaaccaatttttaatgaaaatttttagctacctaatgtttttatgcatattatagaaaacatataacattaaatttaccatcttaaccattttcaaatacactgttcagtagtgttaactctattcatattgtgaaacagatcctcagaactttttcgtcttgcaaaactgaaactctatacccgttaaataactcccttcttcccctcccctcagctcttggcagctaccattctactttctgtttctgtaaatttgactgctttagattcctcctccaagtggaatcatac

SEQ ID NO: 129150 - DNA, 1088 bp, Homo sapiens
ttgtaaagatcatgatgaacatccttgtgagaatcttattgctttaggatatattatctggaaatgggattgctgggtcgaaaggtgtgattttttttttcctttttttttttttaatggcttatggtatttattgccaaatcaccatagaaagttggtgttgatttttcacttcctccaatagtgaatgggagtggccatttcctgacctcttgacaatacctggcacaatattcaccattcagaaaaatcttttccagttatttgtttgagcacgttcaaatgttggagcctttttgtgttctttgtctagttttctttggtgatgcttttttaaatttatttgtagtatcacagcccttttccccttctgaatcatacattgtagtggaggaatgttggagggaagctcaaagaaataatttgggtctgtattacatgggaaagacttcctaaatgaagtggatttttttcctttttcttttttcttttttgttcaagcaaaggaaaccagagagtaaggaaacaaacatttgagaattgctgtgttttagttttcttatctgtaaatgggaataatagtacttgtctttttatttagaggattaaatatacatgaatgcttagttttggcacatagtaagcctcagaacatttaattgatgtagttatttttctatctgatacccaattaacagaattaacagttgatagcagaagaataaaagcctattccggtccacaaattgagatcaactagtttttgaggttttgggcacattttaggcacttccaataaatatacgttacattaatgactaacatttcagcttggttgagttaggcatttggtaaaactagggagagattagtttcccagcttcatcagaattgggattagtttagggtctggcactttgactattaatttgactaatttaaaattattgtgctgagccgggcacggtggtgcaagcatgtaatcccagttaattgggaggctgaggtgagaggagcacttgaagccacgagttcaaagctgttgtgcacagtgatcatgcctgtgaacaaccactgcactccagtct

SEQ ID NO: 129151 - DNA, 2020 bp, Homo sapiens
cctgtgttggttatatcctgtacagccatatgtggtagacgttatgtgggtgtcaactctcttgttctcttgagtattcatcagcagaagacgaaaaagcagaatcctggttatttggcaaactctacatgttgtactccaaggtgtcagatcagcaaatacgttgctgcctgattcagttttggttgattcttcccctccgatatcattaatattctcaggagatagagtgaataagctattgggagagggtaaaagagatacatgatgtagggaacgtttttttaattgttaaaccagaagtgggtattttggtttgtgagttaaaatactgctggtattctaacttacgattagtctttaagtattatgtatattccacagtgccaggtgcccactgctgggcatgcagttgtaggtacttctttataactctggctagtttatcctgtctgtgcaattagttcatactgctgagcagctgtgtctccctgccttttacaattgtaggtatattgttagtgttgctgtgctcactaagttttgtgatgttttaaacggaaccaagtttggtggtattattattatttttttaaaagaaagcagttacttaaattaacatggtagaaaatatcctggggattgatggtgtagattaaaaatctttgttttatccaacaatagaattgaattatatggctaggaacaccagcaagcacttcctgtcacagttatcgaaacagtcttttaaagaatgtctagagggccttacttaaacaaatagcttgtcttgactttgggaggaggatggttacctaagcccatgtgttaaaacagacagatgacacactgaaatgaccaacgagcataataaggagaattcagtatccttggaaaccctggaacggtgccataactaaactaaaaaaattttagcaggaaacagtacaaacaagaaacatcgtgagagaaggccttagtgttcatttctgtggttgtgaagcgctagtaggagtaagtgacaggacctactttgaatagccagagttagaattgaagggggagccactggacaattggttcatgtattctgtactttgaaactgggattgaaaactaaatggctcttaccaagagaaatgtgaccagagaaatgtgacctgagagagaagcacaaagttgaaactctgcccccaggctgccttctttgtcaggcagccgcttaaggtggccccagtgatccctggcttctggtatttatgtctctgtgtaaccttgtccctttgagtgtttctggacctctcgtgacttgcttccacaagtggggcaagatgctgggatgctgcttcagaggttaggttacagaaaggttttggcatccatgttgggctgccctatttcacttgctgagggaagccagctaccatgtttgtgtggttccctgtggagctcacatgtcaaggatctgttgtctctggccaacagctggcgacctgacacctgtcagcagccaggcgcacgagcttggaagtagatctcctcctccagtcaggctttcggatacctgcaactttgtgagagaccttgaacgcaaggccccctggctaagtcacacctagattcctgacctgttatgagataataagtgtttgttgttttaagctgctacctttgggacaatttttaaggcagcaatagagaacttatataggaagtaacaatgtcaacatttcccctcctcggtctaagatttgaacttggttctaatgtgttttctggttgaacccaacacagtacccaatattacataaacacaggcccttttctttaaagatacatacagagaatgatagacacatccagattcagtaggtactgtaaaagaagttgaccagtatgagcagtaacttcctatgaaatagacttagtgcaggaaacaagagaaactgttgaagtttaaagagcagctaattagttgctctgggagactgatgagaatttgaaagaatcagagagcagg

SEQ ID NO: 129152 - DNA, 2023 bp, Homo sapiens
gatgcaactttgtactgtggacttttgagttaatgctgaaatgagttaagacgttgggggactgttgggaaggcatgattggttttaaaatgtgaggacatgagatttggaggggttggggcagaatgataaatggttttgctgtgtccccattcaaatctcaacttgaattgtatctcccagaattcccacatgttgttgtgggtggacccatgggggggtaattgaatcatgggggctggtctttgctgtgctattctcgtgatagtaagtctcatgagatttgatgggtttgtcaggtgtttccacttttgcttcttcctcatttttctcttgccgccgccatgtaagaggtaactttcacctcccgtcatgattctgaggccttcccagccatgtggaactgtaagttaaattaaacctctttttcttcccaatcttgggtatgtctttatcagcggcgtgaaaacggactaatacagttgtattccctgtttagatgctgttaaataatatttcatgtaagataagtatctgcctattaatgatattaggtgcattcagctgcataagtacctgaacattattcttggctttcatctgtagctgtccacactttatcaattatcaagccttgttttatgtactttggaaatgtatcttaaagtttgttcacttatgacccctctttggccttggtactttaatttcttcatttgttaaatgggtatattgatacagccaacttaatagttttgttgtgatgattaaatacctaacatagagtatgtaaactttacttatttttatttattttttattattttttgagatagggcctcaccctgtcacccaggctggagtgtggtggcgtgagatcttggctcacagcagtctcagcctactgggctcaagccatcctctcatctcagccccacaagtaactgagactacaggtgtgcgctgccatgcctggctaatattttgtattttttgtagagacgggttttcgccatgttgcccaggctggtcttgaacttctgagctcaagtgatcctcccactttggcctcccaaaatgctgggattataggtgtgagccaccatgttggcttgttaggtaaatgttaaatgttgctgtctaatgataaccatattttactattactggctcaggtcactatcattgctaaactgggatttctgtggagtaactccaggttggtctccagttttccctttgcttaggttcctcccagttctcagtctccttcacttcagtttgagcaatctaaggtgcatgtctgactggattgcttttacttaaaattcccaagtggacttctttttgtcattggaataaagtctgtaaaatgttttgtaacataccttaaagactccgccattttctctaaatattttgcctctttgttttcagtttgtgggtgaactagaacaattctggcaggaaacaaactgtattgggtgtgactctaccaagaaagatggatagtgaagtgctttctgattcttatagcatagccatagtaatcctaatttgtaaagattttagggagatattaatagccagatacccattctaattataaaaataccttaattaggcatacatagatgcaagagtttcatactgtactacttgtttgtataatctccttgagaagctatttacattatacttaataaggccactgaatgaggtggtttgcttttgtgaagttaattagccagttaaaagttgaggaacatctaatgaagatgataactaactttaagtctagaatgctcaatttagagctcttctttctaacatatgtaacagttatataccagggcttattgtctgtttaaaaaaccacacctatagactaaatgtattagcagctgtttatctttctgttcttggttgcagtaggatatgattccattccattttatccaaacgggctatcagattatccaggaacaagttacaaagaagggaaactggttccaggacacat

SEQ ID NO: 129153 - DNA, 1242 bp, Homo sapiens
ggccaacatattgaaagcctgtctctactaaaaatacaaaaaaaaaaattagctgggtgtagtggtgcatacctataatcccaactgctcaagaggctgaggcagggagaattgtttcaacccgggaggcagaggttgcagtgagctgagatcatgccactgcactccagcctgggtgacagagcaagactcttttgtctcaaaaaaaaaaaaaaaaagaagaagatacaaattgatatcaaaataccttttgaaaaaaaaatacttaagcaattcctctcagttgtttcttcccctcctttatttttatttttttaaaacgggcatttacatattaacttggtccttatgtcttgtaattcatgctgtagttgtttattttgccttaggatactcctttgatttttcttaagcatttactgaatcctttattggttaatgcttcatctgtagggattacagtgctttctcttagccacattagggggtagaatttagaatgtgtatcacccagtgccttgaatgtagcagattctgaataaatatttaaaagttgtagggacaggcagtaactgtaatgtggtcattaataagtagtataaagttgatgttgcttggctctaaatattttactaaacacagacattttgacaatgaaaaagaggcaataaactgaatacttacacattatcccttttttcatcatccagagatttatagaattctgtgctgccaccttatccctatagtgctaaatatgagtcctgagtctgacagttgatcactgtgtgatttttcttaggctggttaatcactctaatttgtttttctatacattgaaaatgatatgcatattacagtgatgttataaagattaagagagaataaatgcccacttagcacaatgtttggcacattttggttgtaacatctgtatgtgctttggcattagtttgatatgactttgtgttattttaatgccagtatccagttaatataaagcagagtttggcaaacattttctgtaaagggccagatagtaaatgtttccagtctgtgccgtctattcaactcatgggcatggctaagttccattaaagaattatttacaaaaacaggttgtgggccgtagttttccaacctgtgactagaggttacttttgtatttctttgtcttttttgtttttgttgctgttttcatttgacagctttggtacaatgtatttcttaactattgagtat

SEQ ID NO: 129154 - DNA, 1271 bp, Homo sapiens
gaatttatgacttaaaattccatctaaaagtatttttacatttaaaattccctctccttattagtaatatgtgcctttattatagatgattatttgcatttgcataaacaagcttatcaaatgtatataagaaaattagcaagataatgtttaagggtgctatcagaatgattcacaaattgttgatttctttgcattcacaaatttagtgaaatgttaataaattagtatttgttgtattctctgttaaaatagtttcatactggtttattctgaggagaatttttattagtggatcaaaatatttatgaaagaactttagattcatgttatttctgatgggtggttgatgtacttcaaagatatacttcatagacttggaatgtttgggaaaacacgctaagttctgaaactagtgagtcgggaaagaaaaactaatatctttttttgttttgtctcaattatacagcagatataatttctacagtagaatttaatcattctggagaattactagcaacaggagataaaggtggtagagttgtcatctttcaacaggagcaggaggtaagtgtttaaagtttattgtctaaatttcagtttgatcttaggactagagcttgtgttgcactggagaatctcatcagaggatgttggaattttaaaagaagtgtgtgtttattgaatacaatgtccaatatatagacagctctggttctcttagctttgtatgtgtgcatgtgtgtacatgagcgtatgttgttttggtttaaaaacataacactaattgtaaaaatacttgattagagaagggggtggaaagtgatggaataatccaagattttaacggttttgaagccttggcccttcattataatttttcctttgaaactccgtaaagcaaagttgctttgacttcttctcaatgcttggtttactttgtacaattgaggggtgagaggctagtttaaagaaaaagcagctcaattattttgatgtcagttcataataatactgttacaatgatttaaatgtaaaggtttaaatgacagttgcatgtacatgcatgtaaagtaacttaaaagtgcagtgctagctttttgaagaaagaaaattgcagaatcggtaattaaagtgggcttttgttttgtttttcttacaacttaggcacacttctaaatttaattgaccagatttctcactaaaaattttttgctaaacaaaatttgtcacacttggttttttcttattcattctctccttccatttgt

SEQ ID NO: 129155 - DNA, 1064 bp, Homo sapiens
aatatatttaaaaagtttaaagtaatgtggataaattgcagggttttacaaatacatgtctaaatcataacacagagttaggttttaaaggattgtgaaattccttaaataagcaaagaatctagtaataatactactactttgcacttctatagcgcctttgacctgaggatctcaaagtgctttacaaacactaatgaattaatcctcacaacaccccagtgaggtaggtaatttaattttaaaagaaatgattaatagtgtctgattagaagatgcacaaacactaaatatgtcttttattatttttttcgtttggaagaaaatatgaaaataagactcaagctttgcttgacaaagaatggtctcgtgggaagtggggggctaaatcagttttctgtttttaagtagccaaaaactcgaccataagaatcttgacatacttagagttgacatggaaccttacattataatttcattataatttccctttatttactaacaggaaagtcaagatataaatagattactttattacttagtggcagaactaacaagcagaacctgaacttttgacatgtcgtttttcagtattctttgctgtttttcatgctagataaccaaaatgtgaaagtttttatctagagtttagagcagaccttcccataggtgttctctgcccttgaatgtattttttactgaaagttattgactctctacactttacttttattttaaagaaaagtgtttgagaaaaactcgtaaaaattgattttgccctaggcttaacattctgagggtttcagaaagtcttcatttttaatgaaggcattgtgtcattgtcaattctaaaatacaagtttgtcaattaaaagctaatttggaactattttgcctgagaatgaagtcattttcatctcctgtggtcgtttgttgtccaagtcaaaatcaagtgtggaaaaaatggctgaaaatttttttaattgggggaaatgtttgttttaatatgggtttagtaatgtagtcagaatattagtatttagtattttcctaaaggctgttag

SEQ ID NO: 129156 - DNA, 1026 bp, Homo sapiens
tgtaagaagaattgagcagaataactttttgggaagggccattgataggaaaaataggacctccttttcatgtgtctcattcttcttaactatatttaagaattctagatggagagttttgtagaaactcagtaacatgtcttttgagaattacttagtggtgtaaatatcagcatgtttttaagtgatagattaagtaaagatgatgatggtgattgactcttcacttctgaaacttgatcttgactattaatttggtgtgttttgcctatttaattttctacattttaaagccctgtcttagagtttctaatacagtattgtcttcagaatctatgtcattggtcataaatatgtatacttgacacttagaggcacctttgtttcaatacctaatgtaattggatgagattttatgaattcacatctagaggcacctttgtttcaatacctaatgtaattgaatgagattttatgaattcacatgtatatatctgtaagatagtgttacagtttgaaaagtgaaagaaatagtcctttcctaatttgtagataaaatccaaattatttaacaaggttatattgcttcatttagtagcaaaaatcaggttaggatttgggtctccgattttcaatccaactattatatgttcattccagagtacactggtgcctaatgtttcttagactctgatgagggtgctagccttgtttgcagaatacactggcatttgatctattgtggctttattctcttacctagtggcagggttccttcttaaacttgactttactggagaccaaaatatctccacccactcatttttattgtctttacttggaagaagaagagatcatataacagcaacagagaacttggcacatcagactttgacatctgtaacccctcattgtctgcctcatttattttacccttcagaagtagctagtctccttcctgtgatccaggcgggtatctgtgtcctcttgctgcctgtccgtttattccccaatcgtaatataaag

SEQ ID NO: 129157 - DNA, 1063 bp, Homo sapiens
gattaatggggagttgagtctgttctctctcccctaatgcaagaccctgttgcagtggtccctgtctccatggccctctttaaagtcagccttactaccttataaataagtaaataaataaatttaaattattaaaaataaattgtagaattaacttccttagttgcagtagccacattttaggtgttcagtgtgtgcctagtgctcaacatgactagtggcaaccatactggacaacacagatacagactatttccatcattgcagaaaagttctcttgggtcctgttatcctaaaacttaattattgtaccttcacatttatatctcttattcatctgtaatcactttacgagtggttttgggaaggggtcgagcttcattttatttcctatgaatagtcaacctaacaccatttagtgaaaagaccatcctttccccattgcccagcaaggcaacctttgtcatcatttaggcctgtttctgggccatctgttctgtttcattggcacattggtgtatcctcatgccagtacacagtctttatgactttgctttaaaacttggttatgatgtcctttagtgaattctgttagcatctgtgttgaaaatgtgtgattttggttttgtgtcctgtgtttgtaatgtatgtaaagtatgtgacatagctcattctaaatcctgctttgaaagtctttattgaatgcctgttatatgtgccaagtactgttataggtgctggggaataaagcacatctaaacttactgtagaaactttcatgcaaatagattgtatggttaggaagatgattctcatagtgatcataaaggcaagcaagaaaagagagggaggtgaaaatgctgtgcaggtaaagccagtatgaattgttgaaggatgtgtcacaattctgtatgactgtaggagaggtttttaaaacaaaaacattgtgtttgattttgatgcattctcatttgagtggctcagtgttgagtatgcggttatgtgtcttcttattcaggcttgctcactgtactttgtttgtgcagggaacaatgctatcatg

SEQ ID NO: 129158 - DNA, 1272 bp, Homo sapiens
cctgttgcaaagagatggagcttcttgcagtccacgaaactgccatatacctctatgattttgtttttggattctgtaagataccatgtttagtagacctgtgttgttgtccacgagtctacaggaagatgttcatgttttgtttcagaaaatatttctgttgttttgtgcttttcttaactcatcaaatacaatgtgtggctcgcccttggcccttcatattgcttaccttaattgtgtagaccataaccagtttctactttgactaaagtttgacgtacacaagttacttgaatgtggggattctgtctatccctctacgccctagtgtacatagtactatatattatagtctctttaagtgttaaatgaaaaaccagtctaaaatgcaggatttatattaaaaatcgagttgcctgcttaatggtattgtggtttccttgtagactataatgataaattttgtgagactgggtgagtcattttaggtaaaagatttgtggagctttaaagtgatactggagtatttatatatgttaatggaataggctgtctaattttgtgtatgggtatggtgatgagaccaaggctctgagtctgatttttaccccttgtgtatccccgatatgtggatcgttttgtgggacatgtattcttaacattggcagacttgccctctaataactgataactgctgtccaagggttcaaatacaaccatccatgaatgaacaacccagatcatcaggctgctggaaaaaacaacccaaaacatagactttcaagatgattcagtgaagtttccttttgatatggagaatagtaataggctgtttttattatcaagaagttctaaacatttcactgggtaactcacttttacttaaaatagttgactgtcaataatatctcattctattttttacttaaactttttccataggtggttctttgaactagactttcaaatttttttatgaaaatgtttttaatcgtgtgataataggtcaaaagatgaaattctgaacatgattataattctcacttttgctgagatattaatgctaaccagagtagttcaaaagtagtccctttatgagatagcttaaattacattttttcaaagtgatactaaatgaaattagtcatcagtgtgtgccaggttcataagatgagaaagcaaatttaaggcgagtaagcagttgttgatgggggtgcatggggccattgctgggtagtgctgaatatggacttgattggtagcaaagctgtc

SEQ ID NO: 129159 - DNA, 1032 bp, Homo sapiens
cactcatgatgtatgtgaagttatttaatattcataataatactataataaaaaattgctatctctagtttgctgctgaggaaaattcaattcagtgttagtaacctgcccaagattacgagactgagaaatgacagaaatattacctgacctaaatccaatggtatagcagcccattcttttcactacaaattggaggtgtagtaaacaaaaaattgctatcagagaatctttcagagaatctaaaaactgcaagtgacagtaaaaaagtagagtttacattctgtatagaaaaacaaaagtcctttttacaagtatctctgttaaatgattcctctcctaggctacaggatatgtgcaacaggtacacacagtgggcacatggaaagaaaatatgtatacttaccattggtagacaataaaaactgagcagcatttttctggggtaaccacctaattttgttgatcttttcttctatttctaaacttttcaagtagtcaaactctggttcatggctctggaaggtgctgtaaacattatattctcctctgctatgagactggattttgttctaaaatgaaaacaaaaatatatggaccattgttgaaaaatatttcaaaataatcaaatatgtaatcaattccaaaggaccctgcacattctcaataccccattagttgtgtctttatacaattacattctgttttttatatttctaaaggccttcaaggattaaatgagaaaacttaacgggggaaaaggctaaataaagctgaataaataagctcaattcattagggaaataatgacgttaaatatggatcaatttgattgctaatttactcttatgtatttgatggtatagtctatgaaaaaaactgatgaaaaaaaactgagcacccataataaggaagttcatctaaaaataatgataaagtcttgcccagaaagagctaggtgaggcacaccttcttcctatgcccactttagggtcaactccccgatctgttatttaatatgatgtattgtcc

SEQ ID NO: 129160 - DNA, 1007 bp, Homo sapiens
aatcaaattgatccatatttaacgtcattatttccctaatgaattgagcttatttattcagctttatttagccttttcccccgttaagttttctcatttaatccttgaaggcctttagaaatataaaaaacagaatgtaattgtataaagacacaactaatggggtattgagaatgtgcagggtcctttggaattgattacatatttgattattttgaaatatttttcaacaatggtccatatatttttgttttcattttagaacaaaatccagtctcatagcagaggagaatataatgtttacagcaccttccagagccatgaaccagagtttgactacttgaaaagtttagaaatagaagaaaagatcaacaaaattaggtggttaccccagaaaaatgctgctcagtttttattgtctaccaatggtaagtatacatattttctttccatgtgcccactgtgtgtacctgttgcacatatcctgtagcctaggagaggaatcatttaacagagatacttgtaaaaaggacttttgtttttctatacagaatgtaaactctacttttttactgtcacttgcagtttttagattctctgaaagattctctgatagcaattttttgtttactacacctccaatttgtagtgaaaagaatgggctgctataccattggatttaggtcaggtaatatttctgtcatttctcagtctcgtaatcttgggcaggttactaacactgaattgaattttcctcagcagcaaactagagatagcaattttttattatagtattattatgaatattaaataacttcacatacatcatgagtgcaagtgctcaataaatgttaatttattcctcctttttaagtgtttgtaaactacacagagtatctcaaactgcagatacaaaatactcaaaggatggtctccattccaggatacgctataggagagcactttcttacttgatcaccattagcatattgccttcttcccagcaa

SEQ ID NO: 129161 - DNA, 1358 bp, Homo sapiens
tggggcgggggtgctgaggcaggagaatggggtgaacctgggaggcagagcttgcagtgagccgagatcgcgccattgcactccagcctgggcaacagagcgagactcgtctcaaaaaaaaaaaaaaaaagttagtaatgactctaccagaatttgaaatcctttatgatgagttgggtgctttctctttgttcttatgaaaaactttttcctgtgaattgtttggactttgttggggtcttgagtctaaagggaatcattagagtgactgaggagatactttagtttctgggtagccgtagtctataaaaatttgtgattaaaacttttttgaggttggtgctagggtgaggggaacctcttattttctcatcccctcactattaatttaaaaagcaaattctaacacctagaccataaacatttgcagaatatatacttaaatgacttcaggatgaaatgggggaagaaattcagcacttcctccatctaattgatgcccctcgtccacagtattagttcttagaaatgctgttcacaaatgcctgatggccatcagcgttggccgcctcctgggtgcccgtttttctgatcatgaaagctttccccagccagtccattgagatgcgtaccctctgccttctctgttttcacaatagactgcattcccctctcttgtccttattagaagaaaaataaagagaagtaactatttaaagcctgtaaatcacagcactatgggtggagggaacagtttattcctgtcatatgctagcttctagtcttgggtcagttttaatttatatggtaaactaagttatttcaaatagcttcaaatattttagacactgttctttggcatcagatgatacataattaaaccatttatataatttctacttttagaagtaaatgttcctagggaaatgtgttgttaacattttatatattggaatatttttatgtcagtttatttcttatagggctacatcagctttcttataaagagaactttttaaatgtaggctgagttcaagagaatagtatagtgaagccctgcatgctcatcatccacttctgacactcctcagttcatggctaatttgtgtctcggatccttccccttcccctcctcctcagtgttatttcgaagcaaatccgattacaacgtctatggattaaatcttgtttaaagacattagagaatgcattgtagatttttgtcttttgtttcttaatactaagtaaaatacagctaactgggggctgcattttttaatgctaaaataagtgcttaataatagagtccaatgtggaaggataaagcagattatgagaatcatatgaactgttgtgtc

SEQ ID NO: 129162 - DNA, 1054 bp, Homo sapiens
ctcatacctctcataccttctgcttgtggtgagaggaactctgttcttctgcagtttctccaatgctttagttattagtgttgataattcaggggaacaccacagtgtggtcgttttggaaggaacagatcttgagaatctaataacgtctccactgaaaactgtgtttttacataatctcacatacagttttatggagtttgattattctcacatactttgtcttatgggccaaaaactccaggtaataaaatatcactgctgtagaacataaggattctgattttttaaaaatttatgtcatatttattaacatactgatttatttcctgcctgccttgtccccaccttactgaaaaatgtatcctaattcatatgtgtcctgtgtttgtgttaaggaaaaaacattttttaaagagctttcttcctgtaaacactattaggcaccacaaactaattttatctcatctgaaagtttcataaatacattgtggtttctttatttggatctttaataaggaggatggatttaaacaggccacaagacaactggaccagggggcgggggtgttgtcatcctcatcacaaatactttgcaagtatttagaacaaatacttctcagaatacagatttaggctaggctcatatctatctataaatcatatacatatataaactaaataacacatagaaaatctgtatgactgaactacaagaaaattataagcaaggtcacatagggcttagaagaaataatagattacagatgattaaagttagcagtttttctctgtttacacttcatcattgggaagggcatccttaggggcaactatcattcttctgtacgatacagagactgccaggctagagtcactggcatctctctgagttgtttctgtttttataaaatggctttatatactgttataaacaattttgttacaccattttgcttatgaaagatcgttaggaatgtatgcttttctataagaaaaactgttatacaattgtaacagttttaaatcaacatgcatgagcctatagtgatac

SEQ ID NO: 129163 - DNA, 1769 bp, Homo sapiens
tcaagtgatcttcccacctcagcctcccaaaccgctgggattacaggcataagctaccatacacagacctcacaaatgtgatttttaaaacaaaaacctaaattataaaaaataatcctatttacatagatacaatagacaaattccttaaaattccatgaatccaattttaaatcaatacattatgccctttatgtttagcaaataactttttccagtatttcattactcatctacaaagaaaaaaataaggtgccatacatatatgtacacagactataaaaagcaaccaaattcattaggagagatgaaataaatctaatatgggcacaacatgccttcttcaccaaacaccaaagaaaaccaaatggatactaaaactcctgtctgtaatttccagatgccaaagattaatccgcaaatcatctgcagataaatatgtttcataatcactattaatagaaattgagttgatgtgatatgtatgagcattggcaaatattcttcgtggactggcctcaaccattagatccataggcctaaagactggcacctgtcaataagacacatgaaaaacagaaattacaaaaggctcagtttcaaatagcaattaagattcagaaaacttcattatttcagtttttgagaacataaaatagaacaatattacatagatttagttttaaaaagcaactgatgttgatcctttcgagtgctgaagaaaaaatgaacaatgtggataatatatcttcttttactggttgcaatactattagaatttgcagttcttagtttcaatattttgcttgaaagacatgccaagctaataaatgtttatggttcagattaaagaggctaaaaagaaaattaacccataacatctaattcttggtattttttagctacaactagaagatttgatctgtatctacttttttgatttccaaagaaaatttatcttgaaacttgaccttgtgatagctaacatgacaaaccagagatgaagtctgatggcgtgaaatactgtcttgtgcttgagtcctgcttctgtccctggccaaagtgagacctctatgtaggtcagtttctatgtttaaatgagttactcaatgtcctacctgattacagaattactgggaaaggggagatagactgtaattattcctattcaagctctgctcaggatttgggctatataatatgaatacaagcactatctgtgacatttttttcttatgtacttactcgtagtgtagtaactgtagtaggatctctataccttccatcctcctctttcaagttatacccttctggtcttttgtccctttcactgattttccataattttattgttttatctgggaagaaaataaagaaaagtccttaaaatactgaagaagaaaaacattttaaggcatttaaaatatgctatttcacatttcacgtaaaaggattccacgaaaaaaaaaaaaaccctaatctgaacttactaaaaaatttcctattatcagctgaataacatacacacatggaaataaagtgcaaagattggtggcactcataaattccatgtgatagtcaaatcaagtcacagacaggtctctatccctgtcccttaaaagtaattaaagctagagggaaaaacttgatatgcatgtgtggtgtatgcaaacacatatatgtctgtacctacatgtaaacatatacatgttcagtactgaattttaaaaaatttaaagggaacaatgaagttgattaagactgcctat

SEQ ID NO: 129164 - DNA, 1218 bp, Homo sapiens
gtaatcccagcactttgggaggctgaggcgaggcggatggatcatgaggtcaggaggtcgagaccagcctggccaacatagtgaaaccccgtctctactaaaaatacaaaaaaaaaaaaaaattagtcagttgtagtggtgtgcgcctgtaatcccagcttttctggagactgatgcagtagaatcgcttgaacctgggagtcggaggctgcagtgagccgagattgcgccactgcactccagcctgggtgacagagtgaaactccgtctaaataaaaattaaaaaaaaaagttttaatccctttggaatttatactcataaaaacagtggagtgcaattcagaattaatatttttgcttaggtccatgaatgggttttaggtttgagaaatgtagaattatatttgcccttttttctaagtggaaattccttaataaaatgttatctagacattgtggatatcaagcctgccaatatggaagagctaacagaggtgattacagcagcagaatttcatccaaacagctgtaacacatttgtatacagcagcagtaaaggaactattcggctatgtgacatgagggcatctgccctctgtgatagacattctaaatgtaagtttattgtatctttccttaaaatgattacatattctgtttgtctgaaataagcctcagacatgataagtacaattacagaggttcaaagtcttaaacccgtgtgtccagagccacttgtacccttggtaatctgcctacctcctcatgaggcattccaggttattcctggaagctctcttggggggcatgtctattgattgccaaggaatatatctctcatggaatgctgttgttctttggtaacttgcggttgggctctgtaaccttgtattgaagtagagctgttcctttctttcccatcctcccttcctactttgagcttcctaggaagatttcttctgaggtttccttggcttaaaaaaaaaaaaaaaaaaacaactttggtttaaaaacttcaggatacaatattcttgtcttgttgaatattaactcatgaaaattgatacatgcctgttaccaaaataattttacctggctactagaaaataagatcctggtatgaatttgggatgggcgaggatggtgtgtttctcatggtgatgatacaggcagtcagtgaggcatattgcaggaataataccaataaacctggtgcac

SEQ ID NO: 129165 - DNA, 1076 bp, Homo sapiens
agtcccaggtgagtctggttctaaattagtcatatgactggaagtatactgcatacttatgcatcttcaacttcaatattcaattaaactaagaagctttcaggagaattctagccagagagatgtttttcagttctttattagcctggcattttacctcacttgtagggagtttgtgaatggttgtttaggaaatgctttgtccaagccagaatattgtacaccttgccctttttgtgttgttttgttttgtttttagtgtttgaagaacctgaagatcccagtaacaggtcatttttttccgaaatcatctcctctatttcggatgtaaaattcagccatagtggtcgatatatgatgactagagactatttgtcagtcaaaatttgggacttaaatatggaaaacaggcctgtggaaacataccaggtatttgagttttttctttcaatgagcatataccctgtttactttgaagtgtttatagagaaggattttgttactaggttttaatccctgtatggtgtttgttcaccattaggccttttccctcagagatctatgagtatgttgctcttccttatgttaaatgtatatatacttacataggttgtgttgtctcttgagttttgcagttaaagtgtgattttgctacccatttggttcagtattgacattgtttttttttctgccactatgtacatttaaagtgaggatggaagagcacccttcattgaggtctgggcaggaagaggattggagaaagtggccagtccttagtagaggtgcacctgctcaggttgtgggagtagttgaactagagattaaatttggtgtgccaagtcaaatggactggtgttctgccttttggcagataactgttgtcttcagctaaaagaaagggcttgaaagccttagcagatggctttaggagttgcctatccgttgttggatgtcagttcttgattctcttatcagccagccactactgtttatccgtgtccactacatcaaacagaagagaatgaagtacacagcctggaacagggtgagggacagcacaaacctgtgctagg

SEQ ID NO: 129166 - DNA, 2001 bp, Homo sapiens
tggagggccaaaacttcacgtgtgggttccgcagggctaactgcagatttgggtatacctggggttcttggaacccatccctcgtgtatactgaaaaaagacttctatttgtgtaactgccaagattgatatatctcctagttaccctcaccatcatttcattcccattgagaagaattgatttgaagcttagcttcatactgatgtatagtgagaaactctataatgtgcattctaaaatgttgctaaattatgataatctacctaattttacctgatttgctacttttctacttataaacagttggagtagtgattaaaagtagtcacattataggcaaatgtatcatatatagataaaactatttttattgaatttgtaccagcatcttgccaagttttgtgtgattgaagggtatttttttcttactgatttttttgtgttacatgctcacttttgatcctaaccccacatgagttgctattcctctgtattacagattttcacttaatgtcacagagacatggcctgaatcattccactatatttaaagttaaaatagacactgaaaataagtttagattgtttcatatagaatagagaattctaagcatttagaaggtaccttctcatttctgtcatttctccttaagtagctccttaaaaagagatggtgaaatatagacacttccttttttcctttgagttacaacaaatactttggaacttttgtttgtaattaatattaatgttgaaatatgtcatatttctcagactttttaaatatgagatttctagtttatccttttttgacatattagtaaatacagaattatataattcaaaaaacaggcacagctttgttagcttttgacattgtataatatgatactatcaaatttttaataatatatgcccagaataaccatataatttatcaccaaaccaaggcatggttacgctatgcatacatgtgcatttataatggaaaatataggcttcagttaaatttatgcccagaaaatggtatttaagaaagaaataggcacagtttcagtgttgttatcagtagttaatggactgaaagccaagaatagtgatattcagatattgctataatgttcttttattagtctcttaactgtgccattttcaagtgtttttggcctgaatgttttattcaggcttataaaggctatgtgtgccatgcccagaatggagttttcctttgtcataccagtaggaaaatgtacctccctgaagggcttgtgtgttttgtaaaaggacaaaatgcctttattgttactgagaagattgagattaataggtttaaaaggtgtgtgtatgtgtctgtatatgccctttttttctttttaaagatatggacttgttaaatcattttcctaatttcagtgcagtatatttgtatttttcccccaggtgcatgaatacctcagaagtaaactctgttcactgtatgaaaatgactgcatatttgacaaatttgaatgttgttggaatggatctgacaggtaattaagtcaaacctctcaaatatgaattttattaaagaaaagaaacaactatttcattccaggtcctaacttcgtctctagggattccttgaaataaatttagtaattttagatatagcacagcagtactggtagataaaaaattaaagcattgtatttcactagtaaatataaaagtacacaaattctaggtaatctaaattatttaaatgtctagaattttttttcttttatgaaccagatcacatttctgacatgctaaccattaaaacggtgaagcttcagcttggttgttattcttccattaaactgttgcagaaacattcaggcggcagataactcatttggattgttagaaacaccaggttttccagatgctacattaacacctcatagaagtggtctttcatatgtatgttatgtatgatgttaaccataatatatatggttaaaattttagtagta

SEQ ID NO: 129167 - DNA, 2500 bp, Homo sapiens
ccaaagtgctgggattacaggcgtgagccactgcgcccggcccaaaaaatgtaaatcataagataaagcattggtttcttgtgaacagctacagctacttcatgcggggttcttttgttttagaacctgtgagttccacagatagttgctcctttgagaagctggctggcctggttgatcacatagcctgtagttgcaaaaatacttaacaacgataattctgcactcctaagaagttttacttgaggatgctgtcaactttgctgatagttttggtagccataaaaagaataagcagaaaacccagttaattagtaccgtatttctggtttattctagtgattgagttgatgtcaacagcccctgtcccttagtttaaatctgcttttgaagtagcttcctatggtttaattgccgaatcattttacttgaaaacaatttcttgttctgcttgtttgactgagtgtactgtctattttcacagtgttgtcatgactggatcttacaataatttcttcagaatgtttgacagaaacacaaagcgagacataaccctagaagcatcgcgggaaaacaataagcctcgcacagttctgaagcctcgcaaagtctgtgcaagtggcaagcgaaagaaagatgaaataagtgttgacagcctagacttcaataagaaaatccttcacacagcctggcaccccaaggaaaatatcattgccgtagctactacaaacaatctgtatatatttcaagacaaagtgaattagggttggcattcctagcagaagaacccacttcctgcttagttgagatagttgaatctagcattcgttcctataaaagagagaggtccattgtggcgcccctttccagtgtttgacagtgtgccattcgacaacacattgttatagctacatggagaaagctctgtggattcatcactgtggtgttctccatgtctgctagccatttaggtaagggtagggcacttttaatttaaatgacttcttgcaccatcttgcctaatggactagattggactgtatcaacattgatttactccactttttatgccttccattgtgatgacgtcaaacacagtgaaagccttcagtcatgctatgggatttaattgtgtatcctcattactgtatcatttgtggggtacaccccttccccctttttttaaattaaatacagctcattcttactgtggcttgtagcattcctcctcttctggcctcctggactgctccccttcatctcttacccttgccccctccacccggtcttggtggtggtatattaaaaaaagaaagaatgaaagcacacaaaatgagtcagtttggggtcagtggtataaagggggtatatgttgcaaacaaatgttttagtaacagttggctgtaatcactcctcgccgtgtctggcactgaaaataaggaaaaaaaacctactactgaataaaagtgacaaagaatggagaatctggttttctttttctttttaacctacctcttgtagccaatattttgtgtcatacctttgggcacagtgaaacaaaatgggttttcattgtttattggtatttttgttaattatttttaacaagtgttcttttacatgcaggaggagaggtattggttctctatgaacatattttgaatataggttttattaaggatttcacaatctataaatgctactagtttttttttttttttttaccatcatgagggtattggatacattgtgtctctatttaactcattatgtgttaatgaaattgttgtaaatgggaaccaaatttgtagaacttaatttctactttttagagtgcttaatttcatttttgccttactaaatagtcaaagacttataaaacatttttaacaagttagaacttttttgttattcagtcatataaaatagcagaaaactaacatcaagtgacactgcactaaatactttttttgtattttactgctatcaaatcagaatgaaatatactttaccatagatatttttcttctatttttggttttccaaagctatatgaaagacaaatttttaaaggtacagcgttcaaaaagtgcttaatgaactccaacagctgcctcaaataaaaatctgtatatgaatacattttccctaagcggtgatacattatccaaagatgaagagtgctcctatttttaataggtagaatgtacctttgtcagtcttgcagaaactttaatggagaagaaatggactttatttttgaaaggtgaaatgaacaggcatttatattattagagaatggtagtcttattttggtggaacataatgtaacaaccttgaatttcagaggactctgagtgcttctatgtccactacctattgttctattcttcaataatgaaaaagaattcaacgagccgaccgtgattccctctactacaaatattatgtcttgtaagttagcatttttagcacacaggagaaattttatgtaataaaa

SEQ ID NO: 129168 - DNA, 1035 bp, Homo sapiens
ccactgaccccaaactgactcattttgtgtgctttcattctttctttttttaatataccaccaccaagaccgggtggagggggcaagggtaagagatgaaggggagcagtccaggaggccagaagaggaggaatgctacaagccacagtaagaatgagctgtatttaatttaaaaaaagggggaaggggtgtaccccacaaatgatacagtaatgaggatacacaattaaatcccatagcatgactgaaggctttcactgtgtttgacgtcatcacaatggaaggcataaaaagtggagtaaatcaatgttgatacagtccaatctagtccattaggcaagatggtgcaagaagtcatttaaattaaaagtgccctacccttacctaaatggctagcagacatggagaacaccacagtgatgaatccacagagctttctccatgtagctataacaatgtgttgtcgaatggcacactgtcaaacactggaaaggggcgccacaatggacctctctcttttataggaacgaatgctagattcaactatctcaactaagcaggaagtgggttcttctgctaggaatgccaaccctaattcactttgtcttgaaatatatacagattgtttgtagtagctacggcaatgatattttccttggggtgccaggctgtgtgaaggattttcttattgaagtctaggctgtcaacacttatttcatctttctttcgcttgccacttgcacagactttgcgaggcttcagaactgtgcgaggcttattgttttcccgcgatgcttctagggttatgtctcgctttgtgtttctgtcaaacattctgaagaaattattgtaagatccagtcatgacaacactgtgaaaatagacagtacactcagtcaaacaagcagaacaagaaattgttttcaagtaaaatgattcggcaattaaaccataggaagctacttcaaaagcagatttaaactaagggacaggggctgttgacatcaactcaatcactagaataaaccagaaata

SEQ ID NO: 129169 - DNA, 1025 bp, Homo sapiens
taactgctggatggtaagcttctgtgcagccctccgtctcttgggattaaaaaaaatgcatccagtcgggcgcggtggctcactcttgtaatcccaacactttgggaggccgaggtgggtgaatcacctgaggtcaggagttcgagaccagcctggccaacatggtgaaacgccgtctctactaaaaatacaaaaatcagccaggtgtggtggcacgtgtctaatcgcagctattccaaaagatgaggcaggagaattggcttgaatccgggaggcagaggttgcagtgagccgagatcgcgccactgcactccagcctgggtgacagagcgagacgccgactcaaacaaaaatgcgtccatgcactcttttcctttcaaaatgaagagaattttttaaaccttaaatgtgagttattctggttagggatacttctacggaaagctagagataggaaagcaggttctttcagtgtgtgacttttgagtaaggtgttaattaggaaattgtgcacatgtgaaagctatgcagtactgataaagaatttttagtgatatttaaacccttctaagggaatattgtttgagcatctttaccacacataaattcaaatgtagatagtattgtgcccttccagaaaaacaaaaccaatcccccccaaaagatggaaaagataggcatatgctgggtagtcaagaatcaagtcagtttacttgtgtatttgagagcacctgtactttagtatcttacttatctatctgttcagatggtgatagtttaagctctgcgtgtatgtcttactgtggttaaaaagggagttttatgcacctcctcttccccctcaaaaagccttgaaaaatgaccctgcttcattttgtaattatgcatgaagtcaaaacattacaactcttttagtattaatcaaatgcttagcgattctacagagtcttgaggtgttctcagatgccaaatatattttgtaactgagtttgcctcaacattttattccgtagtggtgtcagact

SEQ ID NO: 129170 - DNA, 1530 bp, Homo sapiens
cagtcctgccagctgtccgacaatgtcgtcccacctagtcgagccgccgccgcccctgcacaacaacaacaacaactgcgaggaaaatgagcagtctctgcccccgccggccggcctcaacagtgagtgcggggccgaggctctgtgaaggggatgggggaggaggagcagccccggccgccgccaccggcgcggcgcgggaggcgggaggagaaggcagctcattggctcaggcatgggatgtccaggtgactgacagctcccgtcccctgtcaagaggaggggcgcctgccttgctccgggcctctctgttgcctcctggggtcttgggcccggggccgtttgggctcgcggtccgggagcggcgcgggtagcgcggatccccctggtgcggggggtggtccccagcagcggagccgggcggggcggggcgggggcgggcctggggggcggggaggccgggtgggcggagcgggccgcggaggggacgtgggccgggatggggacgtgcggcggggacgccgggggatggacgcgcgggagcggggcggggcgggcggctgccgcgggacgtgtcggggatcaggtgtgcggggctcgcgggcgggcagcgtctggcgggcgcgggagccccccagcgagcattcctttgttgccacacgtttgtcaggaaaattcatttgctcgtctagggttggcttcagtcacgtgtggggtgagaggctgtgccttgcttctcctttttccttttttatttttttattagatttctcgaagttgcccaagtgatttttttttttttaaagcgatgggttgtgcgcccagtaaagctgagagcagcctcctgaaccacccaagattgcacacgtcagggagtctggggccatgcatttaaagaaacggaattaaaaacgcactcgggcagttgaaagttaacggacgaggctgatagacaacccaggccagggtcttttcataacattccgctgcccagacatcttgtcctcagattgttcctagtcgtgagaaccgggagccttcttggaagggttcttgcctaacctttctttaattcaactcttgggaaagaggtaatgggagcagtgagcatatggccagatgaagtcttttcaaaaccacttggatgcttaaaggtcatgcagtatctttcgtaagagggaggtgcttccagtgtggcctgaagattattttagggaagagagtttcagccctcaccaggtagcgatggagtttggagattttaagatggatgctgctgctccaggttttgatgggttaattcccaaaacctttaagtgtcatatattccagaatgtaagatggttatattatttcccacagtaaattaggatgaatgtatgagtctttaaacgttacttgtatcacatattcctatgcaattttaagttatttgcccatgtttagcatactgtcttagattttagaatgggaagaaacttcagagctagctaactgcctcctgttgtttgcctgtagagaaacaggtct

SEQ ID NO: 129171 - DNA, 1212 bp, Homo sapiens
gttgttcaaaagaatgaatgtcagtatatattgatagggaagacatctgaaaaacgacttacagaatatgtcagtatgtgtgtatggtacagttccatttctttataaaaacaaaagcaaaaacagacctatatttcattgacaaaaactctgcaagtctccatgtgaaactgtcaaaagtggctcctttgggagtaggaacgggaggttgggagagatgttaatttttaattttatgtactgatgtttacgttttctaggaacacatttttccagtaaggaatggtttttctatgatatagaatataattgtagtagctaaaactttcttagggacctttcttattgttctgcgtgctatattcatttaatcctcctaacaaagtcttcgaggtagatacagttattatctctattttatagatgagaaaactgaggcacaaagaggttaagtaccctgtgcgagggtaacagctataactgagagtgggagcctggcttcagtctcagcccctgaccacactataccagtgtatcccaagtacaaattgtccgccttaagtagaaatgctttcagttatgattcagggtgtggaggccacagcagagatcacttttactaagcttttctaggtatgtctctttcaggttccaaaagtatatattggattatgattgcttatgtgtttttaatgaagaaaataggatccagacattgatttgaaagtccttcaaaaaagtaaaaaccaggttgggagcagtggctcatacctgtaagcccagcactttgggaggctgaggtgggaggattgctgaagcccaggagtttgagaccaacctgggcaatgtagggagaccctgtctctactaaataaataaataaataaataaataaataaataagtcgggcatggtggcatgtgccctgtagtcccagcttcttgggaggctgaggtgggaggattgcttgggcccaggaatcaaggccgcagtgagctgtgattgtgccactgtactacagcctgggtgacaatgcaagactgtctcaaaagaaaaacaaaagtaaggaccagaaaacctgatattgtttgttacacccttttttctcttcgattgcctacttcaagtgaatattaattgtattttagggaagactgacttccacagagacctatctggaactcctggttccttacctctgcttctgtcaga

SEQ ID NO: 129172 - DNA, 1036 bp, Homo sapiens
cactggatgaccttctgggtggttgttaactgatgttaaccatttagaaaatgcaaatgcacgggaagcagattaaggaaatgtaaacagtgactatttttaggaatgcagtatggatatgtttcttcttaacatttttgtattttgtaaaaattgtgtatattgcacatattattacttatcagaagaagtgaaaaaaaggagaaatgagttaaatcatgtccaacttcctgagtggcttatgatccactaatgttgccaaggcagcgggggactggtttgttggctctgtggcacactgtgcacccccgccacccccgtgtcatccctgacttgtccctgtgcttcttagagcctgggatggctcttgtcataagcggaaccagagcagatggctctcttctgaacagcttgcccttgattccagtagctacagcattagtctgtctttccgaatgaagatttatatttatattatggaacttgctgatgggtttctcaagttttctgcttgttatggcctgtcaacaaggctttcactctgcgttcaggtgtgtgggccttgatcattgataccatggtgtccatgagcctgttgttcacatggtgctgtcaatgagcagagaacagtcacctgcttacctgtctgttcatcttacttcatttatggtgcagttttacgtgtgactgaatatgccttcaccctcctatgatcatgtttaagtttaggttgccatgaggaggcatggcaaatgcttttgaacactttcgtacccctcatcttatgtctctccaggccctagattagtggtcatctttcagagaatggctagaactcgagtcttctgggatagcctactaacacgctttaccattgaggagtgtcttcaaaactcacatcatctgaattgccatgcgtctctatatgtgaaaagtaattggaaagtgtttcttgtagggggaaatgttttagggttgttgggtatcagtcctagagctgatttatgtatattttcaacttaaaaattattccata

SEQ ID NO: 129173 - DNA, 1071 bp, Homo sapiens
gatgtaggtatagagagaggattattgattttaaaagcacaaatcttacgtaattagattaagtacatttttaccatattctggaattctaagaattggaaggcagtttaaaacctgaaagtggcaaatttaagattaataaaaggaagcacagagtggtagtgaatgaggaaagcttaccactcttattcttaaagtattgtaagttgggaaacttatggagttcttttttgttttgttttctttttaaaacacttgtccagagataactttgcttcattcaactgagaaaattccatcctcatgaaaaaaaaaattagagcgtgaaatcttactgcgtttcattctgtcagaaattatgaaatattaacttgttaaatctttgagcaggtttaaagaaagatctgtgaggccaaagcaggaaactaaacagaagcgacctgcagtgtgttgagtatagtcagatattgtgtgtacaggaactgatgtgcaagtaaattgtaacagtttattgtttttgatttgggatgatttcagtgttactccaaagagccaactcatgattctgagtaatctcaatagccaatggaaggagcttaatcctaaatgctacattgtgtcattcagtggaatttgccaagttcagcagaactagataagattggtactaacaagagcagcagaacgcacaggggttttactttgccctgtctgaagctccttcctggggtagctgtttcacagagaactagacctgtcaagagtcatgtgaatatgtcagactctgcatttcttagctacctactgaaaagaatgacagctttggtcattcttttgagtgaatcctagtcaaacaaaataaaatgtcaaaatgcttcttagttttgagacccctgggtttgggatcatagcatgacatcccttaaaactgactatgaccaggcacggtggctcacgcctgtaatctcaacactttgggaggctgaggcgtgtagatcacttgaggtcaggagttcgagaccagcctggccaacatggtgaaaccccgtctctacgaaaaatataaaaatt

SEQ ID NO: 129174 - DNA, 1376 bp, Homo sapiens
aaggggtttgtgcagaaggggactgtgtgactgttgcgtgggggttgatgtggggcaggtgtaggagtttaatacattgctgcctatacagcagttcattgcccttaagcgattggtgtctataccttgccgtctctctttcagtcatcttcagattgtttgtcttggctgtaagtataactattgctatagatgaatgtaaaaagagtgtttaaaaagttcgttgctttaattgcactggaggtgaagctagttacatactttccttaacttcccttctgcttttgctgttgaagaggccaaatactttcttggcatgaaaaagtattataaggcccctaatccttaggagttattagtaagagctgtctttaaagcactggcagcttttaaggttttttttttcttttgtcctacatagagcaccagaataatttcacatattactatatttttgtgtctgaaatgtcagtagaaccttctgtccaccaaagaggaacatcttgaaggagttgggctgctttatttactctgtggagggatctgttctctctggctttactttgtctaatcactacccctttgctgtcgagccccgatatttaatgagtaaacaaactcatataaaaccagtttggccgggctggtgactggttttaagaaagtcagtgatgatttcacggtgtttggggagcggtacccacaaacctttagagccttttacaaagactgaagagttttaagtagagttcaacctgtggacaagctggtatagaactgttgaaacaggtgaaacatgatgcttctgcttcctttcagcatctatattggaaagcgactgagcacaccctctgccagcacctactgagggaaaggaaaagcccctggaaatgcgtgtgacctgtgaagtggtgtattgtcacagtagcttatttgaacttgagaccattgtaagcatgacccaacctaccaccctgtttttacatatccaattccagtaactctcaaattcaatattttattcaaactctgttgaggcattttactaaccttataccctttttggcctgaagacattttagaatttcctaacagagtttactgttgtttagaaatttgcaagggcttcttttccgcaaatgccaccagcagattataattttgtcagcaatgctattatctctaattagtgccaccagactagacctgtatcattcatggtataaattttactcttgcaacataactaccatctctctcttaaaacgagatcaggttagcaaatgatgtaaaagaagctttattgtctagttgttttttttcccccaagacaaaggcaagtttccctaagtttgagttgatagttattaaaaaga

SEQ ID NO: 129175 - DNA, 1509 bp, Homo sapiens
atagaataagaagtaaaatacatcagcagattttcatactagtatgttgtaatgctgtcttttctatggtgtagaatctttctttctgataaggaacgtctcaggcttagaaatatatgaaattgctttttgagatttttgcgtgtgtgtttgatattttttacgataattagctgcatgtgaatttttcatgaccttctttacattttttattttttatttctttatttttttttctctaagaagaggctttggaatgagttccaatttgtgatgttaatacaggcttcttgttttaggaagcatcacctatactctgaagcctttaaactctgaagagaattgtttcagagttattccaagcacttgtgcaacttggaaaaacagacttgggttgtgggaacagttgacagcgttctgaaaagatgccatttgtttccttctgatctctcactgaataatgtttactgtacagtcttcccaaggtgattcctgcgactgcaggcactggtcattttctcatgtagctgtcttttcagttatggtaaactcttaaagttcagaacactcaacagattccttcagtgatatacttgttcgttcatttctaaaatgtgaagctttaggaccaaattgttagaaagcatcaggatgaccagttatctcgagtagattttcttggatttcagaacatctagcatgactctgaaggataccacatgttttatatataaataattactgtttatgatatagacattgatattgactatttagagaaccgttgttaattttaaaactagcaatctataaagtgcaccaggtcaacttgaataaaaacactatgacagacaggtttgccagtttgcagaaactaactcttttctcacatcaacatttgtaaaattgatgtgttatagtggaaaataacatatagattaaacaaaatttttatcttttttcaagaatatagctggctatctttaagaaagatgatatatcctagttttgaaagtaattttcttttttctttctagcatttgatgtctaaataattttggacatctttttcctagaccatgtttctgtcttactcttaaacctggtaacacttgatttgccttctataacctatttatttcaagtgttcatatttgaatttctttgggaagaaagtaaatctgatggctcactgatttttgaaaagcctgaataaaattggaaagactggaaagttaggagaactgactagctaaactgctacagtatgcaatttctattacaattggtattacaggggggaaaagtaaaattacactttacctgaaagtgacttcttacagctagtgcattgtgctctttccaagttcagcagcagttctatcagtggtgccactgaaactgggtatatttatgatttctttcagcgttaaaaagaaacatagtgttgccctttttcttaaagcatcagtgaaattatggaaaattacttaaaacgtgaatacatca

SEQ ID NO: 129176 - DNA, 1021 bp, Homo sapiens
ctgtcacccaggctggagtgcagtggcacaatcatacccactgtaacctccagctcctgagctcaagcaatcctcccatctcagccttccaagtaagtgggagtacaggtgcatgccaccgagcccagttaattttttcatttttttgtaggggtaaggggtcttcctatgttgtttaggctggtttcaaactcctgatctcaagcgatcctcccacctctgcctcctgaagtgctgggatcacaggcatgagccactgtacctggtccccattctgatttttaaaatgggataatacctgccacgcctatctgagacaaggttattgccaagtctaaatgagatagtgcagggaaggcatttgtaaaacactcaatatttaacatgtgtaaagaatgttaagtattaaaaattcatccactgctatgagtctttccttgtctaatctagtctacatgtatctggaataggcattagcaccttcacagagcttggaataaggaatttaataaatcttatctgattttcaaggggctggaagaccccagctgttacctaggttacacactttttgaaaagagagcaacagatggcaaataagcatatgaacagatgtgcaacaccatatgtcaggagatcattgcaaatgaaagccacagtgagataccactgcacacgtatcagaatgctaacatccccaaatatgacaataccaaatgtgtacagagcaacaggaactctcattcattgctggcaaggagtacagaatggtacagctacttcggaagacagtttggcagcgtcttacaaatttaaacatagtctgattgtacaactcagcaattgtgctcctagatatatacccagttgagttgaaacgtacacccatacaaaaagctacacacagatgtttatagcagcttcatttgtaatggccaaaaattggaaacaaccaagatgtccttgagtaggtgaatgggtaaactgtagcacatccagacaatgcaatgttattcagggc

SEQ ID NO: 129177 - DNA, 3975 bp, Homo sapiens
gccattcccagtgaggtccagggaaaggggggtgtctggaaggtgatctttaagacccctaatcaggacactgagtttcttgaaagattgaacctgtttctagaaaaagaggggcagacggtctcgggtatgtttcgagccctggggcaggagggcgtgtctccagccacagtgccctgcatctcaccagaattactggcccatttgttgggacaggcaatggcacatgcgcctcagcccctgctacccatgagataccggaaactgcgagtattctcagggagtgctgtcccagccccagaggaagagtcctttgaggtctggttggaacaggccacggagatagtcaaagagtggccagtaacagaggcagaaaagaaaaggtggctggcggaaagcctgcggggccctgccctggacctcatgcacatagtgcaggcagacaacccgtccatcagtgtagaagagtgtttggaggcctttaagcaagtgtttgggagcctagagagccgcaggacagcccaggtgaggtatctgaagacctatcaggaggaaggagagaaggtctcagcctatgtgttacggctagaaaccctgctccggagagcggtggagaaacgcgccatccctcggcgtattgcggaccaggtccgcctggagcaggtcatggctggggccactcttaaccagatgctgtggtgccggcttagggagctgaaggatcagggcccgccccccagcttccttgagctaatgaaggtaatacgggaagaagaggaggaagaggcctcctttgagaatgagagtatcgaagagccagaggaacgagatggctatggccgctggaatcatgagggagacgactgaaaaccacctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttccttttttctttttctctttcttctttatttcttgggtctcactctcatcacccaggctagagtgcagtggcacaaaaatctcggctcactgcagccttgacttcccaggctcaggctcaggtgatcctcacaccttagcctcccaagtacctgggactacaggcacgcaccaccatgcctagctattcttttgtatttttggtagagacagggttttgctgtgttgctcaggctggtctggaacccctaggctcaaatgatgtgcccaactcggcctcccaaagtgctgggattacaggcatgaaccgccatgcctggcccttgatttttctttttaagaaaaaaatatctaggagtttcttagaccctatgtagattattaatgaacaaaagattaaactccaaatattaaatagtaagcctgaaggaatctgaaacacttgtacttccaattttctttaaataatcccaaatagaccagaattggcccataccatagaagaaagaattggcagtcaaaaaaaaaaataccttttgtaatgtttgaaaaataaagctgtttgacttgtcaggtgttttcctttctcaaatcagcaaattctctctgagtgcctggctttgtgagacactgtacaaggagttacaagactacagctataacctgcagttgagcagttataaacctacaaaatgggccctgccctcagagaggttccagtctagatgaggagctgatctagacaggtaaaaggctaactaaccctttgtgtaaataagttcatcaccccagtaaaagtgtcatcacccagtgaataggaccacctctgcctgcagatttttgttgttgttgttgtcattgttgttgttgttttaacctgggaagtgttcttcctgcctttctgctaggtgtcagatagatggtcccagagctaggtgctgtgtcaggccctgaagacacagatgactcaacctaagctttactttccagaggtccacagcctgagaggtgtccccaaagaaagggggacatgaggggactgcatgcttgagagcagggttgtttagggcaggtttggatttagtgagcaggctggtttgcttagagaaggcttttagtggcaacaaaggatgaagaggagagaaaaggaactcacatttattgagggcctactgtgtgcaaagtgtttcatgtatatctcattgaatgtatacagccaccctgttgtggtataattttgctctttataaagagaaagaccgaagctcagatgagttaagtggtctcctcaacaccaaaatgccaagaagtgatggagcctagacagaagcccagaactttctgactcacactagtccatcctctaccatcacgatgactttcaaattgtgctctgcagttctgcagattttctagcagtgccatctccaaaatgtgttttaaactctttatttttttaattattattagtattattttgagactgagtcttgctctatcacccaggctggagtgcagtggtgcaatctcagctcactgcaacctccgcctcccaggttcaagcgatttcgtgcctcagcctcccgagtagctgggattacaggcacccaccaccacgcccagctaatttttgtatttttagtagaaatggggtttcaccatgttggccaggctggtctcgaactcctgacctcaagtgatccactcacctcggcctcccaaagtgctgggattacaggtgtgagccaccatgcctgggctaaactctttaagtctctagtaaatgcagctagattcaaatgggctgataaccaaattttaacacatcagcattcaccaccaggtttacttttattttcagattggctcattttgtgcagaccttagagcaaagtttcctttatggtatctgtgtacgtatccaaacttcttttaattgttcacagattttaaaagcggtagcaccacatggttgtgtagatcagacctgtgtatttagatcagacctgtgtatcacgtaagtgtgtgagtgcagtgcagatgagcaccatttagttatatgtgctaggcaaatctccaacacagttgatgtgtagtcttgtggtagatttgtgcatactgtaagcaaattgcttagcttctctagacatcagtttccacatctgaaaaataagaagatgagagtacacggttgttatgaacaaatgacttaatgctttttaagcacgttgcatgacatctggaacacagaaagccctcaatacattgaagctcttaggattttcacgatgttcctgtctgctcaatgcatgctttctttattgttctgacagttgtgtggtaacaagctaatatgcttccagttgacttccagtctaccctggtgttagaaaccgtttcatctcttattgtaaatttgagtgcttgttgttttttatatttgtgatgactcttccagcagttgttgacaattgttagaggtttgacttttaaataattacttattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtatacaaagtaaaatgttataaatgtgaagttataaaataaatatatgctaataaaatcctgagtttttctgtttcctatatcgtggtctctataaagtactgcttgaagaaggagctttgttactgaaaaattttgagagataagttgagaaaatcaagctaaagccaaaaggtcttagaatcctgtaggcaagaaaacctgaa

SEQ ID NO: 129178 - DNA, 1048 bp, Homo sapiens
tgagaggtggggcgtgggcatagggaatgggctgatcccctgctggggcgggcggtggtcgtctgggagggggttggccgcggttccattcttctgaaaccctcccgggcggcttccgattgcagctgcggctgggtgccccaccctttttttgagcggctcagagcgtgcggtggaggctttgcgtgaaggcccgcggctccccggtggtcgggaggggcgggggttcggacggccgctccctacagcctccgcccgcgccttctgcgctcacgtcccgagctccgaggccaggaccatggtcagcgccccccggaccccctccgagcaccgcaccgcccttgactcctgctcgcagcgtgagaagagccaggaaggctgtggagtcacccgaggaaaccgagacgctcctaaatagcctatgtggggaacaaagttccaataagtgtctcagccggggcttcacagagcgctccccaaaccgctatgtgggaggcgctttaggaagcggggaactaagtggattatgttcaaagggtcaaaaagacaagaaaagggggaaaacccctcgcactcgaaatagactgtcgaagaagactaaacccccttttattgtgttaatgggggaaacaaaggccaatttggtcacgcttgattttagaaaatgtttgtcactttctgacaaatatgaacagtgagcattttcagcgcagtaataatctcacaccacaattctttctttatctgagtgatccttacactagtgtaattcttttccacagccttaatttcttaactgataatttacaatgcaaaatgttttaacacgttttccgtttctctcccatgcctgctggtaaaaataataagtcaatcaatgaatgattgttgattgaatacctattgtgcgccttgccttgtagggcagagggaaggttagttatagaaagtgcaagaggtttcttcttctcagagggcttccagagtagttgggagtggtctatacatattcagcgagggattccacaagcatttacatttgtgtact

SEQ ID NO: 129179 - DNA, 1110 bp, Homo sapiens
ggcgagttgtgctggtgattgtgatgtcctagagaaagcagaaaaacaactggagaataaagaagaaatcatgtaaaaagtggcagatcagaggataggggttgaaagtggcccacccctatcatgaattagaactcaagtttgaaaggcatagttttatcgggttgaataacacttcttttttcttggccatttagaagcttagatatatgaaattctaaattgtaaaactaaggcacgcagagggggagatttgaagagaaaatactcaaacaaactgcaagggagttttagattgcaattcacattgatttcagttgcccagttattagtaacagagggcgattctagcttggcctttctgcagcaccttcccctgaattttcatgtttaatcttgccttatcatataaggcctactcaatgagattttgtcattcacgactaagagcatttacctggatcagtacttgcaatgtttcaatatttcatgtctttagaaaaggggaaaggctgtggctatacatgtgtttatatttataacaatgtgacttccgaaaagctcaactggcccaccattttgactgagttgacttgtcattagttggttttcaacgaatgagttgggtgagtgccagcatctctgtgcattctaattggaagccctgacgcagagaaaggtgggggagattgagaatgggtggatcctgggaccctgactcacaccatccctcctctcttgcagctttatttatgtgttactaatgtatggtcagatgtggctttgctcatctgttgcactaagaggcctgctgttcccctaacaaggctttgggaagggagagaataggcttccttgacccacatgccacatggctcatggaagatgagagatgttggacatgtgcatttgcaggaactaaatgaaattatattcagagtatgagccagacagcaccagaaagcgatgggtgtggcttgactcggcatgtcagattttggcggaggaaaagagctggcatagtggttgtgaatgaggaaagcctctatcttgttactctctttttcctataagtccactttgggcttcagtgaggttacattgatcacc

SEQ ID NO: 129180 - DNA, 1033 bp, Homo sapiens
tgatggacacttgatttagttggttgcagctggtggtaacctagtaccataggtactgcacacaaatactgtcttacgtgcaagtgcctggtcttaaaggtggtttgtgtttgtttttgagaatatgcagataacctgcatgggctctgattctgagggcactctgcagaaagcactgagtgaagccagctggtagtcctggctctgccattgactgactgtgtgacctgcacagtcatctaacctcagtggtcattgggctgtcctaggaatctctaatgctccttctatccatttccactgaaggctctgaaagaaagctatgctgcccatggctgttctttttttttttttcttataatcgaggcaaaattgacttaacataaaattcttattttggcaggtttgaaatgcacaatttaatggcttttactgcattcacagtgttgtgtaaccattgccactgtttaattccagaacattttcatcacccctccaaaagaaactttgtaccattaagcagtcactttccttttcccattccccccatcccctagcaatcactaatctgcattctgctttttttttcctgagtggatttgcctattctggacatttcatagacatggaaccatacagtatatggccttttgtgtctgcttttgtttttcacttagtataatgttttcaaggttcatctatgttgtaacatgtatgagtgcttccttcctttttagggccaaataatgttccattgttttgtatgtatcctattcattagtttttccaattatttgatggacatttgggttgtttccaccttttggctattaggaataatactgctattaacatttttttacaagtttttgtttaaacatatgtttttaaggctgggcacagtggctcatgcctgtaatcccagcactttgggaggccaaggtgggcggatcacttgaggtcaggagtttgagatcagcctagccaacatggtgaaaccccatctctaccgaaaatacaaaaattagccggg

SEQ ID NO: 129181 - DNA, 1024 bp, Homo sapiens
tggaaaccttgctatggttgaacccagtgtatttgtgtggtatatcccgtgacagcagactttttggtcaattgtgcttgcttgacacagtctttccaagacatggctttcctatatgtaggtggttttttttgttgttgtttgtttgtttttaaattgaggtttagccaaaagccattttaaaaagtactatcttctttttttttttttgagttggagtcttgctgtgtaacccaggctggggtgcagtgacgtgatctcggttcactacaacctccgcctgctgcttcaagcaattctcctgcctcagcctcccgagtagctgggattacaggcgcccaccaccatgcccagcccattttttgtattttttatagagatggggtttcaccatgttggccaggctggtctcaaactcctgacctcaggtgatccgcccatcttggcctcccaaagtgctgggattacaggcatgagccaccgtgcccggccctatcttctttatatgaaataattttcactgctttttttttttctttggagtccaaggtctaattgaaagagatggttcgtttatctaggataagctgtccctgtgtgttctgactcatcaggtgatgaataggttgccacatacaggcttacctttgtcactgaacctttccaaaatgggcttattttgaacatcacttttgaacagtgaaaatgtatccttagctcacatatcttagcacctgtttctcataggtcagttacgcgttgtgaccttactgcctctttgtttcagagcgatcgtcttctgatcaaaggaggtaaaattgttaatgatgaccagtcgttctatgcagacatatacatggaagatgggttgatcaagtaagtgtaactcatgatatacagatgtatttgaacactttccagacttcccaagtattagataccattcgcatccaaagtatcaaacttcaggaacatcagagagtgaccaacttagtatctgttttaaactggttttgattggtgg

SEQ ID NO: 129182 - DNA, 1049 bp, Homo sapiens
ccacactgagccaaggatttcaacatctcttggagaaattctgcatggacctgaagtttgaagctttgcattgtaaccaagttggctctccttgccttccccccaggccacgatttcgtcatcctgctttacggatggcatttcctattaagtgtctgtctgtgaacataaacatggagctgagacaaagcacagcttctccctggacccggaaagagggactcaggcgcctggggctggggcctggctccagacctgctgctgctgcctggcctggttcggggatgcctagcctaacaaggcagcctgggctgggaatcgcttaggcctcaggttgatgaagctgggagaagggttgagagggcaccagacctaagatggtggccagagccatttaatcatgtggttgtaaaattgtcagtaacttctttgtatggctagttgatctgatctctcatgtaggactcagtcccccagttggatcttggaaggtagacatttatttgaaacagacagcctggtagagtgaaaagagctttgtgttttaccccctcagatagtaagcaaagaaaatggaaaaagcagcgctgtctggggtgacatcctgatgcattgctggtgacagagtgaagaggtgacacatttggaacataatgtggccatctgtatgaagaaccatagttcatccagtcatcccaaccctaggactctccagagaaaaccgtttaaaatagggggaaagttatttgcatgaatatgttcataagaacattatgtataatagaggaaatttggaagaaacctataggttcttccacagggaaattgttaaggaaatgatggtagattctccgcaagaatggctcccattaaaaattgaattagtaagactctaagataatgtggtattaagaaaaaaactccatgattaaaaatgagcatgggccaggtgtggtggctcacgcctgtaatcccagcactttgggaggccgaggcgggtggatcacttgagctcattatctgatgccctgaattggctttttctcatg

SEQ ID NO: 129183 - DNA, 1086 bp, Homo sapiens
accatgttgaccaggctggtctggaactcctgacctcaggtgatctgcccgcctcggtctcccaaaatactgggattacaggcatgagccactgcacctggccacccctattgtctttataaccttgacacactgtgtgtcttatggggtgagcagtaggaggggactttagtctgttcccttccagagccttctgagtgtgagtccaaatgtgcccacaccatggttcccaggatggcatttgcattcaaactgttacccattaatctgtgaaagcctgagctttagacaaacctgagctgccagaaaggaatttccagtgcattcaggtgctaatgagcaggaatgagaagtcctagctaacttcctaggctcttaggctctttcccatcttgctggaacttcctagcaactttgggaggcagccctggcaggaatttttatattttgttttactttgcagctgagtaaactgaagctcagagctcatgtatagtggaattggggcttgactgtcaggcatctaacttgaggccacaaatatccgtgtaaatgtttgactgacttaccttcatgctttgagattattttaatacggtgatgcttgtgacctgtgtctgttggggcttagttccttaagaatcctgattgaaacagtggcctgacacccagcagagatatgggtaatgtacacacaaggattcccaaatgaccaagaaggaaagctctgtaagggagtattaattgtttgcctccaggatcagtattcattcttggatcaaaccccagctccactgtacaccagccacgtgatgctgggtgcttcctcatcatctccacatgtccttttgccatctgcaaggggaggatagtaaccatgactcatctcacagggtgatgatgatgtgtacatgagatattgcaggtaaagatggagatgagaagcgtgaccagttattgtgactacaggatgaaggggctggtctaaccttgagcttgcgaggaaagcagagtaaagatgcctgctgaccctggacaagggttttctgctcagaattgtttgtccacttcaggtgggttcttctg

SEQ ID NO: 129184 - DNA, 1050 bp, Homo sapiens
ataaattcttggaaaggcaaaggagaatggtgagagcgtgtgtaactgtctgtctgtctgtccatcccagttggttttcactgtgctttggtggctgcatatggagctacagatactgatttcccacagttcccactttggatttgttctcctgcttctcgtccatgggaaatgactgccagagctgggagctatcaagcatatttaaaccgcagccttccatttattcttcatgaatgcacacgggccccagactggttgtaaataagcaccagctcccatcccctgcagttcttggccttatagagagcctgccagaggctggcttggtcacatccttcagtttagactttacctggagaagaaaatcacaaaggtctaacgggcacccagatagcatcagcagtgtatttagagaagtgcagaagggccaattaagcccatttcgtggtttattattattagtggtaattatttctggcatgcagttcaagggtgtctgtggcctggctgagctccggaagtgcatccacagcaccctcctgtgaatgtttatagacccaggaggggagccctgggttgggagctccagaccactggggatgggaggcagagactctatgtatagatcatactcttgtggaggtagaggcctggaacatgatggctaaactcctgtcgctgattctgggctaagaaagaaagaaaatccaaaagacagcaaggacctctgaatccctgagggaagttgaacagagcaaagtagaaatgaaccacaggatggctccatccctcccctggcatccactgcccctgcccctgaatgtccctatctttgcttagctgtggcccagaagtccactcagcctttgtctaaagaggcaggttctgctcagcagtggcgttgagagctcagaccccattttgggttttctagaggcagaaggccaagttcattctcttgaagtgaggtagatattcctgtgcacagagagaaggggaatccagctcctcatagagcagctccccaccccaagctgagttgtgttt

SEQ ID NO: 129185 - DNA, 1044 bp, Homo sapiens
gctggtctcaaactcctgacctcaggtgatccacctgccttgacctcccaaagtgctggcattacagatgtgagccaccatgcctggccaggactcacttataattctttttttttggctgggggagacagtttcactctttccccccaggctggagtgcaatggcgtgatcttggctcactgcaacgtccgcctcccgggttcacgcaattctcttgcttcagcctcctgagtagctgggattacaggtgcctgccaccatgcccggctaattttggtatttttagtagagacggggttttgccatgttggccaagctggtctcaaactcctgacctcaggtgatccacccacctcagcctcccaaagtgctgggattacaggtgtgagccaccacgcccagccacatttatgtctttggttgaacatttatgttgtttctggtttttttttttttttaacttgaatgacatttttataatagacacattcttgattatgtttgtaggagaaatttctacaagtggcattgctgggtcaaaggatgcatatatttttaacatttttggtacatattgtcaaagttccttccagaaagtttgtactgctttatacgccaccaccaatatatgtcattccccagtgtcttctaccacctgggtgtcatcagcaaagatccattgtttgctgatttgataggtgaattttgtgtcttattgttttacatttaatttattcaattactgattagagtgaaaattttttcctatgcttagtggccatttgtacttttttctccctcttaataccagcttatttcctttgaccagttttttactggatttagagtgggtttgggaggggaagcacttgaggaaatgtgattggcacctaaaaccagatgtggggcggagacttctaggttggctagactagaagatgacatctggccaggcatggtggctcatgcctgaaatcccagcactttgggagagcgaggtgggagggttgcttgagcccaggacttcgagcccagctgggcaa

SEQ ID NO: 129186 - DNA, 1051 bp, Homo sapiens
gctcctgggctgtgccgtccactggggactggggatgggacacctgaggacattctgagacttctttcttccttcctttttttttttttgtttttttttttaagagcctgtgatagttactgtggagcagccagttcatggggtcccccttggggccccacaccccgtctctcaccaagagttactgattttgctcatccacttccctacacatctatgggtatcacacccaagactacccaccaagctcatacagggaaccacacccaacacttagacatgcgaacaagcagcccccagcgagggtctccttcgccttcaacctcctagtgtctgttagcatcttccttttcatggggggagggaagataaagtgaattgcccagagctgcctttttcttttctttttaaaaattttaagaagttttctttgtggggctggggaggggccggggtcagggagagtcttttttttttttttttttaaatactaaattggaacatttaattccatattaatacaaggggtttgaactggacatcctaatgatgcaattacgtcatcacccagctgattccgggtggttggcaaactcatcgtgtctgtcctgagaggctccacaatgcccacccgcatcgccattctgtagtcttcagggtcagctgttgataaaggggcaggcttgcgttattggcctagattttgctgcagattaaatcctttgaggattctcttctcttttaccatttttctgcgtgctctcactctctctttctctctctagctttttaattcatgaatattttcgtgtctgtctctctctctctctgtgtttcctccagcccttgtctcggagacggtgttttcctcccttgccccattatcttttcacctcccaggtctaccatttcatggtggtcgttgggtccgcctaaaggatttgagcgtttgccattgcaagcatagtgctgtgtcatcctggtccatgtaggactggtgctaaccacctgccatcatgaggatgtgtgctagagtgtgggaccctggcca

SEQ ID NO: 129187 - DNA, 1076 bp, Homo sapiens
tttacaggttctcttaagcaatgttgtatttgcaggcttttctgaataccaaatctgctttttgtaaagcgtaaaaacatcacaaagtaggtcattccatcaccacccttgtctctctacacattttgcctttggggatctggttggggttttgggttttttgttgttgttgtttatttgttattttaaaggtaaattgcacttttaaaaaaataattggttgacttaatatatttgctttttttctcacctgcacttagaggaaatttgaacaagttggaaaaaaacaatttttgtttcaattctaagaaacacttgcagctctagtattcacttgagtcttcctgtttttcctgtaccgggtcatggtaatttttggttgttttggttgttttcttaaaaaacaagttaaaacctgacgatttctgcaggctgtgtaagcatgtttacctgttggcttgctttgtgtgtctgttaaatgaatgtcatatgtaaatgctaaaataaatcgacagtgtctcagaactgaataactgcagtgacttgatgctctaaaacagtgtaggatttaagaatagatggtttttaatcctggaaattgtgattgtgacccatgagtggaggaactttcagttctaaagctgataaagtgtgtagccagaagagtacttttttttttgtaaccactgtcttgatggcaaaataattatggtaaaaaacaagtctcgtgtttattattccttaagaactctgtgttatattaccatggaacgcctaataaagcaaaatgtggttgtttcaggggtgtgtctgtattgagatgttcgggaggcggctgcttgacttgggcctccaaccagacttcccctccacaagcattcacggagccctcggcttcagtttggtgaatataccaattcaagagttttcactccatgtcacaggctgctacgtccaggccacgggattctaattctaagcaaagatgcagcctgcgggtgcatggcaaaccaagtgtcagaaattcacagactctatcctggagagccctccagaatcaagctgcatactgaagc

SEQ ID NO: 129188 - DNA, 1057 bp, Homo sapiens
ggtcctagccaggctgcatggagctcacagccaagtcagggagacagatattggccaaataaacacaaattagttgtttaattacaatttagttagtgctgcaaagaagtacaggatgctataggaatgcatatgaagaggctgtgacccagtcttggggtcagggaaggggttggtgatgcttaggctgctgtctgaaggatgtgtaaaaaaggcttagcgtgtgtgcagagggggagctttccagacagagaggaaggagcagctaggttcaaggagttggaaggcagagaggggtggagagcaaagaggaggggatgagaagctggatcaaccggggtcttgtatggattttggattttatcctgagagcaatgagaagtcattgggggttttaagcagggacatgattgatctggcaggaggccagggagggatttaggccaaatgctcattggtaatgatgagttgtcacttgccaggccttggactttttgcctaaaatggcttggatgccaacagggatagctgtggacaaagtaggatgtggggtttctgggtcctgcccacctgctcaacagaattgtaaccaaccctaccttatgggtagcagaagtatctgccccagggcctggagtttgtgcagcagagcttctctagttcctgccagggagtgatctggatactctgtctgtggcaagttcccattggaagagacaggcacttgtagcagaagttctcagaggaaggtctgggattgctggagatgagcggccaattctagggccagggcagaactggtctgagcaaatcacctacctgtaggcaatttccccagtgaagcaggcaagggctggtcttgagttgaacagaggtttccttcaaaggccacagtggactcagctcaaatagacagcccttcagtgcacaggctacagggtgagagatgttgcttcatttccttttgtcctgttccttaacccagctggtggattgccgtggtgctccataagaaatagatttagggccaggcgcagtggctcacacctgtaatccc

SEQ ID NO: 129189 - DNA, 1093 bp, Homo sapiens
ttttactatttaaactttatctttgtaaatcatcatggatgcattataggcagcaaaatgatttcgttgtcaggaatattggattaagtttctgtgttaatactggagagtgaattgcttgtgacttgttatacccagagataaaaatagtttgttttctctcacatctgatgaagaaagcatgtgtttttgattcagctttaaatactgaggcagaatttctgttgcacaaatgtcagctctcacttgttgaagtttaggtatcagggttgcatatggtattcagaagaggaagacggggccagataagctgctgggaatggagatgaaagcaagcaagggacctcagtttttattcaattacttcccaataaaagtatgactctttttttttaaagtatgtagaaaactagcaatggattgttatttaaatatttgtaatgcttgctttgatcttcaaaatacttcacagaagtactttttaatagccttcctacttgtcggattgaatttgggcatccttatttgtagattcaagctgtcattcagcaccacattcatcaaggtctcctccttctctgctctttacaaccactgtcacctctgttatgactccaggactgactcggggaggcactgtggggcacgaagtactctgcccgatgctcagcttttgattaatgggccacagccctcccatcccttgagacttcagttagccgaactcttttccttaagaaagataaggctgcatttagcaacagggatgaagacaagggaggagaagaaacgcaatttttaaagataaatcaataagccattgctacacttattcgaacttggttttggatggcttttgggcttgaaaagacagaatacttttgtaggctttgccttttgatgtgattttccccctgtcatttctagattggactgaagctggtgcatcacgtgactctagatagcaagggtgttctgatgtgattgatattgtggaaccagatatacttgcaacctgagagtccccagggaggaaggaggtggataggaggccacagcggcatggtgtcttgcccagaaaacacaacagtag

SEQ ID NO: 129190 - DNA, 3535 bp, Homo sapiens
gctttgaccccaacaccgcagctggctggctctccgtgtctgacgacctcaccagcgtcaccaaccatggctaccgcgtgcaggtggagaacccggaacgcttctcctcggcgccctgcctgctgggctcccgtgtcttctcacagggctcgcacgcctgggaggtggcccttggggggctgcagagctggagggtgggcgtggtacgtgtgcgccaggactcgggcgctgagggccactcacacagctgctaccacgacacacgctcgggcttctggtatgtctgccgcacgcagggcgtggagggggaccactgcgtgacctcggacccagccacgtcgcccctggtcctggccatcccacgccgcctgcgtgtggagctggagtgtgaggagggcgagctgtctttctatgacgcggagcgccactgccacctgtacaccttccacgcccgctttggggaggttcgcccctacttctacctggggggtgcacggggcgccgggcctccagagcctttgcgcatctgccccttgcacatcagtgtcaaggaagaactggatggctgagctggcccggggctgccccggtcttgtgccacagcactgttttctttctgccctcttcctaatgcccacactgcttgggcactattgcgcccctgcctccttgccaggctcttcctcctgtcctgcctggtccttttccatgactccaggctgtgcctctctccatgtttggtcccttctgtgcccatggtcaggagctattcgggtggcacctcgctggccaggctctcccgagtcgtggcacctccacaatgtgaattttctgaatccctattccaggatttctgggaataatgtttacttctagaatgggcctgttgtaaaccatctcatcgaggtgtggtaaagccattggatgaggaggggactgccatggaaaggagagtttgttacttacggttctgagaggaggggccacataggaaagccccacggtgggtcagaaggcggaaggagggaggggaacgtgtgggcaagagacttcctctggtttcctcaggaggaaatgggcaaggcagagtaagcaggggagacaggtttaagggtagctggcttgagtaatttcagtggctctcaggataggggctgccctttttgtctgatacctggccccgggatagtcaggacaggtgaatgttggcctggggtgtgacagccctgggagagccatgtgaaggaggcagctggcgccatcgctccggattagttggtttccataggaaaggcatgctttcagccagatgcttgccatctctagggattgggggattggctagcctgggaggatcagtctgtccaggtcagcgaggccccagataccagagcatcaagagtacaggaaatacagttaatgcagggcctctgtgtggctggatcctccgtctccatcagatcagctctgattgatctattcttgcacgatttcctctgaacacagggttccagagtacttaaacacaacattttttaaatcgtgatttcggcctatttccttgccaggcctgtttccccaccaggaaatgagataggaggactggatgaggatgtcctgttatagttgctgtggaggaagttcctctggttaattctcatcagcgtctgcagaaaagaaggaaagagggcacccttttcagttgggaagaaaggagaggggtggcgccatggacgtggccctaaacgctgtgggagagggaagaggaggctgggcctcgctgccctcttgtctctgctgacttcagcctggtcatgcttgctctgccacttgcgatttcatccctaatttcttcctccaccatgcctgcagacttttccctgggcttgttttttctcgcacatctctgaagagtttttaatcttcagctcatcatgtcccaggaagtggcatcataaaaggaaatatttttttttcctaggagcagtgttaaaatctgggtcacattcctgaccaaggacagcatcctgccttctgcccatccccttcagttcacaaaagctgacattttaaacaaatcatgactcacacgtattaattggttataaatatgttgtgtacactggttagataaaacttaaggccacaaggagggcccaggtaggcgatgtcagtgtgtgaaggggctggattgggcgtggtgaggatgttggcaaaccagtgcatgcacctggttggaagatgctcagcctcacaaaagctccaagccctttgggagccaaagtgtctgagagtgtgaccctctcctgtaaagtatttatcccacccattaatataatttctgtataataaacttgacctgaaattatttcattctttatattaaacttttaaaaatgttttttattttcaccttagatatgggaagagttttttttttttttttttttttaacaggataacttgagcaggctaggcctcttaaaaaaaaatttgagctaaaactcatttttcttttggcattttcttttcaatgttcttataagcaaagttcatccatgttgtagcatgtgttcaactttattttttcatcgggtaatattccattgtatggaatggtagtactacattttatttatcatgcatcgattggtggacatttggatcgtttctacttcttgactattatacataatgctgctaggaacttttgtgtatgagtttttgtgtggacatatgttttcatttctctttggtatatgcctgggagcagatttgctggatcatatgaaactctatttaacccttgagggactcccaaactgttttccaatgtggtgacacaattttatatcccatcaacagggcatgagggttctgatgactccacatccctcagtgctttttattatctatcttttaacttagccatcctagtaggggtaatgtggcatctcattgtgattttggtttgcatttccctgatggcgaatgatattgagcatcttttcatgagcttattggccatttgcatatcttcttaggacagctatctttagatcacttgctcattttttaattgggttatttgtctttttattattgagttgtaagagtccttttatagcctggcacaagtccctttaactggtatatgattataaaatttttctccgtgagctgtttcatttccttgatgatgtcctttgaaatactaaagcttttaattttgatgatgtccaatttttatttattttttcttttgttgtacatgtatcctagaaatctcacttttgatactgcccttaggtccatgtaagttcggggttttggctcagggatggggcagttattctgttggcaggaagcgctagtccacgagttcattaattcttccctgaagcccctctcctgcccttgccttccactcaccccgtcactctccttctcattactgtgtccaggctcaaagcagcagctctctgggaaggcccccgttctccagtttctcccacttttgcatccattccacatg

SEQ ID NO: 129191 - DNA, 1091 bp, Homo sapiens
ttggtggttgctgtggtttaaatatgttccccaaaatttatgtgttacaaacttaatccccaatgcaacagtgttgggtggtggagcctaataagaagtgattgggtcatgagagccctcatgaatgggttaatgttgttactggcagagtgggttagttattgagagagtgggcttgttataaaagtgagtttgggcccctcttgctctcttgctcttggtcttatgtgtagtctcttgcccttcttccttctgccatgggatgacacagcatgagggctctcatcagatgctggtgccatgctcttggactttccagcttcagaaccacgagtgaaataaactattgtttataaattacccagtctgtggtattttgttacagcaacacaaaatgaactaagacagtggtcatttgggttgtttctattttggctattatgaataatatgactataaacattcaggtagcaatttttatgtggacatgttttcatttttcttggaaatatgtctgggagtagatttgctggatcaaatggtaactctaggtttaactattggaagaactgctaggccattattcagagcaactgtatcattttatattcccatcaggagtgtatgtggattccagtttctccatatttttgccaaaatttgttttttaaaaattataaccatccttgtaggtgtgaagtggtatctccttgtgtattgcatgtcatcacatccctgatggctaatgacttggaacatcttttcatgggctttttgatcattagtagatcttccttggacaaatgtctattcacatcctttgcccatttttaatgtgggttgtctttttattgttgagttgtaagagttctttatatagtctagatacaagttttttatcggttttagctcttcatgtaggtctttgatgcattttgagttttttttttgtatatggtatagtaagggttagtccaacttcactttttttttttttttttttttgcatgtcaacatacagttttcccagtaccatttgttggaaagactattcctccattaaatcatcttggcactattgtaaataattg

SEQ ID NO: 129192 - DNA, 1008 bp, Homo sapiens
ttccacatactagctgtgtgcccttgggctggtcatttcccttctgtgcctcactttctcatctataaatggggccaataatattacttatctactagggagaagtaatgattaaatgacataatttctcaagtaattggtgttgtccctggcacagagtaagtactgaataaatgataaccatttataattatttgaattatttttcttaagaaaaaacttgagaagctttctgagaatgtagatcgaaaaggataatgagggagaaaaaatgataggcctaagatacaagaggcaggaatccaacctaaaacactctagtggttcttcaagttgtccaaggacatcagaaacaatcattaaagtttaagaaacaaaaactactaaaccaaaagtatttgtgcctgctgattaaagtattccgtgcgatacaagcagtgttagaatgtcaggatgcaggaggggtatggaggggcatgttgggcatgttgaggtgaggcctcatgggaggtaactgaaccccgtgggaaatgactggctccacccccattgtcagtcacctcacattagagattgcagacccattcagtttaggaaactgcagagggaacctatgaccacactgtctgcagttgtccacacagctcagggattcagacccagcatgaaccagcttttggcccacatgggacactcttctggcctgtgctgtgaccaacatgagagagagcagcttgcttcttctcagccccatctcccagtctgtaccaggctgggctacaggatgtctgagggctctttatcccatggatgtctgattcaggatcaggaccttacttaccatttgtgcccagagcacttggcatggatggggttaggcaaatgcagttgagttacacttgtgttgaagtggagtcccagttgtaaatgtgatgtgtctgccctctctgcccagcctccagccctaacctgtcttcctccctctctctcattcccatgtcaggccaa

SEQ ID NO: 129193 - DNA, 1310 bp, Homo sapiens
tgcctggtactgcaaggtcccagggatactgcaggagacaagatagaccatttccagcctcaaggagcttccagcagagacccgagggaagaggaggtgttagccaggtgaaagagggtatttcagatagaggcagcagcatttggaagggtccagaagtgggaaagcctgactttctaggcactgagggaatttaagggtagttagaatgaggagggacgtgcaggaggatccaggaggccggtggctcacccttgctgtgaacagcagctgggggttttagcagaagaatgatggtgtcaagtcagtggacactcaggatgatgtcaggggctgagtagtctagtcccaaatggatctgagaagaatgagagccaggtgtggtcagcctgatgcagggtgcaaatcactcatttactagacaaatgggtactgatggctgttgtgtgctgtggcctcttcttagcttcatggaattctcatttgagcagggggcatagacagtcaatagacaagatgtagttctgtgtgattcaaggtaggtggttgtgggggagcggtatgggaagattccctccaccacttggtaagaagggactgggtaagaagctgtgtgcctcactgagggggttttccgttttgtgctgtggggagctctgaaagattctaaacaggggagtttgtgatgggatgtgtgttttagagaaagattactttgccaactatctatgtgaggaacagcaaagtcaaaatcatcccagctaacacatttcagtgctcactgtgtgctagatgcttttcagtgttcacacgtcaacaaatttaatgctcacaaaaacgtattttcaggtcctgtgtttcctgttactgcgtaataaatgtggtggtttaaaatagcacaagtttgttctcttatggttctggaggttggaagtcctaaaatcgaggtgtctgcagggctacattccttttggaggctccagggagaatttatttccttgccttctccagcttgcagaggccccttcttccagctctgaagtgtgtcattccgttctgcatctgttgtcactttgacttctttgaccagttctactacctccctctcataaggaccctgtgatgacattgggcccacccaggtaatccaggataacctccccacagcaagatccttaatttaatcatctgcacagtcccttttgccatacaagattctggggattagaatggggacatcttttcggggaaataattattcagcttgctacagttaggtgctattatccccattttatagacaattatag

SEQ ID NO: 129194 - DNA, 1178 bp, Homo sapiens
tgaggacacaagggaaagaccatgtgaagacactaggagaagatggccatctgcaagccagggagagaggcctcaggagaaaccagccccaccagcaccttgactttggacttccagcctccagaactgtgaggaaataaatatctgttcttgaaaccacataaactggtattttgtcatggcagccacagcaaactaatacaaaggcccagagagtttgattttggccgacttgaaggagagacctttcagcagagctgtgctggagtgactgctgtgtgagcttcgcatggtgtcccacatgagcctgggcgaccatcggaggagctgccacagaagcaaataatattaattaaagtccaaattctctcgcttagagcaagtgatttttgcttcttgcttatatggagttcagtggccagtggccaggggcttcgcctcatgcagtcattcagggactcaggatgatggaggatgcactgtcttctacctgtggtttttgaggtcacactggacacccagctggaagatggggagttgaggaatgtagagaatcatttgggggttttaatgtgccaggtaggaggctgcactcttccatctgcatccattggccagaactcagtcttggggctccactcaactggaaggcaggagggagaatggagtctggctgtgctggcaggagagggagatgggctggtcagccaccaggagggctcaggatggagtggaaaaggtgatttccaaggcctcccctggcaccagtattcaggagagcctctcacggaaggaggctgctgctgtctctctcactatacctttcctgcttacagcttctcaataccccggcccctctgccgacctcttgcaatccaagtgacatgagccatgggtacgtgacagtaaaggtgagtcagttttgtctctcagtcggctaagtgctctcccaccaggtcacctaaaacgaccagcagagacacccaagaggctgagctgtgaggatcacctgaacctgagcctgggaagtggaggttgcagtgagctgtgatcacaccactgtgctccagcctgggcaacggagtgaaaccctgtctcaagaaaaaaaaaaaaaaaaaaggaccagcagtgacatttgttaaatatcgagggtggttgaacatccactatttataagg

SEQ ID NO: 129195 - DNA, 1008 bp, Homo sapiens
gagtcatctgctcctcccggtgggtgtgctgtcttgcagctgtcttatgctggtcttgccttctacctgcctgagcgctccacgcctcggtgctttccctggtcccagatcagagtagccttccccttaagagagtctgacttcacctctttcctctcctacggtgccctgtgtctctgcactttgggcctcagatgcccctgccccccacactctgaatgaatacagcagcccctaaggctcatgctccaagggatctcccactgatcatgggggatggcggacatagaatgtaccatccatctccagaacattcttcatcttgcaaaactgaaaggctgtattcagtcctcagttcttcctctccccaacccctgacaacttccattctactttctgtctctatgaatctaactcctctaaagactgcatataagtggaatcatacagtatttgtgcttttgtgtctggcttctttcacttagcataatgtcctgaagtttcctccatgttatagacggcaccacaatttccttcctattttttttttttttttttgagacggagtctcactctgtcacccaggctagagtgcaatggtgtgatcttagctcactgcaacctctgcctcctgggttcaagtgattctcctgcctcagcctccctagtagctgggattacacgtgtgtgccaccacacctggctaatttttgtatttttagtagagacccactttgctggatacatttatctttcagttcttgtaacttttcatgaattatttctttgataattttttcttgtattttctctatttttgttgttctttttctttttgctttctggaattgctattgttaaaatattgttattgttaaaattgctattattttttaaatcatactacccattgatttgggtactcatatgacccaaagtaacctacagatgcaatgcaatccctgtcaaaatctcaatggcattttttacaaaaatagagacagcaat

SEQ ID NO: 129196 - DNA, 1194 bp, Homo sapiens
gaaggagaggggaagcaggagaggaagactccacaccctgagcctccagtaggaatctcctccccagccctcagcacatgacattcagtgacctggacacttcactttagtcctcatccaagcccctcccccatcctttggtccaccaggaaggttctggagcctattttgtacattggcatctcttggtccagtttgccagagaaggagctcagtgtctgtggagctgatgaagcaagttcaggtcagagaattcccaccatacacaagccagagacctgggaacagccagagaactgtgtgtcgactgggtaattaaatgccatactgctcccaagaactggaaggacctggtcatttgtcaccaggaaggctatgtgtcccagctctttaacagtggaaaccttgctgccctgtctgtggaatacaatctattggcaatctaatggtctgtaacaattaagacccaagtcaaaggagttgattttgaagtttctacagcaaaaaaaaaattgtttaagtttctttgtaaagatggggtctcgctaggttgcccaggctgctcttaaactcctggcctcaatatagcgaaatttagatgcctggatggaagagcatttggtatatagtttttggcttttctgcttggtttctcagaatccttggagcccctctcttcttaccaccagtcagcctccaacccattcctctaccagccccctcccaagtcctttcaagagattattataagtagtaccttctcattataggaatattgaaaaacacaaagaaagtggcatctataaacctgcctcccgtggggaactacagttagcatcttgtattttatgctaacctttttaaaagacatgttttatgatgaaaattcaaatggatgctattctgatgaaacttgggctggatggggcacaggtagggtgcttgttgctttcagtcagatgaaggaggggtacagtttccacgatttctagggggtccttcattttgctttcttgattgttttagggagtggctgaggctgaactggaacagaacctgagtcggactttcaaaagcctcttcagagcaagcgatgaggtgaggggtggggatgggtgcagaagaacaggagggggcagttgtgaaggaagtagggtacctagtgtgtggcagggaccaggagtagcaatctgg

SEQ ID NO: 129197 - DNA, 1078 bp, Homo sapiens
ctcccagggtgagaataagtggagaatttgaagtccatctagcaaagtcaagaccctatgggagtacgccctctttggttggtgactttgtgcaactacacaaagcaatcctggcttcccagtctgggcggtggtgggagcacaggggtggaggaatgctagacccagctcagcccagtgaacttgggccagtctctcctcctccctgtgcctcatcttcaccttcgaacagaaggcattacccagaatattcctaaagctccagcactctcaggctcctgcagaggacgtggctcaagctgaccccaggctgggacagacccacttatgctcccaagaagcttggcagcaggagtgagggctgggcaaccacctggctcctcccggcctacactggtctcttgcaggtggatgaggagaagaagcaggtgaccatggaggctggcatcctcctggccaacctgcacccacagctggatgagcatggcctggccctgtccaggtaagagcccatgctgccactcctgggtgggccaagaccacctgcccaccccccatccttgcctggctggacactcaaggatctgtcaggagccacagaggagcgcctcccagtgtgcacccctttctctgggctcctgttcttccccattgtggtgcctatctccccatcccccatgggttcaggggctgttgtgttgggaatagaaagaaataggccagagatgagatgagcattaaataatagtctcaaacagaaatgggacaaccctggattaagtcattctgaaaacttgcaacaaacaactccagggatccaaatacaagaaaatgccaataaaccctcagaggaacagaagaccctgatgactgagccccagggtttcctggcatgcctatccatggcttcacttgttcctccatccaaacatggtgtcagcgattgctcaggtttaatatcaggggatttcctttgaaacaggagcaaaacacagccaaaggagtgaatctctaactgcagaatttcaaccattagaaacaggtgacagagctgtttggagcagtgaggtgagcaatc

SEQ ID NO: 129198 - DNA, 1024 bp, Homo sapiens
tttcgctgcatttgtcaccagtgctataccttactcatttactcatcttcttattcctgtcgcctggcactgcattggaacaaagaaatacacatatctgtttaaactgaactctagaaagatttgtgtccaaaataacaatattttatattttgatgctgcaaagctgacacttctgggtttttttttttccttgccaagtttcttctgcacccagctcattctccaggggcacatggcagtggctgggcataactctgggtgtgccggctcccatggtctgcatttctaagcagtagggtgcagtcagcaaggagcctgtgatgggagcctgtgccagggcaaggctggggccatgctgctgcctgctggcaggagtgggggtcccagccttgacagcccctgaactgaacgggcctttctggccatccagctcattccagggtcctgaggccacctcttcctctcgcctcattctgcctcttgcacttctcttgcagaaatgtccaatcagggaagtaagtacgtcaataaggaaattcaaaatgctgtcaacggggtgaaacagataaagactctcatagaaaaaacaaacgaagagcgcaagacactgctcagcaacctagaagaagccaagaagaagaaagaggtcaggaggagccgctaccgcctccctgccttgaccatcccactggaggggagggagggggtcactgcgcggtgccctgctgggttgccatggtgacccgcagtcctcccaggctgtgtcagctgatgctgaggctgcaattaagaagcagggaaggttcatttgcttctgaaagcatcagggagtgagatcttggatctggttttgttatgagcctggcccagggcctaatgcccagattcatttcaatagatgtttctaagccctgatcacatgctagttccaagcaggctctggatggggtggcggcaggggcccagacaggcgtggcgtccaaccttcaggaagcttatctaataggggtgatatggttag

SEQ ID NO: 129199 - DNA, 1070 bp, Homo sapiens
tgggatgcagtccctctgtggaggtggcatggggagggacggatgcatgacctaaggggggtattttcagtgtctgacatgatcgataccactctggacaaggaggccaggatgcagaaagcctgtgtgcctcgctgattgtcggggaggatgtggcttggacaagagcctggttcctccgatgccagggttcttgtttcttccactcaacattgctgtcctgcagtccctccctccctgcacctcctgccttcgctttcattcgaggtgtccatggcaagtctggtcatttccccccatttcctcaggaataaaagtgcagcagtgcctgctgtggggacagctgagggcagtgaggccctggggagctgctgcaggcagcaggtgggcgggacgccagcaggctgtctagctgttcccatgatggtctcctgttctctgcagaggcgtgcaaagactccagaattggaggcatgatgaagactctgctgctgtttgtggggctgctgctgacctgggagagtgggcaggtcctgggggaccagacggtctcagacaatgagctccagggtgagtagaccaagcatgatgttcctctggccacagggtgatgaggtcagagggcagggtagctaattctgctcagtgcctctctatcaggccccagtgttacagaccgtttttatcttgtgcactgggtctgggtgcctgtgtctgggcccactctgagcctcagctccgaggcccctggttcaggctctgcgtgcatcagactgccggcatttgcaggcatttcccaagcactttcggctgttgcatttcattcagctcttcccctcccaggccccttagcccagctcccaggcctcctccacgaagctgtgtctggaccaccggagctcttatccctctcccctttggagtgcccagagcttatccctcctgtgagctgacggtttctgcaggatcattgttaaaaacccagatcagacatgggtgtgagtctgtttcacctcttctcagctgggtgactttgggccactatcttgatctcatgacactccccccac

SEQ ID NO: 129200 - DNA, 1024 bp, Homo sapiens
caaagggcacacctgcagccacctctgagacttgagcccactttgccagcagccctcgtcggtgaagtctcaacaatttagctctcacctggaacccagctttctgctattgcttccctgtgatcgagggaaaccacttgctaaatgaggcaagtccagtttggccagctgctaccactgtctccccaacttgctgttgtgggtagctctagcttgtgtcctgccttaagaattatccaggtgagaagcaggatctgtccacccccggcccatcgccaagttccagaaggctcctcattcagcttggtgtagtaggattggaagagtggagctctcccttcctgggcccgtggattcccttcagtgcagtcctttaaattgtcacatcttgtagagctgttggggtgattggtttggctctctttctgtatatcatgcattgtgtgtcttacaaccagaatcccttcttgctctctgctttgagacttcatgaatacccggtaacataacattacaaatctagattttttaggtaaagtttccaaatttttatatattggctcaaaattatttaatattgtataggccaaacaaggtttgtctgtgggctgtccattgtccaggagctatcagtttttaagggctctggagagctctggctcggagcccagtttagaaagagctctgggtcttctccagtcctcatcatctgtgaatttctgattttcctggatttagtatgagccactggaaggaactctaggtgacagagtattatccagtgtggataccaccagtgtcctagagaaagaagagatgcagcgaaggaccagcaggtggcaggagagagtaaaccctggtctcggcgcgcatcacgcggaggttcagcggtccttgagaaggctggacacaggaagtgctgcacctcacaaaaagctgtgcttcaaggggggtttcaaagctctttgcctttgaaatcttaaaaatgtgggcggaaggtgcctgaatcttcttctaaaccaat

SEQ ID NO: 129201 - DNA, 2093 bp, Homo sapiens
tttcttacagtcacatttgttttgcactatactaggtcaggtgggacttactgcattatttagagatcagtggtcacttactgctgtgtaatcaggccatgtaatgacacctcacaaaatatagctgttaattcagctatgtcaggaaactgacaacttaaggcggagaagtgatgagtcaatttagttattttactttctgaactcagtgactgagatgagaaggcagctcgctaattaagataattgtaaattttaaatattgaattattttcaaggcttttatgttctcatttttgtgtttcctacaggatggcaatgattcagatgaattcatgtaaaaggagaaaaggagaaaaggacctttgaaagatgtgaatgtagagacaattgcagaccttttggtttcatctgtgttctgaaatataaaatacaaccaaaattctaccttcatcctacccagaaattattgattttcaagttttaaaaaaattgtaccttttttgctgacagaaaaggatcagatatgtataaaatagttgaacttgacagcatataacttaaagtgaaaatgtttttgccagaacatgtcttggtaccttgtgaaagcaggctgcccttgttcttgagatagactttaaaatgaaccagctctgaaaagtacttctgctgctctggtctatccctgaaaacagatgtcttgaaacacttttcatattcttaaaataatcttcacttctgttaagaagaacatgttggtgggtaattatgcgaatgtttccctgtccctgatttctcgattaggcgtatgggttttgaaaaagagatttttcagaagattgtcagcttcagtattcatgttccatcgtgtcatctgggtctgttagtgtagtgaccctcagtgcagtctgtcccagcgtttacgtccttgcttcctctgagcagaggcctccatcttagtatcaacatatttaaagaaattgatggtgttcatcaagctggggcctgtggcagttgttgcctgagcaccaagtaacccaagccacctatgtgacaacttctgggcccaggagtaatttctcagcattgagggtaaaataggatggagtgctctgttgatcatttgggagatgtaggttacctgatttgtgccttaggatgcagcgtgaagcagaagtccatattgcaattatgattttagaaggaactaagcattttactcacacccacagcagcaagaatgacctcctgcagcagatattccacctgtaatagcactttggaactgtgggcaaaaccaaaaggctagtgtttccatttattccatgttggtgtatggggttgaactggaaaattccctgaggcaaaactcactggccaaattttgagagggtatagaaaatgactttagagatgagtggttttgtgtatgtgtctgatgatattcagtctgatgttccgcaattttaaaagttataataaaataccatttttttaatctggaaggacattgatatatgaattcttagaatttgctattaaaaagggtagcccccattccacaagctggttttgagggtgatcttgctctaaaaaacctcattcatcataggctcagtctgacaggttctgtacggggctatcatctttctcctcctctgctaaatgcctctttcttccagctgctcactgggtcaaagggatgtcctttctcagatgtattcttgatacatctcagatgtattcgtagctgtgctccttccatacttccaaggagtccggcttctacagaattcctctgtacctcacactgcaacacatgtagatagcgcttttgaaaaatacatatatttttactatagtatgagaggtcctggggctcaaactttaaacatttcctaactcagcttacactggtttaaaatgtccaggtctctgctgaattctcttgttgaattcatagctctgtgttgattcctatgcccctaaccctgcagcctctttgttttatttttttccccatctctgttggtcccagggaaagcaaggaaattttcttttgaggacttataggttgattgcccacaggtcaa

SEQ ID NO: 129202 - DNA, 1003 bp, Homo sapiens
tattaaattaaatagagctttgaatttgaagtttagagacttaactgtcatgtgctaattgaggtgggggggattaaacatcccttgggcaagggaacgttgtcacagtggttgggttagatcctaataaagtcatttaacctctctgagggagtattcatcatcagtaaaatggacacatattatttcacagggctgcttagaattgaagcaaagacacatcgatgtgaaagtcttccttgacctactttgtaaatagtcataccttatccagatagtctttggttgctgtttttccagaatatcattatgaaaagatgagatgtgtttaatcctttctggaagctaattttagatttcttgaaactattggaacagtttaacactaaacagtagtcttcaacataccacaactcagatgccattgttgtggttattttgcttattgaagttttctgtgttttagaggcactttccaccagaaatctagcccccatattatttcatgaccttagtcattttattctcatcattttggatttttaaagcttgtatataattctagagttgagaaataaacaaatacacacacacacacacacacacacctacctaccgacctacatacatacatatacaaacaccatctgatcagtgacagatgttaaaagtcccgagactaggaaattgaatttgtagcccaaaagattgctaatctttctaccctaactctccctctgttgcttgcaacccctgttcctgagctccaagtatgaatcaagttcaagattccaaggaagttttgcactgggtgtttttattctctctttcagtgaaaatgttttcctagtttttctccatactttaaaagaatagactaattctccttgtaaccgtcttctgttaagggatacagatgtttgtgttttgttttgttttgttttgtttccataagttattggggtacagatggtatttggctacatgagtaagttctttagag

SEQ ID NO: 129203 - DNA, 1079 bp, Homo sapiens
tcatttctgttatttcttctttacagtgaatggttgagatctacacaacaataacttttttcctgattaaagctgaggatagatgacctaccagatgtctgagaactaaaactacacgtattcttttgagaggaaggtcatagggacctcggccacgaagacatccagttgtcaaaaataggcaccattttcccacaaggtttctagaagtcagaatgagaagaaagagaataaaaattactcagacataattataattaatattctgggagtttttttcatttcctgtttttttttgctttttttttttttacttattaagtgtcaatattttcatattacagccttctcttattttaaacaaacattcccgtaatgcacacagtaaatttacttttcagtgttctgtaacagttgaagaacctctgcttttagtaaaatcatgcctagtaggtaaggcagcaaatgccctttgagtgctccagtgtcaatggataatgaggtagtggaccaattggtttatttttgtgtttcagggagagaatatagaagacatcccaaaggaagtgctgatggactgtgcccaccttgtgaaggccaatagcattcaaggtcagttttcctagaggtgtttttagaattagcacggactttctctgtgtctgaaatggattacattttagtgagcatgctgttgactttggcctccatcaaagaataacatgtgctgtgcctttgccatgttttgttctttaagatggatggcaattttggtacctgtcaaagaactaaaaactgatctccccacccttgtcattttgaccgtcctgtctaagtctcggctctttttactgtttccttaccttgaatagaaggttgtctagatctgtctgtacttagtgttattataaaaagactttgggaaatttggcaatgttgatagctaagcaagaacaatgtgttttatggctttatttttaatgttgtttgatatctttatttctattatttgtcattagattctagaattaaagtccccaaatcatgcttctctactttttctttccctcctcctctta

SEQ ID NO: 129204 - DNA, 1016 bp, Homo sapiens
ctgtggttctgctaatctcccaggctggcagcattggagacttgctgacttctttcatcccccactcttttcacctgaaattcctttccttggttttgctctaagtcctatgcttcagtcaggggccaaccaaatctcactgcctcctttttatcatgaagcctttgatcactgatagttctttttatatcttgaaaaatcacccttcccagtacagttaatatttagtatctctactcatcttggcacttactcacagctccataattcagtgtttctcgtacctcttcatggtgatggggagccctttggaggtggtgactgtgctttatactcctcatgatgcttcacatgtggcaggcatggagtgaagactttttagaacagaatgctttaaatggcatgtggcctgaggagatgattgtcttgtacctcttgctaaaagtggttttcattctttgtaggtttcatgtggacaaactctcttcggctcatgtataccttcgattacataaggtaactgaatttaaacatggattcttgacttttctcctgatgatgcatcatatcttgttctttatcctttgcaattaaattgcttacagtaataagttggtacgcaaatctaaaagttaacaaatgaagacgtgtcttccctctgacccagaaaatcactctaacattctagatgatttttgagatatagaaggaggcagtgtacatatttcccagctagatgcactgcttatcctgtcacttccggtgtgctgtctgtcatctctgctttccttttctttcaattcagttgacactcccagactttctgtctcctccagtggatatcatgtgtggctcatgtgattctcctgcctcagtgaagggcccgtgttcccagttatcatgggcttctttaggaagtttaaaagaacatgctagtaataaaggaaaaaaatttttagtggcccctagtaatacaataccactatttttccaatctatctctattcatatatttt

SEQ ID NO: 129205 - DNA, 1660 bp, Homo sapiens
tacagtagatgcttgtctggaaacaattctagaaagactgtgtactcagatattaattactctacccaggaaaagccccagggggtcagttcattacagacagttattatagggggcttgtaaacaatagagcaaaatatatgagctataatttatatatggccaacacatagaaatcgattttaaaacatacatgcatatatgtctatcatagcttctttgtatatagtatttgttttcatgaactctttgggaagatatttgaatgttttatttgataaagacagaatttgagaatcctactgttaaactaatagaaaattgtgtgtatggggggtacatgtattgtttttaatatgacctacaagtagagcttacttagcagtagatttatgtaaattttgacgcaaaataatcttatcaatggactttgtttctttttatagccttttacacttcactgaaaatctgtttccatcacctaataaaaagcactgtttttatcaaaacagtgataaaaatgaagaaaacctgcattgctctcaacaagagcattttgttttaagtgcgctcaaaacaactgaaataaatagactgccatcagcaaatcaaggctcaccatttaaatctgcgctctccactgtatctttttacaaccaaaataagtggtacctcaatccactggagagaaagctgataaaagagagtagatctacttgtctaaaaactaatgatgaagataaatcttttcccattgtgacagaaaaaatgcaaggaaaaccagtctgctccaagaagaacaacaaaaaaccacagaagagtttaactgctaagtatcaaccaaagtatagacacatcaagcctgtatcaaggaattctagaaattccaagcaaaatcgagtgatctataagccaattgtggagaaggaaaataattgtcattcagctgaaaataattccaatgctcctcgggttctgagccaaaaaataaaaccacaagttacactccagggtggagcagcattttttgttagaaaaaaatcttctcttagaaaatcgtccctggaaaatgagccgtcactgggacgcacccaaaagagtaaatcagaagtcattgaagattctgatgtagagactgtcagtgaaaaaaaaacttttgcgacaaggcaagtgccaaagtgcttggtcctagaagagaaattgaaaattggactactgagtgcaagcagtaaaaataaagagaaattaataaaggtaaagctaaatatatcactttaaaaatggctgtataacaaaacttcagtataaatgacatagttgaataaaattttattttctggactgcttttataaagccagatagcatagtgtttagttactgtaaggagtttatttatttatttattttaagacagggtctttctttatgacccaggctgtagtgcagtggcacactgctcactacagcctcaacctcctaggctcaagcaatcccacctcagcctcccaagtagctggtactatagatgcacaccacctcacccggctaattcttgcattttttgtagaggctggggtttcaccatgttgcccaggctggtctcgcactgctgggctatagtgatccacctgcctcaccctcccaaattgctgggattat

SEQ ID NO: 129206 - DNA, 1048 bp, Homo sapiens
tgatccatttgagttaattttacataaggtttgaataggtgtaatttttttgcatgtggacatttaattggtccagcaccatctgttgaggactgtttttcctccatggaattacctttgcctctttgttaaatcttgatcttgagtattattttgtcttattaacctttgaaatcttatgaattaaagctttgattttatttggtaatacacattatcatgatttttcccctaccagtttctcctaagtccactgtctatccaatcttcagtgcatcttcagtcaattcaaaaaggtgagaattgttattgttttaaagtccaagccttgtaaattatacagttcctctgggtctctttttcagtctcatgctacttaatttggggagtttttttttcttcctcactaaggggaataggagaataatattgagaatagggtgatgaaatcagtccctcatagaaacatcataagaacttaagagttgagagatggaaaagatctttatatacttgagtaataataattgctaacattattatataataccttacccataataagtagttttatatctattatcttaattttcacaacaacttagaagttagatactattattctgttttcagcctaagaaactgttagtaatttagccacagttgccacagctattaggtgctaggaccaggactagaatccatatctgaaccaaatgcccattaggttatattgccttccctgggtgatagtatagtagctacaatttaataagcatttacaacttcatgatgtaggtaccattattaccccatgttgtagatgagaaagctggctggaggagtaagtaacttgcagcagcttaatgttatcataaagtatagctgaagctaccagtacccaagctaaagactgcaatggaggaggcatggatgggtagagagcatgataggcggcagagctctgaaaaagtagtttcttatggtctaaacatcctcttcctaagcagctttgattcttctctccccatttgattataaataactc

SEQ ID NO: 129207 - DNA, 1979 bp, Homo sapiens
ctgatttcctgtggatctgtgaagttcagtattatacttattttctccagtaccccaggaatttcttcatagctgtatggggtaaatattgtcctaagatttgataaagcaaaaaaatctttttttaaagggcaaagtcaatttccaaagtgtgcatctatgtgcatctgatattgtggaagaaagtccctaggacttggagtcagaggaccaggatttgagtgttaacactgccatttactagttactttaccttgagtaaattactgaccctctctgagtaggcctcaggtttctctttgttcctgtccttattacttcatcaagttaatgtcagatagaaagcactaaaaattgcaaggtactctgataaatggctgctttctttcccttgtaattcctccaaaattgtaaatttatatatatcaactttctgtgtcaagatctttaggtgaagaacagttttctgtgggatctgtcaacttcatgaaacagaccaatatccagaaaaatactaataccagagatacaagtaaaaaaacaaaagaccagctcatcatcgtgagtaaattccaaacaaagcttctcctatctagccctttgcagaaaagcttgccaacccctgtattagacagttcagaacttggtattttcaatgtcattaagcaatgttttatgtgacagaatgggagttgtaggtggtgacattgaatattcttgaatttatctgtgcttttcctgcactctattttttgtcaactcttgggtcaaataattttaatattgtttaaaataatttaatattcttagctgcttaaggaaaaatattgtataattaatatagaagtcctaaaatttttgccctccctgtttgaaataaggctttttcaggtctttaagggtttcattaaaaagttccgttgttcattttagctgtaatttccacaatttaatcttattctttcttagaaccatgagtctagtaaataatcttgtaaaaataaaaaaatctttggtttttacactgtccattcaaataattccctttcatcaatttattgcatttttaggtctcttgtctcttttttttccccccccaaagagatggagtctcaccatgtcgcccagactggtctctaactccttggctcaagtgatccacccacctcagcctcccaaagtgccgagattacaggcgtgagccactgtgcctggcctgatctcatttcattttgtcttgggggagggaaggaggatatggtaaccagattttcatttagtttttcacttgtgtcagcaggaaaaaaaaaattaggtgaaatttgaatgaatggttataggaacttaatttagagctatttgtgctatatttaaatgggtttctttttttaccccccaattataggacgctggtcagaaacattttggggctactgtgtgcaagtcttgtggtatgatatatactgcttccaaccctgaagatgaaatgcagcatgtacagcatcaccacaggtttctggaaggaatcaaatatgtggtgagccaaaacatagtctttcagtttgttctagaagtaaaactaaaagagacatttcttttccaccacctctaccacccagccggaaaagttaacttttaatgatgatgtttcaagcttactatctcaatttaagataaatattttgtaaacactgcattctgagcagagctgaacagtccagatatacaaaattcagagactgcagagatactctcttcccactatagtgttgtctttataggtagccttaggaaaaaaatagccttcccatgacttctccaggttttttctgagaggagaggtcccacccatttattaaacacctttcaagtccaaacacatcctatcattggccctatctttatgattgtacctgctactcagatacattcctttttccctatttttattgccacggttaatgccttcacaatatttt

SEQ ID NO: 129208 - DNA, 1538 bp, Homo sapiens
tcaaattatttaatgttggttttttttcctcttcacaaattaaactgtgacccttttgttttcctttggcagggttggaagaaagaacgtgtagtagcagagttttgggatgggaaaatcgtgttggttctgccacatgatccaagctttgctatcaaaaaggtatggaacattatctttttatctcttgcctttccccacccccaagaaatcaacctatgttgaagtgcaaactgcctttgctgacagataattcacttgggtacctgcttaatgattactttcatagcaatttatacaaaactaagaattgtaggacaaaggagtaaagaaggcagataaggctccacagcttatcttttatattcatctttcccttgtgaaagataaactaagctttcaatgttgagaaattaatggcccccagggtctatttcttatattggtgttgcttgtgtttctgaggttgaatgtttagccaccgtgaataatgaataaagctaaaacaaatctgttttaatgcttcctattccttatccctcccaggtgtctcaatttctgctgaaagtgatctttaaaataggttcttaaaaccttgtttccacagtagcagctacatgcatcaatagtgaaataattttggaggtgtataaatttaagaaatagaaattaaagaggctaaagtaacagtaatcatacattctgtgtatataaatatgtatagtttctattgtactttttaaaacattcacctgtcttggtttttaaaatcattaggtagaagatgtccaagaacttgttgataatgaattgggcttccagcaagttgttcctaaatgtccaaacaaaataaaaacttttctttttatatctgatgaaaagagagtagttgggtgtttaattgcagaacccatcaaacaggtatggtatatttgttttaaattattggcataatttgcaggcaaaataaagaaaagttgggagaagtctcagcatttaagattgctaccattaatgacactcttcctactgaaatatccttgacctagtggataattgaagttatttatttccattaatatttggaattttgctttgtataaacaggataggtaagccagtcttttatgttcatgtagtcattaacacagctggattataaagtctagtgattttaagtaaacaaatctataaactgaaatttttaaacatgtggcttagtgaaggttaatatttttggcaaaatagtcattacttatcccttaattagaatctaatttaggtactaattagcaatgttctagaagacatgtagtttctccttgtgttattagaagttggagagaaaagcagcttttttgtatttttgccagtataagtgatcagtttggccttttccttccccctcagctttattaaggtataactgacaaaaattgcaaatatttacagtgtacatgtgatattttgatataggtatacattgtaaaatgactaaatcaagctaatatagctatacctcacatacttaccaactt

SEQ ID NO: 129209 - DNA, 1040 bp, Homo sapiens
aaacgaaatgccaaccaaatttcatagttaatagatataaatcttctttagtgttactggtttctttaggtggtcatatatacattttaggatggagagaatgagagagttttatatactttattaaaaggaagagtctaatgtttacaattgtttaagaggaaagtctcgtaatgctatgggacacactagaatttgtgaatgtctcaacaccactagtttttttaaagcattgtgtgactaaagggataagaatttaagaaatagaaaatattttttaacatacttggagatataagttaaatttttgatacttatttaaggaatttttttttaaagcagtgtgaactcatctgtggtgttagctatagatgcttctgtatatcattgcaggcatttcgtgtcctgtctgaaccaattggtccagaatccccaagctctacggaatgtcctagggcttggcaatgttcagatgtaccagaacctgcagtctgtgggataagtagaatctgggttttcagactgaagagaagaaagcgcattgcaagacgactggttgataccctcaggtaagaaataaaatggatctagatccagaaccttagattcatagctttcccagaacctctcggcttctgagctaaagggaaggatattggtaagatacttcagtataaatactattaaagtcaggctaaggaaggtattggtactagaaaaaccatactagatgtactcagtctagggtgcaacattccaggtctgaaacatactagcccactgcttttcaaactacctgtgctaaaggactagtttaatttgtcacagaccaacactaataaaataaaaatggattgctagaaaaaaatagaaaaaacaaaactacaatctcaaattgttttagacttaacagatgtgaaattacgcttcaataaatataatctatacaaagtaaaggtttgaaaaattacagaagctgtacatggtcattgatagtgactagataatgaagacttggtataactcataagcataactaa

SEQ ID NO: 129210 - DNA, 2032 bp, Homo sapiens
ccgccttggcctcccaaagtgctgggattacaggcgtgtgccactgcgcctggcctagcaatatgatcttatattagttgctctttaccatggatatcctagagttaggtggatggttccctttgcctctcatcagaattttttctggaccttagttttcccatctgtgaaatgatatcattagacttctgtctctaaaatataaggcattttttcacttactaaaaataaggttgatttaagtcaagagtatttacttaaattgtgctcatgttaattagaatgttaagttgcttccatcattaaatcatcttttcttctcttttaggaattgcttcatgtttggctgttttctcagcactgatgaaatagcattttctgacccaacaccagatggcaagttatttgcaaccaagtactgcaacacccctaatttcctcgtatataattttaatagttaaagctgatttcagttataaaggagttactatctggataagttcaaagagctccttattataaaatacaaactatttaatatcaaaataaaaaataccgagactcacactcatacacacacacacacacacgcacacacacatatcacagttttgttccttatgagttgaaaagtcaggaataaatttgttgaaaattatctggggattcaaaggaaaaatctttgggtgattccctgattagcactctgaatgtttaattatgaaactttgtagctataactggaaaattacctgactctttgtaagagtattaaatacaaagtgatttttctctagaaatgtgacctggtcttttataaagcccactcttagaccaggattatctaatgccacatcagaagcaaacaggcaaatttaaacttgggcaagtaatttctgtgcccaatttgtaaagggaattcctgaatttttttttttttttaatagaggcatgggtctcactgtgttgcccaggctggtctgaaacttttgggctcaagcgatcctcccaaaacgctgggattacagtcatgagccaccgtgcccagcctaattcctgacttctctatacagagtcttcacttgataggcactcgtctgtagtaactcagtttgaatatctttagaaaatgtttagaatttatttgtaacaagatggtaaggaataagattatcccatatgcatttctgtagagcagaatttgatagcttagtgttcaatctttttgaaaataaatgtttacctgtcatcagatttaattaaaattatacttagtaattgcactattacttagttaatttttgttgtatggaaatattggtagtactactttgggaacctgttactgacaattgatgtcattaacaaaatgcctagttggattagatgttttcattttctaattttttgcttgtttaaaatgcaccttacttgttctgagatacctggcaaaagtctttacaaaatgtatggtaatagaaccaaggttagtaaatatacataggctggtggatgagagaccatggaactgtgtaaatacacttaaatgttcacacatttttctagtgtaattcttggatactttaaaaagcaaaacattgttcaaattgttttgattctgaaaaatcattcaactgctaactggcaataagactctaggcaagtcgttttccagattgtaattatatgtagaaactattcatctgcattcattttatttgcctgtaagttaacatgtttccaaaatttaaaagcctgggtccccaaaagaatgtggaagtattaaaatgtatgtaattatgcaaacattttaatgctattttctgcacttatttcttttaaatattttatttaaaatttttaattaacattttgtttgcttaatgcttttgttatgaatcaattaaaattctttattttatacaactaaatctgattttaattattttattatgaaaatagtatatgttaaataaaattcagataatacagaaatagagattgccaaaagaagaggcttcccggccgggcg

SEQ ID NO: 129211 - DNA, 1007 bp, Homo sapiens
gacaacttccaatttacttgtcacattattttgatggaatatatgcaaattaatgttgtgtcctattgcttggtacaatcttataccaaaaggccttcagtgatttctaggcatttttaaagttcagagtgcagttgttcctaatgtttctgagaacgccctgtgtcggtaatttttaaaattctgtctacacccaaatgtaggtataccacctacattggcaattcagtaatttggaaaattcccaggggactgtggcttacagaaactactgatccaaaacactttatagattagcaaaataaggccaagagagggaaagaaacctcacatttactcaagtttaatgacaacactcaaatcaatgaagtataaaataatgctgagacaccttctggtacccaaagtgtcctttattctttatcatcctatttgagttttattgtttttacacagctgggaaatgcttaaggtacaaattaataaattttaaactcagtatggaaaatacatttaataaattaaagcaaaaaccaaagatctgaggagatccaagagatcaagacaatctgtaaccagagtctgaagtatccaaggagctactctttttgaggcatattctcctcagcttccagttatcatttgataaacacatcagcaaaaggttcagtgttttaaacaaatgtagactttattttgtactgtacaaagtgctaatgtcagtagatccattaaaatatagaatatttaagaaagatcattaataaaagtaatggtcattcaatttaatgttacagtttacagcgttttactgctagtgttttaagtcagcatgagcagtatcaaagtacttatgtagctagtttctaaaactttacagaaaacccagtacaattccaagtgcttatagccaatataagcatatttcatattagaaatagttatccatatgttaacaagaaactatggtcctcaaatatgccaattttagagtctaataactactg

SEQ ID NO: 129212 - DNA, 1003 bp, Homo sapiens
ctacaatgtgtcaggttttcatattagagttatgctgaccacaaaaacagactgggcagaggtccttattcctctattttctgaaaaagtttgtgtaaaatccatatcatttcttccttggatatttggtagaaatcaacagtaaaacatctgggtcttgagttttctttgtgggaatgtttcttagtagacatagggctatgtggatttccttttcttcctatattaattttggtaaattgtatttttcaaagaaattgtccttttcatctaagttgtcaaattcattgccataaagccgtttataatagcctaattattctttaaatgtgtgtagaatttacaataacccttttctcattcctgttgttggtgacttgtgttctcttttttcttgatcagtctagataaagctttatatatttcattatcttttcaaataaccagcttttggctttgttaatattttatagtatttgttttttatttcattgatttctgctcatagctttattcccttcctttggatttgctctgcttttctttttctagattaaatcaatgaacataggtcattgatttagaactttccttttttccaatataatttacaactatagatttccctctgagccctgctttagctattgcttgcacattttgatatgctgtattttccttaattattcaaaacattttccaatttcccttgtcattttatttgacccataggttatttaaatttgtgttactgaatttccaaatacttggggtttccttagatatcttgttagtgatttctaacttaattccattgtggccaacaaatatactctatgattcctcccatagtgtcatacaaacctttacttctgctataactaggataaactcaaactcttacagacagaatattcactaggcagtgttagagtgtattatactaaaaaatgaaaattttcagtatttgattactataatctgcatttcctcacaaataagg

SEQ ID NO: 129213 - DNA, 1029 bp, Homo sapiens
ttgattatctcttctttaaatttcctaatgtttttttcttcaggatcctataactcatctctgatacatataattaaatatttaataagttgtagtccaacatgctcaaatggaaaaattggaaagttacaattttcaggtttaaagtttgtaacattccatctttacccttcaaattcttttcatcctctcccttccacagtatagatagtaagacttgttttagtatattagatcttacctcccaattgaaatggaaatgtagcagaggtgttcatagtccaaactattttaaattctgtttttaaaagcaaatttctttcaagctttttcccaaaaatttggaagtcattttaaaaagtattgtggttttattgttttctatcctttttaaatgaatttttttcttagatctccaagaggtttgtctcattctccttgggctgtaaaaaagattaatcctatatgtaatgatcattatcgaagtgtgtatcaaaagagactaatggatgaagctaagattttgaaaagccttcatcatccaaacattgttggtacgtttaaatttggtagcagtatctggtatattattttgtttattcagaaacagcttatatgctctcttaactggtttcactaatagaaatgaagaggatggggctggatatttaatgggtatcaaattaatgtgattggtctaaaataaaaatttgcatatagtattttttgatgcctaagtatataaacttcatgagaacagatataataattatgttgctagttctatgaagattttaagaatataaaatgatcttcatttagataatttaaatccatttaggtaatttcctggatttcatttttcatttttaatacaagtagggctggtgaaactattatatttagggaagcaaaggaaaataaaagtattttaatttgtggtactactggcaaacactgaaggcattttaaatgagatctactgaattagtcttgtaaatagtagctgtttcattgtatatttgtcag

SEQ ID NO: 129214 - DNA, 1055 bp, Homo sapiens
ctgggttcacgccattctcctgcctcagcctcccgagtagctgggattacaggcacgtgccaccacacctggctaattttttgcctctttagtagagacggggtttcaccatgttggccaggctggtctcgaactcctgacctagtgatctgcctgcctcggcctcccaaagtgctgggattacaggcgtgagccaccgcgctaggcctctattgatttatttttctcctatattggtcatattttcttgctgctttcatgcctggtactttttgattgggcagtagatattttgcattgtctagtactggattttgttattcctttaaagagtgtttgatttagttatggtctgaggttaagttacctgcacattagcctgttccttttgagactggcttttaagctttgttttgaatgtttatctggggctaaactttagctgtactatctagttgtgaccctttagaggactttactatgtgttacagggttaccatcctctagctcatggtgatatgaagtgttcctagacttgtatgatctctggtaattgttgagccaattgctttcctctggtgctttcccagctttggggcatctacacattgttatgtgcggataagtacttggccaaacactcaaagagaaactgttcagatctttggagtgctctctttggagctctctagttctctgctccacaaattctagccgcctagtccttcttgacctctgatctctgtctcttcaatgtgacaggacttctggattatgtgacctctgtcctgcagtctggaaactgccttcaagcagtaagttagggcagtgatagggcccacctcatttgtttctcttctctcaggcatcacaacactgctctgcctgttgtcaagtgtctgaaaacaattatattttgtctagttttctagttaatggcgagatggtaactctaggagcagttaattgtccaggagtagttaattatttttcatgagcagaagcagaactccatcttttcatctttttttttttttttttttttttttgagact

SEQ ID NO: 129215 - DNA, 1048 bp, Homo sapiens
tgccgaagatgccagcgtgacatgcaacagacactgaaagtgggcagagcccaagttcggggtcctgcacagagcacccttcctgcatccctggggtggggcacagctcggggccaccctgaccatgcctcgaccacaccccgtccagcattctcagtcctcacacctgcatcccaggaccgtgggggccggtcgtcatttccctcttgaacatgtgctccgaagtataactctgggacctactgcccgtctctctcttccaccaggttcctgcatgaggagccctgatcaactggatcaccactttgcccagcctctgaacaccatgcaccaggcctcaatatcccagttccctttggccttttagttacaggtgaatgctgagaatgtgtcagagacaagtgcagcagcagcgatggttggtagtatagatcatttactcttcagacaattcccaaacctccattagtccaagagtttctacatcttcctccccagcaagaggcaacgtcaagtgatgaatttcccccctttactctgcctctgctccccatttgctagtttgaggaagtgacatagaggagaagccagctgtaggggcaagagggaaatgcaagtcacctgcaggaatccagctagatttggagaagggaatgaaactaacattgaatgactaccatggcacgctaaatagtatcttgggtgccaaattcatgtatccacttagctgcattggtccagggcatgtcagtctggatacagccttacctccaggtagcacttaactggtccattcacctagactgcaagtaagaagacaaaatgactgagaccgtgtgcccacctgaacttattgtctttacttggcctgagctaaaagcttgggtgcaggacctgtgtaactagaaagttgcctacttcagaacctccagggcgtgagtgcaaggtcaaacatgactggcttccaggccgaccatcaatgtaggaggagagctgatgtggagggtgacatgggggctgcccatgttaaacctgagtccagtgctct

SEQ ID NO: 129216 - DNA, 1028 bp, Homo sapiens
gtatgtgcttgcttcctgtgatagcgtatgcatgtcccacattgttacatggcagacttcatggttgtcatttttagagcttcattaaagttcatctggttaatgtaccatgatttaattgttcctaattgctcatccacgacttctctaggttttcactgctacaaataagagagtgataaatttctcactgctgtagcatttcccttcttttgggttacttcttaaattcccaggagagagactattttgcaaaggatgtgaacatttttatggctattgatactttttgccaaattgccttccaaaaatatttgcacagtcatcagcaatgtttaaacacactagcgttcaccacggtcttgccagcatgatgtagcactgttccattacttttagagatttccttttttaaaatttgcatttctttgatagctaataatctcatcaagctttccatacatttgattattcattgtgtcatctcttaaggagactggctgtttaagccttttgcctggttactatgtgaggtcaaatcaggcatttataaagtgtctaatacatactcactaccatggggtgctatagggggaccaaggaagtataagacctggttcttatcttccagaaggctatgattgacactcacatcttatttacttgttgttgatttctttgtacccaacctgctgctttgcacaacctgtatgcttcataaatctttatgtagttaaatcccggatgacatgtttgttgtctttgtggttcacagagatcagcactcaatttaaaggaatgcggaatcagaacccaaaataaggctgaaacccagagagatagcttagacctggtcaattaatatggacacacatgaagtagtgccccacaaatggggaagccacggcttgacatcagtttttaaagcaaggttgagggtttgagtttggcaggatgcagtctatgagtcagtgtgtgacatgcctgccaccaaaagctatcgtgatcaaagttacgttcatagagaa

SEQ ID NO: 129217 - DNA, 1326 bp, Homo sapiens
aagccaattgtgggctccacccgcttgtgcttcgttcattcagcctggccatgtgggtttttataatatctgcttttgcaatataaactatgcacatcgatatacacaaacggccataacaccacattgcaaattacaaagcaaaacgcatgaactctcaaggatggatttttaaatttccttgataaggctggggcttatggaaaagtgcccattcccgtctgtagtccattgctttcaatttaactaggcgtttggggctggaatcgttttttcctcccctttcagtcttggagcgagtcccacagctaggcttcctgcgctcagctgtttgtttttcttccttggagagggactggggaatgttacccaccaagccccgtgggactggccagtttgaagagctctccaggcccctagctgctcaaatcccaaacacatggaaccgggccacacccttcggcccagtggacagaaaggctggcctggcggtcctgacctgccggtggaacggcccagccccaggccctgccgcctttgtatttgatggaagagaagataggggaaggggaaggaaggctccagctcgtggctcccagccaggtcctgagacttcagttgtgaaagctgagctggggcctccctgcctccctcccagagggcccatatatcttgtggccttgggtgtggccaaggctgagtctgagtaattgcttgcctggagcagccagaccctcccctaagtcaccgccctcaccctggggaggaggcctgcaacccagcccgaggccaaatctgtcctccacccccgaccccacccagctcccctcctcagttaccttttagaattttctttattctggtgaaatacacagaacataatatttatcattttaaccatttttaagtgtaagggtcagtgacattaagcatgtttacattgccgtgcaaccatcgccaccacccactagcagaactcttcatatctccaagctgaaactgcatccactagacctgaactcctcattcccccagcccctggcaacccccattctactttctgtctctatggatttgtcttctcttggggacctcatatcagtggaatcagacagtgtttgtctatcatgtttttattttatcttttcactctgtcacctagactggagtacagtggcgtgatctcagctcactgcaacctctgcctcccgggttcaagcaattctcctgcctcagtctcccaagtagctgggatcacaggcatgtgccaccatgcctgacttttttttttttttttttttagtagagacacggtttcgccatgtt

SEQ ID NO: 129218 - DNA, 1027 bp, Homo sapiens
aggatccacgacgtgtcaggccagggtgagcagccagggattctccaaacacaaattaaaaaatctctgtcctcaaagggcttatgatcccagtagaagaggctggcatgggaacaactgcctataatatacagtaggccaaaatgtgtgtgaataataaagtcaggcgagcagagggctttctggaaaagggctggaagactgaaggagattgtctaagagaagatgtgggaaagatattcctatttgtgtgacaccaagctgggtcaggtttctgtaaggctcacaccagtcaggcggaggagaaggcctggggttctggtcccatgcagagctcccatcagtccatccgcaaaggggaaggtggcatccatatccactggcacatcagcaaaggggcttggtttggcaagaaagactgggtacagcacagtggggtgattggagaggactatcagggccagcctggggggcctcaggggtgggaggggtcagatgtccctgggaccaccatacccacttcctagtacctcatcttactctccctttttctgaaccccagattgtttttttaaaaagctcatttggaccagaacgactggaaattaacagcaaccctagccactgcgccttctgggcccctcctctgtggggagctctgtcagagggcactttgggagccatgctagccatgtcctgtcccagggttccctgatgctagggcccaggtgcagggcagacagcagaggttgagaggtgtggagtccaggctgattcgtgcctcctgggcctctgtgggcctcagtgtactcatctcaggctgactcgtgcctcctgggtatgtgaccctctgtgggcctcagtgtactcatctgccaaatggggatgcagggggttatctctgaggtcctatctggttctagaattctgtgtgtaaaattggacctggccattgaattaggagtgtggcccttttcaaccccaagttagaatatgatactatgctgggcaaagcatggctgtggct

SEQ ID NO: 129219 - DNA, 1047 bp, Homo sapiens
cagccattgcactccagcctgggcgagagtggagacctcgtctcaaaaaaaaaaaaaaaatttcaacagtcaacaatgaaaccgcatctcagctcaggctgttgggggatcagttttcaaaactgacaccttgtggcagcaagaaggaacagcagcagtatactacgctttttggactgccgctatccaccccaacagctggtttctcggtggagaatgctggaaagggcaaggaagggcttgagcgatggacaagaataataagatctgtgatctaaattcggacaagtttattttggttacaatctaatataaaaatactaccctcgtatggtataaatccaagatggaatactttctcctttccagatagttttgcattttagaaattgaagaaaaagttttaaaccctgctgtattggacttcctagcatttgctttagttgagaaataagcttccaaactcttatcagattcgttgccagtccttacaatgttgaaataagggccctggatgtgtggacttggcccttgttttatacacatggctaagagattaggcaaacattgtttacccaaaagagttcctgagttacaaagtctacatccctttccactctttccacagacaggttgtggacacatcctggagttctgagatgctttttcgagcacagattaaagtgttcttcagccggtagctggcctaggggcctgaccagcagacttctttctttgcctcttcctctccagctccagccaccaagccagcaaccacttggtatttagttctaaggcagtcctcaaaccgagccagggcgaattcttgaatttgagctcaatcatcagttagaatgtctgagagggaagggtcgaagtataacctctctcaactctcagttgtggcttgagcgtggagcatgaggtggcagagattcaggccttggcaaatagcatggcttgcactagaatattctacggggtgtgcgttggcttccatttctactggaagatgcaaggttgaacagagagggagggctgcctgaa

SEQ ID NO: 129220 - DNA, 1052 bp, Homo sapiens
cagcaagaaagataaaataaaggctctgaaatgggaagcagcctggggtgttctagggacagagaggaagccagcatggttagatcctgtgttaatccatttgtgtccctataaaggaacacctaagactaggtaagttataaagaaaagaggtttaattggttccagttctacaggcttcacatgaagcatagtgctggcatttgcttctggtgaggcctcaggaagcttccaatcatggtggaaggtgaaggggagccagtacatcacatgacgggtgcagggaggtgccacactcttttaaacaacaaatctcacgtgaaacaactgagcgagaactcacttatcaccaaggagatggtggtaagccatttatttatgaggaatccagccccaggacccaaacacctcccaccaggccacacctccaatattggggatcacatttcaacataagatgtggaggggacaaacacccaaaccatgtcagatcccagtgaacaagagaaagaacgtcatgagacggggttgaagtgttaggtaagggccaagatacatgcttttaaggagttgaaattttatttgaaatgcagtagggagcagatgaaggggaagtggcaagttctggttaacaggtagggtcattccggctactgtctggctaatggattagaggagtaccagggtgaaagtgggaaaccagataggaggccatctgattacatccatccctgctcagatgggggcggcagcagtggtgatggagaggagattgagatgggggtaagagaaaagaagggatcaagcctgacactaaggttttggctgtcagaaatggtaggaaggtagggtagggctgtatactgaggtgggaaagatagcgggaagagcagagaaaatctcagagggagaaaatcaagagttctgttttggatgtgtgaagtctgaagagcctgtgatacattcaagtggagatgtcggtgggctctgaatgcaagagaagtctgagctgacggtacgaaactggggattatcagctcataggtaacatt

SEQ ID NO: 129221 - DNA, 2055 bp, Homo sapiens
gaatgtgagtgtgtctgtatgtatgtgcacatgtgtgtgcacatcatcagagcttgaagatcttggaaggaatatggcctgtttttccttgccctccttccctaccaccctcaggcttttctctggcttctcttttatatggggtgagggtttcatatagctaattataaggttgttcaaatagtgccacctcttaagattttttgtgtaggacaaaattttggatagacctaagagtggtttttattaccctgtaagtaaagcagttcttggcacatagtaagcacaagtaaatgcgtgaatgaattttgaatgaacagttagctaatgacctgggtagggttgcctcttggaattgggggcagccacatctttttgtgccctcgctactccccctacccccttaacttcctttgttctccttgggtttgtaaaagtgaaaagaagagaggagctttttcataaaatttaataccaagggtagctcaaagagcccatctgaaaggtttggcagctgggagagtttgtgtggacagcagcccacttctgtttgattgactctagggaatgcaacaggtgaattctgtgtccgtgaatctggacctgtagcattgtgatttcttcgtcttacaggggctttagtaatagaggagatggcgactgcattgttactgctcgttcaaaactgatcaagaggccgggcgtagtggctcacgcctgtaatcccagccctttgggaggccaaggcgggcagatagcttgaggccaggagtttgagaccagcctgaccaacatggtgaaacttcttctctactaaaaatgtaaaaattagctgggcatggaggctggtgcctctagtcccagctacttgggaggccgaggcacagaaacacttgaacccaggaggcagaggttgcagtgagccaagattgcactactgcactccagcctgggcgacagagtgagactgtgtctcaaaaaacaaacaacaacaaaaaaaactgatcattaatatgagtcatacttagtaaatgctgaagtcttcaaactttagaggagtaatgatatcatccagctaattactcttaataatactgaaaaatcaaactataccttagataaaatgtgattgaggaaaaacaacctttattagttcaaagccaggcgacggggatggcagcagaaggttctctcagagggttgctgaccacagttcattcagctctgaaaattccctggcagggacatctatgaagataagtttttctctgcaagcttatatacttctgtactcatttcttggaccttaatatgtaaggtcttcttatcttgaagaccttacatattaagtggaattgagctgtaaatatcttagacttgcctctctcccccataaaaatttgccactaagcttttcatctcctacagtttgggtcccctgaggtatatgaagcaggccaactaagatctgcatagtgaacttttagtatgtatctagtttgacattttcatcaattgaaagtaaaaattttgttttattcttggtgtaacattttatttttgcagaaatgttctagtgctaatggtgcttgaatgtaagttttccatcattgggttgaaaatagggttgtctagtccagcgagctcagtgcagatcatgatgtgtttgtagaaaaagccctgtggaagagaaatcctctttcagtaatattctaggcagtgccagtgttgttttgtttctgttcttgaatttacctcaagagggcaacgaacactttattttcagataaaaatttatatatgatttgggtcttcattgcaacacatctcatgaatgcctcttgagaagtaatgaaagtacaatctgggagccataaaaccatccataaattacactgaattctgccaacacacactttaaatgttttgctcttttctctcagtctctatatttttatgagatcatctggaaaaaaaaaagacctgatttgtggcgtgttgttgctttgttaaggtaaagttttactacaaacccctcataatagagtttgtatt

SEQ ID NO: 129222 - DNA, 1317 bp, Homo sapiens
ctagagacagaaagtattttcaagtgttggcataattgtgaaataaaaagcagcccagagaagttgtggttttgacataatgtggccctcggaaatgtttggatttgaccttgcccttctctctcatcctgcccagagtctatgagtgaaaactggttggtttgcacagcgtagcccactgctcttagatgtaaggtgatgaacttcatgtttattttacttttgtttttgcttgctgactacatagatgtaaactgactttcattagcttagcagggttttttaaagattaattttaaattaggttaaaaatgatgtattgtgacctatgagtcagcaagcagcatttaaggttaatagtctgttcacgttagggtcaagttttactgctgtgttggctcaggtgtccctgctatgttttcatatgttgaacctgattaaagttttgcttcttaaaagaataggagttaaggtaaagaaaagccccagcaagcagagcctggttattatttatggcaagctagtagcaagcagtgtgttatatatattctcgtggatggataaattggaaagttgagtgaacagagagttcaaggacaaaacaggtatggcttttgtgaaggctcattaaatcaagcaaagtgctaatcactcagtactatcagctggactgagattcttcagtagtctccagagagcaacaattactggtgactgtcatcgtgtaacaatcaggctctggagatgaaaaagaccggtagtgggatctgagtcacccattcactagaatgcaaatgttgccaaataactccaacaaccttttaaaatagttttattcctttttaatcagctttgcccagaagcagttttacattcaatctttaatgctccttggctgttttcacaagatgcaatttaaagggtagttacccattaaaaagtgagtgagtcatactttctccctgtggaattttaaattcatttcccgttccttcctcttcccccgccccgccccccacgccccattaatgactttagatcctccaactatgttcttacctgtctgagaaaagctgaagtgctaggtaatgctaggtaccaggcccagaagacaatttcgtagacttgcacagctgcaacggaagcaaaaggaacctacagagacctgagagtgagtgactgtggccctgctgccctgggcgtcatttctggcaggcctcaggaccttctgcatttctgggctttgacgctgacactgcttatctctcactttttctattgaccattttactttctcttttggtcacccagatttcc

SEQ ID NO: 129223 - DNA, 1047 bp, Homo sapiens
tttatatatcttaagccctgccagctaatgtgatagggcacaagggtctttgattagtctgtaagctgcagtgccaccaggttggtttttcataggtagtactcatttttaaatcaaaattctgtcgttacttcattttgtgttgggcgtggttaatttatagaacctcatgatataaccaccaatatcgaggaagcagacttgactaccatctcaaaaaaagattgggggtaatagttatttttaaatcctcaagcacatcaaacatccaactcagttaagtctagagcatcactagcagagcattgggcagaacttcaaattttattgaggtattttcaagatagggtaatagttaagaagaggaatttgttcatggtgctgctgccaaggagttacaccaataactcaaggtgttatcaacaattcaaacaaatctggctgttcaaagaagtgagtaaactccactgacttgttttgggaccgtagatggagaagagattgtatgttgtgactaacgaaaatgaatatttcatctctgtaccattttttactgtgcaatttggtttgaacaggttgagtatgaggttgcagcatgtccacacagggaatgttctgtaagccattcagcaacttgagccttgagttcttgtgagagtttaagcaggactagactcaggcacatccagttgcagtaaggacagaggttttgaaagaggagctgccacgaattatttgtaatgagaggtgcccacctctttgataccacagcttcttggagtgaaacaaaagatagtttccagaagataataaagagactttaaaatcagtgtgctatcttccttccatcagtgtccccctggttgggcccttagtgcaaggagacagtaataatagatagtgcttctgtcaaaaggtcgctttcttctttccagaaatagaaacatgcttcccaagaaataatctaaatctatttatatttctgccacttctagctttttgttctgtagtcatttctctttttttttttttttttttttttctgta

SEQ ID NO: 129224 - DNA, 1023 bp, Homo sapiens
ttgtgcaggagacaagctggaatggtgagggcctagtgcagtccagcacacacttgctttgccccagtgagactacagaaacaaggagtttctgttctgtctgtacgccctacctggtcagaagcaaaggctgccccagggcctactgggtgtgccagagaagctgtcaggggttgagatttcaccctcggtgatctctgcataactaatggagaagtcattttctgttctctattcacaggagttttttgagaaccctgcttttcgtcccgatgggctgaaactctatcctaccctggtgattcgtgggaccgggctttatgagctttggaaatcaggaagatataagagttactctcctagtgacctggttgaattggtggctcggatcctagccctcgtgcctccatggactcgagtgtaccgagtacagaggtagtgtgttatcttttattcctaaaatagttggtgactagtctgtttactatttctcatggaaatagtctgatttcatattgagggttttggatttttcttaatggaaataagataactggaatgctatctgtaaatagggagggatggaaatcatagcatgtctaagccactttgccaataacgtatttatttatctacccattcattcatgagcctggagacagagccatgacggtcaataggcatggtgcttgcttccgagcagcttatggtctagttcagtgtttcctcttccaggtctgcttccatctagatgcagtaatgggtatgagcataagaagtgtggccgtgtgtgcaatctctgttctagagcctctgaaagaaaaagtagcaacaatcactctttacagatattaatgtaaatgtggaggaaaggtgacatatttctgatggcttgaagaaaacaaaataatctgaactgctttcttcctagaaaagagaaagtaagatctcatttacaatcaggaaccttatctacctatttatacttacatacatacatacatatatactggaaacataaca

SEQ ID NO: 129225 - DNA, 1632 bp, Homo sapiens
caagctctaatttcaggaggcccaactgtcacatatgtttctctatcaatacatcacttatggagcttgtgagtgaggagtggtacaggtggatgtaggcttaagatttcgaagtgacactcttacttcacacataggtgggtggattaaaatgtaatggaatactgtaaaacaagaggcagtggtgcaatctctttcaaaatgtggaattagtaatgtcctcgatgagtctgaggacagtttattttttgaagatagtgatgactcagttcctaacacagtaaggccattggtgaagagagtcatccagagtctagctgtgatgtcaggtttttatgctttaggattgataatgtagttaactgtgaatatgatcatttgctagattttttagtacaaagactaatatgttcatagtattttccattttgttttcttattttttatgtagttttggtgcttttaactatgatatttgttgtcacacacgtttctgttagaattcattttttttttaacgtaccttactgtggactgaggttcagtaaagcatttacttttttgtaagcatgaggagaattccttgagatgcattatgttactttatgttttgcattgagtgttactaaactattactctgactgcctgcgtaagaactcattcatatttattatattttgctacttcctttttactcatttctttgtatataccacattgaaaaatgattcagatttattttatattggaacttgctttttattcttaacagccactgaaatcactgaaattttagactaggcatatgcagtgctgaggtagcttatgagatttcacgttctagtcaatgtattacatcttgtgtttctgctgtgtagcaccactcccatgatctcatacacttcttttttgatcatgtgattttatactcccccccaacagtctgtagaatattactaattatccagaacttatgtttcttcctgatttctagccataaaatattctatttacatgagcaaaataatgttttctctgtaaaactactaaaccactttcaatatatgtattaataacaagttaacattatttttccaaaaatttccttacaaagttggagtgcatctttacgtatcagtatattttatacactagcaaatttgctgttagcactttcatgttccatttcctaaggatttagaataatcttcatggttataaacttaatggcagcatagtactctgcaattttaatttgtcttttttagtaaactgttcgccttgttagaaatttaggtcgcttccaggtttctttgctttcttcttccttttttaaatgtaattatcctggcctccactacagctaaacttcatagaactttctactgctgttgaagtaatctcttagagtagtataatctgggagaaggattacgcatggtaaagggtctaagcatcttttcattattattatacttcttaaatcctttctggaacaaggggaaaataaataaatgttacagtttttgctatgaatattgatatggctttccaaagggattataccagtttaaagtaaacatttactggttttatcacaacctctatagaattgggtgctttatagtatt

SEQ ID NO: 129226 - DNA, 2128 bp, Homo sapiens
gagatcgtgccactgcactcagcctggtgacagagtgagactccatctcaaaaaaaaataaaataaaaaagaaacctgtatcaaaagctagatagtaaaattttgaaataaaagtgctcagaaaaatgttaattgctaacttaaacattatagtcaaatgtgtatgagaaggctgagtgtttatacagcatcaagtggctgagaagctttctgatttgggaagagagactcatggggattttactcagcaatgtttttttctagcttcagccttaaagttttagagcaattctgagactgtagaaaattgctgttagtcttaagactacagttaagcaccctgactctgtttaatttgatattagttatgtcttgctaggaagaaaccactggcaaaggagaaaagtctccttccaggatatttagtccagatgatttttaataattatagtttatttatttttgtttgaaatcattgtaaaggaaaatcatttgtgtctttctgttcagtgcctttagaaaatctgcatagcctccatggaggttcacctagtggcagcttccaccaattataggcaacacactgttgactggtgaagctgaacttacaaggtttatgtggagaaggaccttttttttgttgttgttttgagacgaagtctaacccttgtcacctaggctggagtgcagtggcacaatctcagctcactgcaacctccgcctcacaggttcaagcaattctcctgcctcatcctcctgagtagctgggattacaggctcccatcaccgcgcccagctaatttttatacttttagtagagacggggtttcgccatgtcggccaggctggtttcgaactcctgacctcaggtgatccacctgcctcggccacccaaagtgctgggattacaggcgtgagccaccatgcccggccaagaagaaacttaggcaggtatcagaagggagaatggaggaaaggaagataatttgagtgagaacacaatgtttcacacttttaaaattttactgtattttactgatagattacttgatgtttttaattggttattttccccaccctgccctacccattaccttttttttaaaaagactatttatactttttagttttatgacagttgagttaggaacatcttccagggtgtttttatgaagcagcatcctaatagaagattctgtgttccagccctgaagggtgcagtcaatgattaaatgtaaaattctgtccagacacatgatggagccatattaaactgttgctgccctcaggctatttgacagctgtctgctgatgtgatatttaaatcatcatgaaacattagaataggaataccaattcacaacccaagcatgtttctgaagtatgagcaactgcagacaaaaaaaggcctagacatcacttgaaaggtttctgatgagcaaattgcaaatatcagcacctctaagcttgaaatgttacctgttgaaatagaacagtgaatgttcttgtatgtaatcgatcttcaggccaagaaagtggaactagattgaatcaaatggagaaacgtaaaaataattttaactcctacctagatgaatgcagcaagctcagatagtcagtaatctcatctaggttttcaactcctagaagactgtaacaatgcctgcttatatagtccagattgcttactgcagtactctgtccattgaacatgttcagcatacatagaattatctcttttcattttcagtgaaaaagactttgtcactgaaactggcaattaccacatttctgttccttaatgaggaaaaacttccatctggtatactcgcagcacgatactaccaaagaccattgaatccatgttgcattctcatagtggcagacgtaaatttgaggacatttgtgaattgtcagcatcaatgtgaatgcctctgttaccaggtcctcactgacttgtgctctctggtaatcagggccagcttcaaggatatgtgacccatgcagtctcatagggtcttgcacttggcttaatattctgctgtcaccgtcttgaaattattaataatttttttcacaaggactcatgttctcattttgcaccgggccccacagattctgtagcagc

SEQ ID NO: 129227 - DNA, 2090 bp, Homo sapiens
cctccctccctccctctcttccttccttccttctttccttccttccttccttcctcctttcctttcttccacagtgcccttcttgcaaaaaaaaaaaaaaaaaaaagccatcttcaacatgtaatttttggatattcctaaaatgatacaaatatggggatgctaaaaatgttaactgccgtaaaatggaggttttaaacatttaggaatttactttttactctttatatacatacttctggattgtactttcagatagttatatcccctaggcaaacctgtttcttacttttatgacttacattctttactgctaagattatattatatattgatctttttcgaattctaaatttattttaaaagcactactgtactacttcatacattcctactctggtttccccatcctcagattcattaaaggtggttttattttgaaattcagctcttttatctcactgcaagttatatgcaaacttaattttgagcccagggtttggtggagaggtttaaataaaaataaagattgaattggttaccagttttatatttgtacccctcccaccccccaaccccgctcacgccatttttttttgacagtgtcgagatgtgagaaccagagaagttggaatccaagaaattcatcacaaagtacggccataccaggttagtctcttcatgtcatagagggcctaggtactgtccttagatctttgccaaccctgggcccacatattcttaaccaaggacagagccccaggagtgaataactaagagcagagactaatcgaggattagataccggtgtcaaaccgtgaaagccaaatacaagaattctagaagagccaggttaggaaaacgaagtctgaacctcattctagattagcactgtccagtggaactttctgcagtgttggaaatgttctgtgatctgagctatccaatatccaatatggtggtgactgttgagcacttgcaatatggcttgtacaaatgaggaactaaatttttaatttaaaataaattcaattgtaaatagtcccctgtgactacgagctacatttgggaagagcatagtatgatctgcttctctctttatgtgtaactattcagctgttggcccaatggtgataagcaaatgaatagatcagcccttacccacaggctccacaaaaattaagcataatgccttaaggcattcatggtatgtaatgaattaacttttctcttatactcttataatgtctagctgtatgccagattttctgtaggatttgattctcttgtggaaccccatttgagaaaggctggaatagatgatctctgcattgatatttctgttctcagcatgaatcagttaattgacatttttcacatttaggaccttttgagagaaaaagtagacccaacacaatttgccagattcttgtgctgttcagttatttagcaaacattgttgagaaggaatatgtgttagtctgaattgttcaccttgctctgggtaccatctccccatctaccgagtgtttctgcgtgtggccatgtccatatgtatacttttctctgtgcgtgcaatattgttacatatggcttctatttaagaaaagtacaagagccatttgtacaatgagctgaagagccaaaagcctgtgcagactgctaccacaaagcttccccccagaagctaccctccatgactgaactttctctaacatttttatcccataattatgcataatatttaagtgccctgtgggaggccacacttccttgaaatttcgtcaaggtgcaggtgaccagcatcacatttttcttccccaaagataggtttcagtggaggcgataaggactagaagatgaaacccaaaccattgaacacctgacagttttgagacaaaggggtgctcctgagagctacgcatgagacgtgattttgaaattttacattaagagactcttcatggggagtcaaatgcatggaagcctttactgagctggatctctgtaagagtctcaaggttaatgaagttcaagtatttgtgaaattatacagttattttccttttataatagtccatgaacaaggt

SEQ ID NO: 129228 - DNA, 1015 bp, Homo sapiens
ctagctttttatcataatctaaataatagctcaatttcagatcatctgcatgtagagtttctcaaataacaagaagagacttgctcaaattaacagggaagaacctttctcttgtcagctggtatgataggtctacttcatttctatacaaggggtttcttttggcagtgggtttctctgggaacagccctggaatgccttcttgggactctagtgagttcagaagggaggatgccgtaagcattacttcctgtcaccctgcctggaagccccaccattgctctctataggggaaactacgtacgcctggactttctgtttgacttaagctctggtcacccttcaaatgaaagaacaagaacatttgctgtctggatgatgcatttttatttctccaatttagtaatctattactgttctgtgtaagtttctgaatcagatgccggagaagttagtccattattaagaacttcaaggagggcagatgtgaagagcttattattatatggtgtttttaatgttgtgtttttccggtttttgcattttgactttggtttctctgatgtgagtacagtgatgtgtgtgcgtgtgttttagttttttgtaaataggcagttattctccataaattaatccttagaatgaaaatctctttatgaccgtgctggtgtctgtgggctgcattttgtcagcgttacctcattggattagctgagaagaggcactgatttggatgggagtggggtggggaggacgggtggccaggattccattcctgctttgccagtagctcttcttgtgatctaggataattttacttactctccatgggcctttatttccgtattttaaaaaagtggatgtggttatcttttacagttctgactctagaattctaccccttagtatcttctttagttctcagcatgaccaattatgttttcctaattaaattgtaggtgggaccttttctgtgccatattaagagactctttaatttcatcaataatagatc

SEQ ID NO: 129229 - DNA, 1020 bp, Homo sapiens
aaaatgttaacatgagcagtttttctgtctcctctcttataatgtaaagtgcaaggaattatactggagaagctaaccacaacgtctgaaatgccatcactaataatcaccgtggaaacggagatctctgatgtcacactgcctgtaccatttccaaaagggcaaatagaactgtgatagtcactatttaaaaagccatttaacacccccaacagaatgagtttttttcttctggcagttttggctaggtatcagatccaatcgtgtgactgtttcagtttgccaagctaattgctatgcagcaagatgaccagctattccccaagctcgtctgactaccttcatcataagcagtattctatttgtgtcctttcaagtagaaaattaatatggccattggccaagaatcgtacaaggccgatggatcacacagtgatggtgaagaataaggaaaatgtctgaatggtcaatgacagaaatcactgaagtcagagactgatagccattttgtttaaatctattaaaaagccagagaaggggagaggagagaagaatttaaatatagggtgattaaatgagtcactatggagatgaaatcatccttaatcatgatggtcttagttatatgaccctaaaactacatcacagtgcctcctggtcagaaaataagtgtacctgcgccttatacaatccaatatggctttctaggactgcagttaatggtcttgtttgccagaaccactgattaataaaatcatatgtgggcagaaaatagcagttgttttgttgaagcatttaaactacaaatggctgagatttacttattcgaccttcacctgtctctcaggctactacacatctccctcagtttcaggagaagatagttttattccttgcattgtactctagttgaaaagaagggtacattcataactacgtttgtctgaaaatggactcataatccttaccaaaatgcctggaaaagcatttcttcattgtagcatatctatttgctaatgg

SEQ ID NO: 129230 - DNA, 1040 bp, Homo sapiens
tacaggaattcaatttcaacatcattattaatcagactggaattgatgatatggaatactactttgctagataatgtattagctaggtgtttgcttattggtgtctgttgtagctgcactgtggcagcattgttttgtagctcctcccaggaatctgtattccatgacttgacatttactcatttgaaggtgaatcaggtaccagtttgtagtacaccgcacatcaagtgcattagaccatctctaacttggcatcacagactatgttaattagtacacatgttttgaatattattgaataggccactaatgagtttctactgtttggatcttggaggcaactgaattttttgtgatgtttcccagccagaagctagtgatactgatttggagtggctgattggcatttgaagtacagcatttggcaaatgctgttgctaatcccaggtccatgcagtccagcctcttacatttcagagtgtgcatgttgagatcttgaagtccagccttgccagtgtagacacaacagcacatttgtagactttttgtccccattcttgttcctcttagtttatggatatagggaatcatggtcttatgcttttgcttaggaggaatagggttatatcatgtgattcctaataacattcctgaaaggtctggaagctttgagatgaatgactacctttatttaaaattagacacttcacaggcttttttctgaggaagcaagccctctccaaaagtggcccaacctatgctactcactaccagctgtctatcagaaagtctgttttaatagtttgttgcaatgttgactccttatcaatgtaacttgaatatgaatagtactgttcttttctctaaatatttgacattgccttaattcattcaatttgataaagcttttctattttagatctgttagaggcagagatttggcaggttattctttgggtgaacaggtattactgaataatgctggaaaatattggtgctgccttccttagcagcaaccaagatactagttttgtggagcc

SEQ ID NO: 129231 - DNA, 1048 bp, Homo sapiens
ataaaagagcaaaactaaacatgtctccaggaactgagctgagcagaaccaaaaggaaatgttagagatgttttctaagttcacgtgagtagaaagctcgaaactcagaagtctcctgggtggaaggcggaggttgcagtgagccaagaccatgccattgcactccagcctgggtgacaagagcaaaactccatctcaaaaaaaaaaaaaagagagagatctcctgggtgaattgtccctgctaaagctgagtgatgggtgcagggaggttcagtgcactgtcttctgcacttttgtgtgtttgacattctccaagatacattgttttaagtccatggaaaacagtatctgttttgtaaaagtaaaatagaaacataaaaagccagaagtatttctgaaagatttggggcagtttttgttagatagagataataatataagtcaggaagctgcctcttaatctctcagctaacaaggtaggaaatttgtacctaggttaagaagtcatcctgcccttcagctcttgtacattgaatcattccattacccaacacccaacatagagccaatttttttttcaaatacatcctccaggaacacatttctttgtatatacacaacataagaatagctgaacagcatatgagagatctgcaaacatttattgcatcttgattatatgccagacactgatgatagaagccattgactttaaagagctgacatcctagggagggagacagacctgcgcagtgtgattactaaaacagtggaactctaattaaggcacacagccagcctggagagagagtgctgtgaattctggcttctttgtagataggggaagtatctgcacaggtctcctggtgggggatgagtgggagggtggctgggagggccttagcagacagaatgggcggctgctgagggaagcgcccagaggcagtggctgagcccgcgtggtgatgctgggctggtttgctgatcctggacctagtcaactgtgccaggaactaaagttgaagggtctgggcaggaaagactttgt

SEQ ID NO: 129232 - DNA, 1979 bp, Homo sapiens
gcttgtaggaaccctccatttgtagccaacttggacagcagttgtaggcaacctgcagcccctctgcttgcaattggtgtctgaagttgggggcagtctctggactgagctcagaactggggggccttgcgctcatcagagtaggtagggtccaaattgagttaaattatagaacacccagttggtgtcaacagagaactggacagttgcttggtatggaaaacctacacttctcttcacaaaccacacttcatgagccagggccatcccagcaaagctgcttctttgacaccaactgatgaggaaaacactttttcctgttaagccttgtatacttccaacacttctgacagtagccacaagtgtaccttcgctactggggctgagtggagatcccattttttcccccactcttctctctttaaaacttctgggaaaccgtctatcgtttggcctcatctggagcataggcagctcagacagtaaatccacctcttctccttcacctgtagcacctaaggtggtgcctggtgttgccagtagggtagtgaatacgcaggctccaacacacgggtgcacacgtttgctgttgcctgtgagtgtgtgtgtcacataccctgagcttgagttaaaaatcagggaaagagtcttcttctctccacttagcagtttctatattttaatgcagcctgaattcaaagtaataatgttccaaacttattaagctgagattttatgtgggagagaatttggtctctgggtgggagagagtgtaaggctgagggaagcacatgccgacttttgagaattgctaaagtgaatgctccttttttaacttcgatttttctgcaggggtcggcaccaggaattattatagaaagatcggctacagattacaaggcccgtacatggtgaagatgctgaaataatggccacaccagtccactcttctgcagtatcctccctggcagaacacggagaatcaggatttcttaaatactcaacagagaggctgagcagagcaaatggggggcttcaccctcatcccgcagctgcagagactggaaactgccttcaaggccacggctggtcatctgctgaccacaccccagatccgccctctcctgcgtgcaccccaaaaaatcacttgcgtttttgaggcttaaatcatctatccagtttctacattttgcatgaggcctgcaggtggcctattttgactcagacggtgaaaaaagcaaattaactcatttggacaccataactcatgcaataaaactgattgtcattcgaggagcaaacttaagagtagtttatttatataccctggggacagaaagtcaggttgaaacaggaaaaccaccagactctaatctcagccctttaacgacatacgcattggagcgcaagttaggaaaatgagcttttgttttcatggaaatcattctgattacagtgctgatgtttagaaataaatagcagtgtgactgggaaagaggaattgcagttgtgggggtgtgagcctggcagcagccagccagcagcctctcccaggcgggagtctaccatccgagacggcgatgacaaagagcttcattccacattctttgttatctctacttcccaccctcttggcaactacagagcagtgtgggcagccccaagtgtggtccccagagagcgtttggctttcctgtctgtctatcctgagcgggtggagtctcaggttgtgtgcccctaaatcaagatttgcttccacagaagccattacttgcaattttttttttttttctgagaaagtctcgctgtgtcacccaggctggagtgcagtggcgcaatctcactgcatcctccgcctcccgggttcaagcgattctcccgcctcagcctcctgagtagctgggattacaggcacccgccgctgctaatttttgtatttttagtagagatgggggtttcaccatattggtcaggctggt

SEQ ID NO: 129233 - DNA, 1073 bp, Homo sapiens
tctggtggctcacacctgtaatcctagcactttagaaggccgaggcaggaggatcgattgagcccaggaattcgagaaaagccttggcaacatggtgaaatcctgtctctacaaaaaatacaaaaatgagtcagatgtggtggcacgcacctgtagtcgcagctatttgggaggttgaggtggcaggatagcttgaacctgggaggtcaaggccgcagtgagctgtgatcgtgcgactgcactccagcctgggtggcagagggagaccctgtctcaaaacaaacaaacatagcttttgaaatcagacacatttgggctcacattctgagttctgtcattttctagcttcgtggccttgggaaaattactcaccctgagattcagtttgctcatctgtaaaatgggaatgatgatggtatttataatctcatgggttatttgtgggggattaaatgagacacagtctgcgaaatgctcagcaagttgactggcacttaagtctttgataaatgatagctgttagaacattcctgaatgcacatcagtctttgaaaggccacggattacatataagggttcctgttattctcttgtcacttagatgtgattttatttcttgggaacatcctactgccttttcttcaaaagattctcctcttctgctggccttgaactaagtccagtctacctgctggcctgaggtggcgggggtgtgtgtgtcagccccctcagttgtgttcctggggcaggcagaactcaccagcacccggtgctgattttatcccttccttctctgaaaactcggagagtatgtgccagctgctgtctgcgattgatgcacatttattttgtcacttgggctcagaacgtcctcaccagtgagcagcttctgattaatgccgccaccccatccatttcaagaaaagcttcagagagtggcaccccaacatcctaagctgggactggggtgaactctcattcagcctgtttctccatctctctttcgtctcgaaactcattctcatgcccacagttattggggcataaagattccttaaatggcttcctccaga

SEQ ID NO: 129234 - DNA, 1065 bp, Homo sapiens
cacatactcacatctatacctataggacttacaaaaagttaagtgcattggctgtggattacgtaaggtctctttactgaattgcctctccctccctcaacagggtgcttggtgatagttcccggctcctatgcaaaggtctccttgattttgtttaacctctgcccggtctccctttgaattagaaggctacacaagtacttcacctttccctaattcatgggcacttcagtcatttccagatcctttactgttaaaaacgctgataccaaaaaacattgctgcacagacctctatagcacctgtgagttttctctggggtaggtactgagaaagtggaactgctgggccgtagggttcttgagttgtacattgtaacaaagatgcattatggggtcagttcctcacttagagttactgtgggacgggggatgcctgccctgtgctcagacattaagcagttatttgaagacaagggggcaggatttagagtgtgctaggtggatgctcaccggcctcacaggtcgcacataccattgctggtttgtgggaagggttggtattgggaagggctcttctgggcctcctagttaattctacctggttcccgccccccaacccctgaggactttgacccgtatgttgatagtggttgtgtggaaaagaatcacaggccgaacgggcagcccgttgtggactctggatgggaaattctaaactcagttcacttggcctggagaccgtcaccgcacctgcggttcttctccaggctgcctttgtaatccagtgtggcttaaacactcaagcaaagcgtgaggcgtttggaagcatgatgttctttaaaggcatctagaatgcggccacgtggctgttattagcagtttatgttaattacagaagaatggcatgtgccactgtttacgattctggccttcatctctatctctctatagaacttgtggaaaacatgagaattaatcctatcagatcaaacccatgcatttaggagccagtgtggcaagggagggagtggctgtgcccttcccgaagacagctttgtggccg

SEQ ID NO: 129235 - DNA, 1054 bp, Homo sapiens
ggatgaactgtttttggtgtctcagggtgctgcagatgtggggaggtatagagtgggcaaagccttggagttaggaaagtgtaaagtctatgattgtgtgagagagaagaacagagggttcttgttagagattagggagaaatcaagttgttaaagtgggctggggtcacatatagggcaaaggttgtaaaccggtggccagggagtgttttaagcatatggatgtgttctagtttggactacataaaggtgtttaaaaattgggggaaaaaatacagaaaaatctctggatttgcagctcttttaaagagtcagatctggtgttcatctcaagctgagaaggctgtcccctatggacaggagacaggcttgtggtccccgggcttccttttgcctcagtccagtcactttccattcttcacttagtcctgtaggcgttttgctttgcgacctgagttttcaagagactcgaatgctgggccaggaaattcgggattgctgtcatgggctctgggtggccactgaggattccgggtaggagtgtggcattatggaatctgagatatttctgtgcaccggatttgttttaggcaagtcaatagcactttttgaggagctgctggctgggactttgaaatatttttatgatgatgggaatggaattatagagggctttgacctgtgttctccgtagtaaggcaagtttcaagtgaccccaagatttctccagcctttccattttccgcttctggctggcagggatctctgagagtgatgtcgaggtcataccttggtgaggtgtgagtcacagccatcaggtgccatatgacgtacaattctcaggagcctggtattgatccaaatggctcccagcagacgaggctgatttggggtccagctgaagtgactaagttcaggactctgtgacctagaatagtctgatttaccacccaagactaagagctcgtcccagatgagccactggtgagagagactgacaaatagtaccctgatgtttacaggtgggactaaaatcagttatttaaaaatactg

SEQ ID NO: 129236 - DNA, 1027 bp, Homo sapiens
cccgcgccgaggagccagcagcagcccggcgcctcctcctcagggatcgttcctctcgtcgcggccacaacaaaagccttgggcgccggactgtggcgggctgcggagcgggggcccgggcccgcggtggcggctgggggcctcggggacgcctagtttgaggctgggggctgagggctgagggctaaggggggagctgccccgggagactgttaaccctgtccgccctgagcccgcggctcggcaacctgtgcgagtgtggaccgcggttcgctcgcctctaccccggctcagaccctgcgcggcggagagaggggcccggccggagccggcggcagcgcggggtgccgggggccgtaggcggaagacaatgctccgggggctcccggccgcccgaagcgcgcgccgccaggctcccggccccggctcgggtcagcttcgggcccacctttgcctgcccacgcctgaaagtttcccctcccgtccatcagtttgcaaagtccttgctcccttccgcgagcttcccccggctgcctcctccgcgggctgtgggtttgccgtggggtggctgctgctggatccccgagggtccgcatctgaaatgaagctgctgtgaaatagccagcaaggtgaaggagccttgtgtcctttcaagacatgtaaacatcttcctagcggtgttttacatcttaggagtcttgagttcgatccctctgttgtaagagaagccaagggtgcttttcttggctttgtttttaagaacaaaagcacgtgccatgaattgaggcagaggagtagatttcagatttagagagactggctccatgaaggaggtccggcggtttgcccagtgtagaatgactctttgaattttggttcccgtctgggttgagggagatgcagcagcagcacagcagagtagccgcatcagtgactgttacggggaagtgtttagatacagcctcatcttagagaagtagttctgatcgggaatgcttattgatgggaattgagttactttgtaaag

SEQ ID NO: 129237 - DNA, 1101 bp, Homo sapiens
ttttaagggagactaacctaagtctaagaaaatttgtaagattattattcatagattttgaaataaggagggcatcttatatattccaaatatttgaaaatgctgtagaggttgaacaaaacattttttgcttttcctctgagtacacgaggtctaagtggttgaagagagagaattggtataggctatcagattaggatatataaaaatgggtattggtttaatacagtaagttggttccaggcatggtagtctttgctatgtattaaagctatcaatttctcacagaaaattgaactagaaacatttttatttctggtatcattttaaatcataactcctttgggaagcaaataggttaataagaagcaggtcataaagatgtttgtcctgacttgggttcaacttttggctctgccatgtagtaggtttaagactttggacaggttacttaacactcctgatctttgttttcttcatttgtgaaaaggcagtataatgatacaccttgaagggctgttaggattaaataagagatttatgaagtagctagcacaatgcatcatacgcaataggtgattcacaaatattaattctactccaaattccatttctaaatcatctaaagggaagtactagaaacaccatgtatttgctccagtgaatttgcatccctcattgtaggttcatggggcattcattcatagtgatagcatgataggctctctctgacttctcaaatatgcacaagtagtctagatatttcagtgacaatggggttgcctctgtttgaatttcagacactgacattctggggagagcacctaagtgagtaatagtttctaagagaaggctctaatgacttgaagtaatgttgggaatagttgcatattgcatgtttatcgtatcaggacagtgatgccactgacagaaagaataatcaaacacagtttgagagtgtaacgtttctttaatagcaaatgacgtggaaactcagcagacaacactgcctgctcagtgctgctgatgactctccacctccatccctctactgatccaggaaccagcttagcaggcacaagtaattggagcaaacccagc

SEQ ID NO: 129238 - DNA, 1051 bp, Homo sapiens
atgaagggaattcatgacaacggtctccttagttgcataaatgtctgcaacacaaccttgttttctttgtctcgaggctatcatactttttcaagacatacaactagtattttttgctcaactgtcgaaaatctagttgtatggaccacaaacaagatatcaccatttactttatttctacatattacatttgctctccaggaataaataaggttgtgagtgccagatttggaaatccaaactgttagatcgtgatagatttccccataagtaaaaatagttctcatcttgttttgttttttaggttcccagattgtgatgagccatatcctcgacttgtggatctgaatttagctggagaaccaactgaaggagccccagtggcagtgcagagagactatggtttttggtgtccccgagagttaaaaattgatcctgatctgggttattcttttctgcatgtgcgtgattgttcacctccttgtccaaatatgtacttcagaagagaagaactgtcatttgctcgctatttcataggattgatttcaatcatttgcctctcggccacattgtttacttttttaacttttttgattgatgtcacaagattccgttatcctgaaaggcctattatattttatgcagtctgctacatgatggtatccttaattttcttcattggatttttgcttgaagatcgagtagcctgcaatgcatccatccctgcacaatataaggcttccacagtgacacaaggatctcataataaagcctgtaccatgctttttatgatactctatttttttactatggctggcagtgtatggtgggtaattcttaccatcacatggtttttagcagctgtgccaaagtggggtagtgaagctattgagaagaaagcattgctgtttcacgccagtgcatggggcatccccggaactctaaccatcatccttttagcgatgaataaaattgaaggtgacaatattagtggcgtgtgttttgttggcctctacgatgttgatgcattgagatattttgttcttgctcc

SEQ ID NO: 129239 - DNA, 1058 bp, Homo sapiens
tttactgaccactttgatctaaaattgcttgctggccggccgctgcggctcactccttaatcctagcactttgggaggctgaggtgggtggatcacctgaggtagggagttcgagaccagcctgaccaaaatggtgaaaccccatctctactaaaaatacaaaaattagctgggcctagtggcgcatgcctgtaatcccagctactcgggaggctgatgtaggagaatcgcttgaacccaggaggcagaggttgcagtgagccaagatcctgccactgcactccagcctgggcacaacagagtgagacttggtctcaaaaaatgaaataaataaaataaaatagcttgcccatccactaccacaccacacccacacacgctatcccctaccttgtgttttagttcttattgctacctgaaattgtaagatttctttagttcctatacattgatagcactgcacccttaccctgctctacagtgtaagttcaacaagggcagagaattttctgactatttgctgttatgtcttttgtacaaggtcatggtagcactcagtatttaagtgactgagttaattagctgtgtgaccttgcagatcagttcacttccctagagtttgattgcatctgtaaacaaagggatgagtaggataggatgtatctctaaggataggatttagactctagatgatcagtcatctagaattgaagacaaccttgaagtcatgaagttcaagcctcttattttataaaaagtgatttgacttatgtcacgttgctcaggccagtggtcttcacatcacacaattgttctaattctgcaatcaactctgattagctctctttatcttttttcattacaattcttagttttaatttttatgttctttgccttcatcctcttcatcgtattacttacgtaagtcacctctttacaaataattatttttcttcagttagtccttgttttctcaccatttattgagtataagccagtgtgatttgaagtctgcttcccagctctcattctttgccttgccacactccactgttttt

SEQ ID NO: 129240 - DNA, 1040 bp, Homo sapiens
attgcttattggtctgaaggaagattggtatgtatcttaaacttactattttgttgtctaggatagtgaatgagagccgacaggtactccaggaacctgattttgctcagtctctcctgagggatccaaatactcctatcataagaaagtcaaggggaacttccactcaaggaacatccacccatgcttcttcaactcagctggctatggtggatgatcaaagaagcaaagcaggaagcatccacagcaaagtgagcagctaccacggcagcctccacagatcacgtgatggcaggtgagttttgttagtagtgtagtttatttcataagctgaattatgaccatacagcttaagaaagaggagcagccaattctgaaatagaagtcgaacataattaagcctttgaactttgctagatagagttgtcccagactatggtcagacttaaagtcagtcagaattgtttagatttgatggagtaagcaatatgggagttattgcaggggattgagcagggaaaagacagggtaaaagtggttattttagtaagattaatttagtaaacaattatggaacacctactacatctagcactcttgctaggccctgagaatacaaagatgacttaggcatgatctttgctcttggtaagctcacagtctatttagaaagatagtgtagtcagtttgtggtttagaacatggatctagaatgataaacctcagcttcctcatttataaaatgaaaatagtattaatatctgcctctttaataatcttgtacaaattaaatgagatagcatacctaattccttggaacagtgcctatctcagtgagtacctcatatcagcttctgttattattgtaattgacaattgaactaacacataagtatgacagtatagttcaggaattagcaaacgttttccgtgaagagccagatagtaaatattttaggccttatgagccatatggtcttcactgcaactatttgagtctgctgttgtagcatgaaagcagtcatagacaatatgtagtc

SEQ ID NO: 129241 - DNA, 1045 bp, Homo sapiens
gctctttgaaaactgtaaagcattatgaatgataagggattaggttattgtggatttaagaggtgtgaggactgctatagtacattccttgacgtgtgttgaattcatgtatactttctttcttaccctttaaaacaaactgccaagaaattaggtgttgaaaaagaatattctcatcaggcagcaaagtcagttttctgatagtaataatttgtctattatgttatatatttcaaagtacatgtatgataatatgacttattcttcatgagagatatttgaatatttggcccaaaatgtttttcatttttctctgtgttcattgcctttctccttggagctggagttaatgctcaaagcaggcaggtctgaattccctcataaccgacaattagtaaacattttctctgaaagccaaacatataacaacttatttatcaataattcatgaagcttttgtctgagaatctctcctgcaaacagcatgagagaactaaaacaaacattcacaaacaaaaataagttaaaatagaaggtaccagtttgggctcgaagatgttgtcatccattgccatctgcattatattatcaactgccaaaatgttaattggttttcttttacaagtgggccaagtatagacagttaagtgaacatcactatgaaaatcttaactttgtgcttctagatttttagataatcatttgtattttctctattaaattgtgggtatgtatgggaatactatattgacttttcagttactttcagtaagtatcttaattttgtcccacaaaatttatgtaatattaatccatggttttaaacaacagtattcagtttgggcagcagttttaagtctaactagcttaaaccaatctgaataagtctggacagttttcctaccatatgtttaactttgattggcatatgataatgtttagtgttttcttttttcagttgacaactgagaaaataatagttctctctaacatgttaatatattatcaaaaggttttcaaaaagtactttgatttcagcaacttt

SEQ ID NO: 129242 - DNA, 1022 bp, Homo sapiens
aaagtgttagtgactatagcccttttatctctcttaaagagaaatctgcattaaaagcaaacacattgctgttagctcaaattaatgtcagtgagtagaatcttaagctttaaaacaaaagtggaaataatttaaattagtgttgatgggactattttgaggcaagagataccattaagtgacctagcttggaaatctgccccctttgcccaaacccatgtgatgtctgaaactactgtatattttcaatgaccttgagaaagggagctagtcatttgtatttatgggccttatgaagtcagggcctgctgatcctgttttttaagttcaagcgcaatgcctgaagcatcctagatctccttcaccctcattctacctgacagacagctaggtctgtcttccagctctttctcattgatactacctttacatatgaatactatccatgcttgttaaaaaaaaaaaaagtctttccccattttactgttacaatttttcaagagctataaaggtagaaaaagtattccttttcattattctaaaaaatatgtcatttttaaatagctggcacttagcagtttagttttccaaactttattctgaatcaaattgctgaggtgattctaaatgtctaatgttgatttatcatataaacatctaattagaaagtgtttatgctaaagacttgtattttgtggcattagttcttcatgtttcttttttatatgtttattaaaattgttcacttccaaatgagtggaaaagttgctgttgttgggatgtacagggcaagtgcacttggttagagcatgaactgggaatttcacattctctgatgtgctttgcactctgctcttgtagatttattttgtttacagtagactgatgtcagtttttgtaaatgttttttcttagcactttaactgtgagtgtacaaactgattttaaatgtagtggttgtatattttggttataaattggagatttttaataaaattaaataattctcttttctgtcatta

SEQ ID NO: 129243 - DNA, 1031 bp, Homo sapiens
tattttatttgatgaaagatcccatagctaaaaaccattggcttagcccaatacttccattttgcagatgaagaaactgtgcatatatgtacctctgtgctctggcacacacattgattaatcctcaactggcgaatgaccggcatttgcccaccaagttagccaataatcaacataaaacactcaaaaataccctcctcccttccctcagaggcgaaccttaaatttagcaacaatcatttaggatatttttccatcttaattaagtctttggtatatcttaaattgtcaggagattagggactttattttgttcactgcctggcacatagtagataatcagtgcctcagggaaatatttgactttagttgacaaatattacagtttggacaattaataaatatgtatatatacatatcttcatcacataaatggctagacccttcaatggttagagggagatgattgtaaaaaagggctcctgtttttctgcataaacttagaattaacagtagtgtacagaatataatgtacaatgcaatcttcactgattttacagcatctggagatgagtgttcagttgtctggaagactttaagaggaatattcacaactggagtatttcggagaactagggtctgacaggatgccataggagaactgaagaataggaattgcagaataggacatattttgcctgcagagatttggaggaaacaggatgcctttttttcaaatgtctacttctgtgatagaattattgtatatctgtagaatagcatcaatgagtgaaggtacaatttccactcaataaatagaaagtcttttataacaattagagttgtctcaaaatgaaatggaaggccaaacaaaaaaaaaacaaaaatataaaataaaaatgaaatggaaggctttacatagtgagcttcctgctactgaaatcattcaagcagagggttataaaggatggtgttttgaagaaggtctgcaccaggttaagctggacttaggatttctaaggtctcccaac

SEQ ID NO: 129244 - DNA, 1050 bp, Homo sapiens
taattttgtattattagtagagatggggtttcaccatgttggccaggctggtctcgaactcctgacctcaggtgatctgcctgcctcggcctctcagagcgctgggattacaggcatgagccaccacgcccagccccagccactcctttcttaaaattgtattccagtcctctcctcctgccttcgactccctggtttgtctccttaccttgcataaaggtccccacagcaatgcaacctggagagtcctctggcagactcaacttgaaggtgtgggagcttcctgtgctggtcagtctgttgacccagacaccagatcctctggggcggcaaggatgaaagactctggttgtgctaatggagctccctcattgtttacctgtcagagaaaaattgcgctgaacaagttaagtaggcaaagaaaacttttttcaagactattgcattgggggtcaagactcaaccctgaatataacagtggcagctggggatttgtagacaatggacaaggtgcaggggccagtggatggaaaagtaatgcaaggaacttggtaaagtaacaagggtgggggattcttgcagaaccagattcagcaggccaaggatgaggcctggtcaagaagagcattcagaggagcctgactcaagtttggtcaaggaccaggagtcactgttggcccctccttcattcaaggtactgtgaatatttctgttcaatactgggcctcttggccaagtggctaccctcctcactggacttgatagctcaggcctctgatatttctttattttgcatggttccgattggtgaggtttccttaaagcttactcagctgtaatgctttggcaagcagaatcaaattgtgtttaagcccaggctttggaatcagaagcacttaggttcagatcttgtctctgccacttattagctgtatgactttgggcaggtcacttaagaatattttcttcccttggtgtggggggaggggggagggacagcattaggagatatacctaatgtaaatgacgagttaatgggtgcagcacacc

SEQ ID NO: 129245 - DNA, 1003 bp, Homo sapiens
aattcagaagtggcttagctgggtgttttttctgggtggtggtggtggtggtggtggttttgttttaacttttaagttcaggggtacatgtgcaggtttgttgtagtaaacttgtgtcatgggggtttgttgtacagattatttcatcaagctgggtggttttggcacagggtctttcatgagactgcagtcatctgaaggcttgactggggctggaggatctgttcccaatcttattcatgtggctgttggcaggaagcctcagtccctcacctgggcgtctccatagtgttgtcacaacatggcagtgagtttctcccagagtgatctaagaaggagaaagcaaccaagatggaagctgaaatgccttgtgtcgtttaatcctgggagtgacataccttcacttttgctgtgttccattggccacacagatggatcctagttagggtgtgggtggagacttcacaactgtgtgaataccagggggcagggatcattgggggccctttcagaggctggctgccatgggagtctccaaaaacattctgtattgcaggggtgaagttggggggaagtgtatgccttaatatatatgtgtgttgttagacaggctagactggtattatagttaccagacttttaggtttaatagaccagtaaaataaaaaataactgggtaggggataccaaaattagtatatttcagtgttttgttgagtgagaaagatacagaaaaagctgccgttgaccaccaccatggtcatttcataaaaacacattttaacataaaaaagggagaataacataatctcagaataaagtctaatcctttcaattgaatcattcagctttgttaaaaactcacaaacttgtctgtgcttttcgcatttaactgtggactgatgaaaacttcatcctagcttggtcaataaactgttattcaggaatcactgagctagaccataggatgctccagtaactttcaagatgactgtgaagatca

SEQ ID NO: 129246 - DNA, 1057 bp, Homo sapiens
aagcttgcacctacaaatgttccctaaggcaagcataaaggcatctaacatttaccctaaattatgccagtgagtagcaaaaatgtgctcagttagacgcaacatgtcacaacatggtctgactgttggaagaacttagtgcagggagagctatacccagaggaaagaagtaaaattaggcagagtgttgatggctgagttccagtgtcacatttatatacagctcaatgactctagaattgtccttacaccaaaaaaaagttattcatagattcaaaaaatcaactgctcactactttcatttaaaaatgccttgtgtgaacaaggcgttccaactgaaaactggcagaattcatagaggttcttaaagaacatcaattagattcttagtcaaccaatttggctgtaaaatcaaaactgaaagtgcaatttccaaaactaattatgctaaatacttttaaatatatataacttgataataacatttggactttatgtatggaaagaaacagtagtttccaccacaggaattttcaaaagaaaaatatataggttttaaaccaatttatgaagatctgcaataagattttattgaagagaaagttttcccctattttcctaaatattactcaaaattaattctcaacccaaaaggtgacagcatgattctagtagggtccaagtcaatcccagaacacaataataattgatcccttccccaacccaagccttcagccttgcaaacactatgccatagatcaaaagtggaaccaaatgaaaatgtgaccatatttctacaaatccatcaatttggagggcaaaaaaccaacaatccaaagcccatctctaatggacagtgttagatatttcaccctcatgtcaaaagaaacatgtataattacatcatctaggttactaagaaaagcatatctttaaagtgaagaggtatttagaaaaaggatacttgacataaatgatgcaaatactcaaaaaatatattaaatatctgtgaaatgtgttaactatgaaagctttttaaaagcacatgctgagcctt

SEQ ID NO: 129247 - DNA, 1760 bp, Homo sapiens
gatttacttaagagtcgtctttagcatttcttgtcactttgtcctattctttgtccaatttaggtagcttcatttttactggcagagctccccgtgctttcttttgtttttaaaggctttgtgtgttgcagccatgcagactctgcagttttctgtattttgttcggcagtgagtcctgcattctgatacagtgactatcgctgtgacctgtgtgctgggatagtaactgcggggcacagagtctggagcgaagcgaagccttctcagcgacttgctatttagcagagggactttgaaatattttgtgatgaaagaaaaaccgttttcttaaactgttatttgatgtgttaaaaataccttatcctgtgggaatttcccattcgtttgcttgtggggagccggaggaatcataagaactcacgagcaagagagaatcgagcctaagtgctttctggaagagtcagaattgtggctcttcagacttccggaaacgtgcttaatgtccagagatgtgaggggcatacctacctaaaaaatgattgacaggcgtatgtctgtatccctccacttctcgcttttctagtgggggaaaaccctgttaatacttggtgtgtagttgggatctttcagtgattaggcctcaagagttttgacctcggagtaaaaagattttaagggaacagtttggagagaagtaagtcgggccaggccgagcatgggaaatgtatttctaggagagagggcaagtccagagggtggtttgaagccagcagaagactagagagagacctgttcttttccgcagggccctaggccagctgtggattggagggttatgggtgatgaggggctgcaggagtgatgcggagtccttgtctcagttgagactggtggtcttctggaggagggtgggagggattccctgatgtagactcaggtgttaggagaaaaatgaagtcccatcagacctactcttggtaaaggttcgagcgcctttgtatgttactctagagtgaggcgaggaatatgaaaccaggacgtttcataacgtcctaaaactgcctactccattcgctggttattaagtttagctcagaaaacttctattaacatatttctattttatttttgttaccccttcatttcggcaactatcatttcgaagactttcaatgatagggcagctgactgagagggaagaaaggatttttcacgtttggaggtttcatggaaatagcatagcccaggcagagagagtttgtgagctcaagagggacagaggtgggctcacctgtaagcttcatcttttcttttcttgcctgaaccagttgcacagtccttttaaattttcagtcattcagacctcttgggtgatgttactagggagaagagaagcaggatttaaaaaacctgtgatcttgaaaatagaagaggattggggagactcattactaacatacttccctctcccacagttaggccataaagtgcagtgtaggatactactcacatgcacccaaatgacccatcaaaagtctagaagtggagccataggaagatgaactgtagaatctgttggagagtgaaagcatcatatacataatatataagaatgcctactatacgcagccatacaaacggaatccataactgaatgagcaaagctgtattccagtgaaactttatctacaaaagcaggcagctgccgcttgcgggtgcctgccttagagtgccacccctcacacacatgcctttcctt

SEQ ID NO: 129248 - DNA, 1001 bp, Homo sapiens
tcttcaagactgacatggttctctttcttttgcaggcctgattgttggcaaaggcatcataagaagctggcatttatttctgttctaacctattactgtataactgtgaatagacactatgcatatttgttggtcagcaaaaccaagaaacaagagctatggcatttgaaaaagtctgtctgattccagggtgtttttcctgggtttcatcatcaggtacctcctccctttcatctcagcaagaatgtggcaccttttatcgtttgataaagattaaggacatgttctttggtcaacagccagaacttaaaatctgctggaatagggtcagagaccatttcagctgcagctgaggaaaatgaaatgttcattttatttggtgccttgtctggggagcacactaactcttctggaaacgtgtcagtgaaacagagatcgttttgtggaatagcaacccatggttatggcgagtgacccgacgtgatctggggggcaggctgcagaggactcatgacaggctataccatgctgcggaatgggggcgcggggaacggaggtcagacctgcatgctgcgctggtccaaccgcatccgcctcacgtggctcagcttcacgctctttgtcatcctggtcttcttcccgctcatcgcccactattacctcaccactctggatgaggctgatgaggcaggcaagcggatttttggtccccgggtggggaacgagctgtgcgaggtgaagcacgtgctggatctgtgccgcatccgggagtcggtgagtgaagagctcctgcagctggaggccaagcgccaagagctgaacagcgagatcgccaagctgaatctgaagatcgaagcctgtaagaagagcattgagaacgccaagcaggacctgctccagctcaagaatgtcatcagccagaccgagcattcctacaaggagctcatggcccagaaccagcccaagctgtccctgcccatccgactgctcccagagaagga

SEQ ID NO: 129249 - DNA, 1084 bp, Homo sapiens
tcatcattacccccggggaccctcgcttggttatttcctctgggtgtgcaacacggctcttcgaagccctggaagtcggtgccgtcccggtggtgctgggggagcaggtccagcttccctaccaggacatgctgcagtggaacgaggcggccctggtggtgccaaagcctcgtgttaccgaggttcatttcctgctcagaagcctctccgatagtgacctcctggctatgaggcggcaaggccgctttctctgggagacttacttctccactgctgacagtatttttaataccgtgctggctatgattaggactcgcatccagatcccagccgctcccatccgggaagaggcggcagctgagatcccccaccgttcaggcaaggcggctggaactgaccccaacatggctgacaacggggacctggacctggggccagtggagacggagccgccctacgcctcacccagatacctccgcaatttcactctgactgtcactgacttttaccgcagctggaactgtgctccagggcctttccatcttttcccccacactccctttgaccctgtgttgccctcagaggccaaattcttgggctcagggactggctttcggcctattggtggtggagctgggggttctggcaaggaatttcaggcagcgcttggaggcaatgttccccgagagcagttcacggtggtgatgttgacttatgagcgggaggaagtgcttatgaactctttagagaggctgaatggcctcccttacctgaacaaggtcgtggtggtgtggaattctcccaagctgccatcagaggaccttctgtggcctgacattggcgtccccatcatggtaatagagaaacgaacagttcgttttggtgcatgaaatagtatttcactcttaatcccttttccaacttccttcactttagcaatcgtaacttctagcagaggagaatacatgcatactcatgaaaaacctgtatagattcctttcttcctgaagggtttgcttgctgctttttcaagccttggcagttctgtggctgttactcacttcctaaatcgaggatccccaaa

SEQ ID NO: 129250 - DNA, 1033 bp, Homo sapiens
agtaagaggaagagttggaatttgaacccaagcttttctgattggccccaaagccatgctttctccctctgtaccagtgcttctccccatttaatgtgcacaggaatcccccaggggcatgttaaaatgcagattctgactcagtgggcttggggtgtgcctgcactcctacaggctccggtggtgtgtgctgctggtcttcgcctcacactttgaactctgaagctccttgctatattcctggtttactaattgtgctgtagataatccacctgaaggttaacccacaaaactgataatctacaagccaatattcaagaactgaagtggtttttcttcattttaagctgtgtgagggggagctttgtttggctgaattggcagaatcagttctgtactgagtgaatgctaggtgtgttaggtaaagtgaatgttcgaggggagtttgttgagggagtttgtgaacagctaccatatgccgtcatttccaaggcggaccttattttacattttgtcatctctgaaattgagatgtgtcttacaatggatggcctcttaccattgctgagcttgccattcaagtccggccccttcttgccaccctcccgccctttggcgagtggaaccgacagctgctaaggtgagcacttggcatctgctctccttgctgctctctcgtctgacctaggcctcactcggtccttcgttttgtcattgtggactctgagcttaggataccctgggctgtacacttgggaatttttatgctggtcagacatgctgcagggcaaggtggatttctcggtctgttgcttggcttggacatctgttaactgtggtggcgaatctgttacagatccttctttgtcttgagttgggcaggacctcctctggggctgaggtgaagtcttaaagaaagctctggccaagagtgttgactcttgcctgtaatcctgtcactttttttggaaggctgagggagggggaatgcttgagaccaggagtttgaggccagtcaaggctacatagccag

SEQ ID NO: 129251 - DNA, 1022 bp, Homo sapiens
tttgggatttatatcccaaaaaggcgttagaattgggagtcagaagtgacagactcatgaggtttctgagttgggttttaaaattaacaagcatgctgggaattccatagccattggaatctcagatccactctgccaccttgtgttctcttgggagagttgtttttaatttccctacatcgtgtttattgcgtgtataaaataatcttcagcttttgcttgattcacaagaaaattagctaactaatgaatgaagcttaaaaggtaaatctatatacatttattgaagtataaggcagcttttattcctgaaaggcatatgctagattttacaagcgcggagatcaggcaaaattattcagtaaatccagccatggtctccttggacctaaatacagattttgtttggcctttcataacacagccttaatttttaatgtttttccttcctcatcacaggtggtccgtactgagaagaacagtttgaacaaccgattcttaccctggaatgaaattgagacagaggccatcctgtccattgatgacgatgctcacctccgccatgacgaaatcatgtttgggttccggtgagagactaatttccaatcaaaactttaggttgcaagtgacagaaaacctggattaggctgcaaaatgaattttttggctgatggtaactgagaaccccttgcagatagtcagggctgatgtaggacgtggctggatgcaggctcgtagatggcgttggaggagtccatctctcttcatctgtaggctccgctctgtgttcccacaggcctttcctctgtggccaggaaggtggaattctttgattggctagaccctggttacctgcctgttcctggtgctgcaggtgtatcatccttaaatccaaaccacatgggcagagagtagaggcaacgggtagggtagttctctaaaggaaataggagggttttgtttttagaggaatgggaaggcaaaagtgacatgttgctgtgtgttggagcaatggaacagtg

SEQ ID NO: 129252 - DNA, 1041 bp, Homo sapiens
cattcatgtttgagatttagcctctggtaatggagctggtgaattatcattgctgtctatacatcctaaccttttcctaccctgacccttttctcatgcatttgggcatcctttgatctaaaacctttctcttattaatctccccaatttgcttatttcaccttaatgggaatgaaacagacctaagttcaaaggaaagggtaagtctaagaattctttcttctggcaaagatagatcttgactcacttcaacttaggtagccaagaaagaggcagatacaatcaatcataagggacagaaaaggtataccaagagacttgagagcatgtgtccatacagaaaggaatacacaaatggccagagcagcgttattcgtaacagaagtgcaaacaactcagagggataaatactgtggttccattatgtgaggcccctaggtagtcattcatagagacggagagtagaataggggctgccgggctgtgggaaggtgggagtggggattagtgtttaatggggacagagtttccgtttgggaagatgaaagagttctggagatggatggcagggatggttgcacgacactgtgaatgtccgtaatgccactgaaccatacatttaaaaatgattaagatggtatattttatgtttgttttgccacaatttaaaaaaaatcagttgtctaaaaaaacccacctagaaggctgttacattgtgatagaagttgtgatttctcctcttttggattagattagatgcttctagacttattaggagaggaactctgttgaaataaaatcttctgtgtcttaggaactgaagttccatgtaagtgatgagggagtttgcaggcagtttaaatctctggcagcctttctgcaggcctgtcaggtcctgtggagcttaaacgctttcagttctccaatttatcctgtgaaactggggaccaattttatttgttctaatttacctataaatttggagatgatatagaagtttctactgaaacatactgaagtctccatttatttcttccattt

SEQ ID NO: 129253 - DNA, 1163 bp, Homo sapiens
tgacattctgttactaaagggggtgatgatggcagtttgaatgggataattcctcactgcagaagatccacacgacaggatgtctcgaatcccctgccccagtccctaagtgccagtaatacctcctagttactgccacacccaaacagcccctccatccatgcatattttggctgaaagccaacaacctgtgtcttgtaacagagcatgtggttctttttcttcccctgacagtattatgcctacctgtattcttatgtgatgccccaggccatccgggacatggtggatgaatacatcaactgtgaggacattgccatgaacttccttgtctcccacatcactcggaagccccccatcaaggtgaggtcccaccactggtggggctgtggatgcgtgcatgtttacttcacttgttttgcagtagtgcagcacgtaactgcactgtacctcagagtcctcatttgtacaatagggatgatactacctacctcatcaaaggattgtctgtgagcttaaatgagttgttactacaggggcccttcattcctaagggcaatggatagaaatcagaaggtttggaacttgggtgggaaagatgttgcatcattatttttattaatgtcttactggaataaagcattttcttcagttatgaaacaggctataattcataagagtatttgtagtaactgatttgtcaccagtagaaatcactgatatcttcatatcacaatacctttattgcaatatctgcaaaaagtattgtttgtatttgttactgctttgaattcacggcagttactccctttcccctagatgttgtgatttaatacattaagaaaagagcatgtatgtcactgtgttttactgtaactcgtttcctttgtcatcctgtgtattgtagtttatatacctaaaaacattactttgaggagtctacagtcttgaccagattgccaagccagaggcacaggcgatgtccatcaaacaaaaaacttaagaatttctgagttaatatatgtaaagctctaagaatagtgcctggcacataagtactatataaattatttgctcacaaccaaaaataccctcagaattctagaagttctgagggtattgttgtgtttttttcttggaggtattaacacatacactcagtg

SEQ ID NO: 129254 - DNA, 1016 bp, Homo sapiens
cctctttgactagcccctctttgggtagtcttcaatacccaaagcccctctttgggtagtcttcaatattttgattcaaaacattgatgaaacaaacaactcggtacctacctatggctctgcaaccaagtacatactaggagtagacttactgagacagctgacactacacacgttaaggcttttggcatctgagaagcgtaggccatctcaacagaatacctgacaatgttctggagacatctggtaggcaggaggcctggggccgggctctggttcctgccatgctctgcagggatgttgcccctgaggggatcagcgtcttcaccatggacatgggagtgtgggatcggctcagctgcaagggttctgtcagtattagctgggattcccactctgtctctctctcccgtttccaggtgacctcacggtggacattccgatgcccaggatgccctcaggccctgtctcatgatgactcccacttccacgagcggcacaagtgcatcaacttcttcgtgaaggtgtacggctacatgcccctcctgtacacgcagttcagggtggattctgtgctcttcaagacacgcctgccccatgacaagaccaagtgcttcaagttcatctaggggcagcgcacggtctggggaagaggatgagcagagggaggaagatggctcccaaggttcctaggcattgcaggaccttgggcacatctgctggtgggtggcccagagcctctgctggaaggggcagcaggaggagtggaaggaaaccgctgcctttatcttgaagtcagccacactgggcctggagccctgggcggagtccccggggttccccacacagggcactgactgatagcttacactgaggactgtggcgactctgcagagtcactcacaccgttcgtacgcccaggacagctggttcgtggtttttacattcaataacaactattatgattatttaaaaagagaaagtttcagatttgccattcaaggcttatttatata

SEQ ID NO: 129255 - DNA, 1991 bp, Homo sapiens
cttgcctccgtacttatccctgctctcccatttctctcttgtttgagagagaatgaggaagcaaagagtgagaaagaataggggctgaagacgccactcccagatggctctttctatcctgctcttctgttgaaacacacgtgctgtgggcctcaggcgtttctgaagtgctctttcttggattggacaggagatcagcagcgtgcacatctgctgtggtctgaagtggtttgcaggtcagcctcctctccctagtgtagagcaagccagtgtccttcgaggaacccacccggctggccgggaagttttacagcaaggcgcctgccttgggataattccttggtgaaattcaccttccccccgcctctgtctggagccccatcctgtgttatctgtggtttttggacccctaatgtcagcttggctgtaggactccccgaggtttggtatgtgctagaacaatgggaggctgtgatttgctgtgtaagctcacatccagccttggaatctaacgggcattcacaacccgagttaccactttccactccctgcttaggattctgttccctgggctgaaactgaaataagctaattttttgggtcacggtggcagtaggggaacctaggagggtgtgagtggcatttgtcagggatttagcccatgacgtgtttcttgaaccctactttctggaagtggagttgactctggaagttttctagcaactgaacaaaagctcaggtttgtcctggtcatgcacatgccttaagccagttccgtcttccctagaccttggcatcctgtgcttctatttcttggaatacgttctcctctgacctgcctgtaccacgtgggtcctcttcaagtactgttttgaagctgggctcttttgtgtagctcccacccacctgtagggctagctcggcttaagggaactctccccattggcaaaccggacccggccgccgccaggactgtgtttccaaaggttccccgcccccaaccccagcatcagcctgtagctcccctgctgaggcagtgtggttatgttcccagcagtgggggtcagacgcccttcctcagaactttctagttgccctctacctgactcctgacttgtattccttttagcagtagccttcttccctcggggagccaaagagtgtggtgtgtggcgctatattgtggctgctatttcatctggtttcttttaatgtgaggaactcacatactgacttcagtgggactcggtgagccggggccgtctgtgtggtgggaccccctttagcgggactcagtgagctggggccgtctgtgtggtggagccagggcctctccctttagtggagccaggttgtcgggccccgaatgtcactggtggatctaagaagggctgagtggtctgacaccaaaacatgccgcagggagggctgtggtgccggtgcttccaacaaggacagccctccttgaccctgaaaggaacactggcttgaaggactgcagacaggctctgaggggcacgccctcctcagcgagaggcagcaaggtggccacagtgtcactggtcaggtgcttctcaccacgggaaagccgccgacctgtgactcgcttgagatgggaaagcggcgccacagaccccgggtctccttggctgtctgtgggccgcccctggccaccttgtcctggctcgcagggtgcaggagcgcctcgttctctgggtggccggcttgctgctccggtttgggctgtcttaccataacaccgtcccagggctctgcaggccactgtgagcgctggctccctgggcagtgctcctccgtgtggactgtgcctcaggccagggctcaccagctggggtcctgtccggaaggatgggatctttctgggagctgcgccggacagagtggggagctcctagtttgtggggggaagctttgatatccatgccacgtccatccaccccaccccttttcgtcacgagcacaatggtctt

SEQ ID NO: 129256 - DNA, 1135 bp, Homo sapiens
gcgcctgtagtcccagctactccggaagctgaggcaggagaatggcgtgaacccaggaggcggagcttgcagtgagccaagatcgtgccactgcactccagcctgggcgacagagcgagactccgtctcaaaaagaaaaaaaaaaaaaaaaagaaaacctgacttttctcatctcactgtttctgtggtcgggaatctggtgtagtgtggcttagctggtcgaccctggctcagggtctcctctccacacggctgcagtcagctgttgggtgagggaacagagcttaagtaactttccgcagaaccgccagtgagtggcctctgccttaccgcaacaccgtgggtgagtatcaggtcagcagccagccaggaaatggcaatctgtcttttaggccattgctttccaagtcacatctactccatctctcctgatccctgaagagcttgaagcttttggccctcacagttgtcctataaaggcatttccaaactgtaatgaagtatcaacagaaacaagagtgaagaaacctttaaacctgcataatgacatattaacaagagtcaagcaacgagtgggaagggaaggaggacacttttcctctggccctgagtccagtttttttcctgcagccaagaggagtagttaatgctgtctcactgctttatgccatctataagaaggtagacaacacttatctttcaaatgcactgcagtgggactacacataaataacagtagtcttctttgaacctaaaatagagtggaaataaccaatgacaattatggaggaagtcacaggtaaatcctggagaccagcagtgccaagctgagccacagggccattctcactgtagacttgagccagcctccatcaggaactgatcttctaaagatcaaataccagagtctccactgctccttggcagcccattatgggttttaatcacatcataaagcattatatacattatggccaggtacagtggctcacacctctaatcccagcactttgggaggccaaggtgggtgaatcacaaggtcagaagttcaagaccagcctggccaagatggtgaaaccccatctctattaaaaatacaaaaattagccaggcgtggtggcagatgcctgtaatc

SEQ ID NO: 129257 - DNA, 1082 bp, Homo sapiens
ccccacagccagtgtgcccagccacggggtcatgatgtacctgcagcacgacacagtgtattctggagaatttactcagcagatactgaagtgaaccacctgaaaatttaaaaatggatcttgatagaaggcagagatcttagcgaataaggtgttggtaggctggacagttgagcattagagcgcgtggatctggggctcccggcagccagggaacctgaaccgagtgccggctgaggaaaccgggccggggctctgtggcctgtgaggacaggatagtctcaggctctcagtgtggcctgcggtggcccctgctgctcagaggaagctcatgaaagccactctttccttctgctctagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaaggtgagctggtttcgctggtgccgtgaaaactccacacgtggcagcctttccctggctcactatggccccctggctgcagggagtggatgttgctgcttgtcacttagtccccactgtcctgtggcatctgtttggtctaaggtcctgctgggagacccaggagaaagaaagcagagtgaggagtgccccatccttcctcccagcacgaggtcaccagaaggcctctccagactgaagaaaaagctgcttccacacacacatgtgacgagtggggcagggtagtgaggccaggacaaagagggacccggccctgccagagtcttgcacttccacagatgactccttgctgtcagaggggagccaagtctccagtcgactgtcaggatttgcaggaggcagtcgggggaggggacactggcccttcccctctgtctcagcagccctgatggctgcttctcccagagatgagatttcttgactatgattaaaagaaaaaaatctaaccttaaaggttgtaattttggcttcagtcacaggacttcagagatgactttattaggattatagaatctttgataggaaga

SEQ ID NO: 129258 - DNA, 1047 bp, Homo sapiens
ctcttgcatgtttttgtttttaaataaaggtggcttggctaggtaggggtctacatgtcttaaaaaccatgcagctaaacccagcaacagagcacctaataaggtcaggctgcacggcagggcacccatcaggtgcaggtggtcggaaagataccaccccccaggtaaagccgtggctcccaccatcaggagaagtcagactttcaggaagagagagctccctcaaccgccatgctgctgtccccgtccttcctgccactggtcacctggagaggggatgagggtgaagtaaaggccagaatgaatgaaaggctgcacttggtgtgtcacctgggcgacagagcaagactccatctcaaaaaaaaaaaaattgtttacctttaaagttatttcatctttttagactgcagtgatgtaaatacagattaaaggaagagtaatggtcatcattaaaggcccccagcctgaactgcgccctttgctttcagctcgcagattcactggtgcccatggagatcaagcctggcatctccttggcaactgtctcggccgtgctgcacaccaaagataacaagcacttgcttcaggtagggggtgctgggtgggagtgcaggggaccctctccccagcaagaaaccagaccacctaacagattatatttgaaatagcgcttcatgtgaattcttgttgaagaattatttccctggccatgtgcctcagagaggctgctgtgcccagagatgaggccgcacgtcatcccaagggctgccacaggcacattctgttggggagcgctgccacgcgaggcagggctgtggggagacgtgcagggtggcaggtgcagccctgcccttgggggctggaaccggagggcacctgcgtgaggctgtggctacctgagagcctggtcctaccaatgacccacacacaggtgggtggcacttcagctccagggcaggcactgtgtcttaagaattcctttcagatctggactgtgtcacctttatgccacatgtagagttgctcctagctaccacttaaagtcta

SEQ ID NO: 129259 - DNA, 1050 bp, Homo sapiens
tccactgtgaagtcagtttttcccattgtattaaatcagtaccttgtgggggactctttgaaactatatacatattctgttctccctcaaaatggtatctgatatttttagcatttgttgatgattttcatctgaataagtgatgaactgtaatggttgccaaacggtggttttggtttttatttcatcgtttgtttcttggcatttcgttgtaaaaagagctttcttttctcccccacatatgtatttctccctcatttacctcatctgcctctgctgaagcttggagcccacccacagggtccatcccagcctgcccctccttccacggggcccctttgacctccgtcccccacgtgtgcttcctggctccctcctgaccccctgactgtctgtgggccctcagcgccccagttgctgtctggcttggcagctcctgtgtagtctgcattgtaagatttctttcttgtactttccctagaaccagacttctcctacctggaagccctggctccttaccagccgctggccatgaaatgcatctactgccccatcgacacccggctgaacttcatccaggtgtcaaagctgcttaaagaagtgcaggtaatgaaggacactgcttgtgccttcacgtagtcatgtcaccttggtgtggctcatgcttgtgtggggtgaggggagagagatctagctgtgtttgattcttgtcttcagttctcacgcatctgcagaatgctgggacacatgccagcccccctccacactgaaaaggagtggtctttacaccctgaccgcagtttccattctaaagaaatcagatgtggaagggaaagaaaaccatctgtgtccgcttaaaagcaaaccctctcacccctgccaaaaaaaaaaaaagtcattctagaaacatactcactaagctgagacagtttaaatgaaacgcgttactggggccgtgtcgcacgtgtaggctggtaccacaaacagtgctgtcgggtttgggttttgtggcagtttttggtcatttgtttcacttcacattttctgccc

SEQ ID NO: 129260 - DNA, 1020 bp, Homo sapiens
acaagagcgaaactctgtctccaaaaaaaaagtgcatggacaaaaacagaagccatgtctcaaggtgtagatcactttctttgtgaaattgaccacaactaaatgcaatatgataccacggattggatcctggaacagaaaagggacatgattggaaaaactagtgaaatctgaatgaagtctggagtttagttgattgtcattggcctgatgttaatttcttagttgacgactgtgccagtcatatcagatgttaactctggggacatagggtgaagaggccatggaaactctgtactgtctttgcagcttttctttaaatctaaaattattccaaaataacaagtttatattttaagaaaaaatgtattgagaaattctaaagtttaaaaacatacaagatacatctcttctctgtaggcactggatttcattcacagtgaaattcactggcgggaaatttttaaataaacttcagtatttaatatttgcactgctgccactaggtggcaacagatgccaccgtatgctcttcctcacatgctgatgtgtttttcctctttaataggctttgtcacaacaaacagagtaaggtgtatcttccagaaccaccttttcctcatgcagaggtaagaaaacaaaatcactgggacatgggaaggaagcaatgtggataacctgatgcagatgcagacagcaggtcgttagatgaaatagattgctgtgtaaacctgtagacccctttgcctcccaagtcagacacagggaagtattttaactcaagcttcacttgctttcctcctattaacactttctattgcgcacgtggagcagcccttctccaaaatgttgtggaccgcagaattgtttcagacttgggattcgggaatatacttactggttgagcatcccaaatttgaaagtctgaaatcaaaatgctccaatgagcatttcctttgagcatcatgttggtgcccaaaaagttcagatactggaacattttggattagggatgctcag

SEQ ID NO: 129261 - DNA, 2169 bp, Homo sapiens
tggggtccactaaccgcattcccttaagaccaatgggattacttattaaaaatgcaaatttgggggccctaccttagacctagtaagtcagaatctctggggaaaggagacttccagaagaaaagttgcattttcaacatgttctctggcattttccacgcaaactaaagcttgaaaattactgatctaattcattcttttcatgtaactgatgcagaaactgaggccaaggaaggttgtagtggctttcctgtggtcctgtgggttgggacaaaggtaggatttgagacaggctcttgagctatgaccagcgatgttgattttctccactgtatcctactctagtaccatactctagtaatagcaagtccaccagccctcaagttatagcatctaggtgagcctaagtacttaaagtataggggattttcctgcagacaaatgttaatgaaagaaaatactactaactcctgcagacaaacgttagtcaaacagaaaaactcggcctattttcttataggtcattcagccatggtcagagactgaacagagacaaatccagcaaatttttgagcaggatctaaaacgggaaggagcttggaggctctgtcctgaagctcagctgccattggtaaaaacccaaacccgtagtcacatgctctattcccagggacctagattagacaatgatgagaaaatcattatcagcctatagcatcccctgctttgatgtgttcttcaaaagaagcagcttattagacatgtaagtaaatcataaaaacagaagtaggaaaacaagtgcaaatcttattttacaagtttatctttataacactgcccttttgatatgatgttttttctcctctggcatccacttttctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggtatgtccgtggtttttttttttttttgtgaattttatttgattcaggacattcaagcagtaagaataaaaataatcctgttttttctcacattactgtggaaatttcattttgttgtttttctgtctgtgataagattgcattattaaaagccaaatctgttgcattgctaagtttagaataatagttgtcaaagagggaagaatgcaaggcagagacttaccttagcccagcactttcaaaactggtaacaaaaatcttatatacttatcacatgtcaccctctgcctgttactaggtgaaatgacattctaaaagttaaaaaaattttcaagcccaatctcatgttgtctaaaatgtatagtgccaaatctgagaagaaaaactagatttttaaaaattgcaatagtatgatatttgacaaaattttattacatcagaaaattgatcaaatcctagagttggcaaaatatgaaacaatatgaaattagtgaacctttttagagttatttaggtgcatgtttgaatgtaactcacctgaccaaaaataaagggagaagaggaaaataacttttacaatatccccagtggtgccttagaatggtgcttcccaaacgttccgggactgtgacacaggcagtctaggctgcatttaatcccttttagtcatgaggtagccgatagacacagcatgtactgagtttctaattaaaaaggaatttgtacatcatcttctcatgatatattcagttacgctgcccccaacccttgcttttgtaaagtacttttttcattcccttctgtggtcgtttttttccccgctgtgtttagactcatacaggcgtctctatcccatgtacaaattattcttctttgtcacttttttttttttttgagacggagtcttgctctgttgcccaggctggagtacagtggcacaatctccgctcactgcaacctccgcctcctgggttcaagcaaatctcctgcctcagcctccgaagaagctgggattacaggcacccgccaccatgcccggctaatttttgtattcttagtagagacagggtttcaccatgctggtcagctggtctcgaactcctga

SEQ ID NO: 129262 - DNA, 1046 bp, Homo sapiens
tgggaggggcccaacaatccgtgttttagcacaccgtccaggggattctgactcatgaagcttgagagccactgatgacacgtgagatagcattttgaaaagaagaaagcattacagaaatacaagataccttgttttaatggaggtaaaatgtatatatggtgaaacacaaagatcttaaatgtgtaatactgaattttgatataatcagtgccccagtgaagatacagaacttgttcatcccttataaagctccctcttgcctcctcccatcagtccccacccaacttaggcagccagtggttaaggacagactattccttagagaacataagagaactcgatgatgggttaaacgtagaaagagcaatgtctgtgttctcgtattctttcactatttgtaggtaatgttccttttaaaattactaaccatatttctgtgttctttttcagcccatggaccaagcttctctcaaaaacagcgatgttcttgttctgacagggcttacccagatccccactgcaaacccagatggaatggtgggagagttctgcagcaacctaggtgtgcaaccgtctctcatcttacgttggatgatctatcttgcatttattttacaataataaatataatattttacaataatgggggaaggagtgcttacagggtagcagttgtcaaaggagggaggcagtatatctttgcaaataatagcacagaaaagagtgttacactttgaactcacagcagcgatacagtgaacagatagatatgtatgaatgtttgtgtggttgtttttgagacagagtcttctctgtcacccaggcttgagtgcagtggcataatcttgggttactgcaacctctgtctgctgggttcaagcagttctcctgactcaatctcctgagtagctgggactacaggcgtgtgccaacacacccggctaatttctgtattttttgtagagacatggtttcaccatgttggccaggctggtctggaactcctgacctcaggcaatccgcccgctttggcctcccaaaat

SEQ ID NO: 129263 - DNA, 1050 bp, Homo sapiens
aactttctagtttactttattgattgattgactgagacaaggtcccactttgttactcaggctggagcgcagtggtacaaacatggctcactgcagcctcaacttcccgggctccagtgatcctcctgccccaagtagctgcttgaggactacaggcatgtgccaccatgcccagctaatttttgtatttttttgtagagacagggtttcaccatgttgcccaggctggtcttgaactcctggcctcagcctcccaaagtgctgggattacaggcgtgagccattgcacccagtctctggtttactttaaaataatttttgtttttaaactgaggatatttctgttgtttttccctgcagaattacctcatgtgactgtcactgtaagctcattgcacattcttactgtggttctcttttaggagctttttggtgcggtccaggtgactcctctgagctctggctatgcccttgggagctccaactggatcatccagtctcattacgagaaagtgtcttatgtctctggatcctccttgcttaccacacacccccaggtaattccaaattctcttctagcaactcagctttttggttacttaagtcaaattcagaatgtatccaaggaaccatcagccatttttaaatcttccaaatatggttttctacagatactctctagccaaggtagactatttgagtctcaacattttgacctacaggtttctctgaaatagtcctgctaccttgagggtcactcctaggattctgaaatcccccaggccttccaaagaccatagcctgatgtgggacacagatggttatgcatttactcagcaaatattaactgtttaaaatccttcccaagggccaagtgtcaagtgtcatgcacacatctgggtattggggattcagtggtgaccaacgggcaaagcatgtgcccgtagatcttatgttgtaggggagttgatgatgttggggagaggatggtgtatagtaggtaaacaaataaagtgcctggtcatttccgattgagatacaagtactgaa

SEQ ID NO: 129264 - DNA, 1050 bp, Homo sapiens
gcacggtggctcatgcctgtaatcccagcactttgggaggccgagttgggcctatcacaaggtcaggagattgagaccatcatggccaacatggtgaaaccccatctctactaaaaatacaaaaattagccgggcatggtggtgggcgcctgtaatcccagctacttaggaggctgaggcaggagattcgcttgaacccgggaggtggaggttgcagtgagccgagatggcgccatagcactccagcctggtgacacagtgagactctgtctcaaaaaaagtaaaaataaaaacagagaaatggtcataaaggaatcctatgaacaattatatgccagtaaattaaaccatttggatcaaatggacaaattactagaaaggaatgctgtagaacatgaagaaatgttcacctggtagttgacattgtgatccatttgcaggctgttaccttctcctctcaaggatgcagtggaagtctcaacctggagaagatgctatacaatgcaagaggtgaactctgcccttagtaaaatccagctggtgggatattctcagaaaattgtgagtattcatattacatttcagttattcatgaatgctttccattcatattgttgtttgttgtttggaagaatcctatagttacgtttttaaagccattccattgctgaggatccagagcctctgttctttcctccgttccgcgcaggattttattggtgctctttccccaccctcacatctccatcaccagccagcattcgattggccagcgtgcagggagtccggagaaaggcgtctcatcctgttcacattagattttatagattttggatgggtgaaacgggaagagagaagagtttgtcaagtgtgacttttgagctctgacctaaatgataagccttcccatttcttactgtcatcctgtgcccagagctactcagtaccgaacaacaagggcctaacacctaactgaaaatgaaaaaggaaagccaaagtgtgtgagtctttggtctgtttggtaatatttcatctctcccttttaatgtg

SEQ ID NO: 129265 - DNA, 1031 bp, Homo sapiens
aatttactttcagacactgcctttctgacgaaagcaaggtagctaagtggacagaaggaaaactgttttcaaattccactgttacctgtagttagttgtcactgtcactcagactctcagactcaatctccttttctgtaaaataagaattaaattatctctaagtccacttgtgttagagttctaaaagatgtccagagagaggctccttaaggcaggccctcagagagcggcagtgctttgacggagtaatcacagctggttgggctttgcgattctggtcacttcaccgtttcatttcactcggagttgattagcctctgagggactgattcatgctcaccagactcccaggatgttgagtgacaaacaaaaatcccaattaatcactttaaagtaagacctctgagtggctccagaactagagtggcttctctatccaggacactctatgctggccaggaagtccacttaagacctcaaattatggataagaaatttttccatgagcataggattagagcaaagatagttgagttgctctcaagagtcgttcctgtcatgctttggtagcctaagcaattgccatttttttaagcaataatttgatctaaaataaacatcaggggttgtaacctagtttctggttaatattgaaacatacttcattttgaggctccagaaactccatatgtgtccttattctgccaacatgcccagtctaccctagcccccacaggcatgttaagccctttgctgtgatgagagtcaggcagggaactttcctgattcctatcttctttgtattctgtccttacattaattttgttcattcacttattcattcatttattcattcaacatacacttaatgcccagccagttttttacttaccaccttccaagtggtccttctggacttaaaagttttaatatttaataaaaacacaaaagtgtgctgcttttgctggcaggatgaaggaagaggccgcagagctttggcatcatgtcagagccctgggaaagaagtt

SEQ ID NO: 129266 - DNA, 1020 bp, Homo sapiens
tttggttttctgttcctatgttagtttgctgaggataatggcttcagctccatctatgtccctacaacagacatgatctcattcctttttatggctgcatagtattccatggtgtataggtaccacatttttttaatccagtctgtcattgatgggcattttggttgagtccatatctttgctattgtgaatagggctgcaatgaacatacacttgcatgtatctttataatagaatggaaatctcccttttaaaagaagctgctagttgaaatatatttgcccacctggtgggcaaaaatcagaaactgttgagactaacttggtagaggagcaaggagagtagtaacttgcgctattggagaaggccatctttgattctcatcctggccaatgattgtgttttgatttttgagcatgagatgagccatagttattggtagagaaagggaagagtctaattattggaaaacatactgaggtgtgaaagagacactccatagctgtgtcctctttttctcctagataaactcagcataaatactagaagtggtagaagaatttgaagagcttttttttttttttttttaattttttgagacagggtctcactctgtcacccaggctgcagtacagtgatgcgatgtcagctcactgcagccttcacctcccggggttcaagcgattctcccgtatcaacctgctgagtagctgggactagagatgcccaccaccatgcccgctaatttttgtattttttgggtttcaccttgttggccaggttggtctcaaactcctgacctcaagtgatccgcccacctcagcctcccaaagtgctgggattataggcatgagccaccatgcctggcctgaagagctatttattctttaattggcatcaaatgaaagagttcttttaaaatattcacctagaatttaatcttggaccagagttctaaaagtgctgcatttgggtaatgtttgtgctaagggatttacatcacctttagatttatctcta

SEQ ID NO: 129267 - DNA, 1002 bp, Homo sapiens
tataaattaattggaaggagttcatggagacggctcctctgtacagagaatactaattaggggaggtaatgtttagaaagatgccacaaagatgcaaggcagagagcttcagagggaaagagtgtagcatctttaagaagaagaaattttattgctttgctttcaaaaattccccctttttgtggtttgttgtagactataaatggagacagcttgtagaaaatacaggatagataagtaaatagatggttaagttgtctctgctgttgacagagtgaaactgagcagtctaggagtaaaactgcagttttcctttgactctaagaagcctctgccatccctttctctgcttctactaagcctttgtgacacaggtggttaccacaagtagcaatagtatcatttagtgaggaattaggtaaagaaaattactccagaaaaaaaaatttgtcaatttattttttttgaaataaattaataagtacggtataagttgaaactgtcaggttccaaaatgtgagacttaagaattgctatagactcctaggttggattctagagccttgcagatgaaataatgtgttttcttgtttttatgtcaaaccatattacctgcactgtgtatgtaaccattagggagctgaggaagggctctcataggaaagtaaaacactcgaagtgatgcactggtttcaattgagaggataagctaaaaaactagcctctagtctggaaaagttaaagcagtgaggatcagcacaccaaactgttcctatgaaagctacatccaggacaccagtgagcctgaatcacaggtcttgagatgttgaaattagcactcttccttcaagatggaaggaggagatggtattaggccaaaataaataaatgagaatgaaatgaagttgtttagttttcaaatgctaatacattaatggcttaccagtatgtatatgttaacttggaggggatttaagtcaatatggatcacgaatattagat

SEQ ID NO: 129268 - DNA, 1024 bp, Homo sapiens
acctgacagcataacaggatcactggaggtgcttgttataaatacatattccatggcctcatccccagtttctgatcccttcagtcttagatagggccagggatcttttatgtaatccatgtccccacataattctggtgttgctagtacagtttgcataccttatttggaaaccactggattgtgggttatgggagcagcacatacccatgcatggctttcttgaagaggtatcaaaaaatgtgccttcaagtcctgagtctgcaaccaaacagcattttacccttaataagacacttggcctgcctaagcctaaacataggacagtcggcctaataacctcccagcttccctccagctctagtagtctatgattcttcatgaaaagttttgtttggggagtttatttctttggtcctgtatctactggatatctcttccttgtatttttccttttcatttcttttaggagctaaaggagtgctcgggtcatgtatttgtggattctgtgccggaattctgtttaccagaggtaagattaaggtgaatcttattgtagaaacaaaccttattatgtaattgctcaaaatgaagtcaagaaataattttaagaggcttagcttcctgttttcaagtttaaatgaatctgttattccaggcacattgttacacagccaaaatgtcatcatttagcagctttttatattgtttgtaaatcatttacgtcactctcttcttcctatttccggttctttctgtaatccccactaatactcctagtagggcatagttttgagcaaggtaaggaactaactcaagccttttagttttgtgattctgatgcctgtgtgcttaggttagccttatgtgtcctggtcttgctttatggtgggtaattgacaattgctagtaaactgtaaaaattcttgctgacttgaaataccatattgaatattgtttgaaattcatagattctgaactgagtcatagaagacaatcacttacatattattatcacagtgag

SEQ ID NO: 129269 - DNA, 1063 bp, Homo sapiens
cccagtcccctcccgacgggcgccccacgcggaagacacccctccccctcccgccttccctcctccctatctcagcccttcgtactgggacgttggggagggggctgtgccgggcggagagaactcagcgaggattctgaggtgagtcgagcggttttgaagccggactacctcaagtctctttcctcacttctttctcttcacttaaaacaatttttttggaggggttttggggaggaagtgagcggacgctggggatgggtctcgtaagcggccggattgagaggagggaggaagcagggggcttccgagtgggtgacccagacgcgggctgtggggtggggcagttcgtggggtccggtcctggaaaggcgtcgactgccccccaactcttctggtttcctctacgatgagcggaaggtttgaatcctggaggtggggtctccggtgtggagttctggaaactgtgaggtgatttgcaggtgtgttggtttgtttggggtgtgtaagtgtgtttaaactgtgtgacgtgtacttgtgtgctctgctcgtcttggagcggtgtctgtagatgggaagttagacagcgcgagtcctcgctcgctctgggcctgggctgaggggcgggcgtgaggtcctggtgctgggcgtttgggctggcgacgtggtgcgaggcggccgggctcaacaactcgcttgtgtcccgtcgcccgctcacactctgccactcgcctccgccccctcccctggacgaatctccaccccaaactccagccacgagaactgtagagatggtgtgatgtggagatggattttttgcatcctcaagtcggtagataggtgggaaaggaaaagtgtttcttaatattttattccggaaccgtgttttggttacactattggggctactttgaaaggcgtcctccacccaccttcaccccgaaacagtaggtagaggtatcttgtcttcgtgtgaattagatgaataattgctgaagattcggggggcctggggtgggggtcgggagtgctggattgtgtacgcgtctgtgtgtgtctacta

SEQ ID NO: 129270 - DNA, 1354 bp, Homo sapiens
atcttaatgcaatatttgacagattcttaggctatagtttttttttaacatttgcaaaaaaaaaaaacagtaacaatagtctgattttagctttgaagtgatcaattattttaactttttcacccttaaaatgggtgacactagactccttcctgttaagtggtaaaatgattctaatccagtcaaagggcacttaggtttttcttaaatttagagtgtggattgtgataaaaatgttgactaaattccacatgctgagtatgtattctctctggctgcttctttgtttatcttatgtccagagatggtccacatgtggtgtattgaaaatattagtagcctcattactgtatacgtattaagtagcgtggagttgccaagtggcagtaactttaatttgtatctagtcacaatttttatagcaagaaagtgaaatgctgtgggtactgctgaaacagggatgacttaagactgaattgttctgctttaagattttgataatataggccaggcatggtggctcatgcctgtcatcccaacactttgggaggctgaggtgggcagatcacctaaggtcaggaattcgagaccagtctggccaacatggcgaaaccttgtctctactgaaaagacaaaaattagctgggtatggtggtgcatgcctgtaatcccagctactcgggaggctgaggcaggagaatcgcttgaacctgggaggtggaggttgtagtgagctgagattgcgccgctgcactccagcctgggcaacagagtgagactcagtctcaaaaaaaaaaaaattttgataatgtattgtattgttaaaacatgaaatccttggcttgtgtgtagtcagtcaagccttgaaattggatgaagttctcactcttcatccaatcgtgaagtcaagttggtttcgtattttgtatacatttctttctattaatgttctcttatttcatatcttcatcctttctggtttattgcatcagtctcttaactaatcttgtttgaatttttttcattagtcattctaagctcctagtaggagttatcttgccaaaataaaatgtgaatttgattgtcaaccatactttgcctgtaatcctttagtggctcctcagactttgacataaatcaaaaattgagagtcataccacctgtgtccaaatcctggtttttgccagttactagctatgtgaccttgggcaaatcatttaaaatgtctgtacctcagcttccccatcaatagactggggataaaaatagtacctacttcataggattattgtgagcccttgaagtgctggcaagtccttaggatgcttttggcatattatagtttacaggaagc

SEQ ID NO: 129271 - DNA, 1010 bp, Homo sapiens
ggtagatcacctgatttttgtcttctctgggtttgagacaatttttcatttgtcaatactgtgataatttctattaaaaaaagacaaagtttaatttgtttcattagcaggaatatgacaaatattgatggtacttcctgataaataagattcatatttacaaagctttttggctacctgtgatttcagttttttcctggtagaattattttttcctccttggatttatgtttctagctttctatttgtcttggtgtacgtactaaaaaataatgcttgaattagggatcatttggcttcaaggacaggcgttgtagggattcagctgttttgggttgaagaagagtgactagaccttgtgtgaatgggagaaacgttaggaatctgagaagctagtctctcaagctctcgttctggtgataaatggtttcttgtctcagcatctccttccatgtctgcttcatctccctttctcacttctcccttccagttctgtttgtattgccctggtttttcatagtctctgcttctctgactggtaagtggatttgatttgccatggtgttgacttgaactgttctttcaactagagtttacctgttgatggtgacagtgtgtttcttttagttcagttggcaagagagaaatctgaatgcattgcatgaccaccatgacttaaatgtctatccttatcccgtgaccttggtgggaggtagcgtggaaagcaccttttatatgaggcttaagcttttagatgctttttatgaggagggttctcttgttggtgttgaacaaggcactcagttaaacatgtcaagtctagcagtgcgtgatgaggtactttgtgggatacaaagataggttggatttaatccttttctgcaaggatcagtttgctggaaatagcaaaagactcctataatttaagatttgctttttattctagtcacctcaggcaaaccagaaagatgacaaagtaggactataagaactagctaggattaaggaag

SEQ ID NO: 129272 - DNA, 1031 bp, Homo sapiens
tattatatgctttgttctgtggaagtctcaaatatctgtttataattgggagtgtttctttcctgatatttgcctgcctcatattaaacactgtgtccatcctctctgattgcttatgtcagtagatcgtgacatgggctatattttgcgtaaatatgattatttttctagatgttgtacttaacagtattatgccctaaacatctagtttttatggttatggcatcagctcattttcttaaactctgtatttttgtatatgaactcttaagaagacagtctttttttattcccaccttttgtcattaagttctcctttattctaattttctggatctggtaagcgagttttttttgtttgttttttaaccttatatactttggaatatcagccatctcttgaacctttgcactcatgaattaatttctcaccttttaaggtctgtcattctttttggagtcttaattactcttagaatattgagctggttgtgaacatgaactttggagccatattgtctaggtgcaaatctgatctccactacttaaccctgtaattttgtgtaaacctctatgtgtctcatctgtaaactgggcatagataaataatactatttattcatatacataataggattcttgtgagtatatgattcaacatttgcaaagtgcttagagtagtggttgttacaccttatcttattattagttgtcctgttctttttcctaggtaatactcccctccttaatctttagaattctctatttgttgcaaataatccctttctggctaatttattttttctttgtgtatttattttcttctgagttttccttttttagctcttagctgcatttgatgtaatatttccccttaaaattttttctatacaagtgtttcttccatcattcttttctctcttgttaaaattacctctggtcttgaagttcctagatttgaaggctttaaatctccctttagtacttttctttttgtacttttctccctcctcctctcacctaatttgtca

SEQ ID NO: 129273 - DNA, 1052 bp, Homo sapiens
tatggaaattcagaatacctataataagccaatttaaaaaaaagtagaggaattacacaacttaagactgtgtgatgttagcataggatagatcagttgaacagaatagagactggaaagacttttgtttatggctcattaatttttggcgaatatgctaaggtaattcattgagcaaatgttggtggaagaaccggatatccatttgagggtaagggggagcatttcttgactcttatttcatactatatacagaaattaagttgagtagattatagtcctaaacctaagaggtggaaggataaagcttctagaagaaatacagaagaaaatgtaactttgctaaggccaagtttcttagagagaaaccaaaaaacatgaacaataagagaatattgataaattccattttatcaaattataaacttctaaagacatgatggaagagtagtaaggttgcattataaaaggacatgcaccataagatgggtataattcgcggctttattttgcaatgcattactccagtatagtatagaaaagagtgtactgagcttaggaacctctaatgtgtaatcttgactctgacacttgtcagagatactatttagtaaattagtgttttgttattttctctgagtgttggctttctttttttgtaaaatggtaatactgatgcctactctctagaattacattgagggtcaaataaaaaaatagaaaagaatatatatataaagtgctcttgctattcttatttaatgtatcatcatcaccattgttattatacatagttggtccttaatagttcctccccttgaaaaatgctaagtatgaaaagatgtctctttttcacaatactaactgtaattatctcctaagggaagcgtaaaattttttaatgtttcagtagatgtataaactccagtttattttaaccctctgattcttgactgtaggaatcaaacatgggtgtaatcacattttttttctcagaagaactgctcacactgttacactctgtagttttatgccagaccagtccctttcac

SEQ ID NO: 129274 - DNA, 1033 bp, Homo sapiens
ctatccaaaggtaatgcagattcatatggaaattgtgtatatgataaaggcagcatttcacatcggaggagaagacagatattcagtaaaaacatacgacatctagctgtccatttgggatgaaataaagccccaattttttatacttgttaagtcaataaaaattctagatggagcaaggattttaaatgtagaaaactattactaggacccctaggttcatcagtaattagaatagttttatctaaatggctttaaatgagacttaaaggagtagaatagcctgtgtgccaaatcatatgtttccagttaagtcctgcaatgtattgtaaaggagaatgatgtgtgcttttggagtcaataagatctaggcttaaatctttttcctactgtttactcagattttttgtgaagtacaaaactacactgagctttagtttcctcaacaatcaatccatcaacataaaatgaaatgaataaagaacatctaccatggggagttgctgtgagaattggatgagattatgttatgtgaaattcgtacccagttcctgcctagaagtgactgttaataaagttttcatgtagaaggacaaagaaacagtgagaccttcaatagctataggacactggcccagagcagatgtttgtttgagaaagatgaagaaatttcttgacatctgtttccatctgcaaacacttattgagagcctactgcatgccatgcattatatttggcactagaacaataaatatcaaaatagaagagattacaactttaaaaaatcttgaatggaaaactcaggtcttataagaaaggaattcaaggccgagcatggtggctcacacctgtaatcccagcactttgggaggccgaggcgggcgaatcacctgaggtcaggagtttgagatcagcctggccaacatgttgaaaccccatctctactaaaaatataaaagtagccaggcttggtggcaggtgcctgtaatcccagctactcaggaggttgaggcaggagaatcgcttgcaccc

SEQ ID NO: 129275 - DNA, 1013 bp, Homo sapiens
tcctgagctcaggtgatccacccgcttcggcctcccaaagtgctgcgattacaggcatgagccactgtgcccagcctatcttctactttgtgtagagatgaggtttcaccatgttgctcaggctggtcttgatctcctgggattacaggtgtgagccaccgcacccggctatcatctcctgttttcgcaagcaagaactgaaaatacatttacacatttattatctattgtaccacgtggacctttcttttgctgccatatctatgggatttggtattgttacaaacttctttcaccattttcagcctcaccctaacttgttcttcctcctcttcatttctactccaaaagcttgcattcatcttcctttgatcagatatcttctgatgattctccattgtctaaaaaatgaaatttcttttaatctgactccagccttttcgtttgttgccatcctctattcagtatgcccccagctgaatttcactatttgccattcccagaattctgcccagttggatgctcccagagttttggttgtgccaaagatacctttcacctcctcatctcagccttatgaatttctgtttatcaagattatctctgttgttaccctcattttaacttcttgaccaatttagtccttgcagacctctctttttttctgaaattaattacacttagttcatcaccctgaggtgtagtactcattttaattatgcattttagagcaatgttcttcaggagtgacctttccttacacaaagagtctagcattgtgcaggtactctgaactttccatgtttacctagctaccttgtagtgtaagaggagaacaggtgatgctgacacaagctatacatgtgaaaatttgtccagtgtgactttcttcagtggtgtgccctctccaaaaataataattcatttgctcaacaaatgctgtgtgaatttttgcccttaaggagcttgcatttttcctttatctacttcagttgtttatatcaggcctgggg

SEQ ID NO: 129276 - DNA, 1024 bp, Homo sapiens
ataggaaataaggggtgggagtggaggaagggcttttattttatctgcgtgcatttatgaattatttgaatttttgtagacaatgcatatatgtgctttaacttaaatttaaacataattctgcttgcactgtggaaggcgaattatagagatgatagcagttctgaagtacaaaattgcttgaagaaggaaatttcattttttcaattgtgaaatgatcttctaattaaaaaggagcttatgagaattttgtactttgtggatcttaaatggtttgttatttttcttatagttactgcaattgtccaggcaaaagagactgagattccaaacttctggaatgaggattggaaaggacatgaaaataattttaggaagagaaagtgattgtatttagtaaatatgtaagagtgtggggggaaagtagagtgaacagtaaaattgagatggagaacacaggaaggagaacagatttaaggatgatagtgaattaagttgactgtgttgaggacctgtgggaaaatctcatggacgctatctagcagatggtttgaaagaatggtctggtaccctggaggtcattggcatttagatgacattttaaatcaatgttgttggtaattgagatgaccaaaggaattctgagggttactaacatgtaagaagctagcaaagcagccctgaagtcgactgaaaagatgtggtgttggaattgtatccagcattccaaggaggaagatgatgggagtggtcagtggtttcactcctcaggaagtggaaggaaaattaaacataaatttgtggtattggagactctgacaagaaaggattatggtggagagccctctagtggaagggagcgtggtgtttgaggaacaggtagcctgatgcagctgctcagaaaataatgtgaatgaggctggaaaggctttttcttcctttgaataccatgtgataactttcttattggaaataaattaatcaggggttagttttagtctctcaatgtgtgaaggttatatgt

SEQ ID NO: 129277 - DNA, 1092 bp, Homo sapiens
cagttcaagctatttgagaaaagagtaatctgaattagtaaaatgtctcaattatagatatttttcattgaaattttattatgttcaggaggtaacagaatctagtatagcatcaacaggtagacctatggagacctgatttagttagtagacaaaaagcatatcaaatatcatcttattttctttcatgctgtatttcactctttaaaaaagaaaagagtttacaagaattagggttattttaagtttgtctcctacctgcataaattccttaagcttataacttatttgaatggttagtaaaagattctgaacatctgaggtatattgttcaaaaagagtataactatcaagcaggaatttcaaaagaaatttttcagagaaagatacattgattaagttgtcactaagccaaagaccatacttccctagtcccataggaagtagatgttatattgttttaaataaactgcaagatatttgctaaaagtgtcttgtttatttcaggcgctacactaagtatgagaccagcccccattccaatagaggaccctgaatggagacaaacgcctcccccagtctctgccacatctggtactttccgactgcgacgagggagtcgatttacctggagaaaggagtgcctggctgttatggaaaggtatgtgtctcctttttctacgaatgatctcccaaacttagggaagacatcaactctggatagactgggacagttttcatttcaaacaagtaacttggtatcttggttctatctctaaaagtactttagaatatcataaatgctgtattatagaaataaggtcatcttagcattgagaattcataaagctggagttagcatctgtcaatttattttacttataatagtgtccccagtaatttaagaaatgttggaataaatattttttgaattcagatctttgtattatattttggaaaaactctttgaagtcttcttttcatcaaaaataatgaataattgtataggagactactgagatttaactttcctttaataaggagtatggtctaagtaagctttgtcccaaaggttaaaaatacttatttttg

SEQ ID NO: 129278 - DNA, 1021 bp, Homo sapiens
tttaaattcatgaccgctaacctcaagtgggtctttaattctgccaagcagaattaatactatacctttctggtttattttttcccactctcctgtaagattatttcacactttcttctctctgtgcaaactccccatcctcattctcttatgatgaccttgctcatcatgaacggaaatgaggaaaatcaagcaatcagaggagactgtccacaaactacctacttgctaccatgtacacacacacacacacacacacacacacacacacacacagttttcctgcctcttaacatacccagagcacttcaatgatatgtatatttcctagcgtgtgtcttggtgcatcattcatatatatgtgcattttctccttctctgacctcattccactgtgtattccacatatttgacttctaaaatatccaattccaaaaacatttattgtcacaaaggacaatattgtgtgattccatttatatgaagtatctggagtaggcaaacctatagagacagaaagtagataaatgtgttacctagggctaggggaggataggggtgttgggtgggggatgtgatggctaaggggtatgtgtttctttttggggtgatgaagatttgtaaaatcagttgtggaggtgcttgtacaactttgtgaatatgctgaaaactattaaattgtatgccttaaataagtgaagtttttgatatatgaattatatcaagctgctttaaaaaaaggcatttattcagtgcactgttagaagcttcacatatacttaccctccatatttaatcctcactgcaggcctggtttttcctttttctaatgaggcagtcaaggctcaaagaggttgaataactaacttcctaagaccacagagctaacaagtgtcccagtcacatgtggatgtttagccagtgctattcacagatttgagttcttattaactaagaagaatgttattttaatttgggtatatactgatggtttttaatttgtggacttgggcttcgttaa

SEQ ID NO: 129279 - DNA, 1038 bp, Homo sapiens
atagcatgtgtttatttcagaaattcaacagagaagcatataaggcagaatgtcattttttttaaaattttttcttatttctccaagaaaaagtgaaaatcattcttaattgccaccagtattttcctgtttttgcccccatccccaacactcttgcttcttggagatagtcattgctaaccccttagtacgtatccttcaagatccgttttgcaatacctctttgccttctcttgttagcagttcatttactgtgagatccatttcttttggaggcccccacactgggttggtggtgcctttgtctatcattattggctcgtcaacactatcattagtggggagcgcgtgtgaggatgattcagacttgtaccctggcatcaggtggttttcagtgtagtagaagacagatgtatacagtgataactataatacaagatgaaagatatgtaagagaggaacagatgaagtgcggtgggattcatagggcaaaaaaaatacctttgattggccaagaggtgatatttgagctgtaccctgaaagatggataagatttgcactgcggggtgggggaggcaaaaagctgatatacttgcaagagaaaggcacagagatgcaaggagtttacagagttattccattttcctgggtggtagcatgcatatatgggagtagcagataaagatgtagaggttgtttgcggggggactttgaacacctctataataaacctttgagaatttctgaacaggatagtgactagagatgtgctttaggaatattaatcaggcattggagggggtacagtgtcatcacaggctttgcagtcacttggaagaaaagttgtcacaatgaggtgcactggccaaagagctatggcttaaaaggaacccgtaggtcttagcaactactgtatcccatcaaatctaagaaggccttgattgtaagacacaccttagttgacgtaccagtaagggagacaaaacaccaccaattataaaatgcatcctgacttcggagatcacaataatgaagaa

SEQ ID NO: 129280 - DNA, 1029 bp, Homo sapiens
taactcagatggcactcctcagtgacgcctttccaggctcctgccaacaacactgaacacgccttcatccatgctgcctcagtgctctgtccatacatcctatggcatttcaccacaggatattgacttacatgtctctctgtagtagactgtgaacacttcagagtcagaaactatatcatctttctttacccacagtgacaagcacatattaggtacttagtatctgcttttcgtttttgtatattttgtgtaaatgaactcatccagtacatctcagaagttacgacctgtgcatttaggtcacctggaaatcttgttaaaattcagattctgatttagtaagtctgaggtggggtctgagattctgccattctaactggctcctaggtgacagccatgctgttagttctcagagttaatccaaagcatctcagcctaagtaaataggcatagggcagagacaaaagccattagaaatgtgaaagtgaagcaattatgagggtagtgacttggaaaaatcctccgtatgaacactggagtcccagaaatgataggagaaaatcatgcaggaagagatgctcaaataaagcagaagaccatggtggagggtggtagttgacaagactgggaggatatagctctatgacttaagttttacagaagaaaaaggtggttaggtgggggcagctgctgtgagtcaggactgcatcagatgaggttaaataaataaataactggcagtgaagccatgccctccaaggaggagtgggcagtgagaggagggagtagtgttaggagctgggtttgcaggtgatcctcaggaagggctggggcctccagtgctattcacaataggatggcatttccaccaatgcagacaggagtgctgaaggcataagaaaggctggattacagggaaagggaaacccctgaataaatggtaggtgctagaatttgacaggggcccatttcctgattggaagtttccaagttgaaaccatgaaagttctccttttctttttttaa

SEQ ID NO: 129281 - DNA, 2154 bp, Homo sapiens
tagttagcaagtatttatgaagcacctaacatgcacagcagcagagaccccagaatggcaaatgtgtgcctcccctgacctacatgcagttgaatttcatccatcttacagtctaaaagaaacaaatgtagagaaatacaggttcttgtttaattacattctaattaatttccttagcacaaaaattcattcagtgtttcagccattgtgataaggtaacagataatttagggatctatttgcttttttcgaagaagcagcaatcctggagagtcatgggatagatgtgcagagtccaggaggccactcaaacagtgatgatgtcgacgggaatgactactctgagcaggtgagcccctgcgcagctgggcgaggttcttggtgcctgagcagggggtatagtgggacagcttagttccttgggtgtggctgatggggtgggggaggggaaacagtcactgtccctccactctgctcctgtgtctagttagatttcatgtaatttgaaaggaatgtggtaagattcagttgtcctgttgaatttgtgagagatcgttattcacccacatggatttattgtcatacaacaggatacttggcaagtacgcaatggggaggaggaggagggaagaagttcagagggaggcagagaagcagagaaggtagaagaagagaggaggatctgatccaaacaagcaagttacaccattcacgacacacactcagtgtttgagaaatactaggggcagctggaccccatgcctaaacacgtaccgacgcagggcacgatggaaggccccactcactctggccccactgcagtgggaaccctcctgcccaaaggagtggttcttccagagtctctggcacactgacacatgcatcctctcataagtgcaatacctgcatgactcttcacctcgccctgatttattctgcattgcttttggggaaaatgtatttaattgtagccactgcgtggagtaattcagtaactaagactgtgggagtccctcctcgacccccacatagatgttgacagatttcattaaaattttgataggatttaaatttccatttggaatatgcagagaacgcatggtaccttcccctagaccacagcaagaaaacttctgctcatttttctggggtctgtgcttttttcttgctcctcagccagctcatatagtccaatgtgttctttaatagcctctgtttaccacacacctagaatgcatgcaagtgtgtgctgatccctttgtaaattctaaaaactaatctgtgaacatcagaaggaaacaatgatgtccacacttctgaagaactaccattttttcccatttaggactctagttaatagccccaagagaatattctgtaagtctttctgttcggaaacattcctcttttcagtctacccacatagatggatcatttccatctttttttacagatgccctaagggcagcacattccatgttttgtttgtttttttccttaagggacttaccctttccaaagctctttgatacggagttcccctgaagatgacaggtgagaaacataccccttatttgtaacaccatcttcagtgcctgacgtacatcctgcaatgccagcttccttcacagctttattgtttaacacattgagctgcgcggggaggacagcttcacactagttctaggtaagacgcctgccgctccccttgcacagctgcctgcagcaggagagctcgacaccttcctcccctttctcccgtagccgtttctggcagtgacatgtgtcctgttgtaatggagaattctttttttctttttttacaaaaatgcattttttatctgtaagatgtaattgtaagttctgtctagttttctcagttcagagagggaccatgaattctaataatctatttgtaagagcagcaatctggaatttaatagctcactagtatggccttcagtgattagtgctatatttgttacaaacagaaagatccaaattgttggttttatatcaatcactgcaggtttgatcatcatcaccagcaatcttattaatagaatgaatagaattctcagtgatgaaaaacattttttgtgctttttacttgttgaatcataagattatcaactgaaaatctttggacctata

SEQ ID NO: 129282 - DNA, 1049 bp, Homo sapiens
agtattttatctactaagtcacacagcttgtgagaggaaaggatgtctgtgtcaggcatgttaacttcaaacaaaatctgagatcggctttttccattgacattcttagcacagcacccaaagaagtataatctagccacagtgtggctataatgaggcacggcttattgcagctggaaatcaattatcctcacgctgaggtggggattctagtgttcctttgactctgtggatactccccaaatggtgtctgtcattcctgtgccacgacctcagcttgcatcctatcagtcttggggaaggaaaagggagtacagactagtgttacaagaatctaaaggtacccaagattttacacgtagtctaatatttgagaactgagggctatctaaatacctggaagcactttcttggaatgctaagacggagcagcaagattttctagcctcgggggctgggagagggaagtttggttggttggttggttattatttactgggagttaatactgagagagtatatgcaaaggctgagggcaccatgccatcttcacagaacaagaccctaacagctacctgacatacaagaaactgcaagttatactgtaagaacacatgttaaggaccgaggaaagtctgctaaggtgctacgtctaaactaagttaacttgtcatgtttaacctccctgatcagtcatcatccagggcctctgtcttgatttcgttggctccttgtcgggccaatgccaagatagtgtggttgactgctgccatttccacagctaatgagatggggtcttggtggtcactatggctcgtactgtcatcctagatgtgcagaaataagaaatgttattagtggattggaagaattctttagtcacagagagacatgctggggcaaggggaggcagaacattcgtgggaggaaactgggggaggggctcatgataaaatagaggtaaattgtatttaagtagacactgaatggatataggtccaaagattttcagttgataatcttatgattcaacaagtaaaaagcacaaa

SEQ ID NO: 129283 - DNA, 1171 bp, Homo sapiens
gcttgagagcattggaaaaaaaaaatatgagctgaatgtctaatggatgctaagtccagttttcagaaccactgtacattccacggcacagttagcagtgcctgcctggaaaagttttggaggtcatcgtggaagttgctttgcctcctgtcagtgtcccctttccctgctaccaaaaaagtctttcaaggatggagctaaggtcaaaaatgagtgaaaaaacttgcagtgtttgtatccattaaacggaagccccctcactctgagaggtcactagaggacttcatagtggggttgtgctgcttatcacagatgcagacacttgcccagataggagcagagaaaagcaggggacgtttcctactcacattgtggctgtatgagaacacgatgggactgctttgctgttctctttactctgtccttggagaggtgtgaaaagctgtattgctacaggcaatttatttaataattggaagccatattgataatggatgtggtaatatttgtaaagtttaatctactttaagcggcagtaactaatggaatttttttccttgatcacatatgtagcacttttgttactttttaaagatatttatatttgataaatctttttttcattttgagaactcaaaataccaaacagtgaacttgcattctaaagtcaccctgtgatcaccttgtcatctagtagcaaaatgatgaactattcatgcatcaaagaaaattacatctgctggccttgtatgaaaatgatctcttggcatcccgattaaatgacacactgtcactgtgggtaagaggaaagagccttcaatgtagcagcacagggtgcgcctgaaagaggcacaactgctgtggattttctgcctcgctccatctctcctatgtataatgaagccttgtttaaaggggcatgtggggctggatgttaagcacggcttctttttgtccgttacctgaaaacaatttctaagataaaaggaaggtgccatttccttacctcttcacccatcctcctccaccaaatgtattcaacttaaaactgtgagagagagagactgaatgaccttcctcagttttccctttctcattcaggagatactgaatatccgccagtttgtagttggtttccttccacttaaggcacacgctgactgcatcattt

SEQ ID NO: 129284 - DNA, 1205 bp, Homo sapiens
gatacatgaggggtgggagggaagatatgccggctgccctttcttatctcagtgacgtagatgcctcgggattataggcacgcggatcactgaacctcttttttgtcattcttcctatgacatttgtggcagaactttttagttgattctgttcacatgaaatgtgacaagcatttttacaccatgagacagtttactacccacatgccacacccattgtctgtctcatcagccagccccgtaactgcacccagaggggtgcagctgcaggggagctgtgcctttctcctctcctgacactcctttcacgtggcaggtttgcaggttggttggccctggtctggacagctgtgtccgtgcctgctcggctgccctccagttggtcggtgtggctggcgtgggcatgtaccccccgactcgcacttgagaagtcttgggatgccggctccctcgactccattttcattttaagtaagagtggctctgtatagccataattaactctcaaattcacattggtgtgctgtgatcaaatgaaggttggactgaatcttttcaaactgtaaccatggtaattgaggggggtggcatagaatgaatatataaaaatataatggcaattgttctgaatgactgagtgtcctcctgacatgtaattagctgttttagcaggatgtagattggcatggtcataattaaaagaatttctgtcttttatgtgattggaaatggcagcgctcccatcccctgttccctcttagcactaatgctcccaagaacatttggaacagcagctccataaactaaaataatgacatggtgctcgtgttctcccctaagtgaaacagcagaatttggagttgtttcagcttcaaaatggaagcctttgattattgttccccatttgacttctaagttctttgaaacttcactcaacatccagttccaacttgctccacctctggcagaaaccacagtcaggaccccagaagaagcccctctgaccggcccccactgcattccagcccatggtctggccagctccgggcccttgcttgcctaactcgaggatgttgctgcttgctgggctctctgggatcttcagatttcccttggttgcttgatatttccattgccgtcactatcagaaagcatttcccaaacagaagtttacagaaaattgaatcgaggtttcctcattgaat

SEQ ID NO: 129285 - DNA, 1043 bp, Homo sapiens
ggacgacgaactgccaagggtccggtttggtttacatgctacagaaaagcctcattctcatgatcaccacagcactgttctcccattcgatcaccttcgtcagcctgccttcccttctctgtcaggtcacaattccattccactggcaagtttgcccatgtgtcaaatatgaatacccagtgtttgggttattacattgtctgaacaaaaatgctggattattaatgaaaataaagtgcctgggtatggattgttccatgatgcaaaaccttttaatgcaccaacaaatcatctcagcgctgcttagtgatgtgatttgaacagactgcagtcacaaaataatctgtcgtacacccatcacagaataaaggccccgtatttaggtcagacttaaattattttttaaaaaagaaacaaatactctcacactcatttccaaagacacacttgggatctgaacgcctgattgctggctttcccaagccctcccgagcagacaccctgatccctctagtctaggcagagagggctcggaaaggcagctggggctccggtggctcacgctggcaggtgagtcagcaggctcatgagctaggatgattcgacgcttcgccctcttggatgtggacacatttccaactcctaccaaagccagagctggaatgctgctctgaggctgtcttgctctcctgtcttcttagtggctactgagatttccctaagcagactcttaaattctctatgaaccaagaccaaaccacataaacagaaacggccctaaagaaagaaacgctggaaaacagtgacgaagccagcctgatatggctgtgaagcgatctctcccgctagcttgtccttgccttgttctgcctgcagaacgccagggacactggagaggggcagccgccctgtgcccaccctcaagggccagtgcagggtggggagggatggggacagggcataggccgactctctggcaggttccagaggtctgtatcttgcttaggcacttaaaaaacataaacaaaaatttatccttgaaa

SEQ ID NO: 129286 - DNA, 1431 bp, Homo sapiens
tgcctcggctgctgtgtgtgttagtcttcatgtttccccttggcgtctcctctggtccctgtccatcttgtgcaccatgtgtccctgagggcgagtcacacctgtgtcttgagtctgctgtaaggtgttcagtctacctcaaggggtcatcatggtaagctctatcccacggcatcctccgtccatcaccacacacactggaatgtatcccccccgccctgccccttcgataacctcctgaccttgtctttcctataatcaccacaaactcctagtgcaaattggatgctgctttaaatgtgaaaacaattgttcaaaagctataaaacctgaatgaaagctgaagctgaatttataagccttgttgcatatgagccaaaagtgcaaaaagctctatataatgaactaacctgccactcgtataaatataaatatatataaatatattaaaatcagactgttctacaaaattgtgtatttgtatttttgtgtacgtacaattttctgctaagcagaaggaggatgtagtataggatgctgtgagaagagatttggtttaatcctatttctttgttacttatttttgttaacatcagatgcctgtctttgtcttatatgtgtatgacactgtttggaaagctgcagtatctctcttcctgaggtccagaggccattaaagaataaacatggggcttagaggtgtcttggccaccaaacacaggtaagccaacagagttcggctcccgtacgtggtgtggtgggacctggggcctggagccacttgtactcctggggtgggactgagggagggaaagggctcccccacttcaggctggtcactgtatgttgacttccctctgggaagcaaaattccacttgtaaaaatcagcttccaagacaaaagatgatccgatgtcacttctgggtcaccaggaagggacacaggatctctctgaactttggaacagaccctcatattctggggccagaagtttgcccagaaagcagcaggtggctctgcctggctgtagagcccagctcattggctgtccctgggcttcgtctccctcttccgagtagttgctgcctttcttcagatcaggttaccacaatgcctccccgctgctgacgcttcatcccccacacctccagccccagttacctggagcttctcagaacccactttgccggtgctaaaacacaagagggggtgaaagtggctgccagtaatggccagaaaccaaccaccagaggccaggctgaaagacaagctccgggtgtccaggggctgacgggccaaccatgtggcaggtcccaggccccacccactgcgccatccgcctctgagctccacagtggtcccactaatgggaacctcctctagggagagtgatactgcaccttcacccgtaggactcatatttataacaa

SEQ ID NO: 129287 - DNA, 1274 bp, Homo sapiens
tcatgtgtgagtgtctgcggatgacacagcgaagccggtgggcgctgctccctgcagttgcaggagaattcgatcatgcatgagcagagacttagaaatgaatcggtattcactagatggaacacgattccacgggggcggagtggcgtgaggaaggttctggaaaagccatccattgagggaattctgaatggaaaagccgtccattgagggaattctgagtggcctagtagagcaagcaaagcaaggtgtgtccccttggagattgtatatgtcatgtcaaggggttaattttattcttcttggcagaggggtctccaaaacagcttttattccaagttttaaaattctgacctcatctcccatgtgttcatgtagaatgtgaaagccagagttaaaacacagggcaatatgatgagagcagtgactggcaccttttccctggaatatttctaagccgttctgttgcctgtaagctactcatctgttcagtttcagcaacgctcagtagacagggtgattgcaggttcagccagcacttgagaacttagtccttttccatctctgtcactcacttacagggcaatgtgaatacatttaaccattaggtaaacgctctctgagcctcggtttctgtagtgtgaaatgtagataattatactcatattcacttgcctcatgggacttctccttaatatttatagctgcaaaatacttcacagtcatttttattaatagttaccagatgtgttgtaaggattaatgaacttatgatctgaaatgttttgagcccctgaaataggaggtgactgcctgcacaggggagatgtagaagagcataaaggtgcaaacagacacacttgaaaacttcagctattacgtgtgaaggatgagcacacggttatgatttcagtattcttggtggatgtatttggcatccttaaaaaggttgctgaactcatacccaaggcctgtgccaaaagcccccttcatgtggcgttcacacccgttctatttatgaccctttcctcctctgaatcctctctctttttttttttttttgagatggagttttgctattgttggccaggctggagtgatgcaatggcactatcttggctcactgcaacctccacctcccaggttcaagcaattctcctgcctcagcctcccgagtagctgggattacaggcatctgccaccatgccctgctaattttttttttttttttttggattttagtagagacacggtttcaccatgttggccaggct

SEQ ID NO: 129288 - DNA, 1018 bp, Homo sapiens
tctgcatttagaattcataaaatttatggttgaaaaagcagacccacatgccgaggctgttctaaacatacttaaaagcatttcagtgtttaaggttatgctttattaattaaaataaaaaatggactttctgagtcacattagcctcattctcagtgctgggtcaccaccagtggctggtggctgccatgtcagggctgctgccctgttggggaaatggggagggtgcacacctgtctcaggttacagagcctcaggagtggcagaactgagctttccgttgagaaagcacggttaaatgctcacgtgtgactgtaagagatttcactgacagtgattaagagtaaccaagtcattgtatttgtggaatgaatcaatcagtagagcgtttgcaggagggacggatcgagccgcagaaatacaccatgcaggacctgccagcgtttccctgtctgctgcagtgggaaaccctggcagctgcaaggtggcgagcgacatgggacatggtcacttttgtttttcggaaagctccctccagctgtagtttggaaagtggatttgaagagaatggagttagaagacgctattcgagtgcgggtagaatcctcagcagggattatcatgtgggtcagaaacccatggttgccttctggtgttgagtccttcgaggcactgcttggaggggcatgtggcaggcaggggcacagtggctcgggcgggggtcggcagccaccagtccgcttccctggtgacaccgcttagagaactcatgtagatgggatcatccccttgcagataggtgtggaagcccagaggtgatcaggtttttacacaaaagttagaatgccaagccatgcatttaaaataactatacctgccagatggacaaaagtgctggtgccgttatggctcacatattctatccacatcaccctgtcagggtctggagcctccaggcgcacagggtggtcactgaaggcctcacatgccggaggctggttcacaggcttcaggccag

SEQ ID NO: 129289 - DNA, 1056 bp, Homo sapiens
acacaagttgtgtagtgaaggaatgattattatcaaaaaatacttttcattagagtgtccttcacattttcagacaagaatgttcagttccctccctcatgcaaagatacacagacccataactgcagagaagctttaatgaaaacctggatgcttattaacctgttctttggaatcagcaggttctcaggtgaagatgttattattttcttgttactttttcttaatattgtttatcaaatggaaacggaaaggttcctggatctttttttgtaagacaaaagtcaatagtttattcagaaagtttaaaaacaaagatattcgtataatttacaagatcttttggtttgaacatattcataaggacttatgtttctcatttttatggagatttgtttttgtttgtagtcaatttctgtctgagttccagaaatgcaaaaatactgcactgaaagaggtggcagctgacaaaattgctgtctttgaccttctgatgcaagtttagtaactaatctggaaaataatgaactgcaattaatgaaatctgtactcatattcaagtgtgtttctcagacagcacataaaataattgaaggaacttcctgctctctaattagttagattgaattaatttggcataatagctttttttcatgtatctagaagtttgtgttcagatgaagctatttatgtacttcaaagttaggaactgtaaatggcgtctttgatgaatctggagaattaaagggttaatggtcagatttaatttccactatcaaaagcacagtcacaatgccggcctgtcttgatttatgtgtctgtcccttttggttagggctgccttatcaacagcagggatatttttctcctatttcaacatagcctcacgtgtggtaggtagataaaggcttgtgtagaaagagcacccctctgcccatctctgatgctaattgaaaaggtgtctgtataattatccatcttccattactgtgattcttccttatataaaacagggagaaacaagcacaaatactaattcttgccttgtacacaagg

SEQ ID NO: 129290 - DNA, 1043 bp, Homo sapiens
agacatgcaggatgttggagacagatcagagatttatctttttcgatttcaggtggaggggtgtagattactggaggagaagtaaaacagggatatcatactctttcacgtttagacctgagctattgagagagccagaggtttcctgcgaagtcctttttagtccatggtcctgagttcatctccctgtgaagtacattgaactgggttgcttcatttttctttttttttttttcttttttaatctaccccaacattttagtaaagggaggataactctaggacagctaagcatatacaacatattgggaagatagtcattgcgttgtccctggggaacagtgtgtgtagccggaccctgaaccacacttttcacctctgtcaagaggatggaggttgtagtgcaggagaaaaatcgagtgagtaattccagtggagtgtttccgcagagattcgtaggcgtcagctggaggagggaagcgcgtggtacccagtttagcatctgcattggttgctccctctgaagcagagcctgttccatcccagcgcgatttgaggtccctgtctcaggacagtgggatcagaataggtggggttgcggggggagcatgtgaggttcctcaaggttaagatgactgttcaggtagagggcagagtgagccgtgtctctgtttgtcacgctctgcagggctggcaggatctacgcattgtgtatctttcagtgttctcactttcagtatttgagtaaatgagatggagttactgctctgttctgattgggtagtgcctgctgggaagaactgcccctgaagccatcggggcctgggtgtgccttggggaagaggtggcacctccataatttgtcgttggcccaattctacgtcaagcagcccaggtgccgactccagatcagcggcttagttttcctgagggacagaccgcagccatatcagctaccaaacaaagaaaatctaaaatatgaaacaatactctcaaattaagtaagttgtcttcagaacagccatgtgtgagctcgccactgt

SEQ ID NO: 129291 - DNA, 1025 bp, Homo sapiens
tgaagttgaggtgcaggatgaatttcggcgtgtcgttggtctttccaccctggagtcagctgtgcattgaggtcttttgcaatgtgacaaatgctgtcaagacaaaatcattttttttgttattgttgttttacttgttttttttttttttttttgagacagagtctcactctttcgcccaggccggactgcagtggcgctatctcggctcactgcaagctccgcctcctgggttcaagccgttctcctgcctcagcctcccgagtagctgggactacaggcgcccgccaccgtgcctggctaattttttgtatttttagtagagacggggtttcatcatgttagccaggatggtctcgatctcctgacctcgtgatctgcctgccttggcttcccaaagtgctgggattacgggcgtgagccaccgcacctggccgacaaaatcatttttatttccaaagttattttaggagaaattttatttttaagaagtcaataaggttgtatgtttgtcatcttttgattggagtttttgaggaaattaagattagtcaatagcatgaacaaatacccagttagcagaattgaattttgtgttggctccatcgccttcctgaaagccgtgatggtttcacgcagccctgggaggagatgccaagcatgagtcactcctcttccagctgcagtgaaagctgccattggacccgaaatgtcactggcacttctcgttatttacctttttgtcactttcctgatcaaaaccagactcattcccagaaaacccaaagaatccgtatctggcagaggagcaggagtgggaaaaactgcatgggtccctggggaccaagtcaggccctccccggagcctccggcgttcttactttgtccactttgcccctgagcatggtgctgcctaccagtgacttcagtatcgactaggattttatctctttgagtctgccggtgaggacaaatgtgccctaatggcagtaaagctgggtaaggatccaaaacaaagccagctt

SEQ ID NO: 129292 - DNA, 1138 bp, Homo sapiens
cctcagcctcccaaatagctgggattacaggtgcatgccaccacacccagctaatttttatgtttttactagagacagggtttcaccgtgttggccaggctggtctcaaactccagaccgcaggtaatccacctgcctcagcctcccaaagtgctgggattacaggcgtgagccactgcacctggcccaaatcagatttttgtagagaagtactgatgtataatgattgaaaaatgtaggaggaataagaaaattatatctaaaagttaacattatttgtgagaagaaagaaaaacaagggaacggaaattttattcgctggaatttatttatgtgtaatagagccttccctgtttagcagagttttaagcatggagaactcattctttttcaaaaaggttagcactccttgaaactgtcttacttgggcaccacacatcgtagtttgtgcctgtcacttttgaggggtctggttagatgttggtactgccatctgtgtgcagcatgccccatgttgatttgcagcccttgaggaggtcagtagtggctgtggtcttatgagatggtctgatgtgagggagtcgttttcaaatctacgaggcagcgtgacagagacagaagattggctgcttcatgataattcttaaagctgagtggagttcattgtgctattccaattgttaattattctacactgtgcttttgtgtatgtttgacatttcccttataaaaacttaagaacaatgaagattaagttgatgcattaattagactttttttttttttttttttttttttttgagacagagtttcgctcttgttgcccaggctggagtgcagtggcagcatctcagctcactgcaacttctgcctcccaggttcaagtgattctcctgcctcagcctccccagtagcggggattgcaggcactcgccaccacgccctactaacttttgtatttttagtagagacggggtttcaccatgttggccagcctggtctcgaactcctgacctcaagtgatctgtccgccttggcctcccaaagtgctgggattacaggcataagccactgctgctggctgtagactcttttaagatctagattattagtagtttgcctacactatgatacatgt

SEQ ID NO: 129293 - DNA, 1001 bp, Homo sapiens
tgcagtggtgtgatcttggctcactgcaacctccgactcccgggttcaagtgattctcctgcctcagcctccctagtagctgggattacaggcacgtgccaccacgcccagctaatttttgtattttaagtagagacgggatttcaccacgttggccaggatgctctcagtctcctgacctcgtgatccgcccgtgctgggattacaggcgtgagccactatgcctggccggagatcagcttttggaaaagaaaaatattacatggtacttaggctttcttttagatatcttgtgttgcaaaatgcttttgcctctcaagtcatgttggatagtaactagttctttcctggatctttgaagtgttagacttgcatagtaaatattaaccatctaattatttaatttggagtttgcagaacatttaaaaattaagcctgtttgcagagttagtcgttgcacggtcttgggcctgtaatagattgctctgtgtgcttcattcactcttgtttgtaagatttaaaacaagtatacatctatgtctagctagagacttactgtttactctgtgtatctaaacattttctatattttccagttgtttcagatcttgtctctgtaaatcgcttgaatgcagttgagaaacggtgatggctgtaggaaactgctttcatttcttccttttctctctccatttcccctcccttttccttctctcccacttagtttcttatgccttttaaaaaaagtgcttttattctccaggcgatagggttttaaaaggaaagaaatataggggggatcagcttgaagataaacataacctcatgtgaatttgctgttagttagctaaacatccaagctggcaaacattgtttccacattatcaaatcctgatgataaaggcaaaatgaaacataaagctgattgtgtaaagactagatctaaaaacaaaataaaaagatcccttaataggcaagtttcatcatgaaaaagccccaaa

SEQ ID NO: 129294 - DNA, 1837 bp, Homo sapiens
taacttttcttatccaaagggctcgagtcctctgactctggaccagtcactcctgtgcggtccctctgtaggcctcccaggaactgaagatggcctctctgcaggagcccatctgacctctctagctgtgggttagtttttatcactggggagcacttgtgagctaataattgaaatataggcaaatccagtctttactcaggacaaaaagataaatggcaagtgaagttttgtcattgaatcctcattctcgatgttctagataaaacagaggatgatgctgaccgtgaagcgcagcttctggagatgcggttgaccctaactgaggagaggaacgcggtgatggtcccctctgctggcagtggtattccaggggccccagcagaatggtatgaaccctgtggtgcgtcttgtgaggtctgaacgctcaccaagccacttgcttttagcttgaattttgcgtgtgctacggttaatggaagagtcaatagcatggggggaaatgttgtttaaattaaaggaactgttaaattattttcatgagttgaataactatggcctaaaactgttttattaaataatgttgttattggccaaagtcattaagatttctgagaacttaaatcaatatttaataccactgcacttagcattaagaaaatagttaatatgttaattacttgggtcattcccttagaagactgttcggtcataagaaaattgcatctccacgcgattttggttttggtgctggcttaaactgtactgtcagcaaatgttctgtgctacgttatagaaattaaaaatagtaaatttagccagaggaagcccttaagtatatcattttataagaaagtaggtttaaacaagagaacttcactacaaacaggtagtgtcttataaggctaagttcaaatgtcagggtatgaagcagcagctacagtggaggctttgtggcctctctgattctggattagagtaaaatcagggccagggttattactgctttgccctgtaacagccctgaatgccattaaggctgtgttcctacgtgcatgccactgagaaagtaacctgaggcagatgccatttgttcttcccgttttaggaccccagtacctgggatggagacacacattcctgttatattcctggacttaaatggtaagttaggaggtgttttctgaaggcttacctctgaaaatttagtgcctacataacatgtagattccaaccaagtgcatcgtgaggcaattctgtccccctaaggctagagccagtttgacgtgtgtccatgtctcctggttgcagacggactgattggtgtgtcatagtctcatgtttatgacaataataggcgtgcttcaccatactcctcacctctcatccctgcagctcacggtgccatgtggatgctctgttctcctggtgttaggatggtagcagtgtttttctgcactaaaaatattttctaatttatttatttatttatttattttttgagacagagtcttgatctgtcacccaggctggagtgcagtggtgtgatctcggctcactgcaacctccacctccccggttcaagcggttctcctgcctcagcttcctgagtagctgggattacaggcttgtgccaccacgcccggctaattttttgtatttttagtagagacggggtttcaccatgttagccaggatggtctcgatctcctgacctcgtgatccgccctccttggcctcccaaagtgctgggattacaggcgtgagccactgcgcccggcttcttctttaactcttggggaaagacttctctctggaaaggacaaataactagcga

SEQ ID NO: 129295 - DNA, 2004 bp, Homo sapiens
atcaaacagctttagaacatttaggaagacaaggagaagctatgtgacatgccagaaataataagcattcagattgtaaaatgcttgggctcaattctggctctctagtgtcctggctgtctatccctgagcaagttcaataacctcttgccttcgcctgttatgtagacatgatgataacaccaccttcatgagattagtgtgaggattaagagagatgcatgtttaaagcacagggcctgacatgccaggtgttaagtacacacagctgggtagatacacatgccagaatccacagagcagagaagaatatgggagtggccacttaaccccacatgcatccgcagagtctgtgctgccaactaacagtgagagggaaatttttaatttaatttgtatacaggatttggaattttttttttttgctatactttaatgcattgtttaggagactgccatattctatgagtttccatactttaaaacagcagtaaaatactagaatcgctctagaaaacgagcgtagaaagcattcaaagcaaaatagagaaaattaaaggaaagagaacatttgcttacatgtttaagtttctgaatgttttaagaggaggatgatgataaacacttgttctctgaccccagcaaataaattttagcaaagtgaaagattagtttaaattaaagcatgtgttgtacacataaaatagaattcttaagggtgtgaagaacatctttttctgggcgtctgttaaaaaatatatgtatcttcttcgaagtcttagaaattcatctactggaaggcaagactggataattttctatgatttagtgtaaattggatatttaagtatttgtcatacttctgacaccctttactaaaagtgttcaaagaaatgttggtttatcaggaaagggctttttgaaggatatgcctctttaccttcatattgaaaaaatcatgcaagttctgaaaggatttttcttatatgatggcaaaaaccgcaattttcaccaacttaatggcaagaataaagacacagaggccataaattaggtccatttggatagaaagtcatgtggagaaagagctggaaaacaggaagagaacaggttgcagaagcttctggaggctggtttcggagggccttgaatgctaggctcatttgagtctaatatgtttgaaaattggcttgtattgttcttgaacgggaacgtggcagaggacaactgattagctttaaccatgtgaaaagtgctgtttttgtagaaataaatggtcaaatatcagtagtgacaggaagttctgtctaatagtttaagtgtacttttaaacgtttttctgtggaacagtaaaccattgccagatcctttctctccttttcttccctctccttaggaatcttcccttcaagtgcgcacttcacccttcacacttaggcacagattcacaatagatcacttcggaaagtgcttaggcaaactaagcaaataaaaggtagctaattgaaatgacaaaactgtttaggctattaaaatattttctttaggacttttcccacaaaatatctgaggcttagtccttggtgatattaaatcagaaaacatctgtatcccagccactcaaatggagtttgataggatcagtggttgcctgagctgattttcctgatcatgcagagctcttgggaactaaaatctgatggaagagggcaagagtaattgacttgcaattgaacatttaaattctgtttttcaaatgctattttacatttctaaaatttataaaccaagtttgaagtcagtaatttgggaatactgtgaattctcttttaaaatattacttcattgtaaatatataccaagtctcacataataaacagtctaaacaatcatatttactgattattttttataattatatatttatatttatattaatgatatatactgctatatcagtaaattatattttatgtattatatacaagttatttacataatata

SEQ ID NO: 129296 - DNA, 1002 bp, Homo sapiens
agtgagaaggaggtgaggtgaagcgaagaaggcctaaacctgactcttaattcatagctcatcctagaaccagtcctctttcccagtaaacatctctagaattgaagctgatgttgaagggagtaagttacgtgtcagccacaaggtagcgggaagctggagctgttggagttgggctgctttctgtaagacttcgcgtatattgagagggcttctggtgtttcagttacttcactaggaagggggaggaatcttaattcactgaagggttcatttttattatattgtacttgatttcagagcagctcctttgagtcatgtgatgatcggagatggagacatagggttgatgaccccacaatggcccattttaaaggtgatggactagtaaatgcaactctcaaatatcaccttctactattaaagtaaaataacatacaagggcacttctcacttgggaaatttatccttattactgaaaaaaagtagtacattctaagtcatatgggcttcctaaaatgaggttaaaataccatgttttttaatggaagatctcaaatatacataaataaaagtagtgagaaatgtgttacgaatccccattcaccttcgctccacaattaccacctgtggtcaacctcgtttcattcatacactcagccacttctgtgctgcccccctcccttagcaccccaggcacgccccagcatcatatcttatctgtaaatagttcagtgtgtgtctccaaaagatgagtccttaaaccaatataaccataattgccaaaattagtaatttgtcaaaaattaataatttcttaatattaaaatcgtcagttttcttaattgtcttggttggtatgtctcttggtctgtttcagtctttaggccctggtatgctcgtgctctctcactcgctcgctttctctttttgcctctcttaccacacctgcaattcatttattgtagaaactgggttgttgacctgcagtttcccatagtc

SEQ ID NO: 129297 - DNA, 2348 bp, Homo sapiens
ttgtaaaaagttaacatcctggtctcttgttattgtcactggtcggtgtgctccagatgtcatactgacttttctgtagctaacagagatcctttgccatgggccagtgatattttggttactgagaaaagggtagatgggcacaaagagcatggagcatttttttccttcctaaattaaatgacgtgtaaactgctttgttttgtgttcaaaaccctcatcgtttggattaagctgatctttccagctttagctctagtgtgctatacaaattttgaatatcccgttgttttacccatttctccagggaatatgaacatttccattttcacatcttttcccacactgttccctctgtcctgctttctccttatccgtgaagactcagttcaaatgatttcctcctgtcgcaccttcctttatcaccttgctctgaaaacgtcctcagctttcctttcactctgagcttgtcacaggcgtgtggcctagtgtcatactttctgttgtaagtttttgctggcacatgagtgtcttatttctacgacaagattatcaacttcctgagtacagtaattgccttgtacttacatggtatccacttggcttctaacagataccagtacttaatgaatgacatgaataagtgcctatcttaacttcagaaaataatactctttttcccaccaagactcaatttgcctaaaaagaaaaagaaagcagaacgagaggatgaggaccaggatccctccatgaagaacgagaatagttctgagcagctggatgtagacggagactcctccagcgaggtgtccagtgaagttaactttaattacgaatacgcacagatggaggtcaccatgaaggccctgggcagcaatggtgagcaagtcgggcgtgcacttgagaatcagttccagttggtagaggctgaggtggggagatcgcttgagcccaggagttccaggctgcagtgagctgagactgtgcccgtgaataaccactgctctttagcctgggcaacatagcaagacgttctctctttaaaaaaaaaaaaacggtagagtgttaaaaatgtttatgattggggactttcaaatgttaacaaaaaggaaaatctttatgttgctattctctgtattttgtgtctttggctttaatttatatttatcaaaatgttctgccttaatatgcagtcagatcactttgatctgatggatagaatctctcttgtttattttattttaattttttgtgagagagtctcgctctgtcgcccaggctagggtgcagtggcacgatctcggctccctgcaacctctgcctcctgggttcaagtgattcgattctcctgcctcagcctcctgagtagctgggatgacaggcgtgcacaccaccatgcctggctcacttttgtattttcaatagagacaaggtttcgccatgtcggccaggctggtctcaaactcctgacctcaggtgatccgcccacctcggcctcccaaaatgctgggattacaggtgtgagccactgtgcccggtcaaatttctctgctttagaaacttgcctgtcattggcttatgattgtatttctggaggattcgccatgtcttaggttatgtgtagaacatataatagacctgctttttctgcagggaagatggttgaggatatgtctgagaatatataacaacatgagtgattgaaagtcaggaaagctaagtttatgccaaattgtctttaaagtattaggtggtatagttaagatgacagacaacattaccatatagaacaacatttgaagtttattatgttgtaactctcgatcatgtatcttttttaaaaatgtgtttagatccgatgcagtccatattaaacagcttagaacaacagcatgaagaagaaaaacgatctgcactggagcgccagaggcttatgtatgagcacgaattggagcagctccggagaaggctgtctcctgagaagcagaactgccggagcatggacaggttttctttccactcgcccagcgctcagcaacgcttaagacagtgggctgaggagaggtaggcggcacagaggggcctgttaactttatagctcaggcttgccacctctaacacacctagggaaagtgtcaaatgggaacattaagatggtgcttacaaaagaattatgttaaaagataagtgttaacagccaagaaccactttgcatttgtttttaaaaggggaattgcccatttatattgcattatttaaaactgttggtgttaggtgttgctccattttcagttggtatggcttttggatttggatatagaagtacacttgatcattgtattatgctt

SEQ ID NO: 129298 - DNA, 1221 bp, Homo sapiens
ccagctgggcttggattacagagtaagagtaggaggatgagaggaatgggaacctttctccaggttgtaggactgatagaagcctggatttggaggaagagttgatcatgtgtagtgtacagaaaataagccttttctttttttttttttggcaggagttaagaggccttccttgtgggaggaagagcctttaatgtaaagttaaaaaaattgtacttgatatcctgtatcttaataaacgagtccttcagcaggagaggggcatgatgacactggtgtcccaggaatatcagtgttaccatgctgtgcatactcttaattatttcccgcccttccaaattcttcccttagtggtattctacccaccacttctgttgaatgccattttcatgataagcagcacagtggaactggtaaattttccttatattgataggatgtgatcattttccttgctatgggaagttaccgaagactttaatataggtctcatttctcattactgatatcaggagatgtttgtagagtctggttgtttggttattttcattcacgtagattggacatatttgtttttgttgtatattgctaccatcttttcattattggctgtaatggttccctctttactccttaatatactgtggaacaaatttagaacttttaaaaatggaggttatttattgatctctaatacttcataccataagcatcttaagtaactacatagcacttggaactttgaaaaatgggggataataatctattatacaggcatacgttggagactttgcaggttcggacttccacaatgaagcaaatatcatagtaaagcaagtcacacaaatttttgattccccagtgcatatataagttaggtttatactatagtctactaattgtgcaataacattatatcttaatatatattccttaacttaaaaatactttgcggctaggtgcggtggctcacgcctgtaatcccagcactttgagaggctgaggtgggcggattacttgaggtcaggagttcatgactagcctgaccaacatggcaagaccctgtctctactagccaataatcccagctactcgagaggttgaggcaggagcatcgcctgaacctgggaggcagaggtttcagtgaaccgagattacaccactacaccccagcctgggtgacagagagcaagactgtgtctcaaaaaaaattttttttta

SEQ ID NO: 129299 - DNA, 1034 bp, Homo sapiens
atcctgatggggaggtcactgaagatgtcaagcaggagagtttattgatcctcctttgcttttaagaaggatcccggttgaggaaagtgcacacacttttgcttttatatatacagagttaaatgagatgaattcaagacatcagatattttcaagaatgaaaactgagaatcactagtacaattagttactatatgtaatagactttatttttcaaaataaaattagaattaacaaaaaaatcatatagtttggaaagagaaaaatgcaataaatctataatgccatagcctaagagaatgtatttgaattacaacactattgaataattgtaacattgtaatgtaaacgcttggatatctcactgcctcaatagctgtgaaattaatacttctctgataacatttacaggaacgacagaaacagcttgagagtcttggaatatctcttcagtcttcgggaatcaaagttggggatgataaatgcttccttgtgaatctgaatgctgacccagctctgaatgagcttctggtgtactatttaaaggtgaagtaatgtgctttgctactagattcttgttacaaaataggacaatatttcacagtactttagtaaacttggggaaccatgcttactcagaaaacagcaaaaagttatagaaccatcttgggtttctggactcagttttcttttttagtctttgatgccattcaacctgacaatataaaaaaatgatactctgatattatttccaacaagtcaaataccttacctaccattatttaacgtgatttgtatcagggaattaagtagataactttaaaaatggatgactttgaagactaaatgattcatttagtaagtatacgaaagcttttatggtttatgtgaagcacattcttttgtgagcagtgtgttagctcacaagaaaaaaatgtataaataaagttcttaggaccagttggtatgaaatttatgtttccagtaactcttaggaaaaattaaaaatttgggttatcaatctattaaaagag

SEQ ID NO: 129300 - DNA, 1047 bp, Homo sapiens
ccttcatgtgggctcattttaggttttgttgaggtgcttgatggggctgaagagcacagcctcagtcaggtcagggtttctcagcagtggccctattgctgttttgggtcaggtaattcttttcatgggaggggtgatcctgtgctacgaataatacgaagtaatattttgtttatcagttccttcatatggacttcacattttctccctcaagccaaattgttagctcattatgggtaggaagtttttctgtccttggctcccagaaggacacataggagtcataaagaaaccaaatggagatgataaaacactgtcacccagatgctatcctattattgaatctcatatatacaatttttgctttgtactatggtttaattattgtgtttctggcttcctttcttaaagatacatggttttggtgttatattgacctgaagatttatagctcacatttttatgtactacaaaatattaggctaagcatttttattgcttatagtagtattgggggaaaataactattttgagttgtgtgcttttgaactgagcggcaaaatgctgacagggtgctgctcacatgcaggtacaagggcatcttagtgttcaatctttgtgctaaaatgtgacatttgatatatttcatttttgtaattattttggtttgttgcaccatgcaggtccctcacaaccctcggtctggttatctcagctcttgcagatcagagtgctggcaaaaacaagaataaatttgttccatatcgtgactcagttctcacttggctgctcaaagtaagtttgttttttttcccttcctggcatacttttggtggttggcaagaaggaagaaaaaagagtagactgttaatcccttccaggtatcatttcctctatcggtgtgcaaatgtataattattaggctcttatggtaatgacatttttgatggaataaacgtaggttttttcctagcaattcacatcctagcttactagaacctggatgcagtggggttgctggacgcacacggaatcacacgattgctt

SEQ ID NO: 129301 - DNA, 1172 bp, Homo sapiens
ttcagcatctagtatatagtaatgtaattatgttgttttactcaggagataatagaggatacattaagaaaaaggaaatatgaaaggaaaaaagtcaataatagactatatcctgggcgagaagtaaatcaaatattctatatctactttatccagttacatggtaataagtgacatttttaatggttgatcctagggtactatagattttagatttaagagtcatttccttatcccctgattttactgtttatatgaagggttattctagaactatcctcttcttgctgtctttattatgggtgttagtgattgaatgtggttcagcttctgtgctagtcattcattatatgtgttctacatttcttcccttcctctcctgccttcttagttactagcactcgctctccaaatgacggaagctaacacatttggagtcctcactgtcatcttaatctctctaatcttcactttgttagtgaagtctgttcattcacttagtgattcttatgtgccaggacttgtgctaggaactgcagactcccaaaataattagacattattcttgctgttctagagcccaaagtttattataatacaaatggataaaagtaaattaattcatgcctaaggtgaggataaggagaagctgactaagaggtggtcaagagcagattataaaggagcatgcgtagcaagctgaggagtgtgcacctctcttcataggcgtcaaagaaccacccaaaaacttgacgcattggttgggcacggtggctcatacctctaatcccagcactttgggaggctgaggcgggcagatcacttggggtcaggagttcgagaccagcctggccaacatggcaaaaccctgtgtctactaaaaatacaaaaatgagctgggtgtggtgatgcacacctgtaatcccagctattcgggaggatgaggcaggagaactgcttgaacctgggaagcggaggttacagtgagctgagatcctgggtgatagagcaagactccattggaaaaaaaaaaaaaaaaaaacaaactttaaggattataatttattacttattttaaaaaagattttgtgtagttcaaaagtggacacacattcgtgatttaaaataaggataaacaaaaatataaaatgaaaatcagtaaccttatcatt

SEQ ID NO: 129302 - DNA, 1257 bp, Homo sapiens
acatttagttttgctggatgaggaagatgatcaaggaaaagaggatcttagaggcagtgagtcatagtgactctcagtcaagagcaaacagaaccctcagctcctctctgttgtcagttttccttgaccaagatgataatctttaggattctaacagggagattgaattgatgctcagtgcttctgtacaaactttacttaacaaacatttattgagtgatcattatatgccaggcactatgcaagaactcacagtgtggacagaatgagagttttgtaaacaaataattaaaatacaacgctatctgcttttagcttgtgaaggaggctcctacaaattagagagcaaagggacaatgactgatcttgcccctaggagaagggaagattccagagtgtacttgcttgataacatttgtgcggagtgggaagttggtccactgggaagttgggtgagaactactcaggtgtagggaacaacctctcccacaccttgaaggtgtaaattaatcacctttggagaatgatccagcagttcagtgtggtcggagagtaggatgcacagaagtcaacatggaacaaaaggaggccaagatgggaggatcgcttgagcccaggagtttgaggcttcagtgagccaagattgtaccactgcaccccagcctgggtgacaggatgagagattcatcctgtctcaaaagaaattaaaaataaaaaatgttccaaaacaaagaggctagagagtaccttacggtccaggtacccacatcctacttaatattatatccctgtatatttttttctttgttctgccttgaacactttttcttggactttgacctcgcaaagatcatcacttttctgagatccagcccagacctactctttccagaaattcttagctgactgacttcatacctgttcattcttctgcttaatccagagtgcttgtatggcatctttttaacttatctgcacatgtacagtctttagtaatttctcctatgtttgtcttgggtataggttagtaattaacagcttacttacggtaattacttacagtaattaacagtgaattctgaagagcttcggatttgcatagctcaggatctaggtcctctacttgttacctattgaacaagtttcttaagctttccaggcctaacttgtcagcctagagggaacttgaagagggaaatgataggatacaattatctcagagggctgttgtgaagatagactgggatgatacacctg

SEQ ID NO: 129303 - DNA, 1180 bp, Homo sapiens
gttttaggtattttcttaaagtatgaggatgattaaataagtttatttttctttttttttttttttttggagatggagtgttgctctgtagcccaggctagagtgcagtggcgcaatctcggctcactgcaacctccgcctcccgggttcaagcaattctcctgcctcagcctcccgagtagctgggactacaagcacgtgccgtcacgcatggctaatttttcttttttttttgtattttagtagagacggggtttcaccttgttgcccaggctgatctcgaactcctgagctcaggcaatctgcccacctcagcctcccaaagtgctgggaattacaggcgtgagccaccgcacccagcctatttttctttctaaaggacatttgcttttcactttcacatgtgcagtaaaaaagcttctgtacttattattctcattatatttgggtgtatttctcactgcattttggcgttttgccaagtgtttattatgagcaacggaaagagggttatgtatttaacgtctcaaagagacaatagtaactctgatttccatttttttaggctctggaaaatcttataccatgatgggcacagctgaccaacctggattaatcccaagactttgcagtggactctttgaacgaactcagaaagaggaaaatgaagaacagagttttaaagtagaagtgtcctacatggaaatttataatgaaaaagttcgagaccttcttgatcccaaagggtaaaggactttgagactttagtgtttcagcattgtgaactgaaacagacttaaattggcttaagtgcaaatctttttaattttttcagagggtctcgctctgtcacataggcttcagtgcagtggcacaatcatagcttacttcagccttgaactcctgggctcaagagtttgtttgtttgtttgtttgtttttaaacccaagaaatttcaggtggaattcagctctttgtgggctgtgaggtgagggagaggcataatcagagagatgaaacctagtctttaggacagtgagtttttaaagattctcaggaacaaaaacaagtgcccatgatttcatggcacagacttgtaaagagaattggattggaagtcttaggaggccttcacaaacgctggtttgactctacagctgtaactgagtgaggaaagtgc

SEQ ID NO: 129304 - DNA, 1067 bp, Homo sapiens
aaaagaactatgtgatattctagaaagtggtgataaggtgaaagatcaaaacagatcatctgtaagatcccaccaagtagcattttaatacagattgttcctgctttttatgcatatagttttttggtacaaatatggaatcatactctagacttttataactttttcattaacataaactttttttaaattagtaagtcttctataccctcaaatctatacttgcacatgggcatgtcataatttatgtaaacattctgctattttaagctattttggacatgctatagtgagcatctttaaatgttatttaaaaaatatctttttctttgactacaaaaataaaaatattgaaaaaatataaaaacatgaaacagatcactaatttcgctgcaaaaaaataaactatagatgtaattctgtgtgtgtgactgtaggtgcatgtgtgtgtgcaatagccattttattacacattttgtgaatagttttccatgtaaaatatagagtcatatcacctatagcatgtttagttctcattgtaagcctctacatacataattaattcccattgtatgacagtaagttgttttatttcactattatgaacagttctatcagttatggtttataagtaatgttgaggttttcttaacacacacttatgttcattttcaacaggtgtttgcttatgatcattgtttctggtctatggatgaatctgtcaaagaaaagtatgcaggtaatagaatccagcatcctgtcaactactgatggtgtagaagaggggttcagtattttttcccttacacgattgcttggcaaaccccccaaactgtgtgtttcctctgctgtcacaccacaataacagtcatcaacacagaagatgacttaatgtgaccaaatgttgggggagttttccctgcaccccaagcggcagacactggctgggtgtcctctaactcagttccgatgctctctacctggggacagcgtcagatccacagactgagggctcagtcccacaagaccgctccctccttcccaccagcgcaggtccaggcctctag

SEQ ID NO: 129305 - DNA, 1023 bp, Homo sapiens
ttgagatcaagagttcaagaccagcctggccaacatggtgaaaccccatctctactaaaaatacaaaaaattagccgggcgtggtggtgtgcccctgtaatcccagctactcaggaggttgagcctggagaatcgcttgaacccaggaggcggaggttgcagtgagccaagatcacgccactgtactccagcctgggccacaagagtgaaaactctgtctcaaaaaaaaacaaaaaacaaaaaacaaaacatgcatactattttccatagaggttgtactaatttatatttctgccagcagtgtataagtgtttcagaagtctttttgtcaggaaattcttctacatctcttattccagagaaattattttcttttatgtattagccatgttggatattactccaaaatctcttaaacaggtatcactcatttgctagactttctgtggtgttttaatgttcttgtcagaaatcacttgatacaaataagtattaaatttcttttagaagaaaatctcaggagacaaagcaacaaagagatggtcgaagacaattggaagcaaacattttcatgtacagtttcctttcaggtttcaggccctgaaagttgagttttgatcctctgagaagggccaattattattgttcctattttattccagtttcaaaagtactttcctttattcttaaattgtttgatttcagtattgccctgttattatgtaagtgaacatcatcgtttttaggaagtttagaaaagcttgtccaaccggacttagtttgttgtgttgttgttctgttttgttttaggctttaagcagcctgaagccatggtctttagtttctatctctagtgataagcagaaaagaaggatgaggaaggggctttactggcccagccagaaacagaaaccgtgaacccatgactgttttctgtgttttggacacccggattgttaaagaggcatgtttgcaacttaccctcaaatggttcaggaaaaaaaaacatatatgtgtatgtgt

SEQ ID NO: 129306 - DNA, 1035 bp, Homo sapiens
agtatgacgatgagaaacagagtgtttacatagtttaaaagtttatcccccacatgattcttatttgttacgaaggtaaaaatagtaattttactgtgggaaacctcatagatccagccttgaccaagtgatcagaattaacatgatcagtaatggcacatgcacctcatatgactcttggtagaatgcaccaaggagggcgcaatgtgacttcagtggtgggcttgccaaaatgcacaatctggatttagtcaggaggaagcattaggcaaacccagattgagggacattctacaaaataaatggccagtcctcttcaagtgtcaaggtcatgacagacaaagtgccccaggttggaggagacatgacaagtatatgtaacacaaggtcttggaccaaaaaaaggacattagtgggggtaattggcaaaatttggaggaggttgtctataggttatttaataaactgtgttgatggttaatttcttggttttggtcattgtagctgtggtgatataagaaatatttggtggttaacatttgaggaagcttggagaagggtgtacaggatttttttgtactatttttggagctttttgtaagcctgaaagtatttcaaaataaagttaagcaacaacaacaacaaaaataattcaactcagctgagaaattacagctttagtgcttgtacttgagacatttctctggattggtcagcagctgcttttgcttcctgaatctccacagtgatctggatagttgaggtttctaattaagggatcttgggatgagtgagacatggctgtattgaattgcagctacactttgacaaggtgttgtttaattaattaatttatttatttttgtacagggttgtaattacatctttgggtgtcccatgcctttgcaggttatttgagctttactgtcatagccatcagaatccctagctgcaaacttagctctgtaattaatttactggtttgtttctgtttttattatgatgatgtgaattcaggttagtcccatggattct

SEQ ID NO: 129307 - DNA, 1087 bp, Homo sapiens
acactcccacagaagccttggtctttgctttctgaggaatccacactaagacgtcctctcgcatgcccttgtctgtgtcctcagggattctcttgctgtgtgttgagctggctgtccgttgacctggcctttttgggcctgtctggtccctttgccccccagaacttggtatggatagtaaggaactgaacttaaatattaggaagaggataggccaatttatagattgggttaatttttaaattgatcaaccccgtaagcagtagcaaagctgcagaacagaggtgctgcgagggagtttaatgattaccactgtgtctggggatgggaaaggcaagagttggttgaagagaagcatgactcagacttgggtgtgagtgctgggcctactgtttaccagctgtgtaaatctggaagtttatatcacctccctgagcctctgtttccttttctatgaagtggaggtgataacactgtgatatggatcatgcaagattaccgtgggcatgagtgagttatttatgtaaaatgtctggtacatggtacctacttagtaggtggtagctgctattttgccttgatttatttattcttgtcaactctcttaaacaaattttatttattaaaacatcatattttaagtaatattcttttcaaataacactggcatatatggtaggtactcaataaatattaactgggttagacatgtagtcaattataataccaggtttctaataacaaatgatgcccttttgcttttaattgacaataatcatagctgtttaagctgtagatctaagtgtagtttcttgatgccccagatagcaactgtaagatgtttatttaagggattgtgggtttcctctgaagagcatcaatttgcataatattgctcagagttggtttcttgaactatcattatcataagaaaaggaactccgtggtcaaggtctttgaatgcttagaaggtgtcagtaatgcagacacagccagcacagcattcttggaaatacaagaagtgaatagagactttagtttgtggatcttctcattgatgacaaccagcatttatttataggcatta

SEQ ID NO: 129308 - DNA, 1084 bp, Homo sapiens
ttgattgattgcagtggttctgttagtgctcgttctcaaaggcctcctgctctgatgttaccctcaaatagtagtttgaagggtgatttgcaagtctggagttggaatttctgaagggtacttctcaagacaacagaacctgatgagctatcttcttccaccccactctgtggagttcagtattctagcaatggctgtccttgtccactagatagatagattatcttgcttggacggtgcagatggacgacatttgcattactgtaacctttctagactcccaaagcaccacagcctttgttttgcttttgtcactttgacgacaatcttttgtgtcaatgctgtttcattggttgtattttatttttattttttaagccattatagagctaggttatattttaagtttgatgtttctttgtgatctaatattaggattatacggtagaataaatttccattgggaagaatttcctgaagattaaacaattctgtttataatgtgtagattagagattgcatactcaggcaccatagtccatattttacccagagatatgttttgtttggcctgaagttggaacatttaaaaatcaggttttgtataaagattcagattcattgtgtttcttaaataatctgaatctggcaacactgggttttctgccctcttccggctcccagctgttccattccgtcatttttatgatttgccaggcccctgtaggccttttccttttcaaccttggtgtagattcttactggcttcagtcacaaaagatgtcctttcctgaccttggccctgggttttgaagctcacattactttttctttcctctagttttttttttttttttcctttggtggtaaaatgctcacaagaaaattaatcatttaaccatttttatgtgtatacagttcagtggtgttaaatacattcataatgttgtgtaaccatagcactattcatcttcagaactcttcttaaaaactggaactctgtgctcattacatacgagatccccattcctcccacccctaggcctgggcaaccaccattttactgtatatatgattttgacta

SEQ ID NO: 129309 - DNA, 1049 bp, Homo sapiens
gtgtgccaagtatcaagctgagagttaggttaatctttaccaatccttagttccattaaatttatggtgttattaatttttttacatgatgtatctataagcatactagtaaaaaaaagcaaaacaaaaaactggaaagcagaaaaagttattctgttgtgcatcttgttagattttgcacactcaaatttgaaatgatttgattgtttaattttgagaattgtacattttcttgtgagaaagttttcttttacaaagaaaagcgtttagaactctggagtcctcaaacttcttccacagagttcttttaaaaagcacaggtattttatagatggtaaatttcacctttgctttacttctatcaaacgtaatttatatatacttttaattaagtaaaaacttatataggatgggtcataattattaagagtagtgactatctttatgttttgacctgtatatacaagtcagtaatccttttgttccacttttaggaaaattgaaatagaatttatgtaaagatcatcgaatatgtaaaagttttatttgcaatttaatttttaaaaacttttgttatggagaatttaaaagatatgccaatttaggcagaatagtataatagtataatgaacctccatgctcttgtcactcacccctgaaaaccattaatttgtggctgatactgtcctagctacatcttcatccctgtcttcttccccatattattttgaaggagatctgattttacccacagatgttttaatgtatcttttattatttgtaaacataacctcaataccatttatcatatctaaacaatttaaaataggtgtgaggaggaggaaaaaaatatagtgaggtggtggcatcaaattttcagtgtttaaatgcccaattatctcatcaagtctttttttccccgaagtttgttttgaataggattgagatgtggtctgcactttgaggttgggtggtatggtttttaatttattggctcctcagttgttgaagaagccggatcatttgttctgtcctgtggatgaattaat

SEQ ID NO: 129310 - DNA, 1032 bp, Homo sapiens
ccccatgtgtcatgtttaacctaatgaacaatagacagcgtaaaggttacagctgccagtctaatgggaagactgagatgttgatcacatcatcttttttagtaaggccattaaaaatctttttgttccttctgatagttttactagacatcaatttagtcagtatcattaggtaattaatgagtacctaatatgaacaaaacacacccaacccttctttggagcttcagtgtactctgaccctggtggatgtacagattggagcccttaaagtatgtgcagaattgagtgagtttgacccatgtccatacacttctcttgcaaattatattgcataatgctactgaggggagggccttatggcatacatgaagtcattttcagactaattccttgttagtggaaggcatcattaggtcatattagataatgactttttagatttctctactgctatatggatgctaatttaaatagcgattttaattgaaggaagtcatgcaaaatgtaattatggtacccacaatagacctgtttgttctctctgctgtgaaatgacttgagtggggctaatatttctcctcaaatagagtctgctcctctggagaacagtacgtggtatgttttaatttcataatggggctcttcctcagggagcccgtcctgctaattttattagagtacagtggggagagcgtggttctgtgtactcagaagttgtatatgattcctcagcctctccctttaaaaagaatactgtgatcatttactacttttgaatatacttgtgaagatgaatcagggagactcttaaaagctaaaaagataagaaaatatgtgtggttgaatgcatatcattgcataattaatggaagcaggtagtcaaattgcagcaaatacaaattttgcaaagttttaccagcagagtctagctggttgccaaaataaactggtagccaatagactgctactatagaatttgatattttagcattatcattgaatataaatattattttgctcatgctttta

SEQ ID NO: 129311 - DNA, 1458 bp, Homo sapiens
tgaaggtatgcctgcagcccgcagtgatgtctttcctctaaatacctgtcagttataatctgtcctacctaatttaatgattatagattgttttggattgtaacttccagctgtacagtggattttaatgtctttgggggaaagagactcgagggctgaggatgaatatttgagtatcatttctagatatgtatggtagtatgaacaaaaggaaagggaagaacatgaatttggggcaggaaaagattattttgggttttcttagtaaatggaggactgtaaataagctgggataagattacagaagacctggaaagcagatgaggaagtttggcctgtatttttgtcaggaagattttgtttttggcagtttttgagtattatgattgaggatcaaggtggattaggaaaagttgttgattggcaatgtagagaatgggtcagagtggggataggctgaccttttctggagatcagctgtatcagagatgtttttgtattggccctgaaagtggagaggtgaaagacatttggcatgaggctttgtgcaaagtaggattcataaatccttctagaaccagcgctgtatttggcactctgcagatattcttttgagttgagtttaattgagttgaaaagagcactgggctgggcgcagtggctgacgcctgtaatcccagcactttgggaggccaaggtgggcagatcatgaggtcaggagatcgagaccatcctggctaacacagtgaaaccccgtctctactaaaaatacaaaaaattagccgggcgtgatggcgggcgcctgtagtcccagctacttgggaggctgaggcaggagaatggcgtgaacctgggaggcagaggttgcagtgagccgagatcacaccactgcactccagcctgggcgacagagcgagactccgtctcaaaaaaaaagaaaagaaaagagccctggatttggagaaaatctgaaatcgaatccttcattatgttatcatagtgagttatttttaatttttttgaacctgtcttacgtgtctcacaaaagttttttcccacaaagatcaaataaattagtgacttttaaaagatcttgcaaagtgttctgtacatgggcaggtttattgttattaacatagagacacatacagcaaaatgtatagcttgatgaattttcatagtgaatacattccttataatataagtggcacccagataagaaacagaacgttgctagcatggcaagagactacatcaggagaagtagtttttcttttttttcttttctttcttttttttttttgaggcagagtctcactctgtcgcccaggctgaagtgcaggggtgccatctcggctcactccagcctccgcttcctgggctcaagcaattctcatgcctcagcctcccaagtagctgggattacaggtgtgcaccaccatgcctggctaatttttg

SEQ ID NO: 129312 - DNA, 1097 bp, Homo sapiens
agctcagcaaacaaggccggacgtcaatccaggcagaggaaataacttgagccagggatcaaacactaagattggcaggaaatgagcaggaagaggtagcggggtccctgacgccatctattcaattgtttttcagaagaggtatcagctcttgaaggcttacttctcaatactggctgcgagagcaagaatggtgtgtaatttacaaaagccgtcattgctgtaggtaagttgtagcaaacgactcgcgcccgagcattcccgcccccgccttcgctgcggccccgcccacgacgaccctggggaactacaagtcccgccatacagcggggagcgcccggagctcgcgccggccccgcccccagcccggtccccacccccggctccgcccccggccccctcccgccgggtcaaccccgaagagtcgccggtggccgcggcagacggaagccgaacgagttcctcggcggctgcaggatgggggactccaaagtgaaagtggcggtgcggatacgacccatgaaccggcgaggtgagagccgagccctcctgggccgccggggcggaggcggcaggtgcctggcgcgcccttccctcggccgccgtggggggtccggcggccccgcccctatagtcagcggcggggcgcgaggaggggcccggggaccctgaaacccgctcccgcgctgagacgcccggctccctcttctcccctcccttcccccctggccagccccgtccctggcgccgtcgggcccctcgtgccggccccgctgccccttccgcctgcgcccgccccgcccctgcgcccttttgccctctcgtctcccccggaggttcccgagggcgccctcggccctcgcgcccagcctcgtcctggcccctcagcctcgctccttccccgccagctgtcatcgtcgcccccgcgcgcgggtcgccagcccctgcagcccgcctcgggaccgcccgggaccccccgggaccccgcgtctcgcccgggtcgcccaagcctgcaccgccttggcccgcggcgggaagaagggcagggggccaggcgggtgccccgcggcgagttccttccacctgggcgtcctgag

SEQ ID NO: 129313 - DNA, 1170 bp, Homo sapiens
gagacaacacagttggacatttccactttttccttgattcctggaagtccagtgggttctgcagctgaaaaagccctgggtcccagcagcagagagacaggacagaggggatgcttgggcggggagggacggtaacctgcagaacagattccatttttatagaacgagtacacgtttgctaaaacagtcctgctttcccagactggattcccaccacagggacagtcggaactcaggactagctccagcgacatctttcctccgaattcaagccttctatcacaatgtcaaaacagctatttataaagccattttcattgtacttgataacagcacgagtcccaaaacttttagaaataaaataggacattggcttgattgaaaagagggactttttaaaaattgttctttcgtcagaagccttttggatgacttacaatagctctgatgaagataccaccccagcgtcagtccaataggtcagtgagtttcaacaggcatccatccctcccatgaagggattctggtgatgggaagtttctgtaatgacaggaaagcattgaccctcattgattgtcaactttggtattagccatgaaagacaggatgctcattgggtgttctgtagagtgaggaatgctgcctattccctcccagaacgtctgacccaggggtgtgtgttgaggagccctgggggaaatggaccaagttttcccacagagcagtattaggctgaagagcaggtgactggtaggccccagctcccatcattccctcccaaagccattttgttcagttgctcatccacgctggattccagagagttttccaatttgggaagccatgagaaaggtttttaaatcttgggaagatggagagagggacataggatagttgactccaacatgacaggaagaggctggagattgggaattggccatcaaccaagcctgtagtagtaaagccatggtcccgcattggaattacttggggaacttatacagttctgatacccaggctctcctagaccagttcaaccaattctaggtgggggactcaggcatcagtgtgtttcgtagctccccgggtgttttccctgtgcagccgagcttgggaaactgccatgctttttggatgtcaaggcgctgttggaggctgggtgtgacagca

SEQ ID NO: 129314 - DNA, 1464 bp, Homo sapiens
gggcagcggagaatgatcaccttttgttcagcccggattttcgactatctgatggcggcgcgtgccggattttagcgagccctggcgaaactctcggcggcgagactgtcttgtcacatttggtagtcggaaatcctggaaaaatcgcgtgctgtccgagtccctggagggacctggcgcccgccacacctgcagggcagggtgggtccgcggccctcgggctagggagcgggcagggcgcgtggggtccgggcgccccccgccgcgctgcgcctccgcctcccgccgccgcattccgcgcattcttccgcgcgggtagggtctgcgcttccgagcccggtaggcagttcagacccccccacacccatcaaagagccgctcctcccccccgcaggcgccttcgccgcctccctcccttcctttcctttccgctcctcttccgacctgtccacccgggaggaagggagctggaaagggggcggaaacctctcccctccaaaaagcacaacaaaactgttcagtgcggaggagccgggttcgcccctgccggacagcggggggctttgttccccgcagttgtttcctgcccatttgacctgtcagctgctggggaaacgctgctgttgacctttggttgaactgctaaggcgattttgctgatttttctttctttttccgcgagggctgtcttttgctcctccaaatgagcccagtccccctcccttctccccaaagcgctccaagagaaagtgccaggaaggggcttgtcccggaaggcctggcggctgagcggggccaggtcctggttaggccaccagggtgggcgtccgcgccattgtttgagcttgtcggcgctggtgggagagatgagggcaattcctctgggacgcaagtcccctcgaatggccggggctggccgggatgttccccgcacggcgctgccctcgagtccccccgatggagagcgcgggcgcgccttccttcgctggcgtccaaacccgggaccagctagaacacagcagggctgggactgggttccagccccacgtggagtctggatttgttttgttgtgttttgctttccttcctggaagaaatcccgaggggaccgccctagagcggcagctccaggacctcggcccttgggcttccgggggtgcagccacttaggccccgctcccggggagagagggattattttttaagatttatccccagggcgcgcggcatttccctgtccctcgtgaatcccgttgagagtcctccctccccaacctcctccatttccccagccagaccgattcgagagccctggagattctgggcgaggctagtgactgggtagtacaggcctctaggtaaaatgacagccctctggtgggtggcgaggtgcctggccaacataagagaagtactttaagggctgtttcctcctggagcctgcactgcctctcgtagtcggcc

SEQ ID NO: 129315 - DNA, 1078 bp, Homo sapiens
tatagtgagatccggtctcttcaaaaaacaaacaaaaaattacccaggcttgatggtgtgtgcctgtagccccaggtactctggaggcgaaggtgggaagattccttgagcccagtagttcaaggctgcagtgagctaagattgcaccactgaactccagccttggtgacagagcaagagcctgtcttttaaaaaaggaaaaaaaaaaaaagagaagtctatttatttggttcatagtctgttgacccctaaaggaagcatcagaagccactgcataaaagctgtgacatgaagctcaggaagattttttctaagatatttgccagctacaaggcattgtccaaatatgggccttatttccagaaaaaaaaaggggagggaggaatgccatggagtaagttattctcgggagtccttgcttattcttaaggattgtactaggcccagccagtctcatttgctacttggaaatgagggcatgtgccttaatgtgtgggatttctattaagcgtgaaatttgaccccataagtactacttaatctcatgagtaccttccatgtaagattgggtcttacctaatagactttgaatatttcagtatcagttgaaaagtcctctctgtaatgagaaaggtgagctggctctcagagcttgattcccttaaacatgggattctccctaattcccttcatttggattccatattgaaaaagcagctgtttggctgggcatggtggctcatacctgtaatcccagcactttgggaggctgaggcgggcggatcatgaggtcaggagatcgagaccatcctggctaacacggtgaaaccccgtctctactaaaaatacaaaaaattagccgggcatggtggtgggcgcctgtagtgccagccacctgggagggtgaagcaggagaatggcatgaacccgggaggcagagcttgcagtgagcggagattgggccactgcactccagcctgggcgacagagcgagactccgtctcgaaaaaaaaaagaaaaagaaaaagcagctgttttagttttctgggaatgttataacaaagtaccacaaactggg

SEQ ID NO: 129316 - DNA, 1033 bp, Homo sapiens
atatctttttcctctgggcaacttccttttctggtttaggaacaatccgttccttttcagtaaggatcatctcaatgtggcagggagagctcatgtatggattaatccgaccatgagctctgtaggtccaacggtgcatcttaggtgctttgttcactaggatatgctcaatgaccagagaatctacatctaaacccttaagttcagcattactctctgcatttttaagaatgtgcagcaaaaattcagcacttttttgggccaccgaccttgtgtccagccccactgcttggcctaggcacatctgccagctccaccattgtaacgtcgaaatggtacacactgcttctgtaaagtgacatttttcagatactttgtggcttttcgtatatgcatacccttgatggcctgggcagtttcacgagtgttcttaaagagaacacgaagatttgaacctcttgatttgcatgattttgtgcggttgtcagggtcaagtgaatagtgaaccattttcacagattgcctcaggctgcttagggaaacagctaattatgccatctttagccttgcatcttcagagagagagaatccaacttggatgcaaaacctgggtacgtccttcagtctcctgagctctcaaacataagtgatgataatatctgccttgcaagactgtggtaaggatgagaaatcaagtaagaaaactgcaccaggtacgcactactgctttctgcaactttaatcaacaaatccccaaacaacagtcagtcttcttctgagttgttcaaagaagcactggatgggtcagggcacaggacaggcccattagtggtgaccgcccctgagccagttatcaactcatcaaatttaataactgaactgccgtcaaatataagctacgcagaagcagagatcttagtctgttttgtttactgaaatctcacatacatagaccagtgcttggcacatagtaagtactcaacaaagatttgttaagttaatgagtgtgattctgtgagtggctctgtcctca

SEQ ID NO: 129317 - DNA, 1016 bp, Homo sapiens
aaactggcaggagaaatttccaaaatatttagtcatgtacctccttctggaagcctccctctgctcctcagtgactgttggaattccacttggcctctcttgccaagaccaagtgatgaacagaggcgtctggttgggagtttatgggcaaagctgggatagtcagatgcacaagcatggtgattgagagcttctttgagcatttcaaaaggctgttgggtaatttgagccccagcacacagctgtgtgggccctgagctggggctggccccccgaccaggctagccactttgcttgcaggtcagaccaaggcagtgagcaggcacagggatctggaggccaggtgtccagccctcccgtcagtctcctgaacagggcctcctggaagtccccacctccctgcatctcaccacagggatgggcaccaattcaccccatgactaggtgactctcgtgaaccaacaacattttagaaactagtgaaagagagatggctgaagacacaatggatttgggtgttgactatagtgcctttgggggcaaaagaaagcacagataagttcaaatgcatccccaagtatttttttgtttgtttgtttttgagatggactcttgctgtcacccaggctggagtgcagtgacacgatctcggctcactgcaacctccaccttgtcggttcaagcgattctcctgcctcagcctctcaagtagctgggactacaagcatgtgctaccatgcctggctaatttttgtatttttagtagagatggagtttcatcatgttggccaggctggtcttaaactctgacctcaggtaatccacctgcttcggcctcccaaagtgctgggattacaggcatgagccactgcgcctgaccatttacagggggaaaaagcatctcaagcaaagcatctcaagccctaggaaaagcagcagttaaggactgacaggtgcagcagtgacccaggggtgggttgtcaccattgagctgcaggacggccggagagtctggc

SEQ ID NO: 129318 - DNA, 1460 bp, Homo sapiens
gtgtgagtgtagtaggcttgatgattgggaaggttgctgtgggaggcgatgcactgtcctgcttagcccagttccacctagtggcacactctttcctttcctcctatctcattcatttgctgacaataaacatgtatgacttgtaattttataagcaattctaatgcatttttaaaaactaatgtaaattttacccctctcattctaggatatggtggtaccaggagacgataaagtagaaagttggagtcaaacactggatgcagaaattttggatttttcatcactttctctttagaaaaaaagtactacctgttaacaattgggaaaaggggatattcaaaagttctgtggtgttatgtccagtgtagctttttgtattctattatttgaggctaaaagttgatgtgtgacaaaatacttatgtgttgtatgtcagtgtaacatgcagatgtatattgcagtttttgaaagtgatcattactgtggaatgctaaaaatacattaatttctaaaacctgtgatgccctaagaagcattaagaatgaaggtgttgtactaatagaaactaagtacagaaaatttcagttttaggtggttgtagctgatgagttattacctcatagagactataatattctatttggtattatattatttgatgtttgctgttcttcaaacatttaaatcaagctttggactaattatgctaatttgtgagttctgatcacttttgagctctgaagctttgaatcattcagtggtggagatggccttctggtaactgaatattaccttctgtaggaaaaggtagaaaataagcatctagaaggttgttgtgaatgactctgtgctggcaaaaatgcttgaaacctctatatttctttcgttcataagaggtaaaggtcaaatttttcaacaaaagtcttttaataacaaaagcatgcagttctctgtgaaatctcaaatattgttgtaatagtctgtttcaatcttaaaaagaatcaataaaaacaaacaaggggtttagtctcattctttctattagcctaggcgcaaataaatgttactttttgtttttttaaaccctttttcccaaaggggaaagttcatgcagaagttctgtctccctaaacagtaattttatgtggtagtcgtaccttagtcttttggtaaatgttttcaaaaagtaatttacaaatggtgtggaagcctctgccaaaaaatagcgtttgaaaaaaataattaaatctccaagcctcccaacccatcagagattgcatggttacacttagttaagcttcataacctcaaagccccagttttatatcttatgtgtttaatgatttttgccatttaaaactgcagttacttttcaccaaccaataagaaccaatttaaaacaaacccttattaagactattgcataataaaactatcctcttttcatcagtaaaaca

SEQ ID NO: 129319 - DNA, 1030 bp, Homo sapiens
agcccctcattttccttcccttagacatgaatacttaccattgtgaattttgcggatcattcccttgcttcattttgcaattttatgacggatatatagcccaagtaacatttttttttttcttgagacggagtcttgctctgttgctcaggctagagtgcaatcacgatctcagctcactgcaacctccacctcccaggttcaagtgattctcctgcctcagcctccttagtagctgggattataggcgcctgccactgcgcctggctaatttttgtatttttaataaagatggggtttcaccatcttggccaggcgggtcttgaactcctgaccgcgtgatccacccgccttggcctccgaaagtgctgagattacaggtgtgagccactgcgcccggcccccaagtaacatatattaaatgaaaaaaatgtttgtttctaatagtctgtttctatttttcttcacagtgggaatgtaagacggacttagatattgcatacaaatttggaaaaactgtggtgagctgtgaaggctatgagtcctctgaagaccagtatgtactaagaggttcttgtggcttggagtataatttagattatacagaacttggcctgcagaaactgaaggagtctggaaagcagcacggctttgcctctttctctgattattattataagtggtcctcggcggattcctgtaacatgagtggattgattaccattgtggtactccttgggatcgcgtttgtagtctataagctgttcctgagtgacgggcagtattctcctccaccgtactctgagtatcctccattttcccaccgttaccagagattcaccaactcagcaggacctcctcccccaggctttaagtctgagttcacaggtatgtttccctcgcagtggccataaatagagcgggtgtgaggttagtgcatcctgtgcttggttctgaaatagaaaatcgttgcattgggaaaccaaaggaggtttgtcttctcattttgttttttactttcaacttcttt

SEQ ID NO: 129320 - DNA, 1469 bp, Homo sapiens
ccttcaaaagaatgtacatgggtgtgtttccatctgtgatatgctaaaatttaatctactctagatagatttttatattaaggaagagtaagcacattcctttataaacagaaacttgtagaattttatgctgcttcttcatagcccagaagtcaagcttgtttttgaatggtcatttcatgactttctttttaaaggaaccaaaggtaaatgaaaatactagtataaaagtaccacttttatactataaatatatttatactgtatatatttatatatatttatactatatatttttttactatatatatttatactatatatatttataagtatgtgttcagcactgtgacaattattgttacaaggcatgcttcttttagatcataattgggatacaactagagccttgatttttttttttattttcctttcgtttttcatgcctgttgactgagtgtatcttatttccatagattgagtggggagcttgtgcacttgttctcacaggaaacacagtcatctttgcaactatactaggctttttcttggtctttggaagcaatgacgacttcagctggcagcagtggtgaaaagaaattactgaactattgtcaaatggacttcctgtcatttgttggccattcacgcacacaggagatggggcagttaatgctgaatggtatagcaagcctcttgggggtattttaggtgctcccttctcacttttattgtaagcatactattttcacagagacttgctgaaggattaaaaggattttctcttttggaaaagcttgactgatttcacacttatctatagtatgctttttgtggtgtcctgctgaatttaaatatttatgtgtttttcctgttaggttgattttttttggaatcaatatgcaatgttaaacacttttttaatgtaatcatttgcattggttaggaattcagaattccgccggctctattactggtcaagtacatcttttctcttaaaattatttagcctccattattacaaaaaattataaaaataagttttcagtcagtcaggatgacatcactcccaatgttatgcagacatacagacggttggcatacgttatagactgtatactcagtgcaaatatagctgcatttatacctcagaggggccaagtgttaatgcccatgccctccgttaagggttgttggttttactggtagacagatgttttgtggattgaaaattattttatggaattgctacagaggagtgcttttcttctcaattgttagaagaatttatgttaaactttaaggtaagggtgtaaaaacatttttgagataaggtttttatttatgtttattattgttagagtgagttgcaatgtgggaagaaatgacattgaaattccagtttttgaatcctgtttctatttataagtgaaatttgtgatctcctatcaacctttcatgttttaccc

SEQ ID NO: 129321 - DNA, 1030 bp, Homo sapiens
aattagtcagagacagaagatgatcatcgctttactaattatggtaatgaaaaatcaaaatgatcttaaggccaggtgtggtggctcaggcctgtaatcccagtgctttgggaggtggaggcaggaggatcacttgaggccaagagtttcagaccagcctggacaaaatagtgagaccctgtttcttttttttttttttaattgtctgtgaggcattttgtttgtaaatatatgctgcattacatccctagaaaaagaatcccaggattttccctcctgtgtgttttcatcttgcttcttcatggtccatgatgccagctgaggttgtcagtacaatgaaaccaaactgaagggatggaaacagattttctgccatttttccagatctttgagttgcacatcaaatctggggctgatcactccacacttgtttagcctgtctgtgaggttcacaacaattttcccagctctgtgatcatcaatgatttcaaattcgccaatgtaaccatgcttcatcatcacagtgagaaaccagacgatgactttggagcacggcctaataagcacctggctggcgtttgcctctcttttcggcattgttgatgctcttgagagcatcagccaggacattcatgcgcaccattgtggcggcgcagaaagatggcaggaggagcagtgagaccctgtttctataaaaaatttttaaaatctgaaagttagcagaagattgattaaatcaactgtgactgtattaggtggttatttaaaattacattgtagaaaaatgcttatagacataaagtttaaaaagcaggctataaaatagaaattagtatgaatctactgtttgggaaaaaaatctgtatatatattttttgatttgtttttttttttttttttttttttgagacagagtctcgctctgtcttccaggctgcagagcagtggcagaatcttggctcactgcaacctctgcctcctgggttcaagggattctcctgcctcacattcctaagtagctgggattaca

SEQ ID NO: 129322 - DNA, 1101 bp, Homo sapiens
atcactctttcttctctcatgctcttgacccagagggtcacgtccctctctctggacatttgtgaggggaaagtgaaggcagcatctggaggcttcaggagcaggagctctttgtctgagcatgtgtgtaaggcactgccctatttcagctacttgctctttttccctgctctcctgggaggctctctgtgctccttccagcgatttcaggctcgtgttcaagggtccagtgctttgcatcccagacactctttctgggctctgagctggaggggtctgcagattcttggactagaatgcctaaacgtggcagtgagcagggtggtggatgcaggagcgggactgactgattgccagcaattcgagtgcatctatgtcgtgtggaccacagctgggcttttcaagctcacctactactcccactggatcctggacgactccctcctccacgcagcgggctttgggcctgagcttggtcagagccctggagaggagggatatgtccccgatgcagacatctggaccctggaaagaacccacaggatatctgtgttctcaagaaagtggaaccaaagcacagctcgatggctccgacggcttgtattccagcacagcagggcttggccgttgttgcagacatttgccttctctgcctggtggcatggactccatccaggacaggtgtttggtttcgtttgctgggccgtgatggtggaagctgactacctgattcactcctttgccaatgagtttatcagatcctggccgatgaggctgttctatagaaccctcacctgggcccacacccagttgatcattgcctacatcatgctggctgtggaggtcaggagtctctcctctctctggttgctctgtaattcgtacaacagtgtctttcccatggtgtactgtattctgcttttgctattggcgaagagaaagcacaaatgtaactgacatctttccctggctttcaccttaaacacccaggaaacattttagaaagtgccagatgacgcatcgataatgcatacatttgaacttttccataataaaattttttctaaagttttggatggatatacccagtgacttgcagta

SEQ ID NO: 129323 - DNA, 1049 bp, Homo sapiens
gtgatctggagatctcatgttcctggctctctctggtgatcacaattggcttcagggtcacttggagcacagaggctgtgatgctccaggcggtcacctatctgattctagcctgcggttggttcacttgctttgccatcctcctgactatacctagaatttttttttttaattttcctgtaaagactattttcagccaggcacagtggctcactcctgtaatcccaacactttgggaggctgaggcaggcagatcacttgaggccaggagttcaagaccagcctggccaacatggcaaaaccccgtctctgctaaaaatacaaaaattagctgggcatagtggcggacgcctggaatcccagctactcgggaggctgagacaggagatcgcatcactgcactccagcctgggtgacagagggagacactgtctcaaaaaaaaaaaaaaaagttcggggggagagactattttcaccaaaggcttcaggttggctgctctaaggaaaaggcaagatggcaggtgggtggggcgtaggaagtaccaaatgggatggagtgaatcaggatttcagtagggagctggggcctgatggggctgggagagcaagttgaacaggatctggctggatgcgaggcaggctggagcagacctggaatggggggctctgctagtcgggcagggctgctgccatcacacagtgccacagactgggtggctcaaacaacagaaattcatttcctcacagttctggaggctggaagtcactgatgatgacgtcagcagggctgggttcttctgaggccattctcgtggcttgcgggtggcagtgtccctgtatgtccgcgtgatggtcactcctctgtctgtgcatgtgtctgtgtcctaattgtctgttctcataaggactctgtgcatattggattagcgcccatcctaatgacctcatttaaccttaatcacatctttaaagaccctaactccatatacagtcacattctgaggtactggggttagaccataagcacaggaattttgggggcacattca

SEQ ID NO: 129324 - DNA, 1038 bp, Homo sapiens
ggtattgttgacttgttacttttacagatctgaggttaagtcttgccctcccatctgccggctcacctctctgctcccaccactccgagatacaaggggtccttgcagagatatcgggaccacgttttagttggcctagtggcctgccccactgagaagtgtgctgattgtgacgcaagcattacctgggatctctcccttgggcgtaaaactgaaggcagggggcatttgtgagtctctcctactctcagttgcccaggacaagttcaatgttagataatgctcttttcataatgagaaggaagctgaggaaatggaaaattgcaatgagaaataaggtctaaaacaagagacattttatagaggctaatgtatttgaccagggcttaataaaattgcatattttaacaaaaaaaacccactttaaatgaaaagtatcagagaaatgacatttacagctggtgatacattcaaggacagtgtcgctcatttatcatggaaaaacatctggagtgacaggatgtttccagaaaactttcaactagaagacagatgactgatttcaggacagtgatgccccaggaatgaactctgctccaagaaatttctagtctctgaatttcagttttttcttctataatatgagagggttagaccaggtgattttcttctaatcttactaaaatctttcttcttcaatacagcaggagggctacatattttctgttatttcagtagattgactttttttttttttttttttgtgagacagagtcgctcaggctggagtgcagtgaaagctttgcaccatgcctggttcctttttttttttttttttttttgagacggagtctcactctgttgcctaggctggagtgcagtggcacaatctctgctcactgcaacctttgcctcctgggttcaagcgatcatcctgcctcagtctccagagtagctgggactacaggcacccaccaccacacctggctaatttttgtatttttagtagagatggggtttcaccatgttggccaggct

SEQ ID NO: 129325 - DNA, 1104 bp, Homo sapiens
tttagagctagagaagcattaagggtctttttcaacataagtaaatgagcaaaccaaataccatatgagggaaaagacttgtccaagatgagagagctgagtagctgcctagaatctttgacgctcggtctggtgatcttccccttacatgtggctatctcacccattccttaagcaaacatttcccgaacacttcaagcctccaagtgctgtgcccaccaccctgcagagttttttttttttttgattttttggttgtagctgaaatgttattactcatgcctaaacacgtgaatttaactcaaatatattttttcacatgttttgcacaggtgacacccagaattatagttgaaaaatgtggagtcttagaggcaatttttaaactgtaaagattaaaaataataaaatactagaacatgtgcatgatctgagtgaactagactgtaatacgtatgaatttttcataaacataagttctttctagataaaattttgggaaggaattcaagcttatacctaatttatagcaaccatgtatggaatttgtaagaaagaccttgggaaaatatttaactgtcagaaaaagactgatttaatgcttacttaggatttaaaatacatttggcaccttcagtgtaagtcaattaacagcaactatattctgcagtaactcaactgtcagagataaagcaccatttaaaaatggcgtccacctcttagaacacaaacattttatcttccaaatatttcaactagctaactaatagcaataattattttatgtgaatatctgtttatgtttcacaatcccaaatgattattaagggtggaaaattttcaagttaggcatgattttggttctaattaacagcctaaaaagatagctagcatcttctttcctttgtcctggagaagacccactggactttgaatttaaaaaataaagtaggctgggcgtggtgcctcatgcctgtaatcccagcactttgggaggccgaggcgggcagatcacgaggtcaggagttcaagaccagcctgaccaatatggtgaaaccccgtctctactgaaaatacaaaaaaaaattagccgggcgtggtggc

SEQ ID NO: 129326 - DNA, 1750 bp, Homo sapiens
aggtttcaccatgttggccaggctggtctcaaaatcctggcctcaaatgatccacccacctctgcctcccaaagtcctgggattacaggtgtgagccactgcatgcagcctagtacaccttcttgacaaatttcattactcttcaggtaagcaaggagattgtatttaagtttatttgaattttagttaactattccagaaggttaaaaatgtgccttccctcgctaatgtttccaggtatcacctggtgactattatcaggacctcgacatacaagagaatccaaaatggtgaaataactgacttaccagttttcagctttctgtgttatgacatgtcaattattaactaggaaactaatcattaaaggcattaacaaaattggtctcgttgggtcacattgctccttacacaatggggctggttaacatttggactttcgtcgcttccctagcgaccttgtctctctcttctgtgtatttttaagggagtccactcttttattcccatttactttcatggatgtgctagtgactgctagagacatcaaaacttgcccgggtacagtggctcatgcctgtaattctagcactttgggaggctgaggtggtagagttgtttgaagccaagagtttgagaccagcctgggtaacaaagcaagaccctgtctctacaaaaaataaaaaaaattatctgggtgtggtggcacgtgcctgtagtcctagcttctcagaaggctgaagcaggagcatcattgagcccagtgctgctgtaagccgtgatcataccactatactccatcctgggcaacacgaggctctgtctcaaaaaataaaaaacaggccaggcatggtggctcacacctgtaatcccagcactttggaaggtcgaggcaggcagattacctgaggtcgggagttcgagatcagcctggccaacataataaaaccccatctctactaaaaatataaaaattagctggatgtggtggcatgtgcctgtagtcccagctacttgggaggctgagacaggaggatcacttgaacctgggagccggaagttgcagtgagccgagatcgtgccactgcactcaagcctgggtgacagagcaagactctgtctcaaaataaataaataaataaaaataaataaaaataaaaaacaaacaaacaaaacctaaagcttcatcttcacctcaactcttccaagaagattttcaaaccttagtgcttctatattgattcatttcttcctcttcattcatttatttttttccccacccatgcatttatttactcattccataagcattggtttgatgtttaagatgtgccagatacagtgctaggcatcttgggtacaagatgaacacaaggctccgctttacaggggctcattcttctcagtagctcctcaataaacagaaagcgacccctccctgagaggccgtgctaggaatccgtgttggagaaacagaagctctgagtgaaaaatgaacacaagtctggatggtaacaacacaggaaggaaccgagggctatctgcctctgcatcctggccacatcgctctgctcctttttctcccgccttgctctcactggtccctccactgcacttagtcacatattgattcaaagttcgatgcttccaatgtttgtgctgaaaaagtccttctctgaattctactacaccagtgtctccttgcttcaaggccgtgcttttcggaggatcctactgcagtcacagagca

SEQ ID NO: 129327 - DNA, 1009 bp, Homo sapiens
aatctgggcttaggacccaggtcaggccatgcaactccatctcagagataaaaatcctctcatgaaaaggaagcaagttgcatttctgggtatttttagagaggtttactgagggtgctggttttctccacccattgagataactggagctaacagtagaagactcagaaagggtcacttagaagggatctgatgccacacacaggcccagcttttccagttaaactacaacttctgcaggcctgcattgtcttatttggtgctctcaaaaagtatccatcccctcgaaatcagtctggcaatatatgaaaagagctataaaattgttcctatcctttgacccaatcatcttgcttttggaatataccccaaggaaacatgcagaagagaaaagaaagcaaacggcacaaagctgtttatggtaacaccgttcataacagtggaaacatgggacatgacccaatgcccaaaattgggaaaaggttatgcaaacgatggtactttaagacaatggaatgttatgttgctattaaaaggaattaagtttacagattctgtggatggatcaaagtgcatgcaaaagatgttaagagaaaagaatgcaaaaaaaagtatgcttgggctacaaatataaatcagtcggcatgctcattgataaggatcagaaatgaacacggtgctgcaaatagctggtactctagatttatagcattgttttttcttctaaagttcacagtaccatgaaagtactaacttttggtgtggagcaagatagtggaaaaaagatccatcatctccttttgctcatggtgagtggtgaggggatttcctcatctgaaaggtcagcgtgcatctgcagtgtaatgtgtctgcaagaacagcccactcagtgttcatctacgtaacagaaacacagcacttgggaggccaaggtgggaggatggcttgagcccaggaatttgaggctgcagtgagctatgattgcgccattgcactccagcctggacaa

SEQ ID NO: 129328 - DNA, 1015 bp, Homo sapiens
tgtatttttagtagagatggggtttcgccatgttggccaggttggtctcaaactcctgacctcatgtgatctgctcccctcggcctcccaaggtgctgggattacaggtataagctactgcccccagcctcctcttacttttgtgtcatccacaagagttcctaggaagccgtaactaaggagaggagcttgtacgtgcacaatgaatagggtatcaattgcccaacaataagaaagctattctcagagccacttgtctgttcacttcacgtgtattgagcatctacaatgagtaaagctctgctctagactctgtagggagcatttcaaatagacacgatgagctccaaaggcatctgaaagatgagtttaagtttcccctctggtttagaggagttttggtgtcatgcgttgtgtctggcaatgtactgtttctctctttcccatcttctgggtggcagtctcttctctgtcttcagcttttaggataaataacacttccttgagaggcctgccctgagaaccttatttaaagaagtcacctccttcctcccttccccctcgatcacatcagcttgcttatttacttcatagcacggatcacaatttgcaattagatatttgtttccttgcgtgtgtattttctgtctcatacacttgtttattatctccacaagttcagatcctctcttcatttttcatcgtggctggcgtcatgtaagtttcttgaaggctgggatcatggcttagattttggatttctcagagggcatagcataactactggaaaatacaaatagctgattgatggttgtttgctttattaataaagtcaaagatcacagatgttgctcaatgccacacagttaaattttcattaaaaaacaaaaatcaacagattgtacctctagttgtctgtagttcaccaccacatcactctgtaaacacttctgaccagtcctgggaaaacagctgaaaatggaattcccatgcacagtgggtcaatagaactaac

SEQ ID NO: 129329 - DNA, 1060 bp, Homo sapiens
aaagtatgctatctcagtcaatatgaatatttaaaaatttggttccacttatattttattaattcggaagccaggaaaaaaaaaggacattaaaatcataaacagaaaaaatagagaaagatgtctttctaatggaaccaggaatagtagagacacttctaatataaaaatgttgtcacttcacagtactatagaaatgtaattttagtcattttcagtaattgtttatgaacttaaaccaggtagaaaccaaatgtgccaaaattcgagggatgaattcttgcatatttagtatcatttgtcatatatatatttgtcaaatatatgacagtagtccttctttgagacgaatttgtggcactaggttatacatcatcacaatacttttgactaacagagagaaaggagtcatttaaattataaaatttgaattacagaacacttcattattaagagataattaggtttatcatttaataagtatacagtagctcatactgatgactattacagtgatgtcaaatatagggcttctatatgataagcacagaccatattaattgtgtgcttcttatcaactcaacatggcttaaggtatcattttatggagcaaactgtgcctggttacaacattcagccattagccctattccatataccacatcattagcactctattttcagattgtctgtcttttttaaaacaaacaaacaaataaacaaacaaaaccctctctatgctaaatttgtagcccattaaaaaattccctgagttgtttttctgaaatcaaagttgatattaggttaattctcccctaggctacctttgcatactttatttatttttaattaatttatttatttttttgagacagagtctccctctgtcacccaggctggagtgcaatgatgcgatctttgctcactgcaacctccgcctcctgggatcaagcgattctcctgcctcagcctcccgagtagctgggattacaggcacgtgccaccacacctggctactttttgtatttttagtagagacggggtttcgccatgttggcca

SEQ ID NO: 129330 - DNA, 1046 bp, Homo sapiens
ctggttctttttctttcttttctttctttccttccttcctatttctttgtctctctctctctctctctctctctttctctctttgcttcttctgtcttgttttgttgcccaggcttgagtgcagtgccacaatcgtagctcactgcagccacaaacttctgggctcaagggatcctcctgcctcagcctcccaagtagctgggactacaggtgtgtgccaccacacctggctaatgtctgacttagttcattaatgtcttcacggttcatccatgttgtagcatgtatcaggatttcattcctttttgaggctgactaatattctattgtatgtatataatacattttaaaaatccattcaactgttgatagacacctgggttgcttctgcctttgcctattgtgaaaaacgctgctgtaaacattggtgtacaagaatctgtttgagtccctgctttcaattacttggagtatataccaaagaatgtgctacagaattgaatgcttgtgtcctctcaaaacccatatgcttgtatcccaccccataatgtgatggggtgggatttcagcgtatggattttgcaaggaggtggggtctttggcaggtaatcaggataattaggtaattagatgtgctcatgacagtggaggctttatgaatgggattagactttcaggctccggaactgtgagaaataaatgtctgtggccgagcgtggtggcttatgtctgtaatcccagcgctttgggagcctgaggtgggtggatcacttgaggtcaggagttgaagaccagcctggccaacctggtgaaaccccatatctactaaatatacaaaaaaaattagccaggtgtggtggctaatatagtcccagttactataggcaggcgcctatagctgaggcaggagaattgcttgaacctgagaggtggatgttgcagtgagctgagatggtgtcactgcactccaacctgaatgacagagaccctgtctcaagaaagaataaacaaacaaaaaaataaatgtttgtcgattatgccaccta

SEQ ID NO: 129331 - DNA, 1038 bp, Homo sapiens
atgaagccattattgcagttaatgagtttcatcattatttacaatacaataaacaatgtgttgatttaaactgggtgtacattaacataaatgcgcagaacatttttttaaattcctctccatgctatttatggcacacagcaaagtttaatggtagatgcgaagaaagaaaaaaaaaagtgagaaatgagacccttgggtagccagaaggatcaagataggaccaacctgttttcattagggggcagctttgtgggaagggctcgggtgagcacccacagattgcaccgaggtgctatactctgaggctgtgataaacagacttcccagcccccacagatctttcctgtagatttatcgcagtgcctggggttctgccattaagaattttccctatagtcttgaaggctaatcatgtttacagttctgctttgaagattgcaaagcacctctaggaacacttcttagctaatcccttggggcaggggctctaaccggttgatcaagcttgactggtgcatcttttcgggaagaggcagtagcagtgttaagagctcaggcgttagatattaaatccctgcctctgctgagagtgacctggggcaagttatcttccctaagcctcagtttctttatctataaagtaaggatagtaatatttaccttgaagagcagtcgtaaaggaaacaaaaaaatacatggaaaacgcttaaccacaacagatggtccccatataaggacaaccaggtgggttgaaaggcagctgttagcccctcaccgagcatgtgcgcctccctcagctcagatgcatcccagcagctgggctggggagagtatttccaactgctgggcaccctacttctctgccaactgtgagctgcagggaagggatgcctaggtggaccaggtcagcacctcctctaacatccgacttcacccccatgaaatcaacaccctcacaatcttggtatcctgggagactggagaggggtcctaaatgggagggttcccagaagactttaccagctagagaattct

SEQ ID NO: 129332 - DNA, 3649 bp, Homo sapiens
gccgccgtcgcagactcgccgcgggagccccagcccaacccgagcccgacagccactgccccggctccagctccagccccacagcccgcggcgcccgcccgagggagccccggcgcccggggaaggctccagtgggctagcgcgccctcgcccagccccgcgccccagccctgcccggcccggcgaggaaggaccgggaagatgaacaacggcggcaaagccgagaaggagaacaccccgagcgaggccaaccttcaggaggaggaggtactgggcggctcggtgtggtggcgggggcgacgcgggacccagtgcgggcggccggcggggcgcgggcccggggcgcggcggtggaagaaggttcaggcatggcccgtgccccggacgcagccccacagtgtggcccggggagggtggatctcgggagcgtgtgtttttgtgtccacgcgcgtctgcgggccccaaattgcgtaactccaaggacttttcggagacttttgtaagtataatgctcagctttgtttgcccgggatttataagtggaaccgagagctgactcctgggtgacctcagataatcgggactcggagggtcaggacttagggccggggctggaaattgtgtatggattcagggtcggggggggagcagtttaaggaagaaactcgggggaaagttctcgttaaaagatacctctattccctgccccctccctttccgtgttaaaagttcttggtgaaatatctttctagccgaggttttttggattaatagataactcatcagccacattcttctctgctgagtcaaagaccccgagcctgggcggtgaacgcttgtgattttaggggccgtgcagctgaggggagcagagtaagagggttaaaaacgcagcaattcaccaaatgctcatcgagggtattttcataggactttgacttctgagcatgcattttaggtggtgcgtccgtaatcatgatgaaagttttgtgactgcggagcgttccttcggtggaaacaaaattgagtagatgtggtcagaaggggagtcggactcaggaacaaacgtttcagaattcagtaggatatttgtggtatcctaccaaatgactctttttgcaggtacgttatctggagtccaagaaattatttctggcgtacttcttaacatcccacacagttgagttcttaaacattctagaggaacttgagagtgtgtgtagatgcaggaaagtgcacgtctaaatatgacccgaaaagattcacacaggtattggatcctgatataggtgaacacagaaggtaaacggattctaaagcgttagaatgttgagatcattgttgagacactatgttgtgtgcaaacttcaattctgatagtgaaaccaaaattgcagaggaattcattaatacatacaacttctctgcacattgtccacttggaaaatggtaactatttagatggagaaggtagaggagcgagactatgccaaacaatgcaaaataaataggagattttactcgtcacccagttgtatggtagtgaaaacctaaatgaattgcagtcagccaaaaattgctttttcacccgaggacattttctattttattataaaagactatttgaagagttgtttacttgcatgttttctaattacaattgtaggaatgctactggcatttcttttttcaaagcgatggagagttgaatggtgtgttctgattttttttcttgaactttactggctgctttgctatttattttccctaccacttaaaaaaatttaaaaataatgacaagtgtgcttttttaggaattaccatatttaactaattcacttaccatatcaagataatcatcgcttcagaaatctttctgtttcagctagatgtgcaatctgtttgcttctcagggttagaatattatatgaaaccatctttctttattcacccagttgagaaaacttttttttttccttttggtaggtagcaaaagaggttcaatgtcctaaaaatcatacccacattaaaattaagtatagaaaagtcacatttttctgcttgacccctcttaacagctgccaggaccaagggattgcctgccctgttcctggacgctcctccgtccttgtgaggttgtgtataataatcgctgtataatcgcgggccattgcagtacagttgctgcctcttacttgtcctgttatctgacagcgttccttttcaggtaggaatggcatgtggctctagaaagtatcggtctttttagcaaaacacttgttatgtaaaaagtaaggggacacgtaggaagatttcagaacccaagttgtccaagagagatgtcgtgtacaaaacagttaagaccgtgaagagaggggggtttataatgtcagaaattgaggaaaagaaactaaggtggcctgaatgatccaggtaattttgccttaatttcctatttttggtttatattttgttcttgaaaaactcttaacctcttttttgtttttttctttctaaccctgaaagccacaggtaaaataaatagagtattaggtgagtgccattaatgtgcccggcattacacaaaaccactgcactgaccctttccctgcccacccattgtatcagcaacttgctcttaagcacatttaaaaaccttggcggtggactccagtaaacagaacacacacatacaacatagatatatacacgtaatgacgagaggaaaaatgtgtttcgttgtaatttctggtagccattgaactgacatggaaaaatgagtccaatcatcattaagggaaaatagtttatttcacagatcatgagggtggtttgggctttctccacattgtagaacccaagtttgtttttttctgtgtttctagtttcgaaacgaattccttctatcaatcagtgtattttagcttcttttgagagtttctaatgcttaccctgaaataattgtgctgaaatgcctctttggttctaattgtgtagaatgaacagttcaggatctaggagtatttttgcagctttttagggttggaagtttttgagaactttggcagaacatgtattaatacttctactttggatagcattgaaaactttgaggaaaaataatttaggatttggctagccagttgtgtaagagagatgatacatttaactttccgatttttaatgtattattacattaaatacatgtgtaatacacgtacaatgtattatacatgtgtgttccctaagcaagttgtcctgtaaagactaaccagttgtcaaaatctcactgagatttttaaggtttgtttatatatgtttagagtatcatgtcatttcttatattttacaattgataaaatgattcctagaatttctctaattgtgcaatcaaactttataaaaattgatatataatagatccataattatttgtcttacctaatcagttataattgatgagtttaaagtattttcaaatatatcaagaccttttctgtcttatagcttataacttatagctatagctataagctaacttataacttatagctatagctataagctaacttataacttatagctatagctataagctaacttataacttatagctatagctataagctaacttataacttatagctat

SEQ ID NO: 129333 - DNA, 3315 bp, Homo sapiens
ttcattgagcattaaagtcaatctacattgtgacttcaggaaagtacagaatggttttatacaatttaaccaagattggggatctctgttattccaagttcaatccaatgcaataaacatatatttcagttgtagaataggatttggtgacaactgatgctccatgacccctgtcaatatggcatgcacttttgagttatttttccagtagcggtttaaacatttccctgataaacccttgtgtgcatctgcagtcttcttcattcccagtggcattagttttcagatgggtagtttggaaggggtggaagttctcttctggagatggtttcacatgattttcgtaggttcatgttaatttttgctttaaggataaaagtgttcagtgctggtgacaaggcaataaagtgggtacttttgtgcagagcagtggtgatgtaaattagtgtagcttttcagaaaggagtgacactatcaaaatgtgttcaggccctttgatttagtacctttatttttagaaatttaccctaagaaaacggtatcataaagatttatatataggaatgatttttgcagtgacttatgacagtgacaattcagaggcactctatctaacatgggaaactgctaactaaatcattgtataattctggaaggggaatattgtgcaaccactaaaggctccgtttttaaagagaaaaatacatggattataaaatatgtattatatataaattcatatttattatgtattatacatatgtggttatatactattctctgtgttctggaggttagaaacctgaagtcaaggtgttggcagggccaccgtgctctctaaaggctggagaggagaacctgtccttacctctttgagcttcagtggctccagacattctgaagactatatttttattctcatgttgtaatattaaatgaaaagaactgattttaaagttttatgctatgtgatgccagttctcaaataaatgtatattcattcataaaaccaaacattaattgtatctaattggtggattacagatcattgctatttactttctgatgcctttcggtgtttaagttttcgaaaatgaccatgtgaacaaaaagaattaaatgtctttttgctttgagggtttccttgaatcgtgatattcacaaaaccgaggttggtcacatttagttttgctcacaagcctagcggtgagaatcaggtctgccttgttcctcagacatagtctttcttagtactattagtatttctcttactcattcccttatcttgattgtgttagtgatcttcagctgctctcctgttctgatgctcttctggagtccatccttacaccatactgctgggccctccaatgccccgaatccttcagtgctacttggtactccacaaagtcaagtgcgcacatggcgttcgggattgccctcacctacctgtatactgtgatccctttgctaagaggaagcctaggtcttcctcttctgttctcttgatctagtctgagctgcttttaagccaggattcaagtttttcagcctacatttttgcaagatccccctcacctgaatgtcccatcccatagagatgatttttcattagaatttcagtaaaagttactttctgttatgtccatttaactcctggttattatttttttcagctatttattttgtatgggtctatgccattttacagtattcccaatgttcaacacctaccccagcaccaggtaaatctcctctgcacacatccacacttacatatatacacgtatataattctttgtaaatatatatgaaatagccttattggtgaggttggtgattatgagtttgtacaggtaataagaagcagccactcgtttaatattgaggatcccttctgtgctctgcactggggaattagaaaaggtgtggatggatcggctggaaaattacttccatccctttgtcattaggaacctccatttgcgagcacaggtgagcctgcctggtccatcaaatagccactgctggaaaattacttccatccctttgtcattaggaacctccatttgcgagcacaggtgagcctgcctggtccatcagatagccactgtcagtgtgggactgcttgtcccaaggtgcatttgggttttcaccattagaatttggtttctgctgtggaattccatttgaccttttggacgagggcttccagaagccttggttaggtggaagagcatggactccctgtgttcccaaacaagcctgctctgtgtgacagccactttggaatgtttgtgttcagtttcatttggcaccttagtgtctgcctgggggtaggggaaagggaatgcaaatgttcctcttgaacagtgcttgctttggtcaaagaaaaaaacttaggaaggaatgaggagaatgaaccttaaaagctggtgcagaagtggctgcatagctcagtgggcttgaggccatctgggaccaggtatttaaaatggatgctatgttggtatgaacaagtcagttccatgcccctggtggggatgagcttatttgtcatatggggataactcctcacactcacatccctaaagtgtaccaggagaatattgtaaacaattttattgcactatattttctatgtttggcggtggaggtgggaggtccttgatattatctgaaacatgaagctgagtaaaggggatatgtctgtggtatcagaagaaagctgcttggcttgtcagtgttgctgatagcaggaaaaaggaaatactgaaatctttagcctgcagaattgtcagaaatctttttatctattcattaaataattatctcctaacttttattgagtatttactatgtgccaagctgatgaagggattatgatgattgtgctgctttgatggggaagtggctgaagccctgaaaagctatggagccagggtcttcatgtgcagattctagagatgccaagatctgagagaggcagttcctgtcttaaagttgctcacagtttaatggtgatgcccctgtatgaacaaacaggtataaccacgcccgaggttaaagtagaggtagttgagttgagcacagccaaacctgcaaggaagggatggagctgtgtcacagaaagctttaaagaagtttaaagagtcagttctttaaagatgacgtatgagctaaatctcagttaagattttgactgatgagaaaagggttcagacagtggggaaaagatgggctaggcaaggaaatcgctctgtgaatgaacacacagaggcttcaaaagacccttttggggaagagcaagcaagg

SEQ ID NO: 129334 - DNA, 1654 bp, Homo sapiens
tatcttttttgacttttttggggaaaaggaagagtaggatgagcctttggccagcagcccaaagacatctaatctgtgggttatattttcattttcttttttttttttctttgagacggagtcttgcgctgtcactcagcctggagtgcagtggcgccatctcactgcaacctccactgcctgggttcaagcaattctgctgcctcagcctcccaagtagctgggactacaggcacacgccaccacacctggctaatttttgtatttttagtagagacaggggtttcaccatattggtcaggttggtctcaaactcttgacctcaggtgatccacccgcctcggcctgccaaagtgctgggattacaggcatgagccaccatgcctggccatattttcattttattcaatttatactttaaaagtttgctgcctttttcagcccagctaagtgtcagctcaaagtagtccaggaacttaaaaagaaaacaacttgcatttgtatttctcttaggttttaactctactgcacctattatggtgacggtgcatattgtgtaaatgctaaagagaaaaaggaaatggcagtgataaatgccagtcacaccgagaagatggattcacattccaggttgtaatacagtattgttacacaaatttaaaatgcaaagggaatgcttagccagttccattctgtcagcctttagggttttgcaaaggtaggagacatctgagaatctccaaaatgaggtctggctcaccaacctctgcaaataagttataggacaactttacttttaattaacttttatttctcatgagttgatttttttgtgacgttcctcttgattttcccagattctcatgtcaccagggtagataggctggcagtggccaatgttgttctaagagaaatcctaaagactacccaatttttttttttcttgaatccgcaggatcctgttttgtgaaaattcctcttacgcccacctataggatagacagtggaggccccccctgggagaaagtgtacacagaaagtgctatctaattacagaagtagcagaatttcctttgtgctcagaggggaagtgctacaaaagtgtaattactttacccagcatgtgtgatttacgggacttaaaatgtgtgagtttccaaagagtcatctgtttttaaatacagtatccctcccagccaggcaggatgtgtttggggaggtgggagtgaggacatgtacttccgtcctgtgcctgctgcaggatgcctggtgacaggggactgaaaccactggtacttgctgcccctcagggtcttgcttatctgagtagaaggaagaaaatcagcaaagggctggaatctagtcagctactcccagaccagatcatccactgctctcctcttaccttcccaagccaaattctttttctaggacctccaagacttttcccagtaataagcaaaagaattgttagagtgaaccctgagaccgtttttaaaatttatttatctttctttctttctttttctttttcttttttttttttttacctgtttttatttgagatggagtcttgtggtgttgcccaggctggtcttaaaactcctgggttcaagcgatcctcccgcctcggcctcccaaagtgctggaatta

SEQ ID NO: 129335 - DNA, 2423 bp, Homo sapiens
acttgccaaacttgttcctgcctcagggcctttgtgcaagccattctgtatgcccggaaagccctacactcagacattatcagcctcatccttgccattcatttagatctcaattcagatgtcaccccagagagacctttgacctccaagtttaaagtagccctatattcccaacccttttattttccaaatagtacttcttacctcctgacgttgccttgtatgcttattgtacttatttggtacccttggaatgtaactccctggcagcagactgcctgccttgtttaacactgtacaaacctcagatgcctaggacaatgcccagaactgtccaataagtttttttgtgaattgactagaatgtaaatctgctttacagacgccaaagcctgtctgatacactgtatcatcataaacctttttcagcagttttcaggttaaactttatatttctgccttgaagatgatcatttctggtcctcatccccactttattgcatacaaaaccgcagttgtcatctcacacacttttaagctggaaatgttcagatggtaagtgataagagcccttgtcggggtatgcagcagtttttcacacataaacgaatccttcccttttgtccacttaggatgggaaacctactaattccacagaacgaggagagggatgtgggcctggagtgtagggaatgcctaagtaccagtagggcaaggtgaatttgattcctgttttgcagatgtgactgttaggttgttagggttaatttaataacccaggtggaattgatttggagatagacttaccacttctgatcctttgattggatctagcctccagctcaatataccttcctcaatttgcctacaagaagaaaaagatctgaagctcagcataatgctggctttagccagaagaatccagcctttaagccatctatatgtgtagccatgaaggaccttctaatatgccttgtgagcccttatggggccacctcacagccacaatttatgcccacgtgtcagcctcacagactcaggagctgtttctattcattgtaaagcagaccagatgacatttcaggatgaaagaaatgtaagtcatcattacatacggcatcaggctaacaagtcacctgttagttgagcagactagttagttggtgaaaatgcatcgatgaaaatgcagaccattggattatcctcatttatagcatttatgtcacacttcaccttcaacaaacttggttaacttaaccatcgtccattacctgatagtcttagaaccaatagtatataaatccttatagaagttatttcttgaccaatcaattcatgagtattctttgttttctctcttattatctcattatctctttgtttctaagggacctaggacaagccactgaagctgcttgtctttgacaagtcattttaacctgtttccttaactaaaaggtagggattgtatagacagcacctgtggtgcattaaaagaaccataaatctcatttttccactttcattccactttccatttccccattgtgatgcagaaagctgccgtggcgtgccaagacacatccagggtgggctgtttggggggaatggttttaattttaagccttttaagtgaaaacccttagaccttgcctctgttttgttaaattacgattctaacaaaataagaaaaaattagtgaagcactagactttggaaactctttcctgtatatttgaaatgattttcttaagactgcttttcttacctgaaattgttttgttttttcctaagcaaatgagtgcctctccttgagaactgggtgggagtctctgggtgtgagagaacagcaggaaatgaccctttctaaacaaaaggactctttaaggcctatcctgagtctttgtgttttgaggaggggttatgcagaaaaccagagctaggaaatgaatctctgcattagccattctaatgggggaagggagaatggagaacattctctccttgcacgccctcccaagtatctaatgccagggaacacttactgtgagatccaaagaagtgcagaaaagaccctgggagcctaggtggtggttcttcaggagtgcgtggcttcaagtcccctaaaggaaagaaaaaaccaggttgggcagaacgacacccaatgtgatgttcacctttaacctgggcttccagaatttgcttgaaaaagctcatgatcaacagaatgcagaaataaatacaaaatgaggaaagtatgagagggattttgcaagatctatttgtcatatatatctttttgtttttgttttttttctcaagacggagtcttgctctgtcacccaggctggagtgcagtagtgtgatctcagctcactataacttctgcctcctgggttcaagtgattctcctgactcagcct

SEQ ID NO: 129336 - DNA, 1628 bp, Homo sapiens
gagaaaatgaactttgaggaatgcaagtccttttaaatgatcaggtccagagggactttaaaatgagaccacagtcaggtcctactcccctcttgagctatatattcacctctctgtattcactgcttgctgttgctagaagtagctataaattaactaataatgctgcactggacactgtaactcactctatagtttaacaatgtatatagccaatcactaatcagtataatttgtgtaaaccaatgagaattcctggcaaacaactttatatcagcccactcccttgtccctgctcctttttttttttttttttgcctttaaaaagccacttgtaactgctttttaattggaatgcataagcccctgggttgcagtcttcaagcttggccaaaataagctctacttatattaattttgcctcaccttttatgttgctatcaacttcttttctcaatctaagctgaagagggaattaataatcattgctgtgcgaggtagtgggtctgtaatgaagaaatgttgagccttgccctgcagtggaatgttccctcctctcctcacttcaaagtgaccattcattgtatcagtatttgtgcaaggagatcccaaatttaaaatgctagaaaaggggataggtcttatcaaaattattttgcctttataaattcttgctgtcttggagcaatgaacttctctgctcttccagggacactcctgtttttttttttttcaaggaatataaatctcactaataattagaaacacacgtcttgttgaaaatggttttgtggtttacttcgtttttagaacatttgaaaacgacaaacatcttttctaagaaaaagcattgtttgttacaccaccactgtttgtaggcttttcattgtaactatatttttagaaaggctggctcatgtgtttgatggggactctgtgttgagggtaaggggctggtttatttactccacagcaccagatgctttacagaattaaagataagattaaagctgccactcagatcccattatgaaagggttttgtttatatattaaaggcttggaagactctttatcttagatatgaagccagcaatgcagtattcaaaagagatgtgatcattgtaagttccagagttgatagggaaaaattattctcactgaaaatcccagtgtctgaagtgttggtaggttttcttttttttttctttttttttttttttgagacagtatcgctgtgttgcccaggctggagtgcagtggtgtgatctcggctcactgcagcctccgcctcccaggttgaagtgattgtcctgcctcagcctcccaagtagctgggactgcaggcgcctgccaccgcacccagctaatttttgtatttttagtagagacggggtttcactatgttggtcaggctggtcttgaactcctgacctcaggtgatccgcctgcctcagcctcccaaagtgctaggattacacatgtgagtcactgcacccagccggttttcttcatttcttttttcttttgagatgaagtcttgctctattgcccaggctggaatgcagtggtgcgatctcagctcactgcaacctccgcctccggggttcgagctgttctcctgcttca

SEQ ID NO: 129337 - DNA, 1084 bp, Homo sapiens
cttggcctcaggtgatcctcccgcctcaacctcccaaagtgttaggattacaggcgtgagtcactgcatctggccaattggatacattcctgcagccaaattttaaattcttcctattgtgctatagtatggatgtgccttaatgtatttgacccaccccttattattgggcttattattgaacttatttccagcttaagtgatagaaacagtgctgtacatcctcctagctaaatctgtgtatacacccttagtgatttccttagcttcaactcttagaagtggaatttctgggtcaaagggcatgcattcttttaaagatatttgatgtttattgccaaatcttctctagaacactatttccactaagaaaatcagcaggcccattccttgcatcccctgcccctgccatttaaaaatgtccaaagattgttccctcactgtggagtttttcatatttgtgtcccatccgtgactcagaattaatattccagcctcatctgtataacacctggatgttatatagtgacttttttttaacctcatttgaagacatatcccagttgtgtttcttatacttcactggatacaaaaatgcttagcagataatttctgggggtgtcattcttgagtttatcggacaccgtgaagtgtgttgctttttgtgtgttaggtgcttgctatatttttctggctattaatgtctgacgatgaggccagtattttaggtgttgtgagtgcaagtacagaatttgagtcagctctaacatttgtcaggtaaagcaataacactgccaattaaaactttattgtaagatgcatcctgatttcatagatgttacagtgtggaaacatgtctcagaatcagtggatatgttattctctcatctacttttctggtcacatggttggtttgctcttgagatgagaacagagacacactggtcagtttgacataagttttggtggacagtgagccaagtatatccttggaaagaattttataattacagttgaatcaacaatgcttcaatgcctttttttttttctttttttttggaaatagggtctctgtctgtcaccc

SEQ ID NO: 129338 - DNA, 1366 bp, Homo sapiens
ggtgtatatcgccttgtgaaaatgattcttttcctccctcttcaaattgaggatgctgccttgaagctccagcatgttgcagccccttaagtatttctcaggatgaaggagagaccattcagggcaattgcatcttccctggaggggctgttttcactgtgatgcccgcaacataccaagagtggaatcctgtctgaggagtgcagctccggtctcaccatgtgggcagggcaatcaccattaaccccagcccacaggccttcttaattgttaacagacattctgagaagtgcatgccctccacaaagcctacacacatgtgttcgagtgtgactctaggaaatgagcagatgtaatggaaacctcagtattgactcatcccgattgttatatatgagtggaatttgcatctcatttagtgtttatttcagtagattccagttgaggtcatggagtgctaaatttatatgcatcatagcacctttctcaaaggaattgggagctcttttgcaaaacaaaagatgtcttcttttcccttagcccttggttttgtttggcagatggtgtaggtgaagagaacattagttgtggaagaggtatgtatgactcccttgggtacagtcattgatatttgttaaagacagcctgagagtctgttgtcttggcctttctgggggatgaagaagttgttactgagaagcagttttcctgccttcttggaaagacctcagtcaacacaggaaacaatgggagaataacatttgatcctacctaaatggacaacattgtgtaatatgggcggagagggcttagaaattcagaaagagatcagtgtggaccagaataaaaggctttgagaaagaaaggtggaccttgaggaactggtaatatttaaatagaaatgggtactggcttaggagagtttcaccatcataaaagtttggggcctggcatggtggcccatgtctgcaattccggcactttgggaggtggaggctgggaggccgaggtgggaggattgcttgagtctagaaattcgagaccagcctggggaacatgatgagacactgcctctataaaaagtaaaaaaaaaaaaaaaaaaaaagattagcaggcatggtggtgtgtgcctgtagtcccatctacttgggaggctgaggtgggaagattgcttgagcccaggaggtcgaggctgcagtgaactgtggtcttgtcattgcactccatcctggacaagagagtgaggccctatctcttttaaaaaaaaaaaaaaaaaaaagttttggaagtaagaatgaatgtagcacatttacaggagcagggaaaagctgtatctattactttttaatgaatgaattgtatgtat

SEQ ID NO: 129339 - DNA, 2997 bp, Homo sapiens
cactgtgagaattaatgagttaatatttgcagaggcctctggaaatgttaagtgcttggtgttcttatcttctctctgagcttggttgccttataaggctgtccactgaggctgagggacctttgtggggaacagggccagccctgagcccagatgactgtggcagtccatgactgttcccggaatgggctcaggtttcttattttaataggaatgacactacttttttttttttttgtaattattagtgtcagtctcgcacgtactttccccccaactttactacatctatttttagcacctcatctccatggttcttgccctctcaaaaccaattatagtaaaatccatttaaacagagatactccagtccaagttaagttcttacattttcttttcctggaaagataggctacttatcccaagaattatttgaagttggttcattcttttttaagtgctgtattgaggaggagagaaaaatagtagataaaacattccaatagtacttcattttttttaaaccaatgaattaaaatccacacatattcaatagagaggtctataaaagtttgttaacttctcatgaaacagacatttccaacaatagtatgtaaacatggacatttacatattcaaaagctactttccaagatttttccctcctacccaggttgtcagtataatgacatcgatttaggctatcataggccttttgagctggaaggtcacccaagaaccgtatttgtttaacaccctcacttaaaaagatggggccactgaagtccaaggtggtgtctggaacacattccagttttttaagcaggctggacttttctaattgacattgtttttgtttgtttgtttgttttgaggcagagccttgctctgttgcccaggctggagtgcagtggcaccatcttggctcactgcagcctctgccactcaggttcaagtgattctcctgcctcagcctcctgagtagctgggagtacaggcatgcaccactatgcccagctaatttttgtattttttaatagagataggtttttgccaggctggtctcaaactcctggcctcaagcaatcctcccaccttggcctcccaaagttctgggattacatgcatgagccaccatgcctggccagcattgttcgaattgatccctatttctctctctggaaggagagtgggcatctctttctggatcccttgaggtcaagtaaaataacccctatacttttcaaattttgtaagtagagagaatgatagctactctcagcctgctccaagaagagtgctatcacaggtgaatcctgtaagataaataccaatatttggtgcggtggggagcatcaagaaagtggcacaaggttagaatgttagaacattatttcttttttcttttttaagagtctcactctgttgcccaggctggagttcagtggcatgatctcggctcagtgcaacctccgcctccccaggttcaagcaattctcctgcctcagcctcctgagtagctgggactacaggcatgtgccaccacgcctggctaattttgtatttttagtagagactgggtttcatcatgttggccaggctggtgtcgatctcttgacctcatgatctgcctgcctcagcctctcaaagtgttgggattacaggcgtgagccgcatccagctaattttgtatttttagtagagacagggttttgccatgttgtccaggctggtcttgaactcctgacctcaggtgatccgcccacctcagcctcccaaagtgctgggattacaggtgtgagccaccgtgcccagccagagtgttatttcttaaatctttgttgaccttagaaatatttatttttgtcgtgccccctcctcccccaccccctcctctccttttgatgtcatcagaacaacaggcagtgggtcattgattgctgtctatgctggctcagtggctgtcgccatttttattaatgatacacttcttttcgccagggcagatagcttgtaagtaaacataaatcctatttagaaacaatgaacaaatatttttggtgagccttggacctcctgtatctgtggatgtttataggcaatctcttgtttataggaaatggtgcagagttgaggaactttggcctcagtagtggtgggaagtgggacaaagtaggccaggtctgttgctggttagctcacttgattagaacagtatgctaatgaacccaaggtcactgggccatctgtgtatgggtcagccagctctgctctgctgggatcccagaccttggccaggaggctgggcaatatgtatcactggtcatgaggccggagcagatagaaagatcagtactaatccgtcaccagacccagaaaacaaattcaaaacacatgccctatggatagtacactatctgtggctctttaatttatgagggtatcataacagatttttgtaattttcttaaacagatttttttttctgattaataataaactgcatgttattgaggatcctgggaaaataaagtatgaggaaggaaacaaaattcactatttttcccagcactgacagaggttacattttggatttttccatccttgatgttcccttcccttggcctccatgacaccacacttggttgactttcctcttcctccctgaccccacccctacattctccttttcccctttcctcctgaatttggcttgtaaatgatagtgttccttggcactccgtcctgcctcttcatttctcgtggtcctgcattcccatggatggtgtcctttgtcccagacttctgtcctgaaatccagattcaaagatccaagtgtctacaccacttctagctggatgctaatgtgtccagtaaatgatccccttatccccaccatctaacctgcacccctgtgttcctcctctctaggagtcacagccttcacctaggtgcccagcccttcccctcccctccctgactaatccatcaccagat

SEQ ID NO: 129340 - DNA, 1075 bp, Homo sapiens
tccgcctgcctcggcctcccaaagtgctgggattacaggtgtgagccactgcaccctgcctttttttctgtttttgagacagagtctccctcagtcgcctaggctggactacagtggtgcaatctcgactcactgcaagctctgcctcttgggttcaagtaagtctcctgtctcagcctcccaaatagctgggattacaggcatgcaccactatgcccagctaatttgtgtatttttagtagagacggggttttgccatgttggctaggtgggttttgaactcctgacctcaagtgatcctgcccgccttggccttccaaagtactgggattacaggtgtgaaccactgctcctggccttgttttgttttttgttgggggagtttgttcttctaagagacagatggaccttttttttatttttatttttttaagctagtttaagaatacagtaaaatcttctgattgtgtttgtgaacactggtaggtttgttacaatgttaaaatattttacttctgtagaaagaaaaccaaatatatcacgatgactggatatttaagcttttaccagaacatttggaattgtccaatgccctctgttttttcttagagccttcatggtgctgattcacagtgaaccttcactacttagtcccagataactgattatcagtggttgaaatcaacgtggagatgtctcagaaaacctgttttatagaaacttctagaaagttgcaaaccaaaaaaacatgaatgtcatcatgtcatctcatttttctgtttttgaaaaattatgaagttttcagtaattgtgactttttaaacatgtaaaagtatggaagtacatccagtaaacaatgccatgtacattccccctcaatttcccaaccccatccccatttgctgtccagaagtgtgaccacagttaacggtttaatgtgcatctttttatgtacttaacatgtctgtaaatatgtcttttatcttttttgctccctcttttaaattttaacttgacgttaaagtttagaacttccatgttagtatgtgcagctgtaacacattctttttttagt

SEQ ID NO: 129341 - DNA, 2018 bp, Homo sapiens
cagttactctggaggcttaggtgggaggatcacttgagcttgggaggttgaggctgcagtgggccgtgatcacaccactgcacttcattctgggtgatagagcaagaccctgcttcaaaaaaaaaaaaagaaagaaaataccaagtaaatggagatacagattgtatttctgtggatagatattgtaaagtctcttttctccaaattaaacattaaatgaaattctgataaaaattcccaagtactttaaacagaatttgacaagctaatctataagtcagctggacttataaacatacataaagccaagaaaatttggaaaagaactcggggggactttccacaccggatatcaaaacccattttgaaatattgtagttaaaagagacaaatcaccaaatgaaactgaagtccacagaggtaaagttactagtttaaggtcacagagctagatgggcatttttcatgcgggtcagttgaagtgtttctcagtggctggactgattgcatgtgattctaactttcagcaatgttgtagactttatcgggaggcttcttcatttcccaattagaaagatactatcttttgggaaaattacttatgcagggaatcaacctattagacatttgccgaacttgaataaaatgagaaaaggaaaatctgtcaagccttcgtgtttcatgttgtagtgttttccctgtaaatgcttcctctattgtagcagagtagttcagagttgaagggtcatcagggcagaagatgaagagagtccggggtctatctaggaacagtagttaggaatggtttagaaactttcagtcaattgacaggctagttagtattttagtgacattatcagttaaaagtttaaaatacttacctatttgaagtcatgaaaatggctaattttgatttattttcatcccatgctttaaatttatttgtgctgaattgtgaagatgatgagcttaaaagtacaggttagagatttagaatttgtatgtaattactcttgtgaaaatttgttttcttagggaggtgtgtgtgtgtgtgagagagagtgtgtgtgtgtgagtgtgcgcatgagctggtcagctgcagaaccttctggttagcaaacctgatagcatctagggtggagctaagggggaaacatgtttaatcacatactcaccagcttcctggcactaagaaattatcaccagacagcagccaccaggataatttaactttagttctggacaggcaaatgtgcagcaatcatttaaagtaaatttcttaaagaacatgtaggaattatgtcactactttgtggtgatgtttccataaatcctctatagtgtttttgttatgtttgtgtttcttattaaaaattccttaagtacaaacatcattttcaaatatcatatttagtattcctacatttgaaagccaaacatgacaaattattttttacaaattttctaggtacctactatgtgccaaggataatgtcatatcctcacatgttttatgggttaggtggaaagtattacacacaaggttaaaaaggctgttttactggccgggcatggtggctcatgcctgtaatcccagcactttgggaggctgaggcaggtggatcacaaggtcaagagatcgagaccatcctggccaacatggtgaaatcccgtctctactaaaaatacaaaaattagctgggtgtggtggcacgcacctatagtcctagctactcgggaggctgaggcaggggaattgcttgaacccgggaggcggaggttgcagtaagtcaagatcgcaacactgcactccagcctgggtgacatagcgagactctgtctcaaaaaagaaaaaagaaaaaaaaagctggttgctatgatagagataagaataaagtaataaccaggtaggtaattgagaaaaagttcttaaaagcagtagggggctgggatgggtaggataatctactgttgtttttctttttcttatttttttattttattttattttattttta

SEQ ID NO: 129342 - DNA, 2223 bp, Homo sapiens
catctttttcttgtgtagataaccacacccaagaaaatcataggaaaaatacataacaaatgcacttttaaaacaaaatatcccaagtttataattcatggtattggatggatgtattttactgacacaagagttgcattttcaataaatatttctttttatctacttcatgtgctggggaaatgggtgaaacagggaattctatgatcgcagcaagtccctttcttctacaggttcattttgtagccatcatgttcattgcagctatcccaagtggggttgagaaccaggacctggctccaggtctccgagcagttgaaatgtacctggcaaagtccatgccttaggcaggagagctgctcagcctcacttccagcctgtttactctgggttctgaatcgccgtgggctttgttatctggtttcccagcctcgcctaccagttctctgtctaccagtgttgtaccagggctctttttattctttcttcgactggagatccagactctcaaacatctgtaatacttgtccctatctctttgttcatgtgttccggcaccttgtggatatttgtaggtcaccagttctgcttttgcttgaagacctgtctggcagggcttggcacctctttcctctttgtgtatgcagggcctggttgcctagctacctcggaggggacagtgagggctgggctgcaaaggggaaggcctggcaaatcctgagttaggcctgtgcttgttctctagtatgggcggggcttccaggggctcaggggccatctattgtaggagtaacggccacttcccatccatttcttctttcgtctctcttttagttatttatttctgcttgtgtctcaggaccaaacaatctgcagggtgaattggtggggaggaagttgagggttgggggtggggaggggaggacctcccggaaatagtaaatcttagtttagtttttcagagataagtagtcacatgggtcccttgccaagagagaagatctctctcaggaagaaaggcaggatggtgcgggggtttaaactaggtttgtattacaaaaatctggatgggttttttgttttttttgttgttgttgttttgtttttttggagactgagtctcactctgccacccaggctggagtgccatggcacgatcttggctcactgcaacctctgcctcccgggttcaagccattctcttgcctcagccttctaagtagctgggacctcagacgtgcaccaccatgcccggctcatttttgtattttttgtagagacagaggttcaccatgttggccaggctggtctctaactcctgacctcaaggaatctgcccacctccgtcttccaaagtgctgggaacaggcatgagccaccatgctgggccttggatgggctttgatgtcttcatagtgcatgagttttgggtcagccagtgttaggtttgacatcctggtctcctaacctggctctgacacttattagctgtgctatcttgggcaagttactttctttgaagctagttcttcttgaataaattgggaataacaaaatccacaacatagagttgcatatggatggtagcgataattatagatcatgcctcaatagaatgtaaataggtgctcaacaggtggaaagttgctatcattgttataattatttgaaaggggatatcactgagacatgaaatgagggcaggttatagagcagtcggtcaataagcccagcttttgtgacattggaaatttaattataagttagttactaagggtgcatggttatactggattcataactaggttcatactctgctccgtttggctggctaggtgatctttaacctctctagatcttaatcttttcatctgtttgtaagaagagaatgaggataataatgcctacttcgtggagttgtgaggattaaaggagatatgatatgtaaaatgttacacagtgtctggtacagaatttgatctagaaagaaggcccttattattagacatagtaacctttaaagcacggtaaaagcggtgctcagtgatcagtgacaatttcttttttgtgctctagtcctttgaagcatggctgttgtatttccaagttttttgacactcttggattttattttcttgggtacacgcgcgcacacacacacaaattagcattagcccattattaaatattaactttttattccatgtatttatttatttattt

SEQ ID NO: 129343 - DNA, 1233 bp, Homo sapiens
cgtcccagatattgttctaaacatttttacagacattaacttcctaagttctcctaacaatcctaggaggaggtacagttctgagccccatttcatgggtaaaaaaacagcagagagggaaattaacttgcctgaggtcacacagctgtaatgtgatcaaggctggcctttgagaccaggcggctgctgactcttatcgatggtgttgttcttaaccaccactctatgctgcttcccaccgtgcccaaagagtgcctgcaggcttctctgtctctttcctgaaaagttacttacagtcccttgactgcactgctttaaagacgcagcacggagttcagcagtgaaatctggcagtgccggtgctgaaagatgtgaggattttgacagatgctggagatgctggctcaatgttcatgtcccaccaggggccaaattgcccatctgtaaataaggtttcttgtcttcagattccgtggtgattatttttttcctcagggaccagtcatccttttaatcttgtggtagaaaattaaaatgagtttcactgaagtgtggttggatttttaaagtttcttttaaatattactttagagaagttaattaagtacctgccctgtggatccagcttcctgcattttcctactgttttcactgtttagacgggaggcttttcttaggagaattagattacaaattgaagggtgaatgaataccttatcggcagatcatgaacatttggggtcctgaataggtagcaggcttgcgtaataggacctgaataaagttaggcaaacatgactatctctgatcttaaaggcattgaacaggctgaggttaaagtgtttgtcgtagtttctaaaagtcaagggagcgaggaagggagagtttactttctcactttgcttgcagtgattttcttttttttttttttttgcttactatgtcttggggtttctccaggtggtagaggttgctcggaggtctgactcccagctggcttgaaagcagtgattgttcatgttttgggggatcgttgatccctttgagagtctggtgaagcctgtgggcatcctccccagaaaacacacacagacatacacacaatgttttgttcatgggtctttaagggccacacacctaggctttagagtatatggcaattcaacatcagaacttgtttactgccccttccctttttcttttgttttttgagaaggggtctcgctttgtttc

SEQ ID NO: 129344 - DNA, 1944 bp, Homo sapiens
gcttgactagtccagccccttcttgctttacagatgaggaaactgaggtcccaaaatgtggagtgatgtcacattgtgctggggatgtggagaggggtgtttgtcatcacgtggatggccacgtggctggctggggggcctcagaggggaccttctattccctctttatacaggagcccctgtctgtcttaagcacatggcttgcttcttgaaagctttcctggactccccaggcagtatttcctttgtgcattttaaactaaattttgactaaattaaaagcaatgaaatccaggcctcctggaagggtatttagttttcctttttagcagaacagttaagctaatgacagtgttagaagcctcaaccaccccatccagtgattgatatacatgcccccaaatttttgtagtgaaatataaaaacagtctataatctgattttgtaatcaaggtctagccaattacagtacatctcaaaaagtccttagcaattgggttgttaagtcacccagcaaaatccctgtcattgacttccttggagccatttcctttcatgttttggcttcttggtgtctacatagtttctaagatagcagcccaataaattgtgctattatctccaggtttccacatcttacatatggtatacatttgctgttgtctccttttcaaaatgtagtccaatttgtgactgtttaatttttaaagtgaaagagggagaatgttttagaagaagttaaataatttaaaaattagatgcccaagccctagtaactttgatttgtggaaaaatacttttgattatagccatatagttacagaatctatacagaaacttggcaaatttgaaaatctgaaatctggcccggcgcaggggctcatgcctgtaatcacagccctttgggaagccgaggcgggcagattgcttgaacccaggagtttgagaccagcctgggcaatatggtgaaaccccatctctacaaaaatacagaaattagctaggcatgatggcgcccgcctgtagtcccagctactcgtgatcatgccactgcactccagcctgggttagagtgataccctgtcttaaatggatggatggatggatggatggatagataaataaattaaaaatctgaagtcttatatgtccccctgttgtcaatagagaagagaatcatactactttatacccatagtatctctggaggagtaacaagttgtacgtcttggttctattctgtaacatggaaccaaggtatttgcaagctgacagcgaagaagaggcttcattgtgcatattcctacactgtattttttggtacatttttcagagtttgtaaagaaaacatcttgtactgagtttttaataacttttcatccatttcccaatgtacagtacaagtatatcaaagaacaaaaatgcagtaatccagcattgtcaaaatcactgctatttaaatgctgtatgaagagagtagtgtttaagttcctagtagctatctcacttatttgttggctgtggtagagtaatcattgtggcaatcattttatacatgtttgagttacacatatagctttgagggacatctactaacaccatatttagtggtttctcctaaagactaaagttatagcctcatgttcatttacttagaaatggataaaagtactattaatttaaaaaatacctatgtcttatagttcatttattccaaaaagatatatcaaatgcctaccatgtagtaggcactatccaagttgctaaaatttaaagacgaataaaacaaggccttcttatttggtgaggttgatgaaaagtgaaagcagatgattaaaatgcagtagcataagtaattatttgtgagtgtatttttaatgtatgaagcggttttcagatgtattctttattagtctcaatcacttgcatttccttgaattgaat

SEQ ID NO: 129345 - DNA, 3090 bp, Homo sapiens
ttattcctgattatacaagtctgctatgtcaagtaagagtttaaaacattatttgggccaggcattgtggctcacacctataatcccagtactttgggaggccgaggtgggaggattgcttgagcccaagagttggagaccagtctgggcaacatagggagaccctgtctttacaaaaacattaaaaaaaaaatgttagccagacatgatggcatatatctgaggtcccagctacttgggaagctgaggtgggaggatcacttgagcccgagatcaaggctgcagtgagccatgatcacgccgctgcactccagcctggacaacagagtgagaccctgtctcaaaaaagaaccaaaaacaaattttattttgacatttcaaagactttttcttttgaaccaaccaatctcttacttattaacaaagtttgaagtgatccagtagttgtttaaataaactgactctcccggcagaaagtaactattttctatcccattgtctgatgagatgctctgagtctttggttagatggaagactgcagacaagttagccctgcatctcatttacataatattttttactcttaagcaagaaatcttcaccaggtcctcttgtgatctggtgctgacacagaaccatgaccatagaggtgcccatgacttctttctgtgtcccttgaggatgttggtgccaaaggctacttaaatcctccttggaaggaaacgatttcatcagtcaggaattattgttttaatttgtgtcatttacctgttttgccttcctatcgcaactacctccatgaaagtagttatattgaaaaaagatgcttatattaaaatcagataggctttattaataaagtgtagtgtgtaggcttctatgactaatacatagtttaaagtcagggtaatagctggtgtaatgaaaccaaataaagtttctggctcattcataactgtgcagtagtttcgatttattctttgttattgttgaccaccttgttcttgttagaacaaggcagggaataaataaataaataaaacgattccacattattttctgtttgcctaaattgcaacataaggaagcaacaaaagaaagatccttttcgcttaaacattctgttgatccaagaaaaatcacacagggtctggaagcaacttttatttggagaactagacttgagtacgttcaactgaaagccaatgcaagcttctgttcctctaaaatgatgtcttttgcctaagaatagacccctctttcagtctaaaaaccagataaactgtcctacagtgattcaaatagccagcggcctcactccccccaaacttgactaacaacacagcaatataattctaccgtttaaaacttggctgacccaaacgtgaactttcaaagaaaataagagtcattactaaaagagattccatttctttctggggcctaagttaagatgactttccagaactttgaaaaaacttactctttcaatggccacttaattgtgtaacaaagtaaacattcacaagggaggcaaaatataacattccctatgtttagatttttcaaatatctttaaggggtgcattttctttgttgggttgtcatatgtagtttggagtaatttaccaggttctacccaaaagttgtatcatgatcaaggatcgcttgaacccaggagtttgagaccagcttgggcaccatggcaaaaccctgtctctactaacattacaaaaaattaaccaggtgtggtggtgaatgcctgtggtcttagctactctgaaggctgaggtgcaaggatctcttgagccagtgaggcagaggttgcagtgagctgtattcatggccatagcacttcagcctgggtggcagagtgagatcttgtcttaaagacaaaaaaagaaaaagagggtgaattctacctacctggcaggatcattgggataattgcatgaacataggatctgattcaccacctggtacatagtaggaattcatgatattgtagctgttcttataattattaatttgacctggaacttccatgtcctgattcttagatcttgcatgattatacacgtgttatctaattgatgaatttcaaatatgatctatttcaacagttaaatggctgaacagtcattaatttcaggtggtcctaaacccaaatcagtaaattctttgaggtggataaacctacatttcatttgtagtttaaaaagaaaaagtgaaaaaagtatttaaagtcctgggtcatggaaggcggagcttgcagtgagccaagtttacaccactgcactccagcctgggtaacagagcgagactctgtctcaaaaaaaataaaaaataaaaaataaaataaaaataaagtcctgggtcgataagtgactttatccttctaaggtataaaatgaaggagctacactagatagtctctaagcaaccttcaaactctgaaattctgtggttgatattaggtccagtactggggatctgtgattttttaattgctacaacttctaggaaatgaggagtatcaaagattgttatgggagagtgggggtaggggagttactatcattggtcttttgtgaacaagaccaagaacaaaagaaataagaacaaaaaagaacagcaagccgggcacagtggctcacacctttaatcccagcactttgggaggctgaggcaggtggatcacttgaggtcagaagttcgagaccagcctggccaaagtggagaaaactcgtctccactcaaaatacaaaaattagctgggcatggtggcaggtgcctgtaaacccagctacccaggaggctgaggcaggacagtcacttgaaccgggatggcggccactgctgggagcggagatggcaccactgcactccagcctgggagacagagcgagactctgcctcgaaaaaaaaaaaaaaaggcaacaaaaagaagtcagtccagatttgcagaaataacaggagttattcccatataacacacacacacacacacacacacatttagttctcaagaatagttttctctggcagcaaggattttagggaattccgtttaatctgcatctaagggt

SEQ ID NO: 129346 - DNA, 1329 bp, Homo sapiens
cccagcacttcgggaggccgaggcaggtggatcacctgaggtcaggagtttaaaaccagcctggccaacatggcaaaaccctgtcgctactaaaaataaaaaaattagccgggcatgatattgcttgcctgtaatcccagctactttggaggctgaagcaggagaatcacttgaactcgggagatggaggttgcagtgagcccagatcacgccactgcactccagcctgggtgacagagcgagactccatctcaaaaaaaaaaaaaaaaaggtagccgagcgtggtgggcacatgcctgtaatcccagctactcaggagactgagacaggagaatcacttgaacctgggaggtggaggttgcaatggaccaagattgtgctactgcactccagcctgggtgacagagtgagactccgtctcaaaaaaagaaaaaaaaaaagttgttatttttacttaggaaatgatttatctattttgcaagttcatcttagagcacaattatagctatttattacttattattcattcctatcttcccctttcctctgataaataacctggtagtttttggtaaaataagctaatcagcagggttctctaaataatacagtctcatgcctgtaatcccaacactttgggaggccaggacatgaggatcacctatgtagccaggagtttgagaccagcccgagcaacagagtgagccaattgcttgtgttggccttttactttccatgttttaggttagtcattacttttatcaggtacagagtataaccaagtggatttttcccttctgtcctccctgtacaatgaaggagactgaccgtaagtggaaccaggaagtgttgacgtggtcattactgcaaggaaggaggaaaaatagcagccaaaaatgccatttacgtgaaacttgtgacttgattgaggaaacatttgctcaagcaaaagcttaactgactacctctaaactgaggaatgtaagaattaccatatttacttctgcactagaattaaattctttgtgtgatcactgtctttagctcttattctaacacactggggcataatgagagaggcatttgaatgcagatattatattattctaccttaataaatgtttttctttgtctttgcaataatgatattattagataggcttgatgtcccatgatttttgtcatcaagttcgcatcgtatctatatagagagataggaagatgcgatcttactttttttttatttattttttttgaaatagccttgctctgccagccccggctggagtgcagtggtgcaatctcagctcactgtagcctccacctccc

SEQ ID NO: 129347 - DNA, 1127 bp, Homo sapiens
acaaaataaaaaataggccgggcgcggtggctcatacctgtaatcccagcacttggggaggctgaggcgggcggatcacgaggtcaggagatcgagaccatcctggctaacatggtgaaaccccgtctctactaaaaataaaaaaattagctggacctggtggcacacgcctgtaatcccagctactcgggaggctgaggcaggagaatcgcttgaatccaggaggcggagattgcagtgagccgagactgtgccactgaactccagcgagactccgtctcaaaaaaagaaaaataaagttatttctgatatggtattaagagaatccacgaataaaaaatattgatggcagataaatcagaacattcctttacccctttttaattttttggagggtttatttttcagatcgaacgataaggaaacatatgttgatactacccagcgtctgtaacagaggaagttaggcagtatgagggaaaaaaaaaatcaatcacgggagagagcggaagagatctaccaccttatccatcttcttgactgtacagtctccagagcatttccattaatgggcaagaaacatcccagtgcattgtacacctgttatttgtaaactcttgtgacatgaataatgctttcctcacaatctgttctactgaactttacttttttctaatagttctgccaagtttgagatctgcaattttagctaccatgatgttccactgctttttctacctacacagtcccacacagactgtgctgaaaatcaagaagaaacaatgatacactgcaccagacccgctgtaagtttaaaaaccccaaaacagtgtttaggagcaagtgaaagaaaaaaattttaactctacctttgcagatcgcacacaaatctcacatttgtccaaccccaggtgctcaaagttatttcatcattacggttaatattaaaaatggacagttacggctactatcaaaactcaaaatagtccaggcagggtagctcactcctgtagttccagcactgtgaaaggctgaggcgggaagattgcttgaccagcctgggcatcatagcaagacactgtctctacaaaaaaattaaaagccaaacaaaaaaacaaactagctgg

SEQ ID NO: 129348 - DNA, 1520 bp, Homo sapiens
tctgccatcttcaacaggtagctgtcatcttatgatctaaggtgggtgctctacttcccacagtcatcttctaggcaacaagaaagcaggaaaaaagctcttattttatttttgattttgttgcataccaaaggaatgttctcttttcaaggcaccacctggaagttgcaggcatcacttctgtccacaccataggccagaatttactaatatggtttgagtatccaaaataatgctccagaatctgaagctttttgtctactgacatgatgcccaaagggaatgctcaatggaaagtgtaattgcaaatatcccccaatatggaaaaattcgaaaactgaacacttctgggcccaagcatttcagttaaagggtactcaacctgtacagtattaactagcaagggaatttaggaaatcatgtgcccaacagaaatttattactacataaaatagagaatatattagaggaagttagcggttagaatagtaaagtgtgtaatagtgcaatgttttgtgaattttggatactcatcattataaacatctgacaaaaagactgaactgcattatagagctgctgggttctataaatcaccagtcttgagcatccctgcaaagtatttccttccagcctgtcacccatgtagaaaaagatctcctaattcttaatttaggaaagactttgtaaggagacattattatattaagaagtgaaacatacgataaaaagaaaaatgaattccataacaaaggggagaaagtaaacgtctattcaactttcattgaaataaatattttcagaactttattgtgtctatacaaaattgtatctgcatctttttttttaacttagcaatgaatcttagactttatatcagtaatggagatctaactcattttaaaaatgatacgtagtaatttggggaattttaaaacagtgttaatacataactgtcacatatctcttttgtgattacatttttttgctagatgatggattatagatagctctctgatacaaacaggagatttctaaaagcctcttagtcctcttacctcagcaatctatagtccatcctttcagtgttcctaaatttcctctgtgagaatatatatgctgttaaaagttaaggggactctgacacggaaagcaaataaacaaaaattattagatggtttacaattgtagtgcccactgtttaattcagaatggaacacagaaaaataaattaggcttgttctaaatgtttgcctaattcttttagaatattagaatttaacttattagctgtatgttgggtaagcattgcaagagttaacttgtatttgacatttttcacatgcccttaacattaagcatgtgtgaggtcttcctgtgtgcatatttggatgtacagcctaactgaggtggaaaacaccaagatgtttgcagggcagatgcattccaagtatgtgttcttattgctcttcctgccattggcttcaagatgagctgtcctgcctgttttcagtactagt

SEQ ID NO: 129349 - DNA, 1549 bp, Homo sapiens
ttataggcacccgccaccatgcccagctaatttttgtatttttcatagatacaggctttcgccatgttggccaggcttgtctcaaactcctgacctcaggtcacctgcccacctcagcctcccaaagtgctgggattacaggcatgaaccaccgtgcccggcccacacctcctttttaaatggagacagaagcaagcactgtcacctgtacctcacacaaggagaaacttggcctcagggtgattcactggaggtgcattgctgctcctatgaggcttgaggccaggttttctgcttctctgatagcctcttaggcattttgcctttcacagagtacttttccattattttataaagacctccttcagggccagattctacagttttatagttagaatttggtttcaacagaaaatcttcaaaaattacaatttacttttagttacacttcaagtcaactaggatgtcctgtttagaagcagggctccaagcctttttaaagaacagtttatctttcttttaaacaaatgaaggtattaaacggctcacagatggaaggcaggttgccgcattaaaataagttagtgcatggtttccttttcccaaataactttcctcttaaagtgagggtatgggagaatggattaaaattatagattgctacatatagacactttaaaatcaacgagcatagtaactagttggcattttaatattcttttaaaagtaagttgcttaaaaaccctggaggtagactatttaatcatttgcatgctagtttctaagaattcataattaagcaattcagcatgagatggatttatagatggactatcttagatttggtgttctctagcaggcagacttagtttcagtctggtggaaacactggatggtttcagcccagtatctgtttgcttttactccctaaacccacaactggactttgaggaggaggtgggaaggatgtcatgggaggtcacttcaggtagagtcagttcctgtgatactgactggcagctcccaggtcatgagcaaatggcaaccttggtagtatgcctccactgctgtccaggccttcagttccacttcttgtcttggaattcatgacacttgaaagagaagaagtcatctcataaagtgctgcatagtatttccagagagctgcatggctgtgaaaacataattggagttctaaaagctggcacagtcttttataacaacaggtaaatgcagtgaccagtttatttgtggcttttggtttcccactgcctgaaagcaaaaaaaaaaaaaaaaaaaaaaagtgtgtttttgaaaattaaaggaaggactttcatttaaaaataaagaagcttcagaataaaattacttctcctttgccttttatggtactgactgatgaaaggcagatatatatctggtaaaaatcctacaatgtatattaaaatgagtaaaaaatatcaaaaaatatggtgactagccagtatcttaatatttttgaaaaaatagactccttgaaaagccctggaggtagaaaatgtaattactt

SEQ ID NO: 129350 - DNA, 1067 bp, Homo sapiens
ttgtcattagcccgaaaccatcatataatgattgtgtttcttttctatcatatttcagccacagtatcatttcaggtgtccctcagaaagacgtcacatccatagatggcaccttttagggaggaagcagcagtcaagggccattagtactagaacacaggccttttctgtcaagtgctttgtcctccatatcactctgccttcctttgcgagatgccttaacaaggctgcattcgtgtgtctgagagatcatcagtacaggttctaaggccaaacaggttgtaagaagaaggtgatgatcaagcatggcattttacatcatcagtccttagttaagaaaaatatgggcattcctgagggctgtcataagtggccagaaatcagggtctgtaaagtccaaggtacgggagaactggaagcaatgagtaactcatgtttgatgtacagagatgattgtacccagtgttaccatttacagagaaggcatccaaaccataataagcaaaatgctagactagatgtcactgggcagggctgggattggggggtgttggaggtagaatatcaccaggtggcagttagatactcattgctggcattttatccagacaccagaagaacatgatcattgtaagtatatttgttatctctcctacctccaccccctacaagaattcttaaaaatactgctagtgagtgcatagggaggatccgtatctcatttcttttgtgtggttcatgtaattctgtcatctttgacttctataatgatgcctaggtagggaagagtgccaaatggtccttagccctcaaattcctgccaattgctgagttgctgatagtattctctactgcaggggatataccaggacaattagctttagctcaaaaccatttatcagagaatgtgggagactgactcctggcacttgtttgtgtcatgtgagatatgctatttgtctaaaaactatccttttcacatttaatagttactgtttgctagtcagaacttccaaaatcttttccttggagatttccttctgaaaatgtcagtatctcctgacttt

SEQ ID NO: 129351 - DNA, 1466 bp, Homo sapiens
gaatgaggtcagaagagcaataattttgttgtgtgtgtgttttttaatgcatttcaaaaactagatgtgtgtctttctgtgtgtatgttatatatttatctgatatttgttgttttttagcgtttctagtttttgtcatctaagatgacactgcaaataaaatcgaaaatttctgatgagtggtatactctccagcaaagatgaagatatttgggcaaaaaaatgatgcttgtgctagccttaaaaggtcatcgaaggtctgtgagccagttgtctaagcgctgcttacactctgatggtgttgagggatgaggtgtaaggctaaggggtccatattcttattccctgggtccatagtacttttgacacagtttcagttagcaaaaaagtattgcatgtggtgtgtgacattaaccacactaaaaagatttttttttaaaatcatggttatattgtagtttaacatacatatacagtcttttaagatttctgatgagagtttgtattttattatatttagaatatttggaaattctttcactgggatcggaacaaattacctgtaattaacaatagcttagatgtggccttgcaagagtgattgagaacctttgggtcacgtgtggtgtatcatgaggtcaggagtttaagaccagcctggccaagatagtgaaaccccgtctctaccaaaatgtacaaaaattagctgggcatggtggcgtgcgcctgtagtcccagctacttgggaggctgaggcagagaattgcttgaaaccccggaggtggaggttgcagtgagccgagatcacgccactgtactccagcctggaagacagagcgagactccatctcacacacacaaagaaacaacagaactttcagaacctttggcacaacagaactgcatatctgggatgttggtcgtatctttatttggtcgtactaaaacacagactctctggcactgtgagaactgtttgcctgcacatatctttgcctgtgttctggccaatgctggcctgtcataccaggttccaaagatcactgacaggctgggtcatgtctgctctgaaacatccttcatatgcccccaggttctgacagttttgagagaatcctttctcagttttgagaacagttttggaaactgcccgagatgtttgaaattcacaaaatggaaaatattgagctggtttctgtaaaatatgctattttatttgtgctctttacagatatattacaaatctgtattctcattcacaggttaaactttgtaaattccaaggtcctgaaaggtggtggtcatggtggtagtagtataaataagcatttcagactggaaattcagtattaataatgaaatatttgtgtttaatttgtttagtgatatgcaatttgttcagtggtaatgttctgtttctttaatagcaattgaagcactgttttattatgggtaacttctcaaaa

SEQ ID NO: 129352 - DNA, 2866 bp, Homo sapiens
cagcagggttcagtcttgcaacttggtgtttcagctcatggttacaaagttaacaaataacttaatagattatttaaaaagagtaaaagaagttaaccagtgtgtaaaatttacaagctgggccctgatgccccgcttgtgcattaaaacaccctagctgtatgcgatttatgctgcatgggtatgtggaggccttaacttctcagtttctgaaacccaagtttatattacatggtctgtcagaagagggatggcactgccataggtatgggagtgatccctcagttcttatcttagtagagcagtcacaaagcaagaatacccctttgactgaaaccaggatgtttctgctcctggggcaaccttagtcactggttcccctttttggttagattattttttcagaagtaaagaaacactgacttttggtcagaattgaaatgtgaagcaagttacatgaatatatttttgccagatcaagcttgtccctgaggatcaaggacagggaggaaaatgagaaagaatatttctaaggacagtggacatgctgagtttgtattttcaaacgaaggaaatacatttgggcttggatttgttctcatttttaaagtagttgtttatgcttgtaatttaaatgccaaaatgtataaatacataaaatgaaggttatctataattctaccttcctctccactattaacatatagataatttggtatgtattcctttgataccttttttttttcccttgagcatgtactaacttataaaaaccctaagagaattaaagtgggaatatgggcagttcctgctgtttgctttttcccttaataattgtgaaccttgttctttgtcagtagatctggatatctacttactcagctttttaaatatacaggttaatgagtttgggcttttctttccccaaaaaacttcaagtatgaatttgcatttgttgaaattggacgtatgtatttgtaagtatgttttaattatcataaattaaaatgtggataattttcctggtaaccatatattgatcactattctggtctatatggtcctgaattttttttgcactttctctttttgggtctgtctccatttcagtctatctcttacatttttctccttgattcagattggtttttatcctacttccctttcctcccttctaaatttctttataatactaatctctcctgacaaacacatataggtgtttgtcagttgatgttgtgtaactctattgataaattgtgactgggaaatgccatcttattttgcttgccatgtcaccagctgaactgtttacaagcaaatatgtatatctccatggatacaggattatgtaaatccttggatttgcatatgtttctaagtcagtcgagatatttatagaacatacactctgtgcctaggactgtgttatacactacaaataacagccttcaaactctaaaatgcccatagaaaggtttcatctgtgaatccactgtgtgtttcaagaatggtttctccaaaacaatgattcaaacatacagcacatttaaaagctgctttgaggtcttcatttatatctataagaatatgggtagatagagagagagatgaatgtagccattaacaccatgggtttactcaagagtgtttcaaataagtaactatacagtcattcctgagtcattagaagatagttatccttcccagttccatgaatttaagaggaacctcaagagcccagctcagagcagctagatagatgaccttaaaacttttatgaaaaactagaacatgcagagaaaatgctcatagtctttggatactatgtgtttaccagatgtggctgctagttgaaaagtgtctgtgattattctctgttgtgtactgaagtcgagcatttttctattgctttttattttcatgcctagattaccaacaagattagatatgctctttattaaagagagggccatttcaaggcctgcttttggcctttctctccagggaagctcaagactgccacaaatggctttacttactgaatcggagtttattaaatgagaagacagtcaataaaatgtgtcttgcctttcctagtgggagctggcaatgccatttaagaacacgtggccagtttatccaaaatctaactgtagcctctgcaggaatgctggataatggctaagccaagaacactcttgctcttctgcccagcacaggatgatttttactagcatttattctttcagtcctgttggggtaaaaaggaagttgaaggtacatctacaaatctttttgagtctctttgggacaaagctgtcagcagtttcatctcttgaacttctatgaggcatgttgtgtacttgtctaagaaatatgtttccccatgtgttccataaagtaaacatctgcggatgctaaaggcatagtgccaggcacatctgtgtccatagacattgctggtaaactaagggctgctctggataatgctttgacctgctgcaaagttcagttggcgtagtaattcatttgttatttttggggaacagttttgttaatgagtatttcatcataaatttacatgctgcttatgcttgtatcttactcttggggtttttttagttactttgtgaatgagctaagctttctgttatcacaggcagccattacatattcagtttatttcactgacagtaagctccctgaaggcaaggatcatgtctatgaattcagtaggcttagcaaagccaaaactctgaagtgccctccctttagtggctcagatgaaaagtatgatggtaataagagtagagaaactaaaatgttttaaaatatttctgtgattctaggccgggcacggtgg

SEQ ID NO: 129353 - DNA, 2027 bp, Homo sapiens
tttttccccatgtatgacaattttctattgaaacactaagataagaatctcttcgctttccattatggaatatttacataagaaagaatttcctccataaactttataatataatattgatacaaatattgactttgtttctagtcccttaaagaaagggaggtaataaattgaggtaattctcaacctaataaaataaacttacagtatttaatgcatatttattttagaaagatggaaaatacaaataagctaataaacattaaaatcagttactataccattgaggctaaacgatagaaacatttgagtacacatactataagataaatttttttcctctaaatacttatatgttggctactttatagaacaaagtggaactatatatactttttccttgaacgtcatttttattggctgtgtaatatttcattgtatgatacagatgaaccttagtttatattaagtaaccttttgttcataatccccagatttcaagtaacctctgttggtaaattgacatttatgaagcccttttctctataacaatattataaataatagtttattttctaggttaactcctcaaattctaattcatatttatcacatggtaagatgcaccactagataaatggcaccatgacacttagaacgtaagttctgcttatcgtatcatttttgtggaaatctctgtaatccagttagaacctggcacagtgtcagagagaaaacaggcacttcccaaaatctgaataaatggaagatggtattctcgctctgcccaggttgtcctgaccagaacagccaagtggaatagatggtgttcactttctggactatgggaggagagttgcgggtgacagggagggcacactggattagcaggatttcctcactgtttgtatctttgacacttgtcagcaattctgcctcagcgaacttcataaagaccaccaggaacttgtttatctggtggcaaagttgggggtagtggaaatgaggatgcaaaagatacagaacacttgaacaacaaacttgatgtaattgatacttatagatcattccacccagccccagcagaatacacatttgttttaagtgcacacagaacatttaccatgttctgaaacataagacaaggaattgatgggcattaaaaaaagcatatacctttcatatataggcattccacttctaggtgtttatccaaaaagaaagaaagtatacatccatacaaagatttgtacatgaatgttcatagccattttatttgtaatagccaaaactagaataacctaaatgtcaacatgtgaatggataaactgtggtgtatccacactacagaatacttctcagtaataaaaaggaatagactgttgatacattcaacaacatagatgaatctcaaagtaaatttcacttcatgctaagggaaagaagccagatgaaaagggtacatactctgtggttccctctgtatatgtaagtgtttgagacatatatactaatataaagagatcagagcagtgattgcctggggatggagaatggtgggacagagtgggaggaaggattaaaggggcatgaataaacttttggtggtgatagattgtcttggttgtgatggtggtgatagattgtcttggttgtgatgtttcttaggttatacatatgtcaaaacatcacatatttcaagatgtgtagtttattatatatcaatcataacctcaataaagctgtttataaatatatcataaaataaggcattcagaattctggggctatttacatcattatagtgtttatcaaacatacttacatgcaaatggcatgacattttactgtgtactgtgctgggtcaataaaagggccttgcttggtgattcgcacttctgtgtaacaggaaacagtgaaaagtgttaggaatctagaaaaagccaggcgaggtggctcatgcctgtaatcccagcactgtgggaggccgagatgggaggatctcttgagctcaggagtttgagatc

SEQ ID NO: 129354 - DNA, 1045 bp, Homo sapiens
gaaacaaattgtttttatattatttttgaagcacattatataggcgatatatttagggcagaggagtggcagatttactgtgctcatgtcatttttttcttaagctaatatttaaattatatggaacctccccccatccttcacatttttagaagtgtgcaatggctagttgggaaaagttagcttgtaaatttaaatcaactagatgtaattcactctgaataattcacatagaaatattcaagtgttggcttaggggatgtaccttaagattacacagaaggctgcatctcccctaaaatttaaaaaggaaaaaaaagtgttggcttagtggcatcttaacagtgaagtattcgttgtatcatggaaagagcatgaatttagtatgagttgtggaatatttggaataatatgtttctgagatatcaggtgagagttaactctctggagtgtccacacccttgatcacttcctaaatttatttttccaggtccggaccctatttgtcagtggccttcctctggatatcaaacctcgggagctctatctgcttttcagaccatttaaggtacctttttttatctttcagaaattataaaatgagacaaaagtctgtatgctttctgggagctttttgaagcaagaaatgaaatatttgagaagaaaacagatgtttttaaaaggttaatgagtaaaggagatttaacaactgagttctaatgtacagtctcacttaggataattacatatttatatttcaaatgcagtaatgtaagtgaagatttatttctagtttcataccttattatttgaaatagtactgttgatactgttctttggaaatgtaaataggtttttatgaactgagttaagaacctaaccaccgttattttttccatggcaaaactttcaaacaaagtaaaacaaaattttaaaggatacctaggtgtaagttgatggtaatatttcctggtgtttattgaaatatttaatgcagttacctgtccttcctatggaaataagatcacttgatagatacttaatg

SEQ ID NO: 129355 - DNA, 1040 bp, Homo sapiens
gtgctcaagtttacacacataaaaattggcagagccaagattcaaaccaagcagtctgactctgccctctctgttctgaactattatgttatactgcttttctgtttgtgacttgagaacacagtatatccctaccagtggtgttttacttgagtgaaatatccagttgtcctttgccttcaagaccttcatggtgtttaaacctctagttttttcagaagagagcaccttgaagaaaggaagaggcagagctgtgaatcatgacctctctggccataagagctcaaggcctttgaggtgaaatgtttatagtagctaattggtaacatagttctctgctgggaagatgtaaggatgaatcaatctcaacatcctgcccagaaaccccgactagaaagtcagcaccctagtacattcctgacaaccctcttttaattaaagtccctggaggctgaccctagtctgcaaatctgtctctgcgctgatgtgtgtagtggtcaatcacgtcaagtggtgtgtttttcccctgtgtcgtccgttaatgcaagccaccagctattgattattttcagaaataaacacattttgttatccttatcttgaggagccgggaggggtgaagagagggagtgaaagagggagggagtgtttctgtcttccttgagcatgagctggaataaaaacctgaagggattatttttgcatgtccccatcagaagagcaacatgaaaactggttccttcagtaagttagcaaagtaactcaacaaaattcaacatcattgcctgcttaaccatttctggcagttttgaaaatgtggtcagggagttttaccaactatatttttttgagacggagtctggctgtgtctcccaggctggagtgtagtgacgccatcggctcactgcaagctctgcctcccgggttcataccattctcctgcctcagcctcccaagtagctgggactacaggcacccaccaccatgctcggctaatttttttgtatttttagtagagatggggtttcaccacttgtcga

SEQ ID NO: 129356 - DNA, 3569 bp, Homo sapiens
taagtactaatgatgtaattgtagggggtttccatatgaggtggtgggaagtaatggaatctctttggacgggaaatcaagtggaaagaatatgactgcacagtctaagagggagggattcatcaatttaattagcactctaaagagctttttccaagaattgtgatcagatatgcagattattaaatagcactctgctttttgattgctctgaatgaaatgctcaaaatatctgacatctgatgatgtgggtcttattttaatctagccccatcccatccaatggtggtgcgtagtgctgctttgttttttccagaggagatatttgaggcgttagcttgctcatcattatactctaaatgactatgctcagaatagattgaaatcctggctttttttatttcatgaggctttccttttagatatgcagcattaaaaaaaaaaaactggttatagcctttattctggttgattaaaaatttacatataaggctttcccaaaagacgtgtgttgtaatagaataaattacagtcatttgtaattgagtagatatatctgtatttggtttgtagttatgttgtttgccatgtgttttgagacttttaccagtattgttttggtgaatatttttcctccttagtatgttgaaaaactaaacaatttaagggaactaagttagagaaggtggaaggaagcagaatgtggtttcagatgctgaggatgaatcctcaggtgaggagtctcagcgaaggctggctccatcatgctctaggcagttggcctaagtggctgtgaacaagtgctgactgaagcactcagagtgtttagggtgcttcctacaaggcaagcggccacttgactggttgtaatacaggtaccattttggaggcgtctgggaacttgcgtctggcctttgtgttgctgtggtacctgcaggtacccctggcagctgctcctttgagtagaccatgcagagtgctgttggagagacctgatataggtgatgacttagaggtctaaggaaaagtctttatacttcatataatggtgtcattgatacacaaccttaaaaggtttttagactttggaacaaaaatgtgtacactctgagaagaaacaccttaattcttgttggtttttcatataaagcatataggaacatcttaggattccaggaattccagagtccagactttttctggatttggataaatgaccttcttgtcagaataactgcctactcactctgttcctctcctgtataacaaagtataaaccaattatttattgagcaccagtggtatacaccgaagcacggtgtataattgaatgttttgatataaaagttgttttatgatttttgcattgaatacgtaaaaaccagaattttctcagtataatgacactttaaacttaaaagtagaaccacaatttcaatttagcagtgttttattttaaccaggtgggaaccttctaaatgcagaaatattctgggtcctttaaagttatgttagatgaagttttcaccatgttcttttcattgttcttacaaaggaagtaacaagcagttgaagcttcacagacttggctctcattgctttactatacttctcctatgtgtataaagatgtcactgactcattttctgaacaataggcttttatagtgacctgtcatctgacaaggcaacattcccttaggtgtggtaggttgcatttttgttttttaaagataactgaagggttttgtttgtttgttaaagaataaagacatggtgttgctgtattgcccaggctggttggtctccagctcctggactcaagtgattctccctccttggccttccagagtgttgagattacaagcgtgagccaccacacccagcctgaagttttttgcttgtttgtttttgtttttgttttaatgtttaaatgataatagtcaaaaaaaactgtgtttcctcatcatactgagtacagcgaacataatttcaatttttcttggtgcccaaaggttatcattacaaatagcaggtaatgaacctagtgtaatataatgatagaggtgtttaaccctgtttgcccctgtgccagctggccgcagatcactgttgtctggtcttgaggtctggttttaggttattcttcttgcactaggctctccattctttttttttttcactggcagtacgcctttctttagcactgtcctctcctttaatcattaatagtttgctacttatgtgttaataacttgggaaggaccccaaataaaacaggtctaattctgtcctgttttgtgggcctgagggaaaattcgtatttacctatggaataatgagcctgggctttctgctgcccaaagctgacttacataagagtgtaggacatttactgagctcctggctgatctctttcttgacgttttgaacttttctatgtaaagtagtagaggtattagaaatctttccgatgttgtagttagggaaacagacgtggagaggatgggtgattaagtcagcatgtgtaagtttagagctccaactaggaggcaactaaaagtaaacttcttgcatctaagccttgtccattttatacaacatccttttgcttgctttgtacatgggatgttgctgcatttttccttgtggcagttacagagtatttaattcacaatgtccaggacaaattgccaccataaagtttggtatgtgaccatggagcagacccattcaaggtaatgtatttagtcatgaagctaataggtatattctttgtgatccaacatattaggctctttttagggtcatcttttctaattgatgagttaaaaacatatgatgcttgtagccattacagaattttctcctcccatgtcatctgtccagggttctcttaacattttcttacttacctttggagagagaattcaatattgtaatgttttgttttattccactattgagaaacatatgcctgaatccagtaaatttctctgtgtataatacttcagtgttatgaacgacttctccatgtttaatttctctttttgttgtttctgtcttgattgctatctggttcagttgttagtattagtgattagtcttttctcaaaatgactaatttttaaaatctattttctcatttttggactgggcttcagccattttgataattgtgtggaaaaacatgctcagattgaattaagttgtaacagtgaacttttatcagggaattaaaccttctaaagttaaatacagtacgttttgtttctatagcaaaaagtcccacgttaggcaaagaataacccaaacccagacttcttttcaggttatctttggtctcattaatccacatcattaaaaacccctcctttctttaacctgacagcaaaatatctgacctattctttgtctttaactcactttgtaatttctgtacctgttttgaatttccaagctaaaggaagggggcactgaaaatcttaagtatcaaattatttttaggacttgtttataattttggaaagtaaatcaaattcactaatataggcagttagctagatttag

SEQ ID NO: 129357 - DNA, 1035 bp, Homo sapiens
tccctgattttggatagttgttattaggctaggttttatcttagactgtattatgttacacgagaactagagaagtctgtacatcactacaaattgccttcccaaccaaaattgcttaggctagtgtagtaatttgctttactctcaaactatactcattaatctaagtgatctctaattatcagtgaacctccaagttcagtgttgtttttcttccagatagctcttgagatgtaatttgcatatgattcacccatttaaaattttcaattcaatggcttttggtatattacattattttttttaattacggtaaaatacatttaaaattttgctattttaatgacttttaaatgtactctttcttggcattaattacattcaccatgttatgcaatcattaccactatttccaaactttttcatcaacccaagcagaaactctgtagcccttaatgcagtaaatacctccccattctcccttttccccagcccctggtaatctctaatctgcttgctttctccgtgaatttgcctattctaaataatgaaatatttgtctttttgcttctggctcttctttcttagcataacatttttgagattcatccacgctgtggcatttaccagaatcaaattcctttttatagctaaataaaattgtattatatggatatgtacattttgtttatccattcatttgttggtggacacttagattgtttccatgttttggctattgcgaataaggctgcagtgaacactgatgtgtaagtatctgaatctgttaattcctttgggtatacctaggagtagaatttctgggtcatgtggtgatcatatgttagctttttgtttactttggtttgtaattttttccatagtggttgcaccattttgcattaaaaacttgttcctgtttgtaaaattataaccattctagtagatacgaagcaatcgtggattcttgctaaatgctgtttgactgattttaatagtagatttgatttctgtaggaatttcacatgacttaaa

SEQ ID NO: 129358 - DNA, 1319 bp, Homo sapiens
tttaatttgtaagaaaatatgctgagaaaagacttaatagtgtcagatgttgaaaaaacagctgatatgatcaggaaaacttagccctattttcatttccataaattcctggcattcaaataaacactacagttatttataaatatcacagtgattacagccttgtacataatttgttatactaaatagtttgagctttccaactaccaaggttctttacaattagatataattaattcattagttctataccaagtttctcatttgtgagatggaggtattatttacttcgaaatggtaaagggaaaacaagcaaaagcatttgcaaatgctctgtaagtaaacctatatcatgaatgtattttcttggccagaagtactggtacagaccgttaagtatggagggataccagggcagtcaagacctgcactgggtacatagaaacattttggcttggttagacagtctctgtttcctgtaccacaggttttcctgacagcctgtgcaagttaggacttttgatcttaatatttgtacagcttgtgagttaggtgaattatttccaccaaacaaaacattttacgaatataagcatccagatggcctatctcaactcccatggcccccaccagacactatatcaatatgtttcttatcagttttgaaattttctccttaagtttcatttagcatattgctgaaagtgggttaaagaggcccaattagtgagatcccagctgggacttttagatgggaaatatgcaggattgccagatgagatcatgggcctgatctagtgtttatctgttaaatctgtttataactgcttaactcttgacttgcagacttttaaggcagccatttgacgtcacagggttgggaacgaggcttgtgccagtataaagccgctgtgatgtggggccattgggcccttctgtttttctcaactatgtgcatgcactttggagcttgacaaacagccgtgtccagtgaactccccccaaagaaaattgaagttgactcaccgtgaaaggcataccaccaaaagtgactcctaacccatgtacaattcagaaagaaagcactagttaacaagtgcccagtgtgtgattatttagttctagaatctgtccagattttctttgttctggctctgttctcttcatggtggccctgcagtttttagatgttataaaacctccctacgattataatagcatgtaagttaaaagttgttgtgaaaaaacaaatgaagatgcatttataagtagtcttcagtctttgcctgaagaagagtaagttggttatttgaatttat

SEQ ID NO: 129359 - DNA, 2265 bp, Homo sapiens
cctcccgaatagctgggactacaggcacccgccaccacgcccggctaatttttttgtattttttagtagagacaggatttcactgtgttagtcaggatggtctcgatctcctgattttgtgatcctcccgcctcggccttccaaagtgctgggattacaggcgagagccaccacgcccagcctctgtatactggtttttaaaataattttggtggaacctcaaattccagtggattcagagtatttctaaacattgacttatagttaatggtaaaattattcatccttcctttcttggagctcatcagggaaacacagttgcaatgttatccttaatattctcaagcctataaaatattgtaacctgaacaaacacatcctcatctcccttttattttatcttaattgtgcacatctttctccatttcaaattctaattgaatctctgtttcgaagacccaacatccattgattataatgtttctttagcagccagtgagattcctgacttagaggggttttgtttgttattgttgtcttttttttttgagacggagtctcgctctgtcacccaggctggagtgcaatggtgcaatcttggctcactgcaacctctgcctccggggttcaagtgattctcctgcctcagcctcctgagtagctgggattacaggcgcgtgcctccacgcccggctaattttttgtatatttggtagagacagggtttcaccataccatgttggtcaggctggtcttgaactcctggacctcgtgatgcgcccacctcggcctcccaactgacttagagtttatagataagcctttttgcagaaggggagaaattcagcctcagtttggttagatcactagtaatctaattgcaaggattcattagagtagaggaagagcactgatttcagttgtgtagtggcgagataggttttgcctcactttgttttggctccctgtgcagcacaggaagtactttgcagtgaacttcctaagtttggacttgactgtttacattcttttcaactaacttgtgccttaagccccaagttcttggttggaaggaggttgcaagccatttgatggtgtgtgttagaggtgttttaaaaaatagggttaaggagcaaatttacccactttgcttatttctgtacttttatgaaattcatcagtgacatctccccccaaccctattgattaatttagtatatggtattagtaaatgatgttgaggaccagtaaataatgtattggtataaatggctcatttttatccttagtgaaataaaggatataaaaccattgacttataaaattatttgtattttttaaatgtactacagctttttctttctaaaaatttgttgtcaagttgtacagtttgaaaattagtagctagatcaagatagtgattatctttgggggagggggaagaaaacaagaaaatgcacgttttctacttgctcttggtatttcatttcattaacattacctaaacttggttgggcacacacagggtgggaggtttcactggatcctgttgggggctggggggctgattgctaaaatactggagagcagaaacaggattgtgaaaatatacttggaggcctattgcggtctatgtctgatctttaaatagaaatcttctcaaaatggttttggaaagtttaggcaactgttttttttcaattgtagagtttgtttatgtcagtactgttttctctcctcctcctacctctttttttcttctgcaccagccactaataaaagctcaaagtaaactttgcagaacgatccttaaaacatatacagaaagttaagataggtcctcaaatgacctaacaagcacttaaggtgaagctaaaagaagagctcgttaaatgcattctcttagcctgcctacctcacaagtaggacttattcttcatgtgcttttccatgtagacacagacacccccacccctcccccaatggagtttcgctcttgtcgcccaggctggagtgcaatggcacaatctcggctcactgcaatctccggcctccacgattcaggcaattcttctgcctcagcctcctgagtagctgggattacaggcgtgcagcaccacgtctggctaatttttgtatttttattagagatagggtttcaccatggttgtcaggctggtctcgaactcctgacctcaggtgatccacctgccccggcctcccaaagtgctgacattacaggtgtgagccactgcgcccagccga

SEQ ID NO: 129360 - DNA, 1374 bp, Homo sapiens
cctttaagctttcattttgagtgccttcatttagcaggtagcaggagaaaaagacattgatgcaaaggggaaagaatgtatgccaatgggtttattcattatccttacagtgagacaggagaggaaaaggcagtaaggactctgcaatgaaagggactactggcagcaccagccacgtttggtgtttgtgcattaaggattctaagggatgtttttatgcctaccagagcagttgacctgctgctttaccttctgttcaccttcagagttctcggtgtaaaaatgtgagcatcaggattcctgagtaagagagtaccatctgcactctggcctatgtttctttccatgtaatattatctatttcaaagtgtcactgtaaaatatttctttaatgggtaactgactgtgtttgggttagaaacagccctttcctatcattgtcagggcccaggtctttcaatcatccttttcagaatggtttgagaacatagtggcaaaagttcaaacaatcacgccctctcgaccctttggaaaataaactctgcttgtctctgattctcttgacatgttaaagattgcgtttatcgcttcttcaaaggccctgtcatgactttatagtcatcctatacaaagcagattctcctagggcatggttatatacataggggtggttggctaacacaaaaagtaagtgtgtgttgtagaaaagaaattaattgggctggggtggatggtcaagtcagatggagattccagataccttcgaagtatatctgcctggttcctcctacaaagggaatccagtctctgcaattaccagccaggcctctaagatctactcagactgtgtgaaccaacagacatggggcaggagaagcaggacacacgtcagctccctgtgggggaaacacaggaaataaaggaaactacacagcatcagactggacagcagctcaggtgtcctgctgctttctcccaattggggcagtctcagagcagagtatgaatctcatctttctctttctaagtaatagaagaacctctccaaaaaagccaaaggagaagaatccccattggttcatatttggaagaggagctccatagctgataagcactgggccatagggattagtgtttatcagatgtcaggcattaatccggccatttacaagatctcatttaatctttacaatgaatgctatgaaatatggactatattcatccccagtttacagcagaggactgagacacagaaaggttaaacagtatatccaaggtcaatactggagtagtatttgaatctaggaagtcagactcttaaatccacactcccgattctcacagtgtaagcctcttgttcctggggaggttcca

SEQ ID NO: 129361 - DNA, 1066 bp, Homo sapiens
caaggggttaaaaatcaaaactgacttcaagatatgtggtaacctaacacttcctggaagactgttcaattaggcaatcaagcgagaaactgtgcccagactcatggcccagcatcacctctaatggctccatgggcacgtataccacaggaagccttgggaaaggggtctctttctccaagtgcagtatagctgttttaccaatggacaggcaaacatgttttcaaatgactgatttaggcaagggaaaaaaggagtattaaatcagattattctaaggtaaagccagggcaagcactgggaggtagttggattaagaaaaagaatgaggcataattggtgtgatacagtttctcattgggcagtaacccagcagcacaggctgttgtattaacagtcctgatgtctttgcaagcaatgcccttatttaggaaaagtatgaaatacggtttacatctgacggattctttccctcacttgttcattctctgttggaatccatatctacctaagtttcatcacaatgcaaactgaacaacagcctcagttattatctggaaacaatgtagtctttataaaagaaaaatcttcacggaactgtaatgtcctcacacacacacgctctattgggaatttaaaaattggattgtgatatggattctaccagtagttagctgggaatttaggcacattatttttctggatcttttttcatctgtgttgggaagcctattggcattttggatgagaattcttaacattgtgtgggactatcctgctccttttaggactttatcttcctgcctcctgcctaatgaatgcctgtgtggtattcagtcatataacagccttcagatacccttgcgcatttctttttttttttttgagacggagtcttgctctgtctcccaggctggagtgcagtggcatgatctcagctcactgtaatctccaccacctgatttcacgccattctcctgcctcagcctcccaagtatctgggactacaggcgtccgccaccacgcccggctaattttttgtatttttagtagagcgggggtttca

SEQ ID NO: 129362 - DNA, 1038 bp, Homo sapiens
gagtgtcacaagttttcacttgtaacacagtgatatattaataaatggtagaaaacttctactggttcatttttaactcacctgcacactgttgtctctcagtgagtcctgtgctctccactgtaatagattacccagatgcgggtttatctgtggcctgtcatggagtcatttcaggctccaactgagcgtaacaattgttttcacagactcctggggaaactttcgactataccttgcctagtttctgtttctgatataaccgattatgatgcctgtggcagagaaagctgacaatactcaaaaaactaaatatattttaaccttggaccaatatttgagagctcagaatctctctaaagtatgtatttacttcctagtttctgatggaaatgacatggctatcaattttaagaaacagtttatattcctaacttatgtttttaacttctaaaaaggcaaaaaaaattctttctgcttcatttccttttctcctgttgaaagatttgtggtccccaggatatttccttttcttgtgaccaaaacgctctttgaaaatagtagaaggcttttattgtggctcatgcctgtaatcccaacactttgggaggctgaggcaggcagatcacttgaggtcaggagttcaagaccagcctgacaaacatggtgaaatcccgtctctactagaaatataaaaaatcagctgggcatggtaatgcacacctataatcccagctactcgggaggctgaggcatgagaattgcttgaaccccaaaggcagagaggttgtagtgacccaaaatcatgccactgcactccagcccgggtgacagagtgagactctgtctcaaaaatgataaaccggtagaagacttttattcttagctctctctagaaaatggttttttttgttgttgttttgttttgtttgtttgtttgagatggagtcttgctctgtcgcccaggctggagtgcagtggcaccatctcggctcactgcaagctccacctcccgggttcacacagttctcctgcctc

SEQ ID NO: 129363 - DNA, 6689 bp, Homo sapiens
cggtgactcagctttggtcaacaccattttctgtgtctctatataggctcaaggttgaaatccttataagagaaaacaggttttgtcactttaggctgcagctgccccttaaataggcagctgtggtcagaggaataagggcacagaacacagacattggcccctgagtacccttcccaaagaagaaggcttagagggcagtagccatctcatcccagcttctcttcccagggctgctctaatggtttcatatctgatctgttctagtcccttcattgagtctgtcttccctaccacccctagagttaccgccaatcactgtgattctcaaatgtggtccctacacaaacagcatcagcattaccctgaacttgttaaaaatgcaaattttcagattccatctcagagctactgaaccagaaactctagcaaatcctccaagttgatgctgctaacatttgagggtcacagacctactacataaagctgatcatattatcccccccatttttaaaacctaatggcttagctgagcacacactccaaagtcctcagtcatggcataagaggtcctttgtgatctctccccagtctgcttgttcagccaccccacccctgacccctcccaccccaacaccctttctgcatcctgttacagagaaatttgctgagccctttcctgaactgcacctggtgaacttctactcttcatcacttcctctggtgccttccctggctccctggcatgaaactgccctggtatacttttaagtatactggacgaacaagaatatgttgtttctcagcagtgtccttttaaagatctcccagaatttgccctgagtagggaattcagcctctgtagattatatggaacctgcatttgtagagactgttggctgtccagtagccagtcagattggggtgcttgtaagtaactgtttatattcaaattaatatactaatattcagaaactgtcctttctggtccatgtaataaataggacaccatttacatttggaagagaaaggttctctgttcattgtgagaagaacggtgaattatgagcaagagaggaaaaggttgcttttgaaagacacaggttcaccctttcacttggcagtaatcttatcctgacagcatttaatgtggagtaattgtagccagagaagaatcttagtaggctttaattaaaaacacaaggaatttttttctcttgtcttcttcctatctgcctctttttcttttttccctcttcgtttctgtgttctcccttttcctgcccctcttttttctcctcttcatcatcccttaacatttaaaatgtttttggcttggctaatccctatggatggaaacttagctgcgcaggatattgattaccaaatatggtattgctgctaaagatgttagaggaatgtggcttgtattctaagcctccggcctctgaataagctgccaaacaaattaggtcattttaacttctgagctttttttttttttttttaaataaggatgctggaactttgatttggaacatgatgttgatgttattttagttcaaattggggggcgggtatgaagaagggggcagggagtaggggagacttagttcagcatgttttaggactcaagccgccagcccaggttgtgtaagaggcaaacacatgatgtggagcttcagttgattctggaacaccagtgaaagagctgaggcatagaattcacatgtgcagcctcattttctgaggctagatgctctagaccacaactaggtcccaggatactcttcacatcatccccagtggcctgggccacaggactcaggttaatgtgaactcaggtttaggaaagttgcttcttcacaggaaggttggtcaagtttagtgccggggaggacgtcctgaagttgatggcaagttgctactatgtgtgtctgatggagtgtggtgcaaatgaggaagtccttttacagcatacctgtacgtaacacccagggactgtgcttgcctcccagcagagaccacagttcttaggtccattcttggaaatattaattctgttgtaatattagctttgttagggtggaagttggtccacctcagtgaggtcctttgtgacctcaccccagcctgcttcagaatgcagctttgctttttgtttttgtttttccttatatactttttcttcaaaataatactgaggtttcccaaatttaaaaaacaaaaatacaacacaatatcagttaaagaaaatgttcttatgtttcacagaacaggcactatctgttcgctttttggtgttgattaggtatgcacaagggtattctccacatcccttttgctactgccctcagttggtttcttctcagaatgagtgagtcatgctcatgaagttccacccactccaagacttctgggtcagggctctgtggcttttgttaggcctccctaaggacctctctttccttccccttccccccttgtttcctgttaatgccattaccatccagccacaggctcttccttgtatacttgaagctgagcctgtgaagttcagagttgttcatcctggtctctagagtaagagagtcttgtttttgtggatatttctttttttgagacagagtctagctctgtcacccaggctggagtgcaatggcgcgatcttggctcactgtaccctctgcctcatgggctcaagcaattctgtctcagcattccaagtaactaactgggattacaggtgcatgccgccacgcccagctaatttttttttttttgtattttagtagagatggggtttcaccatgttgcccaggctggtgttgaactcccgagctcaggcaatccactcgcctcggcctcccaaagtgctaggatgacaggcatgagccacaacgccctgcctgctcttattttttttcaagctcattaggaagaatggtggcgagggggcgggggatgctttggagccctcaggcccatgtgtgtacattcagaacactaaatggcaactgtgttcttaggagactcgttttcaggactccagtccctttccagaccacaccatgaaaacatgggaactgagtgggtcccatgggtgcacatttaaaatacactctcttgggatatctttttgacacgtagggtccagaattcatggtattggatgcttaataatgaagacattcttgaatggtggaaaggttccaaatagacttgtcttgcgctagtgtctttcatagtgtctgtgatttgttttactgaatataatctattttaggtaaactgcaggaatagggtcagaggtaactgaaattactatatattaaagtgtgtaactgtgctaggaatttgctggttcaaattttaaactgaaaagtttttgtctaaaaagaaaaggaatagttgaaaatctgtgtaactacattttttaactaaactaaatcccactgactttcgggacactttgtgttgtcatttttcatgtaacctgtgtaagtagtaagaatgagagtggttgctgaccttttttcctgatagaccagggtttactggtgtgtttattttgtcaccattccggtttgactcaaaggaaatgaaaacatcttccatttgttctctgtttccaaagggcatccgcttcgatcctgaaattccgcaaacactacgactagagtttgctaaggcaaacacgaagatggccaagaacaaactcgtagggactccaaaccccagtactcctctgcccaacactgtacctcagttcattgccagagagccatgtaagtcgatctacttttcattcaaaagtaataataactaagaactgttcatgtgctgcatgtgaggttacaccatgggacatggagctggctgagtcttattttccatttctgtgaagaggttgcctaggcgttcttggtgtcagaattccaaatacagcaatcttgtttgtgattggcttcccaaaagatggttcagcttgaatagaaccataacttcagaatatcatttgatgtactacagatttccttaatgttatattgaccatcatgagtatgcccctagttgccttgggtataaacccttcattcccccctgctcggacacgagagctggttctcagcatttactttaatccatttgttgaaggacatcagctcggtggctttggaaaaataggatattaaaagagaaagaagcagatcttgggaatttggttctattcagtttagccataactctagggggaaaagtaaacacatacaaagaatgtatatattggaactgtcagtctagcaaactaataccagtaaaactttaaggaaatttggggctttcttttccaacttaattggataaggacactggctaattgctcaagacgtcttctaccccacattaataagcttatttcattatatgtccagactaccatttctgcctttccctgaataactttaaaagattgaatttgctttctcaagctcagtcagtggcagaagtggggcatgagacaggccttaacttctcctttcattgcagagccatatgtgatttaatatggcagggcattcaaggaaacccaagtgacttggattccaagttatttggaatatttctgtcctgttgtttttggtctgctttctaaaccacacggttgtgatcttcttccttcgatagtacattttaactcttcttattgaaattgaaggacacatggattccttgctccccccatgtcatgtgcatgtcagatttaatcaggttatctttggaagtcacagccattctgtagttcagtcactcttggtactcatcagtagaaactaacagataagtctccctgaatgttctaaaataaatgtttctatgaatccagaaagtcataatagattaaaaaaaattattttgttctttcaccttctttgtcccagggaaactagaaacctttgcttatttgggaaggaaatctaaacaaaagttacatcttacagtgtacttgtagtacaggaggatataggaacatcttttacataattcttcatccttatagtatctagcttaatactttgtatattgtatatatttaatatttattatagtgagtggataaattgatactgaaattgggctacttgtagaactgtagatgcatttgtatgcctcttctctctgaaatttcttctctcttgatcaaggcatcaaaaaagagtatttttaggatgcctgatttagtaaaaataacctaaagtaattctttgcctttttagtgaatttgccagcctcagatctcagagttctttgaaaagattaattcaggcaggaaatgtaatgctggtgatacttaactttaccttttcaattctttgctgaatgctctttttaacaggaccacgaaactttttctgaatttcctacaacagccctgtgaaataggtagccaggaaggttgtagccagattacgacatgctatacaaaagcaacaaataggaacaaactggacattcacaagtccctgaagttacaggagagcatagaaactgagcttagaactcttttctggcaagctctgctcacctcccttcccagcatacagaacagtgcaaaaatggccagatagtttccatgacagggtaaaaacttgcccagctgttcacagcaacacaaatttgaagtttaaaaaaaaaaaaaaaaaaaaaatccaagcagccagcagtgtattcttgaggaaaataaaagtcagcatgatttatcttaatatagctcatttttacgacacagcatcttgaggagagcaagtccactatggctcaggtcaaccttattatccattgccattccctctgggaactgggaacttgaccgtcacatacaacttgcttacctggaagcatacggcaagactaagaacactgtgttgggtctacacggacaaacccacttgcattgtactcagaattggtactcaaggtggtcagtttaactacttatcaggtgtagaatataatggaattggagaatttgaggattggaaaggccctgaaggctagtctttgttgtaggccatagaggttttttataaatgtttcttttggttactgtttttatatggtagtggctgaaaagcactcgttgccatcactaaaggaagaatgttctgtggtttgattatacaacacacatacacttgaactctcaattctccataaatatatgaacttaatgaacttaaacgagcacccaatgtgctagaccctggagaagaaggaaattggttgctgccttaaaagagctgtcgttccggggaggtgatggtggtcaaagttgtcagaaaaacttggccccatatgaaggacatataagagattctgcagcttagttgagattgaccccgaatcagactgccgtatttgctgagcacctgctctatttgtgccagggatggagagtgagaaaaccaggtgttgcaacttagctgggtagatggtggcctgctgtggagaactttggcttcaggctagaagatgtcactgagaatcctgtcgataattctgccaattattgacaagctttgtgacctttaagagaaaaaaatttttttcacttggttgtgctcctattctctcagctgtaaaataggaataatactttctgattgttaggagaggtaaataaaaca

SEQ ID NO: 129364 - DNA, 1821 bp, Homo sapiens
tttacaattgaattggtcagtccatatattgcattagttatgtcttttaagtgccttttaatctagagcactttctctcaccctacgtgggaggatctctctcttttttttttttttttttttttttttttttttttttttttttggagacggagtctcactgtgttgcccaggctggagtgcagtggtgcgatctcggctcactgcaagctccgccttccaggttcatgccattctcctgcctcagcctcctgagtaactgggactataggcgcccaccactgcgcccggctaatatttttatttttattttttgtatttttagtagagatggagtttaatagagagactattgtctcgatctcctgacctcgtgatctgcccacctcggcctcccaaagtgctgggattacaggcgtgagccaccgcgcctggccggatctctcttttttatgccattggattattgaaaaaagtgccagccttcctgggaaaagattctcctgggtttgtctgttttcttcttttaggtgtccttttgcttgttcttgtgtcccctctatttactgtaaatataaaagcttgatgagatttgcaaggtttggttaaattcagccttgccatttctgggtatgaatacatcataggccatactgtgtactttatatgacatccctttataaaataagtaatttgggggctattccatgcttggtgtaaactaagaggggtttgtggattcaagcctacattgtaaggtccctatcaccttcattttaacgacttcatgtattgatcttttcctcattacttcattagtgactgaaaaatgttgatttttctaattggttgtttaccctgaaatacaggtcatccaaaaaagcaggacaaatgcttaattcttttcctttcagtgcaaattttccgcctaagacattggtgcctggtaatctccattggtgatcactgttttgtggggggttgtttgttgcatcgttgttgttattgtttcccctttccctacttttgagtatcatcgtgaactcgtgttttttagtatattttcaggggtttcagtataccgcagtcattattctttctgatgctcaggggcagggaagggacagtatctttttgatagaaggaaacaccaggactgcctcagtggaccttgttttggaatgtccatcatttgtaggaatgatggagtctcacttcctaatggttcagaaccattagaggtgcttccctaggtgcccaatacgacctatcactgttagagtataatgcatttctttggctatttatctggttaaagcaactcctttatccacagaaaaggaggttgaggtaggaagatccctggagcctaggagttctagtctagcctgggcaacatagtgagatgaacatccacagaaaaacccacttttacagctttgtgagaataaaatttttagaaaggaaatagattttttttttttaattactaagattctttgattaggaactacagtagaacactgggattactagtggctatacgttgttattttcttcccaattgtaaggctttgtcagcagaacatgaaattaagctaaaagtggaaaggtgggacatgtaatagccagaatgttcatcaacaagaaaagaaatttatcttgtaaaaagtgtgtctttgcacgtaagataaacataaaacagactgagcactgatattgactagatgctttaaaataagcagaaggggcagaaagttaaatatttagattagttcaaaatgttagctttatagtagtgtgccattgatggagcattcc

SEQ ID NO: 129365 - DNA, 1280 bp, Homo sapiens
gcagtttctgcaaggaattgtgttacttactcctttcagtgaatcagtaatgacgttttaggtcaggagattggaagctgcttgcgggggaacgtaggtaggtgactctagtacagagaaaggcatttgatgtggcacagccctaggccaggtaggtggcgggtgtcaggacccatgctgtagagctctctgcaggttgcagctcctccagctggccttcctagccctgaccaattactctgaggcttcccagccctaagctgcttctcttgaattctcctctgaatagttatacagtgtgtgaaagaattccttgccactcatgagaaatgtattgatttatttgaaaatatttgatgcacttaaatcccagattagtagcagttatggtaacagatgtccttttgatgaaaagccatttctgatagatgggggatccccatagtgaaatgagaagagcttcacttcctactttgtagagtccaactctttagcacggtgtgcaggcccttcatgatctgcgccccaactccttatccccagattcccagccataaggtctccttcaaagccatgctccaacaatactcagctctgggagtccaaacagagtccatcatgtattcgctttgccttcaggctttttgcttagagagcccaatttctggccataaatttaatccctttacaaattagctgcttgtccttcagaagtcaccttaaccatctctttcttcataaagcttgcctggctctccaaatgtaggttaattgctctaccgtgttggttactgctgtagagctgtgtttattcaggctgcggcattgatactgactacatttatgtaggaccattggtggaaggcaagttccccaaagtgaaaacaatccactgagataaattttctaaccgcaattttattttactgaaggctgggaagccctcaggttgcttcttgaagcacacacagcctggagaaaagcaattctgaacgtatgtggctaccccttgatttagatgaattacattccagtcaaaaggaagaacagatttgaaaatttaatggcaagactgacttcattcaggaaatcataactaattttaccaagctaggggtgagttgatggtgtgcaataaatttgggaagaaggaagaaggaaatgggaatgctagattacagttaatagttttctttaattcaaaaggtattgggaggtattgcagatctggaagaaggagaattacattatcagaaagaactcagcaacagattttaaag

SEQ ID NO: 129366 - DNA, 1433 bp, Homo sapiens
accttcattctaaaatgttctgaagctttagggagggaagaaaccccagaaactccttggttcctgtgttggattacccaccaaagatctgaagtcatgccagagccaaccagccttctgctgaccctcatgcccagatttccttgattttgcatcattgcaactgaaaaaagatttcagactgacaggcaaccttttagtgttggaaggtaatctgttcatcccagaccagtgatcctcatgagatagaattacttactattccccagaaagaagcagctcagttagtctaaactcttgcagttttcttttggtatttcagtgcttctaactaggttaggataccctgttctcatatatgaactctgcaagaatgagtacaattttcaggaatgagagggcaggaggggggagttatttacattagcatttgccaagttttcactgtttatcttaccggaaagtcaacagtgtgactattaacctcctgcataattaaaatttgggccttgttatggttgttcttaaacttgtggttaaatctttgtgatttttagaaggcaaagagatggagagtaaaaggaagataaaatatggctattcaggggactgaggtacatggacacctggagctgcttgttgtaaattggcaggttcattgcagccggtggaatgaatgataagggaattgtgtaggtcagagtctcccaaggtacttagccagttttgtttaataaagttaagtagatttttttgagcagatcacatttccctggtgaagctggagggctgtgagatttcttttaaagaaagtcttctgctcttaaatgaagagcattgttcttattttaaaaataagtacatgaacaccaatataattaacaaagctctatcttctagtgatcattaatttaatcttagtacaaaagagctgaacaatatgtctgaggcacgaagaatgaggaagaaacagttaaacatgagaagtggctgagggcatacattccaaagcaccactccctgccacctccctctggtaggtaatgaccccagatcatctgatgaatcaagggattgtttttgtactgaggatggatttcctatagcagagacaacattatttatacccccagattgtattccttaccttttttcctatattaatgtcagttactaatgttactgttgtttgacactgtgcagtaactatatgcatgtcaaattcgcattcagtttttataatgaactaggtgttagtttttatttttatctgttgcatcggaggctggcagagattaggtaagttatccaatgttgcacagctggtaacatttacaactaaaggacttaaaggggagaaacaccggtttgactttcaggtgaagcttattgagtcacctttcaccaccatacgcatacattctggaattacc

SEQ ID NO: 129367 - DNA, 1033 bp, Homo sapiens
tccaaatagatgttttcaggaggcaaaaaagttcttaaaccttgtgttaccaactaaactcagagatacatggccatacttaagtccattaaagattctccttgttcttccatctctcagttgtttctaagagtcattcatgtttatctctctttcaatgtgaccgtagactgtaagcttcacctttctgcatctgtttcctcatctaaaacgaaaaggcagaagatgatcttcccaagctctgtaggcttaaaccttcatcagacgctctgcagttctttcgtttcaaagggattacagggtggagttggaagtttccagtccttgtttttcagaatccaatttgagctcttctggttgcatattctcatgctaagaaaaaaagcctattcagatgtatattgtgagccctcaacaacattatcctcagaaggtgcaaaaaagaaaagatgtagccagattggtgcaatgggaaaggatttgccctgcctctcaggagggatggattaggcccagacaaaaaagccctggcctcttgatctgccctctttctgcttactggggcctggctcactctgggtggtcaagagcctcttttgtcaagaggaatctcaccccctccctaaactccaattcatcccagtgggccttgggcagcaatctttgtcttcttttttcagccttccatcctgtaaagtttgagcaggatgggcagtgactcaggaaggtgaaacccatcagggccttgcctgctccttcagtggggagtccttgtgaagggcttgtgctgtggaaaaccagtctctctagcttttgtaattttctcaagcaacgaaaaagcaaacaaacgcaaaaagcttattctgctttaatacccatttccgtcaaaggagtgtatgtgtgtgttaggagagtgctcaggctcatactggaaagttaggtgttggtgaggactgcttcaggtgcgatcctgacctggtcagaccacgtatcttttgatgtttatggtaattccacattccttcatgatggg

SEQ ID NO: 129368 - DNA, 1025 bp, Homo sapiens
gcagtctgtctttctatcaccaagtcctgaggaggtagtttttactgccttgttgagaggagaagggagtcaggaaggccaaccagcaacagtatgttaaaccacattgttggggtcccatcatatctgaaaatgggtacaaactgccctctgaacgtatcatcagcagtcagctcctgactccctaccatcctgagagaagctcgtgccatgcaagctggctgtggggaagcctcacacaggttctgctactttctggtttcgccatagagcagtcccacatcacaccgagcaaagcagttttctgttgctagccccctttctgtattgaagagtttcgggggatgggaaggatgcagagacactgggcctggaatggctccttagatggtaggaaggaataaagtgactctgttgaccttgcactgtagactcagggaaagtactgaatggcagagttactaatgacttctatcaaatcaccttttgctgactcccgtgttagtcctggatagcgtccttggcacacttgatttcagattttgacaggtgataaaagcacatattgagattgctgcttcacagggcccagattccttgctattgactgatgttatttttgcctttcctgagaagctccctcatgtgtttgctgttacttttaatggattgcttcctgatacatgggaggcccaggcacttgcccttcaatctggccaactgcagcctgacctgggtggaattggagctgcctgaggaacacttagaccaggcacttggcaatatgactcacttttttcccctaaaagttagtctgtaaagagcaactggaaatgttcctgtttacatctttgtggagtgtaattttaatcaggattctcaaggtttttcacttcaattctctgaatttttaagatcttaaatgccctgtggtcacagtatttggccctgtacttctgagggctacgtggaaaatgcttgatgatcattactgacttgtcaatagtaattatgccaataaacag

SEQ ID NO: 129369 - DNA, 2055 bp, Homo sapiens
tgagatctcagcaggccagacaggcagcagatgcttgttgcttttcttgtgttatatttttcgttcccttacttagcatttgtgggaccaaagccaacaaacaacaggttgttaaaagaatgagagtaatttgacttccgacagtgattggggctcggggttgttgggtgttttgttttctgatttgaaactagctgtatggtaaccactaactctcgccttattcttttcttgcagatgagctcacagtgcctgcactttaccccagtagccctgaagtgtgggccccgtaccctctgtacccagcggagttagcgcctgctctacctcctcctgctttcacctatcccgcttcactgcatgcccaggtaattgatacccatcggccaggacttcactcacttcaccaccagtcctttcaaacttggttcccgagagcacaccatacaactaacacctatccagctaacagatccaccctcaagagattaatgatcccctctaaatcaagctgacactccttcaggactgacgaggatcgtctgacagcaatgatatcacccactgcctgatgtttgccccaaatgacacctctctcttccttaatgatctcacctcatatcgcacatgagagaccggggcaggtttatccacctggctcccagctagctagagggcatcaccagagtgtatacgtgtgtgccttgtgtggaagggctgcagaggaaggtgtgtgctaggagaaggggatatgtgcgtctgtgcgtgtttctgtgtgttgagagttttccactctcgtgtacggtgagaagaatctctgaccaaagggaaagcttccaggggggaaggctgtactttcttaaatatgttacaggaaagattaagggttccttctctccattttcaggaaaccctgtagaaaaggagatacaagatagtgtctaagatggaattacaggtcaaggtagagatctctattctgaccagctttctttcttagttaaaaatagcctgatttttataaacaaacttcctgtttctccgcaaagattactgtctacatactaacacttcctctccccttggagaaaatatttctcttagcttcgcttttagtgcaagtggtagtaatcagtgtaaagattcacctctggagatcaccactcattctttggcctgcaaagattgatgaccagtaacaaatagaaagtacgtacgtaggtttcatttgtctttctgcatgtgtaattcagcctttaaattttaaatttttaaaaattattaggctggacaggcagagttttcgtttgcctgttttgctcagtgtttgtttacaaggctgggtgaaataaacagcttcccagaaaacctccttctgacttaaaactcttttatgttgtacagaattccctgtcttgataaagaccacctagaagcagcccccagcgagggttcttgaaagtcatggggtcgagattgttgttggctgaacatcttttaattctgagttaccaacacgttgtgcgtgcattgatgacccggcttcctggcctgcccttggtgcctgagccccagtaatgattgccctctatgttgggagaagaagggagaaagtagtacaagtagtgaagaaaaaaatgtaggtggtgttggtggttgagagtacatggcacagaaaataaaggagccaggattacctgtgcctttggcttctccttcccctgctgctttttcttcctttttccatgtcagtgcttgggaaccctcacaactggcaggtaacggggtcgggataaaatgtaaacctgtgggtgtcttctgctgagtcattaggatctttgtagcaggctgcggataaatatgtggatgacatggggcaactaagagccccttttgcttgccacctcccacccctgctctggatggtgtctcctcttgctagactgccgggtacagatcacgtggcaattaaggcaaatgttaataaataccatgaaacagtggtttgcatagtcttctgaatagccatggctttggttagtcagcaacaaagcc

SEQ ID NO: 129370 - DNA, 2800 bp, Homo sapiens
ctaaagagtctcaagagattagaaagcatatgccattgtaaggaaggatggggagagacagtgccaagattaaatggactcagccatttgacttaatgggatgcactgcccatggtggcaccctcccctgggagttcttccttgatcttgagactttcccaaactggaatccacttagctctgccacatcggtcccagatttggtgggactctcctctggtatcagttttcaacgccacttcttgtttggagtcattcccagtgcagtcatggactctatgaacaaatacggttatttaaatgtatttgtccagtatgagaatcagaatgaactagtagaggctttacagatcagctggtctgacccattttacagatgaggaaacaggcctgagaagatggagggagttacccacaatctgaaggggctctaccatgactagacccaggtcacctgcctcccaggcctggctctttccactccgaggtgctggctcaccacagacttattctttaatggaattttggaaaggcctcactccagtgactctttggatctttcttctctaagtagatgggaagcctgtaagaagagacttggaggcaaagcaaagggaatcagcacttaaccctcacccaaagggcccaagagaatctttagtaactggaggcagagcagactggagcctctacggggcatctccccatattggagaattcagtctttgttttggaaatcttataatgtctttggagaggctttaaataattttgtttttcttagcaatgttatgctctattttgagacatggattttttttttcttctagtgtttctctcctgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataaaaattttaatcagagcaaaaatgaactcaagtagactgcagcgttttgttttcatggtgatgcaattttggagcaaaggtgttactctctgactgaggttttgggagaattgggcctgtgacaccaagtctattttacatagaaggactcagaacgagcttcctggagaggccaggtcctggagccgaggccacactgctgctgcttgtctctccctgggctcccagaagagccaccaagagctgcatgttggaagcgtctcatccaccaggagacctcacttcagcagggatgctgcgtctagctaggggagcccctgtgaaacgtgtgggtgcagtgtgcagtctgcccaccgggatccacaggaaggaagaccaggagacaaagtgtcattgaaaagaagttgagtcacatttctagctctgccccggcttcagctgtggtctggtaccccttcagatttcccagctctaaagtaaggatacttatttgccatcagatcccgttttttagaaattattggataaggtaataggactgaaagcctcagtactgacttaatgtttagagatcaaagagcgaccctgtgcagcagacatcggattgctaagaagatcattaacatttttaaaagtgatcatccagtttactttcaaggtcattggtatttgaaatgtgttaattaggagaggaaactttcatctgttgctttcaaaaagcttatacactgaagagagcacacagctgttctgtcacctcacattcacacacttccgcctcttaggtttgagctcatgttctgctttcagtcttgttgtgatgggcagagagaaagtcgttaaagtatactgtccttaccacattctcgaaacacaccatacaccctgtacttcaggcagagtcacagtgtggggccagaagcttctgtaggtaagtaggactgagagagaaagtcctggttacctaattccttttcagaggcctcatttgtccagagtaacagcagttctatcggatttctaatagggctgctgtacagcttacctggacataaaccaaaggttttaaaattataacagactgcctgaggacaaggcatgcgtgtcccttgggatggctctgtgacacactggaaaaattttaaaggttaaacccaaaataaatacagaagtggaccatgggaagagagacataggctaaccaggaagggagctcacagaggagtagatgggcctgggagtagtgggtggactacctgaactgcagggctgtccccacctcccctgtatctgagcagttgctcatcagcagggtgggacttctgaaaactagatttaaaaaaaagcaaatcgtattaagcatctgcatcactatgccctgtaggaaataactgagaaaaaagacacaaggacttctgctttggtgtcgggtatgttttgaatacatagagtgttggggggtgtctcgagggcagtgctgggtatggacctcagtgcgcacacagctccttaggagtcgcccagcagcgagacagctgtggatcccctccaggcgcatgggaggctcacaaggcaaggactctgatggttttggcttccacctcctgtacggtggccagtgctgtgagggtggttggtcccacagggaaacctgtgaacagagtcatgtctggggccccagggacatggcttcaacccctcacctggcagtcctgcctcccaaaagtaaggcaggagtccggagattcccattgcttgcttctgtgaa

SEQ ID NO: 129371 - DNA, 1948 bp, Homo sapiens
ccaggcctctccatgttgggcagttttaggaggaaatgccgttcagaaaccagagtcggtcccctagtgtatggctgtgtggctttggccagggtcactcaccccaaggagacttccgtagaaatcacagtattattcaggattgccagaacatctcaacgtgggcctcctcctgactgggggcaccattactctccattactccattactctccatttggtacactgttttccaggtttctaagtgtgttccatgttgtcctttgcggaaggttaaactccccagatcctacgcgccttctcccctgtccttaatagtagtaagagcccaaccctgagtcccaacaagtcgcacctggaagtgccgtctgcgctcggctcttccctgggattaacaaccgcgtggcccaactgtcacagtcgggtgctgctgagcgcctggcacctaactgggactcagttttttaaatcaaacaaacctgattttaatgacagtttctacccactctgctaaatttgggatcctaggcaagttggtttttaactgcacggagcctcagtttcctcatctataaatgggaagaatgaacatctccatgggtttattttgcagaaaacagtaagatgtttggcttaaagtcatagttatgattaaaatagttcttccaatgccttccctttgtcaggattcgatctggtgtggcccagaggctcctgagccctccctgtaagcttgagaagcacttaggacacagggactcctgaccagcaccctgataagagaaacctaagggcctgggctttttgctttggtaaagaagagaaacaccagagccagggtgagaatggtccgtggctgtggcgtataccgagaggaggccgtctggttgggtcagctgggtgtgtacccaaggtttttttcttctgtaggcataggcacccagatgccgtccggaaagtatgtgaactctaactgctttggaaacaaaaccaaggccacagagaaactttggaattataaaatgtagccttcataaaaggggagagtgaacttttctgtgaagaaaaccaattgtgacagtaggggtaaaggaaaatcaactccaaatggaatcatgttttattcaggatttgtgctgccggtggggaaggccagacccagcgacaggatgggaaagtgggacaccccaacttcaagctttgtgcgttctgccacgaagttctatgcgcttcactgagctcagctcctggggacctctaatggcccttgatagcaaacatagttaaaaattaacagactgacagaattaaatatggatgacaagcaaccactgtggacttaatctgacacagggtgttacatgcttgggtgcttttaacccaagtggcatctcaagtgaacttctgagatgtctgggcacatttcacatgcctgtttggaagcagggcttagcttgtgcttaggacagacaggaaaagagtctaagagcccaggagagaaaattctccctggaggcttttgtttcattaaacccagctttgatcaggcttaccaggatgtactcacagtcctaggaccttgtccttgtggtctagaccttgtccctgcctgggctcggacctcagtagcacctgccatcgtgactggaagatccggcaagagcacaaggccagcggggagcatggcctcctccagctaggactttcttgctcacctcttttccagctgttggggcaggtgagatggcagccttaaccaaggaccaagtcatacaaatcttgacattctgcctagatcatagcgacttaattgccctaggcaaggactattaggtgccagacaggtagtgaagaatgctgatggcgttttcatgcctgagtctgctgagaaagagtataggctgccgattctggggggcagggagaagaggagtggttcctttacaag

SEQ ID NO: 129372 - DNA, 3689 bp, Homo sapiens
aggttcacgcaatcctcctgcctcagcctcctgagtagctgggactacaggcgcacaccaccacacccagctaattttttgtatttttagtagagatggggtttcaccataatagccaggatggtctctatctcttgacctcatgatccacccgcctcagcctcccgaagtgctgggattacaggcatgagccacggcgccctgcccaagctactgttattaactattttgttcaaagagggatagctgacttctgaatgtggtgcaggggaaacctgcattcaggtacagcatctgcactagggaaggtgagagaaaatctgtagctgctccatgtacatgagacatcagagcactagccggtttggtggtctgtcttccagctcgaagcatgcaaatggcacagcccagcctcttagatccaccaaatgctaccactggaagggaccttccagaccagcatttctcaacacccacagggattcacagctgttccataatccagagatcctgcagtcagataaacttgggcagcacaggtctagatcaagtcaaacaggtttctttattttggaacttcttggagccattactgtgcccacacatatcaagaaactgctgaagggaccaaattgtgcatttctctctaatgtccttgacattagagcatttctagaccagtgttcttccagccatacttttcgaaaccttaattaaaagcagcatctctcagacttgaccatgtgcctggtgatcacctggggggctggttacagtgtcgtttattggatgcctctcccagagttttggcatttctgacaagttcccaggtgatgccgttggtccaggaacctgagaaccactggtctaggcttaccccttcattccccagagaagaaaacagtccaaccagagagtatttgctttcagtagtgactattaattgagccagtcacctgctaagcacttttcgtgactctttctaagggcaagtatgatagtgggattcagcccctagaaaggggatagcgcaatgcaaatcattactgtagagttttaccctgtgccagtcactcaccactgcagaagggttggtacttcaggcagggcgtcctcccgagactagtcaaggtcttcctgtccttggcatcagtattaggaacataaattctgtctgtatttaatcctctgggccttcatttttcatctataaatggaagaggatggaaattatttttatgggtgggtaccgctttctctagcattccatttgatttttactctgagttgcttctttttctgggtatcttggtgctctcctgttgtccaatctgtcaccatgctgagtgctggagacttacagtgttagccatgcaggggcactgcattttcagagcattcctgaagaagagggatggtagaatcccaaacagtgtggccctgggtagtgaactgtaacatggtaataacttaccactattgttaagttctagtggagaagattcccagggtcgtccacgttgccttagatgtcacaggctgtgtgaagtgcttagcgcggtctctgacgcagactaaatgtcagggtcagtttggttaagtatattgtgttaaagtttctcacagggtcttgagaagcccctggaattgtgtgcaagactgtgagtgtgcacatttgagagagagaactatgggagaagagagagagggtgtgtgtttgtgtacacatacgttttctgcacatggcatgaagaaatgtgaggggccgctgccttgcatggaaggccagcccttgtcacattattctaatggggagccctaaactagcctgctgaactgtttggagaggaccttgacgcaggcagtctggagggaactgtaggtttccccgttaagaagaattgtaaagcagcccttatgggatgggcaggagtgacctggggccaaaagcccagcagaacaagcagcccgaatggggctaagagagaaccctctcctcattacccccacacagtgattagcgcggagcagcttgttcccccccaccgggccggctgcccgaactctgctgtgcaccatgagccctgccgctctgccggctgtggtgcgggaacctggatgagccgctcagacttggccaggggggcactgccctctgctggaagctgggcgcagcggagcctctcaggctggaagaggaggcagccgtgggtgtctgtggatgcggtgagaagagccccccacttggcaagcacatagtgtcctagcctgagacacaagagcaatgaattcaggggtctgtgtgtccgccacccgccaccacatccactctgaggagcagccacctattgcatcactggcgtcctcactcctcagctgagcacagcctcccctggaccccacagctcggaacccgccttcatgtcactctggagtgcgcctcgaccaggctgacgagagcctgaagacgggctgcacgctcgtccccaaccctgcaggcacctgtgcgagtgagaacgtgagggctgtgtgcgagagctggtcagagaggctggggcagggcttccttctcgcagtcacctgcaccgaaagcagaaccatgccatccactgtgcagctctcctccccgggcagccctccccctcctgtgtctcctgtgaaacaccgtcacgtcttggcctcgtcggggctcagcgccccaacccacacccaggccgcaccagtcacaccactgcgctccacactgacccagtgcacacagacccatcaccctctactgtgtgtttaggtgtccagccccccacctgccatgggggctctgtgtccccgccccgtcctttcccacctgtctcaggaaggcagctccaactctgctctttgcttagtgagcaagtggattcagatgcaccaggccatgagccgtgggtaggtatgagttctttcttctccccacctctgccctccctctcctcccctagactcttctgtccccttccctgcccgcccctacctcacccccatcttccccactcttgccctccttcttttgttctgaacacacttctaatttcccagaggagtgttttctagccttcctgcctgggaaaagtttctgacccttgtccctgtaattgcaatgagtgttgggagtgaccccagccctgccttaaatgagctttggtacctgctggtggccctgaggacagcaactttgcctttccctgatactggggaccctgctctagctggtcatctgatcgctggtcatatctggcatggtcgccagaagagacccaatgcacaggcagcctgacggagtcgtggtgcaggcagaagctccggtatgtcctaagcctgcgtttcctgactcaggccagcgaggaaagaaccgctcgtgaggaggcccatggggaggaggaggttcccaggccgccttgtgctcggaccagggacaaggtcggggtgctgtgtcggatttctctaggacccaatttctagacatccctgcttttagaatcaagttaggggatctcgtggggcctcatcctggattctgaccccactgggctctgtgaccaaggtcattgagaatccccagacttcagctggtgcccacacctgtaaaacaaggagatgaggcaggagctttccaccagtcccttcagagccctgcgttgtgcagtgctgcc

SEQ ID NO: 129373 - DNA, 1008 bp, Homo sapiens
ggtcatggggagaccatgccgcctccatgtgaaaggaagagcagtgggaggcgggcatctcttgcctgtgtccaaaaacatgtccagtgatggatgccgttaaagacaaacggcgcttgcccttttgggtgttttttgttttgtttcttgtttgttttgagattttcattcattgcccagaatggagtgcagtggcacaatctcagcttacagcaacctcccccctcctggttcaagcgattctcctgcctcagcctcccaagcagctgggattacaggcatgcatgcccacgcccagctaattttgtatttttagtagagatgaggtctctccatgttggtcaggctggtcttgaactcctgaccttaggtgatccgcccgccttgacctcccaaagtgctagcattacaggcgtgagccaccacacccatttttttttttcatgttttccttggcataggacctggaatatgctgccaggtgggcaaagtgttgctcaatgcacctgtgtttgcggctggccttccactttagaaagctaatggaagagacagggctgctggtcccagctgggaggctccttgctgaaggctgtaggcccatctcctcagtagggtgaacagagggcctggggtaccagacacacacagtgccaagaagctggaaccctttttttaaaagaacaggaatagaatcgcaaagtagtcctggccaggccactggtgtggatggggtcgtgaactgccccttccttaccaaagcagctatgtttccacactctgcttagaaagccattagatagcctttcaccagcctaggcctgggaaaaggaattcgctgtgccggatcttagcctcaaatggctgctaacctttaaaaggaggatgagagcagaggagttggtggaacctcgggcacttctcgaggtgggtgctttcctcagagagcttgcctgtgtgttcataatggtgtgtggaacgcctctcaggacaccgctctgatgcttt

SEQ ID NO: 129374 - DNA, 1051 bp, Homo sapiens
tccatttctacaaaataccaaatgccttctgtaattcagaaattctgaatttctgttaagtacaaggcactgttcttctaaactctaatttagtatgtgaatttggagagtctacttagagttaagtttttagaatgttttagttccaccatcagtcttctcttggtttacacagttccttcatgaaataggaagaaaaatgagaagagggaggggcctgatcctcatgctgttagaaatgctaaagagatcatggcaaacctgtgcacctgattttacaatagtgtcatgggcctttccttggagacttctattgtaagataaaaatacttccaaactaaactagtgttcttttctttttgtaccattaatactgagtccatatgcttttgttagatcatttgaagccatttagatagactcttctggagaggcattctgtggaaagaacaggcccctggtcaacttagattccacttaatggagaaatgtttcagacctctcacaagaaaaagacactagagctgaactcgcgcaggtcagtgcctgtcagtgaagaagaaagagagcattgaataagatttttaaagagtgctagggtttattgtgcacaggtaagttgccctgttgacctgaagtctcggttggtgggtcaggtcaccttcaagatctgggaggactgctgagtgtggacttcatgtttgaagttctcatcacgcaggaggccggcccttttggatgagctcaggtccgagtcagaagaccccttctgtgttcgcaaaggagaggtctcagcagacagtagagagatgagtaatgggcatgagagtgtcggaagcccacagacgattctcagagcagccagtcatagcccagcagccacctggccattcacagctctttctctgatggcagggataggaaagttgagagagagcgctctgtgctttaggacatcagcatcaggaagctaaaattgtatctactcttcctctaacccaatgtatttcatattttaactcaaatacttcatattcgagtgtggccaaat

SEQ ID NO: 129375 - DNA, 3909 bp, Homo sapiens
tcaaaaaggccaaatgaaaggcgcataccattcattggcagaggcccacatggctctctccgttcggcggggagggctttcttccccatcttgctttcccagcacggaaagaacagaagacgagcaggagtgatgccgtccttccaaatcctcaaaggccagcactcccagaggtccttcaaggatttttcatttatctacttggacttcttagtgctaaagagaaatcagtgactagactagatatgtaaataagaactttattctctagacaaacatttgttgtgtctgctgtgtccaagatacaaaaatgaaaaaacaggcctgtgcccctcaggagcttaagttctaatggcagagaactgtggacacatgtacaggagagggagttactgctcatgatcctgcaagaccagcttgctgtgaggagagccaagctgagggcatgtacaggccatgtgcatgctgttcctgtggcataagcaaggccatcaggagagggggggtcagaaggggacagggtgttactggtgttttaatttgctccgcctcttgctgatggatggtgttgagtttagtgatgcagacacagcctgtggccagagttttgctgatggttcagccatgtgctagagagcccagaatacagaatcacgattgaaaattgtcagtttcccagatacactgagaacaggcgagcatgagcaacgctgctgtcactccttacatgcagtgagagtgaggcagctttctttgatggatattcaaagagttgaactgttcttgaaagggaagaaccagcgtttgggagccaagtggggtgtagggggacgtcttctttcaggactcttgaaattttcctggccatggaccgggaccagagcccagaaattataagcacatgtagttacagcctccccagattggagaaggaaatgcaagagagaacgtgacggaatttggagctatttttcccttctcttctgttttgggtggaatggccttgcctgtctttggctgtgagcttgagtcatcctcagtagagtcccaggtgctggtgcccaggtggagcttagagcttaacaaggaggaaaggcactggggctccagaggcccagacagctgcggtggctcctgctgtcacgctggcctccccttagaagaaagccacctgtccatgtcatgctatcacactgcggtgcacccaccaaccagtatgaggctgtgaggtctgcacatcacacctaaggctactaacgccgtaactgtccgtcatacctaaggctaatacggtgagcagctgcagcgtcctggggaggagatgggtaataggtaatcaaatagacataatagtttgggtggtgatagtattcagggaataaataataaggccaggtaagcagctcagtgttgtggtacggccagcacttctggtgccttctgcttcaagttagcaaagcaggcagggtccgcctgagaaggtaacatctcagcaaagacctagaacttcaccagctttatacggggtttctttttcagaacacattccactttagtgaggcttggaaaatatttaactcctgtaatcttaaagtaaatggactggaagtgcagcaggcttggctcccacgcagcactaaggaatcactgggagagtgtgcagggccctcctcagagacctttctctgttttcccagtgaggagacgcaagcctggttctgcaattctttccagctctggagtctgttatggttcccatctgagctctaaaggtaggggtgggcctgaagaccctccacactgtcagtcctgtggacgtggtgggtgcccctctagccaccactgtcctccggactgtgccacatcacaagcacttaccgagctcctctacaaaccacgtgacaaccaaatgcagtgaaaactgcagccccccaacctgctcctgcccattgtgttttctgtggatctgtctggagtccttggagactcctgagcatgtgcactggcagagctgcctgactcttccctggaagaagttcaaagagggtagccacgtgttcagaccaggccatggggtctgggggctccgcgactcctgagagcaattcctggccggactctggctcatgttactgcccccacctccccccgcccaggtaaacccgggggtgcagacaactgttgttgaggtcccaggagcgggttgtcccctatgctcctggggacatggaggagagggagggtcccaggatcccagtacttgtatgagtcgcactgattagctgaagcccagaggcttcttaatcatcctagaaatacagcctcccgggaaatgtggcctggctctgcagctctgggtggctcgtgctctccctcctgtgtggaggggtcctggagaggttgggtgagctgattgataggtttcatgtgcaaagatgattattttcctgttctcaagtaacccaacttttgctaggaaactagaatcatctaatgttgcatagtgaagttctggggaaaatgttttcttccttaaatctgaggagagagatgtcctaggaaggtagtcttcaggctcactcttgattccagagctgggtttcagcacacgcagtcccctctccctgaagagtcctggtgggaccactcggaggtgccagctgagccagtgccacctttctggggaacccggacagtccgcagcagtatgttatgcactccagttctcataagcctcgcatactggacacggcctgtctgcagggagggagatctgagaaatgttagtgggaaataggaccgctggtgtccacatgcagggagttgggcttccttccctggcactggaatccttgctgtaaccagccggctcagaggcagccgtgcctgcagggggagtattagaaactgattctttgctaggtctttgcaccttcgtatttcaaaattctcagaccctagggtacaagtagccagatatcttcacaaatgtgcatccttttagtttttgttttccaggagatgcttggagcaaagtttagtccttggtgcctgtgacagacagggatttcctatggccttgggctgaccaaagctgctcagctcctggaggtggctgtttctggatcttgctgtgtgggggcctcaggtcccatgcctttcctctgcagggcctttggacagtcctccgggtctaggccacagcccttgggatgcaaccacagggacgtgggtgtagagtcctgcttgctgggcctgcagcctcctaatgcgccctcagcgaagagttcacatgcttttcttggaatgtccttcctcgctggcccccagaagcctcctcttacttgctccgccaagtcctcagtgcgttttcctggctgagagcttttcatgtcgcatatccaaggccattctgcagcagcctctggtcctcagctcagcagcagaggcctttgatctctttcggcgttgcctctcttggctctctgccctcagaacaggccggtcttcaagaccgaggcagccccaggtggaggttactgtgcaccgttaacgggtgatctttctccatcccaggtcccaggtgtgtgatggcggctgcaatctgtcttgtgggtattaatgcaatcttcagtggtggctactgttctctagctgttctacaaaactggagcatgctggtgagtaacagtcagggctgaacaagccctcaggggcggcatggcgaacacgtgggaactgtgggcctctgggggtggggtctggcattccaggtgctcgtgcccctccaccccaggtgattctgcccggagctctttaacatctgctccaacacggcctgccagggaaggtcatcccaggacagcaactgatacatttttaaagcccatcaccccagtatttggtgct

SEQ ID NO: 129376 - DNA, 1749 bp, Homo sapiens
ctcactcaaacttttttaaaagacatgattttgttcttcctcctggggatatttaaaaaccagttaagccacttgcacatttttttccacttatgcaatttttgaatgctggttagacatgattttaaatgcagcaagtcaaccaaagtatcaacaatgcaaggagcaggagttttcctggtaggccacggaagggcctagtggcaggagacagaaaagaggggacaggtttgggtcacggtcctgggggcagctgaggatcaggttgcaaatgccccagatgtgcctgagagagcggcagcagccagcatggaggggagcagtggcgttctcagcaccagtgtgttaaggtggggctcacaatttcttggggccttccctgggttacagcagcgagtttggagggggcttttctcttcccaaatctgaggtcagacaacagtgcttatgtgacctacccttggagggcagagatgggccattctccatgggcccccagggctggaatggagttccaaactgcagaagaccatgcccctagaggctccagagaccgtgaactttttcaatgacacgtttgaaaatctattacaaattaatatcagtacctgattttttgaagatgaagctgacaggtattaaatgaaaacggaagcactcttaattaggaacctttgccacatgatggcccatgtttatttggagttggggggagaacattccttatctgacttggtaaccaggaagccttagaaactcttggggaaggaatcctcaggaattaggtcaaggagctgcagatggatcaagggaggctttcctctgggagaaaaatctcccaaggcatcggaccgagaccctgactgggtacgaagagaccgcagagtgaggggcaggcagcgggcatcctgaccccaggcccatctgtccccacgttctgagttccaccaaagacccaaaatgcagtgttttagaattgtgtaatattccttaagagaccaagagacatcctccagtgtcttcaaactgggactgttcccacttacctgagataaggagatttgttccctgtcttgacgtcccatcacctgtatgtcatagtcggccccttccaggaaggccccgcgaggagaacctgctcctaatcagagccttatgcgttcccaaccctgaccccgccatccatccctccgtggggctgtgttcccagatgtctttggattctgtttaaaatgtccttgttaagacattccaaggtttgaactccgctcctagctaaacctcctccttgtttacagggactgaaatagccacattttgaccttctgttcagtctgggatcatctgtggtagtgtgactacattcctttcccatgcaaggatcccatttacatggcagttatggaaggcccagaaaaccagacttgctcccgccctcctcctgcctatgttccttctcccttcagattagccctcctaggcagccattccgcctgctcaggggctggggcattgggaagctgcgtggttcattacccaggaaagctggagccaccatatccccctcatcagggctgcagctacccatggaggctcagggtgcccctgggctggtgtacagaacccaaagttggtcccctggcctgctcccaggccagacaccatcaaccccaggggcccatgtctcagtgccacatgccataaatgacccaccactcctgttttgtgtgtcctacagtctaagtgtct

SEQ ID NO: 129377 - DNA, 1885 bp, Homo sapiens
cacaaataagcatctccctgtacaaaattctagtgtatgctgagctgattgattgccttctgcatacaccttttctacaacttctcaaacgtgtgtgacatgctggtaagatggcaggaaaaggagtgactgaataatacaatatagctgagatgtgtttcaagaaaacctctgggccagggtaggggtttgtgagcgggagccaaggacttgccccatgtttctaatcaaggtgagaccactgacacatgtggtcagcaaatatgttctatacacacatccgcacactgtcatctaacccatccgttctcccatccacagcatctccaggacaaagccatcgcaactagggaggggttgacacctgctctcctaacatgttttctttctgtttcaggcttgaaaaacccttgcccagttttgatcccttcaagactttgtcacagcctctatcacacatctgtttttctcgaagaaaaaaatataattaataaaaatgttttactcttttacactgtataattgtaagaaatagcgtattatttgtgaatgcatggtctgaaatttctgtacagtttggagatattttcaaacgaaacgtaagagaagtcaacaataaaaccaagaaaagtgagtatttttataccaaacattttaagtatgctgggatggacgatcttacactggtttggatcacagtttttgttcttgacttttgaatgcttgtaattaaaaatatctatttttttcctctgaagtaagttgcatgtttgaggcatgtttccaaatattatcaaaatatcctgaattgtattgtgaatatatagaaatctgtgcctggccggagtccagggtaaattagtagcatggtgttagatgttagaaacagaactgttatttgcagtgttaggtctaggatcccagttctagtaggacagccctgcaagacaatcaaccagaagcctccaggagcttctacctatggcttattcacaactgggcaagaaaacatcattggtaagaactgctgagtgtgcccttagaaagccctagtagctccagctgtgactatatcaactgtgtgccaagtgtgactttgtacagttttatgtttccactctcctgtatgtgtagccactcgatgcctaacctaccttccacaagccagccccgcatccctgctcccgcagtgtaagtgcagagcctgcctcactggtaagggaaaaccttggcttgggaggccagccctggcccttgaaggggttggctgtgcccagcccacctggctgcagtgggcagctcatgtctgtatctccaaagtgatgtttgtttgcaaaacaccggctgaactgagctggtgttgccaactcttggcagcactgggccaaaccgaccacataccatgagctcccaaatggcgtgtgctcactgtgagacgtcctgccacaccccacaggagacggaggcagtgggcatttggaaccaattctattcagacttcgtcaaagccaaagtcagtctggtgttgtcagttgacacatctccagagttcatgacagctcaacctctccccttgtacagaagccatttttgtaaaaccacactgacctaaattcagctgccaaacacagtctttcctattgatccgctcggcttatgttgaaaatttcaatgtcatgattacctggttggtttgggtttttgttttgttattttccattagaaatataaagatgtcaagaagcttttaaaggtcaacacaaaaaaccaaggccaggagtgaggggctctttcttaccgtaaataaggggaaaaggcagttagctcaaggacttgtgacggatccactttggtgttcaaggacctgcttatgccctcagtgcca

SEQ ID NO: 129378 - DNA, 1126 bp, Homo sapiens
gtctgtcaagatgacataaagaagtaaggttttttttaagggacggggtctccagactggagtgcagtggcagattcacagctcacttgcagcctcgaactcctggactcaagccatcctcctgcctcagcctcctgagtagctgggactataggcgcgtgccaccatgtccaaattcaactagttgtttctgagcgctttgggcaagacatgatctgtgctaagaatatggacaggttcccaaaagcactctcacccacccagatggaaggttctggcacacagttgctctcctctccaactcttaaaccattctctccacaccctcatggcataaaacctcatggcataaaacaactttacagcctgcatagaaaacctaagaatattcattaccagtgaggtgttatttaaaacactcatcctcaataaatgcctctcctaaaactctaataactatgataatgaaaaactgtatgttgtcagcaatttgatcaagagcactaaattaggaaatttcaataactgccactgtaaagctatctgtccctgctgtagaacatcccagatggaactaatattaactcttgtgtgaactggcctggctccatagctacccaatcctgagagatgccagtgtgctgtgagaactaggcccctctgcagctctccaacgaacctgccacttacctcttcctgaccctcagttcaaactcattcctatttggggggcgagggaggagggagctcttcctacaaaccgtaataatttgctggtaaacataaacaaaacagtgaaggcttccattctccaccactgttcacatacatctcacctatggacgatctgaggggaagagaaaattcgggtccttgtgttccacttgtccagttgagaaattcacgtggaactctgcccatggtcgttaattccaagttaggaacttgggccaaatgcttaaagtcaacccaaacttctcttctgagcaaaaaggaaggcctaaatgcaatgagaaatgatgcacgagttaaataaaagatttacctggacaaaagagcactttttaaaactacaacataagctttggcgtgggggcttagcaggcacttcaaaacctcacaatca

SEQ ID NO: 129379 - DNA, 1053 bp, Homo sapiens
tggcgctgtacggttggcccccctctggctgcagtgtaaagaacgacagtgcattttgcttccctggatttccattagaaataaatgtggatcctgctcttcagcagatggggaggggactaatccaactccactggttggggatgggaccagcacatttgtgtgacttaaccatgtggttctgagaccctggtgaaagcccagtgacttttcatctggccacaacttcgtggggcttgcatgtcaagggagaaaaggcaaagactttcctttaaagaaaacacagaagggtgccagcaggggataactgagtgaaccatatcctgatttaggcgggaccagctctagaagcgccaagagcaggtttgtcccgtgggtggtgattgtgaggttttgaagtgcctgctaagcccccacgccaaagcttatgttgtagttttaaaaagtgctcttttgtccaggtaaatcttttatttaactcgtgcatcatttctcattgcatttaggccttcctttttgctcagaagagaagtttgggttgactttaagcatttggcccaagttcctaacttggaattaacgaccatgggcagagttccacgtgaatttctcaactggacaagtggaacacaaggacccgaattttctcttcccctcagatcgtccataggtgagatgtatgtgaacagtggtggagaatggaagccttcactgttttgtttatgtttaccagcaaattattacggtttgtaggaagagctccctcctccctcgccccccaaataggaatgagtttgaactgagggtcaggaagaggtaagtggcaggttcgttggagagctgcagaggggcctagttctcacagcacactggcatctctcaggattgggtagctatggagccaggccagttcacacaagagttaatattagttccatctgggatgttctacagcagggacagatagctttacagtggcagttattgaaatttcctaatttagtgctcttgatcaaattgctgacaacatacagtttttcattatcatagtta

SEQ ID NO: 129380 - DNA, 1021 bp, Homo sapiens
ccaaccgtacagcgccagccagggccgtctagctctttgagtttccagcggtgcttcccccaacactccagacaggacagggatgggtgttctacggtccagttagtctgaaaaatggtttccaagaggtccttggaccatcccaccacaactcccacagaacaccttctcatctctcaggacaagcccacaaaaaccaccctgagagacctcgaacctgcaggaaggtccaggagggctgctccgcctcgctgcagaaggcgcggcaccaggctgagcttgtcaacagtcaaccaaaccttagaaaaccccaaatcctccccacaaatgagtcatctgaaagtaaaacccgtggctacagggaagagacactgagtctcatcctctatgcctcagaaaatcactattaactaagaatcagggaactgataaaccaaatgccctcatcccacaaaaccgtccacactgacaatcccattctactgctacagatttcaaacggctcacagataaagacagggctgtccactcgcagtcccttgaacgctggggctggaaggaacgggatgtcctgcgctgcctttccactaagcctctgctcaacaggtgtcaagtgccactctgtcccctgggtcccaccatcatctggccacatttacaggctgtgacagcagcagccaaatgttcggtttttacactctgtccaggcttgactacatttcccttagctatcccctaaaagcctcacatcatggtgatgaattatagatcaaatgcactcccgactgtcataccctcttaactcaccgagccgtgccattcccacgtgcttctaaatggccagcagagccaccagaaacgggcagaggcgagaacatgacttcaacttggtgtttctggtggatatgttttcagacacccagaagaactgcgaagagacagcttctctgtatagcatccctcggagatgctgcagacttggttccaggccatcgcaataaagcaaatatcacagtaaagt

SEQ ID NO: 129381 - DNA, 1088 bp, Homo sapiens
tttccatattgaaggtttgtgggaaccctgcttcaagcagatctgttggtgccgtttttccaacagcatgtgctcactttttggcaataatatattttaaattaaagtatataattggattctttaagacataatgctattgctcactttctactatcatgtagcataaacattttaatatgcactgggaaaccaaaacatttgtgtgacccactttactgtgatatttgctttattgcgatggcctggaaccaagtctgcagcatctccgagggatgctatacagagaagctgtctcttcgcagttcttctgggtgtctgaaaacatatccaccagaaacaccaagttgaagtcatgttctcgcctctgcccgtttctggtggctctgctggccatttagaagcacgtgggaatggcacggctcggtgagttaagagggtatgacagtcgggagtgcatttgatctataattcatcaccatgatgtgaggcttttaggggatagctaagggaaatgtagtcaagcctggacagagtgtaaaaaccgaacatttggctgctgctgtcacagcctgtaaatgtggccagatgatggtgggacccaggggacagagtggcacttgacacctgttgagcagaggcttagtggaaaggcagcgcaggacatcccgttccttccagccccagcgttcaagggactgcgagtggacagccctgtctttatctgtgagccgtttgaaatctgtagcagtagaatgggattgtcagtgtggacggttttgtgggatgagggcatttggtttatcagttccctgattcttagttaatagtgattttctgaggcatagaggatgagactcagtgtctcttccctgtagccacgggttttactttcagatgactcatttgtggggaggatttggggttttctaaggtttggttgactgttgacaagctcagcctggtgccgcgccttctgcagcgaggcggagcagccctcctggaccttcctgcaggttcgaggtctctcagggtggtttttgtgggcttgtcctgagagatgagaaggtgttctgtgggagttgtgg

SEQ ID NO: 129382 - DNA, 1025 bp, Homo sapiens
ggccacaccacccctcagagcagctgttgtttctaattgtttttaccttttcctttaggcccctattcagagaaggaaaaagcctgcttcacagaaaaagcgacgctttaagactcataacgaacacttggctggagtgctgaaggattactctgacattacttccagcaaatagggaacagttttgccctggaacagagttacagatacacaatcaagagtgttcttgctgatgctcggggtctgaagactgtcttcctatctgcttcttgcggctgaggagaggagcagttcagtttacaaaacaagtgcaaattaccaaactcaaagcttatttgagtagaatgggctcatgggcaatgtgatgttccctgttaaccttctgttactccctgggagaaaggcgctgagcgtggcatgcaggtgtctttgctgtgtttttctccacttctaaatggttcctggttcctttcttcctcgtttgttactttagagcaagtttgcccatagtcttgaatgcaatatttgtttattccaaaagaacatatttataataaaatcactgtagaaggatttttaagatgttagtgaattctgtttcttttcattctcggaaatggcaggaagcagctccagtctctgatttccatgggtcacgtgctggggatgtgatgaagcctgcagtctgcactgtgttgctgagcacatggatttcaccactggaacacaggtgtgctgcttgttagcaagcagagcaataaagatgtgctggatgtcattgttaatgttttcttttaaaaagaagcgtcagtgtcagccgggcaagctggctcacgcctgtaatcccagcactttgggaggctgaggcaggtggatcacgaggttaaaagatcgagaccatcccggccaacatggtgaaaccctgtctctactaaaaatataaaaattagctgggcgttggggcatgtgcctgtactcctagctacttgggaggctgaggcaggagaatcacttgaacccgggag

SEQ ID NO: 129383 - DNA, 1028 bp, Homo sapiens
tccttagtcaccagttaccaggttatttgatttcaaaagtcttttttgcagataaattgttgaataacctcatttccatgtgaaacttcggttcccgtctccctacacgtttcttattttctattatcaatgagagaggaatgagtatatcatgcttaggggagctgagcaggaaataagctgttagccctaaatagaggaattaaaggagggtgttgacggcccaggaaagcagggcggcttcattgtggcagccctcatttgctggcctcaagaaacagccccactgtcggggctgtgtgggtgcagttctgtctccaggcctttccctgcaccgtgtcccacatgtggatgttctgccctgacttgtttcatgatgacatatcagatgtgctcatttggatccagaggagataacactgaaacctggattttgatcaagatgctatagtttgtaaaaatggattgtaaaataactagtgtctgtttgatacagaatttcagaaactgtggaggagtgtcactgtagattccatggacgaggagaaaattgaagaatatctgaagcgacagggtatttcttccatgcaggaatctggaccaaagaaagtggtgcgtaatctctagcaaagcagcttaatcccctgccctgggaactgttagcctgctccgctttctgccctctgaagagctgggagttgttcccccgccattgtttctcagtgtccgcagcccaggtcacatctgaggtattgcaggcctgcagacccgccctcggtgctgctccaggcctgtgagtgcctttctacacccagctcctcccaagcagtcctgctcttgaggtatagccatatggaaccttccagggcctgtgtgttccccactctcccactctaagctgctacaagcccttctccctattcttaaagggatgctgtgccttgatctgcacaacctttcagacttgaacggggccctcccctgctccgtgagcctcgccgtcctggtgcctggttctgccatagtaa

SEQ ID NO: 129384 - DNA, 1001 bp, Homo sapiens
cactgatctgtgtccctcttaagaaggatggtgggggttaagcagggctttcgaccttggcagtgttaacatttggggttggttgagtagtttttttttggtgtggggagtgtcctgagccttgtagggcattgatcagcatccttggcttgtttagataccagtagcttagcttccctgcagtgtgacaaccaaaactttctttagacattatcaaatgtcacctggagaacaaattccccttgttgggaacttggttaaaggtccagtttatgttgatagaatagaggaagattgagacccactgttttcagattccttttcctggctcctgtcattccgcacacttggtggtggaagaagatcacagtgaatgaggttgctgtccttgaccttccaggctgagcgggtagaatggcataggaagcatagttcagctgtttgcattttgtcattttggtgttcacacggtgctgtagagacaccagagggaacagccatttacaggaaccttgggtaaggtaccaccagtcttttagttgaaagtgccagtattacgtaaatcagtaacaaaaacaaaacaaaacaagtttttgttaatgatataaggaatgtgtgtttccagggaagacccattgaaaacggacacgttttaacattcatctctagcctcagaatgctttatgctttgtgtgaagattttcgtttcgttccactaggtggcaaccttagccatagagaggaactctgagtgcgcacacttcaggcacacagagggttctgtctgtaatagaagcacttgtcctaaaatgagaattagctcaaggagagagttgatggtgtagtaattttttaatccagtgtagaagtgaacacagagtagttggacctaggcaggcaacttatttttcaaaggcatttctttccttaagtcagaagcttattcatttaaaggtagtataaatgtgatggggaagaggctggtgctgaggagttagatt

SEQ ID NO: 129385 - DNA, 1063 bp, Homo sapiens
cctgggtgacagagtgagactctgcctttaaaaaagaaagttaaaaaccatttaagatatttctgagctcaaaaaaaaaaaaatctaagaaataaccgattcctttattcttaggtataataacaatcattttgaaaaatatttgcagtacttaaaaaaacctatcacaagtattacaagttcagatagagagtaagagcctatactaaaaggcagatgtgcctttcccttctctagctgcagtccctttcttttgtggcagctgcttaactagttttattttggattcttcagttttttcccaattgctaataatatgcttatgctattgtttcttgattttttttcaactttaaacattgtgtgacttactgtcatttctctttcctatacctatctctctcctcccaatatagttgtatctctagttaagttttagtttctccgtcatttactttgatgccttcaacaaacatatttaaatgttctcagtgggaattttagtgttaagtctgctctgcagatggcagcatagtgtagcatgtctgttgtgtaagcagatgtttaacttgaggcgggtggttgataggaaagagattgcagtagctctgtaagagtgtacatgaagctctagaatttcttaatagcatttctttggggttattttaggagtacactgtgtgtttagcagtgggaagcccagatgttcttgtaatctgcacgctaagctgtcactttctggcccttgtgtgctctttctgtggatactattgttttaactttgctttttcctgtttgtgtatcttttatctatacttccttaatattacccgttttcatttgtcattttatatggcctttgttggcctaaactcttttctatttccttattgcatagcttataggggtaaaatgagaattttcactttcccccctagaaaacattaacaatctagaaatacatagagtaaaatagtaatattaaactctagcatatgtgatgcagaaattaaacatgcatcatggatatgtgttccgtgtcttgtgataacatatgcttggt

SEQ ID NO: 129386 - DNA, 1048 bp, Homo sapiens
tgggattacaagcatgcaccaccatgcacggctgatttttatatttttagtagacatggggtttcaccatgttggccaggctggtctcgaacacctgacctgaagtgatcccacctgccttagtcccccagagtgctgggattacagccatgagccactgtgcctggtctattttgttagttttttgaagctcttgaaatgttaggaagaatatagctcttggtgatacgagttgcatatatttttttgtcagtttgtcttttgattttatagagcaatgagtttcaaccccattctgatttcatggtctatggctcttcgtcactataattatgctacctggaataatacatgtttttcattcctgaaggtttgtttacatgtaactatgatttaatgcatctagcattttgaaactgtcttctaataacaatttcttcacttgatagacacggcatcagcgaggagatacgcatcctctaaccttagatgaaattttggatgaaacacaacatttagatattggactcaagcagaaacaatggctaatgactgaggtaagaatttagttgattatcaagagagatttcctgtaactagaattttcttttttttttaagacagagtcttgctctgttgcacaggctagagtgcagtggcatgatctcagcccactgctgactcagcctcccgagtagttgggactacaggcatgtgccacgataccaggctaatttttgtgtttttagtagagacggggtttcaccatgttggccaggctggtgttgaactcctgacctcaagtgatccgcccacctcggcctcccagagtgctggggttataggcatgagccactgcgccttgcctagaatgttttaatatggtgaaatctgataatgctttttactttttcttaaaagaaatggtgtagggtctttgttttttgaatgtacacatttataagattgatttgttggttttcatataattttatgttatctgtttcaaaatgttaaaggtaagactttgtgtaatagttgtaaagaa

SEQ ID NO: 129387 - DNA, 1040 bp, Homo sapiens
acaggcatgcaccaccatgcctggctaattttcttatttttagaagagacgaagtctcactgtgttgtccaggctggtctcgaactcctaagctcatgtgattttcccacctcggtctcccaaagtgtttggctttcaggcatgagccactatgcctgaccaagactttgaatcttaactaaatttattaaagcgggatttcatttttagctaagatggctaagtaatttcaaatttgctcccttcttttgccaaactcttattcacgattagttactagttgcatctcttgaaaaagacagtactatatttgttattttaatttcatccatctattggttaaaatataaatcagatttttaactgtgctaaggcttttcttttgtaatttaatagacttagtgtctagctgagtctaaattctgtggtttgtatttgggttatagtataaatatgttagtatataactccccattattaaataatgtattttgacacgtaagtattcactgttgattcatttcatccatttattcccccacatggtaagcagttatgaaaatctattggctgtttagggcactaatggtgggaatacccagaaaaaaatgccaccctcagggctgtcactctgttgagggacactgacatttaagtgtcatgtttttgctactctgttaatatggtcttcacttccctatgtggcttacttataactttgtctgtcttagaacagtgaacttcagaatttttacttgtgctccctacagtttgaaaaactgtgtacccctttgtacatatttaagttgataactacactctgttagcaaagtttaaatagtggcactattcaagcaaaaatttaaatgatgaccagaaatacagaatttctggcatattgtagtatttcaataaaatatatcacttttaaatttatctaatggaatctaaatgtcattatttaaaagtataaaaacaaactcccttaatgattgggaattttaattattttttctttgaatatttgtgtcccatctgtt

SEQ ID NO: 129388 - DNA, 1050 bp, Homo sapiens
tgagaccagcctgggcaacatggcgaaaccccatctctacaaaaaataaaaaaattagccaggcatggtggtgtgcacctgtagtcccagcctctcagaaggctgaggtgggagaatcacctgagcctgggaagttgagggtgtagtgagctgtgattgtgccattgaacttcagcctgggcaatgggaatgcgaccctgtctcaaaaaatataataaaaaataatgtgataaagatatttataaaagaattgtggtttggtgttttaagttatttatactttgtttctacccttagtgagaaaattggtactttaatgtatatactcaaagattgtgtatttttcaccagaatattacagggtagaatatactagatgaaaaactcaagaaatatgttaccagcattaaaattattttagctgctcaagagtcataatcacacataatatgacgatgttattttgaacttcatttgcagatcatagcaatggatcatttaacttgaaagctttgtcaggaagctctggatataagtttggtgttcttgctaagattgtgaattacatgaaggtaagtacttttctcagatagcaaaagtcctatttaactttttggcaaaagaaggagattagggttttcagaagttaaatttctgtatacatcaaaatttatcaaaattgtgcattttcagtatgtgcagtttattgtatgccaattatacctcaagccttttacattgtattaatttggcattgtggcgagttaccaaagcatatttaatctgcattaactcaagggtacagtttaagctcaccatttcacttaataagagtgtgcctaggcagtaggtatatcacctcttaatgaatacaggctggcaaaaccaatgggaggatgtgattgatttttcaggttattacttccattgatgtgagaagtaaaaagtacatagttcaggcagatgatggtgatggcttctctgcatcttggaggagaaaattagacatttactgagagtcttagaaaaacattgactcacaaaagaatt

SEQ ID NO: 129389 - DNA, 1045 bp, Homo sapiens
ctgaacaccttgggagaatgaactacgtaggtaatatttcataattgaaacagtgaatggaaaagcacctataaggcattctttttttttttttttttaattttgagacggagtctcactctgttgccaggctggagtgcagtggcactatctcggctcactgcaacctccaactctctcgttcaagtgattctcccaagtagctgagactacaggcacgtgccattatgcccagctaatttttgtatttttggtagagacggggtttcaccatgttggccaggatggtctcgatttcctgacctcatgatctgcccacctgggcttcccaactgtaaggcattcttaatgttattgttacttttggaaacatggtagacttcagtgtgccaattaattaagattgtaacaaagttagttttaaaggaaaattgcatatgaagtttcattttagtctcaaaaaaggatactcaataaagacttcactaatctcaaaggagtatggtattgccatctagaagctgttcttttggatctctgacagttgttacatttgacttgtggttgttctaatgcaatcttttgtttaaattattattaccaacctggtgccagagattggttctcctctccccttttacttaacctctctctttgtggatcagccacatgggaactttataatatctgatctcatgccttgctaatagaatgtgtacttctaaaatgtttttctagtatttatgatggattttttactgttcctggttatgactaatggaatgcatttgtgatgcagtggtgacattagggtttctgcttgtaagaatgcaacaaaatgatagatattttgaaacaaatgatcttttgtacagggttttccacaccagatagagaaggagaggggggtgtttctcaaagtgggtgggtagtgctgtgatgctttttaaagtaagcatccatgttcatgcagtggcagtgcctgtggctttttattcctaatttatctgtaaagtttactttaaaataattgtgatatcttttt

SEQ ID NO: 129390 - DNA, 1058 bp, Homo sapiens
aagacagaccaaactgcagaaatgaaatcgctcagagaaaatgaaattagcaagtaaccagttaaaataaaaagctatggtttactctgaggtctggatatagatcaggttcatgtaaaatgtaatgaattttccattaaggcacagatggtaagggtgcttatcaaatagcacaaggcagtcttcatattttcataataaaatcctaccaagcggtgaaacgaatacattgctttttcttgatatttagtaggagcaaagctttctggttgatttttcagggtaaaatattttcctattgcatcataaggacatgtaccactaaataaaaaagatcatataaacctacctcttgtctgagaggatgctgctgaagcgatggtatcgtctgtttgtaatgcagtctagtgcacagccaagatggagctgtgcttctattggttgaaccacaatggagctgacagtttcctctatgttcatttgcattaagtcttgccacccttaagagtaaatcattcataaacttgaatagagctgtctggggtatcaactgtcatcccttctcctttatttttttgttcttaagctaaattcctatataggaatttgtgagttactaacaaattgatgattctttagtgtttcattataaaatttcagatccttcagtgaatacttcagtgctagggctggaagataatgtcgggaaaggtagtaacctaggaaacaaacagtccaggtttgccagcctgatatttccttcaggaagtgtgcataaaatcttataaatttttcttgttcttccttttctttcattacttgttccgtatataatttttgcactctggaagtgattatttccatgtggtggtttgatttaggaggaattatgaaggaaaataattggcttttagctctgcaagttggaagagggctcatttaggtaaatacactacctgcattcaaaaaatagtctctaaaatgtaaatggcaaagtgatctccaggttggctctttagagacagagtatttttagttactgtgtattatttagagtt

SEQ ID NO: 129391 - DNA, 1212 bp, Homo sapiens
gctgtatttatggtaaaagcctttgaattgaattctcaggtgcttttaagcatatcactttgaaatgtgatcagttaatcctaatagcctgtaaatatagagcaactcacttaatttaagctctggaacttaggccatgtctccagtcagtttggtgaaacagcaatgagcctccatctgtgctaacaatagacatattccaagcaaaatgcaggctgatgatagagtgttaaaacaatgtgggtggtaggggtttctgttgacagtttacctgaaatttgatttgtaagttaactgttttatttgacaaagttatttttattttatctgagacttttgtttggtgcttctgtactttctgtagcaagcacaaatggtttctagataattaaccccactgtgctgaacctggacagatctagtatcttattacagcaacctttgggttttgcaggggatactttgctcaggctagctgaatgccgactaagaaaaggaatagaaattatgaagaaaaaaaaaacaaaaaccctttaaagattaaataaacttaccagcaaggtaaaaggacagaagctggctctttaggtccgatatagtatatagatggagttctaacatctagtaaataactaaattttcatgcttgaatagtataaaattagaaatttggtcagcagttaatattaatttttaatagacatgaatgattgctctgagccacgaagataatcttgttacctagaaaggtacttactctcctttcttaaccagttcttcttaggacatatttttattttaaaatgcagtttatcaaaaggacttactttgtatttattttgaggatcagtttaagaatgacttcaacattatatttaaatggtgtgataaattgatatcaaaaatgaaaggctatttaagaaggtttttgtttaatagcatgactttatattacgagagagaaatttcacagtgaagaaatactttaattaaatgttaaggaagtctgaagctgtataaattatctgttcagtgtagtataatgcagcccatatagtgataccttttatgatcttttatataaaaattaaaattgtgataatttcttggcattctctgcatctacattcaaagcaaaataaaaataattttgaactattttctcatattctaaaaaatataacaaactttcttataagtaactatttttta

SEQ ID NO: 129392 - DNA, 1499 bp, Homo sapiens
ccaaagtgctgggatgacaggcatgagccactgtgcctggccttcagttgctttttaataattcattaagttgatgtgccacatttagttaaagtcttagttattttcaattttttgttattttgagtaatgccattgtaaaaaatctttgtaccttgagcttgtacatttgaactaagtgcttaggatacatttccaggagtggcatttctgacttaggggtagtgtggtggttaagagcatgcttttgtttgctcatgggtgatagcaaaatagtgttagggtcacaaaatatctatatagcccttggaattccaagaaataaaactgccatatttcaacaggtgttgagtggccctatcttttgaccttttttggggggatggggggaggggcagtctttctgccttggttatcttagcctttgagagtataaataagagaggtaaaatgaaagaacaaactcaggaaatgaaggggtgtagtagtaagttttagtttgaaaatagactaggcctttcctatatcatgcatttctaactaaacagtaagtcagttttgtgagaattttgtgcaaatatacttgtggcatttttgattattttgagactttttcatactaatcctacataaaactcaagtcattatatatttatataagttgttttcagtaaattagaaaatactactttttaataaataggaactttatatatataagtggaagtattttacttcagacttagaaacatgttttaaatagcctttttgttaccaacacactattttttgtctacatgaattggttagttataaaatcattttagcatcattagccttgcttgtcttttccagcttatcttttgctgcttaatattgaactctaggaatcttttatccagtttttgaagtgtcagtattaaacagattagtaaattcacattcatgaagttttactgtatatttaatgaaatggctatacacacaaacagtgcatgtttaacttttttttccccttctactagaaatgttttaaccattcagtcagaatttgttttgtagcaacagttggcctcagaatatattttttttctcagaagaggttgagctgctttcagagattttgttcatcttctatagagtgttagaccacttcagtttcacgttttctgatgttgtccatcatacttctaagagggttgggttcacttttcaagtctttcacggttttgttttttacacagcagcagcagtcaagcacttcataaaggaaagccagcaccactaaagataccactgtaaatataaataaaagcaggatgacaaagcaggcagtgttccagttgtcatggaaagggtaaattttttgaacttgaaaaccaaggtactgataaacagaggtagtggtttcattccagtggctggaagccattcttagagattccacttgctcttttgaatctataaaaaaggtagaaaatgaatttatgtagcaaact

SEQ ID NO: 129393 - DNA, 1049 bp, Homo sapiens
cgagtagctgggactgtaagcacacatcaccatgcctgcctgattttttgtatttttgtagacaggaggtattaccatgttgtccaggctggtctccaactcctgggctcaggcagtctgcccacctcggcttcccaaagtgcttcagccactatgcctggcctctttttttcctataatggctagtacagtgcttggcgtgtaataagcgctaatgaaatatttcttgagtacttgaataagtgaataaatgcaagtgctagagaactaataataaaaggtaattttgtttgggaagtaacttgttgagatctgtggatttggagtgcaggtttgagtgacttgaatttgtattaaagacacttattttttctttgtagcattatggatccaagcctgttgagagaaagggagctgttcaaaaaacgagctctttctactcctgtagtagaaaaacgttcagcatcttctgagtcatcatcatcatcgtcaaagaagaagaaaacaaaggtagaacatggaggatcgtcaggctctaaacaaaattctggttagtaaaattgtttaggactgtttggtttttattcagattattcaggaggaaaccgtttagttatggctagttcatttttcagttcagcactcatgttgataggcactttgttgaatataaaggatgggacaagagaatttaagctcttaggatgttaatagtcttgtgctgtagttaaaatttaggttattacctctttaaaaaaactttatttaggtttaatttacataccatacagttcattcattttaagtttacagttcaaagatgtttggtaaatttacagaattttgcagctgttattacagtccaattttagaacatttccatcacccccagcagatctgatgtgcccatttgcagtgacttttcccatccctgccccggaaaaccaataatctgctttctggctctgtatatttgccttttctggatatttcctataaatgaaattgtacagtaagtggtcttttgtgtgttgtttttttcacttggc

SEQ ID NO: 129394 - DNA, 1044 bp, Homo sapiens
cgggaagctgggaccgccgttctcgaagcgaaacacccagcacgcgaaccgttccccggagcattgtctttaggccagaggttcattgagcaaacttttgggttggaaagagggaaaattcgcggtctgccgcctgactgtgcctcttccaagcctccaagttcacgggcgcggtagccaagcgaaccgtgtgtggagtttgagcagccgcggggtccagccagctcaagactgtgatttaaaatgatgctcatacgcggactgctttctaggctaccttttggagatttggtttgtgatgatccctaaactttaacgatagtagttgatttctgcagtctaaacaacgctgcggcccccttttcgcccacctccccacttccgtcatttaagggcgaagcagcctgcttttcatagccgggtcctgaggtgccagggacactaacgaggctgggtaaaagtgaaagagaggggaagtagtaaggttgaaagaggtcgaatggtggcaagaatcgtgggcttggaggcagatttcagtttaatttttgggttttccgtgtctgcccacggaggaaccagccaactccttgagttgtggttttgtttaattgtaaaatggacatggtgatgtagcctgtttactccataggggggtccagagatctaaaacttagtacacatattgggtagtctttgaaaaaggaggaaaagttaggcggagcacgtgatggtgaaagacagacattgcgaagctttctgctctagatgcctttgaacgttcccgaacctcacaggtggcctttgttttaaaggcctttaccagcgttccaggtctggtgtaaggagcacttgagttaggagtcaggaggtttggttcctggccctggctcttccatctgtgcgaccttaaccagacagcttcacttcagatttcacgtattaaaataggaataacactaatacctgtttgctcctagagttgcgagggtcaaatactgtaagcatttagtttgttgtaaactgtacggctttatttactttttt

SEQ ID NO: 129395 - DNA, 1051 bp, Homo sapiens
tgagaagccggcctgccttattttcttttttcttttttaatgattaaaaatagtttgtggcaaggcacggtggctcaggcctgtaattctagcactttgggaggccgaggcaggaggattacttgagcctacaagtttgaggccagcatgcacagcatagcaagactgcatctctacagagagtaaaaaaaattacccgagtgtggtgatgtgcatctgtaatctcagctacttgggaggctgaggtgagaggatcacttgagcttgggtgaggtgaggctgcagtgagtcctgatcatgctgctgcactcaatcttggacaacagagcaagaccctgtctcaaaaaaaaaaaaaaaaaatatatatatatatatatattatttttatgaggtgaagtgcatcaaacttgggaaagatttgaggaggctgggaacctcctggaaaaccactccttgaagaaagatatgagagacatttagaagtgattcctgctttcagaaggaggtggattcaaatacatcaaaagtcccttcctctgctaagtgtttatagttcaatgaataatttcaatatttgtatgtgttcttgtcattttatttttttctgaaaaacttccaaaaatttgaaaataaaattacagccttttcttcttataaaatttgttactgtgagctttaattggtacacaggaaattggtttattttctaaggatatttcacattggagaatcagttgcctgtgcttacgggggtgaaaagagagttctcgtataaaaataaagatcgaaggtataaaagaaacatttagcagattaatgattgagttggaagaaaagcctagaaatcacttaggtctttaacactttatttctattaggttttaccagctagttaaatttttccaggattttcattagtcatccagtgttactgaatacttttttttttttttttgagacagggtctagctttgtcgccaggctggggtgcagtggtgtgatctcaggtcactgcagcctcccggggtcaagcagttctcctgcctcagcc

SEQ ID NO: 129396 - DNA, 1048 bp, Homo sapiens
atattgaatcatgaaggctcctacttagttatttcttcatgccagttatcattcattcagttgataaacattatttgtcattcttctcaagactaagaactgctatatagagaggaataatatgaagagctggccatcaccagaggctctttataagttcaattaagatcacaatatcagtcagacaccgtggctcacccctgtaatcccagcactttgggaggctgaggtgggtggatcacttgagcccaggagttcaagaccagcctggccaacatggtgaaaccctctctctgctaaaaatacaaaattagccaggcgtggtggtgcgcgcctgtaatcccagctactcgggaggctgaggcaggagaatcacttgaacccgggaggtggaggttgcagcgagccgagatcatgccattgcactccagcctgggcaacaagagtgaaactccgtctcaaaaaaaaaaaaaaaagaagaaagaaaagaaaatgtttctcttcttttcccaggtggttgggatccatatgcagggacttgggtgtgatgaaatgctgcagggttttgctgttgcagtgaagatgggagcaacgaaggcagactttgacaacacagtcgccattcaccctacctcttcagaagagctggtcacacttcgttgagaaccaggagacacgtgtggcgggcagtgggacccatagatcttctgaaatgaaacaaataatcacattgacttactgtttgagttttatgtatttctttattttaatcaggatcttctgatagtggaaatttttagtacataatagaacttatttatggagttagaaatttgtagtgttatccaggattgattttcatttgatcacatctcacagtaattaatattttcaagttttttttttattaacagctctgtgctagttttttttttctgttttagcctcatcccaaatataaagctttgtgaagtacaattaacttaatgtacttgaatgaatagaacttgctactttttttttttttttttttgagacagagttttgc

SEQ ID NO: 129397 - DNA, 2069 bp, Homo sapiens
atataatgagatattttgcagatgcgacccaagtcgaaacacggaattcatttgttttacatacaccttatacacatagttggtaggtaactttatacgatattttaaatgtgtgcatgaggcatacttttgtctgcgtttttgactgcaacccttcacatgaggtcaggtgtggaattttctgcttgtggcatcatggtgctccaacattttggattttggattttgaatttctggattagggatgctcaacctgtaatagaatgtataggattctcataagccaatcattttgagttgttcgctgaggcatgacatatcttcgctgtattaaactatctagatagtgtaatgaacaatggtgtgaaactgtcagaactagggcattaaggtagatggataaatggctagtggaacaatttagctatgttaaaacagacagtaagataaacactgattttaaaatatctccatagttgcaatagctgctggccgaaaacttgcccatcgactttttgaatataaggaagattccaaattagattataacaacatcccaactgtggtcttcagccacccccctattgggacagtgggactcacggaaggtaggtatttaaaaactgaaggtcatttgtggtttccttcctctttcccctgcccccaactttaaattaggtctctgtcagctgatgaaacctatctcagccccagattacattgctttttggttactctcttgtcacagttccagttttctcccctgctactactttgagtgtacagtatctttccttcacaccaccctatctctttgatcttttttttttagcttttttatttgaactaattttaaatttaaagaaaagctctaaaaataatacaaaggactcctctctaaccttaatatttttgcttttttattttttcactctacacacacacatgtctatctttcctaagaactggcccttacataaaccgagtatcattttctttttttttttctttttgagacaagctctcccactgtcacccaggctggagtgcagtggcacgatctctgctcactgcaacctccgcctctgggttcaagcaattcttctgcctcagcctcccgaatagctgggactaccaggcctgcaccaccaccatgcctggctaattttttgtagagatggggtttcactgtgttgcccaggctggtctcaatctcctgggctcaagcgatccacctgcctctgcctctcaaagtgcagggattacaggcatgagccactgtgcctggcctttcttttcatctagaggcagaattcctcagcccttcttttgtcttatatgacactgacatttattttgtagaatacttctcattttggcgtggtttgatatttcctcgtggtttgattgaggttatgtatttctggtcatctccctctttgatagttcagtgtaattgtttagttttctgatagatgctttttttaatgtgcattgtagatgaagccattcataaatatggaatagaaaatgtgaagacctattcaacgagctttaccccgatgtatcacgcagttaccaaaaggaaaacaaaatgtgtgatgaaaatggtctgtgctaacaaggaagaaaaggtaaggaaaaatccagcaaactaaatagtgccttgcaaaatggacagggatggcagtattttgcaggggtggaaaggagggagaccaagcagttgagccttctgattcaactggacaggcccactttgatctgtcttacctgcattttggggttcttcataatatttcatctagaaggaggttccactccttttaaaaaataaagacgatgccaggcgtggtggctcacacctgtaatcccagcacgctgggaggccgaggcaggcatatcacctgaggtcaggagtttgagactagcctgaccaacgtggtgaaaccctgtctctactaaaaacacaaaaattagccaggcatgatggtgcgtgcttgtaatcccagctactcgggaggctgaggcaggagaatcacttgaacctgggaggcggaggttgcagt

SEQ ID NO: 129398 - DNA, 1029 bp, Homo sapiens
tatatacccagggagaggcactaattgtgcagttttgaaaagtttcctagtgatgctgccgtggcctactttcaaagcactatgcttaggtttaccacttaaaatgttattacatttttccagaagtacactttaaaatactttgtttttaaagtgaggcattacaatggtgtcatgagctgacattcccagccactgactggaagatttgggtcaacccagggaacaggcttggtttaagggagttcaagtgttggtggcctttgggtaaaagtttatgtctatctttgtatgtgggattcagtagggattttctttaatgttaaaaattctagtttcctctgtatttgctttccttcttcccctgtcctccctgagcctccacacatgtgtaacacattttatttgccaataggtcaaggaggttaaaaagactttgtcgggcttggaagtcagcatggttactgcagttcccggtaggctaccagtcatgaccatgattccagatgttgactgcctgctctgggccattgggcgggtcccgaataccaaggacctgagtttaaacaaactggtaagctggcttggtctgcccgaaacatttgtgaatctactaggagtcttatggttttattttccccccagacacccaaaacttgggtggattccattggattcttttctctttttcccatgtattcagtttgtgatcaaatttcattgcttcttcctttgaaattaaaaaaaaaagttttctcttctcttctttccttttcctttcttttctgtttttgtttttttctttttgtttttgagaaaggtcttgctctgtcacccaggctggagttcagtggtgtgatcatagctcaccgcagtcttaacctcctaggctcaagtgatccacccacctcagcttctggagtagatggaactatgtgtgtgccacaatgcccagctaatttttttatttttattttttttagagatgaggtttcaccatgttgcccaggctggtctcctcggctcaag

SEQ ID NO: 129399 - DNA, 1043 bp, Homo sapiens
tgtgtgtgtttcttttttgaggcagagtctttcagtgtcacccaggctggagtgcagtggcatgatcatgatcatggcttactgcagccttgtctttccaggctcaaagggtccccccacctcagcctcctgagtagctgggaccacaggcatgcaccaccacacccagctacttttttttgtagagacgtggtctcgcttgttgcccaggctggtctcgaattcatgggcttaagcaatccaactgcctcagctcccaaagtgctggaattacaggtgtgaactaccaagccctggcccatcttgggtgtttatccatgtattctgcagtactttcccgagaagtcctcttagacagcagctcaaatgggctgattgttctttctccgtccaagaaaaatgctgatgaatgaacttctctccctcattacagaaggaaaataatgttcttatctttttgtaacaaagaaagtaactagaatttagtacactgtgacttagaacccaaggaagactcctcgcttgatgcttagcgtgcatttcttgcagatttcgtttgatggtttgaattcaatattcttaaagtgtgtctcttttttttttttccaggtgaatgttggatgtgtacccaaaaaggtagaatttttatttctctttccctttacaatcctttttctatttggtaaatcataatcaaaatcagaatgtttccaaatagatcagttaaaattctttctgcaaaaaaaacccctagaccctactaaaagtagcttaagcaataggattgtttttgtttgatttgtgttttttaaatttttttatttatttttaattactttttatttttattattattgtttttttgagacggagtttcgttcttgtcacccaggctagagtacagtggcgcgatcttggctcaccgcaacctctgcctcctgggttcaagtgattctcttgcctcagcctcccaagtagctgggatgacaggcgtgcgccactgcacttgactgatttttgtatttttagtagagatgggggtt

SEQ ID NO: 129400 - DNA, 1047 bp, Homo sapiens
tagagatgaggtttcaccatgttggccaggctgatcccgaactcctgacctaaagtgatccacccgcctcagcctcccaaagtgctgggattacaagtatgagccaccgcgtctggcatgttgtttcatttttaagagacagggtctccctctgtttcccaggctggagggcagtggtgtgatctcagctcactgtagcctcaaactcctgggctcaagcgatcctcccacctcaacctcccgactagctggttctgcaggtagataccactgagccttgcttgaattcagcatttcaagtctccaaaaggttaagtatattgcttatctcatgatctcgtgtagactggagagaaatgcaaagatcgcccaaagtcaaggtgaattagagccttctgggagctttgcctctgtggttcgcttctctgcctacacacgtgatgggagagtcagcttaaggaaaagttgtttctaaattgctgctccctttgccccagggcctggggaacttgcggtcctgggttcctgctgagtgtactgattctgtgataagaataaccaggttcctgtggttttggcgagtagtacttaccaatgagagttgggtagtaagggttgatcatgtgacaaaagttcatgattgccaagtcacagtgaactatgctgcacagcagcagttggagaggcctaggggagagagaggtaggggctttgaaagatcagtgaacagcaggctgctcagtgaatcattgttcatctaggctgaaaacaattacccagcaacatgtaaatcataacctcatttggaagtgatactgtgtactttgatattatgatgtctataccctggtaaagctgaacactggacatgctttttttttttttttttttttttgagacagggtctcattgtgtcacccaggctggagtgcaggggcatgatcatagctcactgcaaccttgaactcccaagctcaagtgaccctcccacctcagcctccccagtagtcaggaccacaggcacatggccaccaccatgccctggct

SEQ ID NO: 129401 - DNA, 1026 bp, Homo sapiens
acgagaggacgttcaccgttcctcgcctcgatccaccggacttcagaaggctacacgcggcaggcgccgctcgggatccaggggccggggtgagaacggaggcggagaaacccctcaggctccgccaccggggcggggaactgggaggcggccccgcctctgggcatcctcctgggtcttgcctagcggcgggcgcatgcttagtcaccgtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctctcccgtgccatggcctgcaggcaggagccgcagccgcagggcccgccgcccgctgctggcgccgtggcctcctatgactacctggtgatcgggggcggctcgggcgggctggccagcgcgcgcagggcggccgagctgggtgccagggccgccgtggtggagagccacaagctgggtggcacttgcgtgagtaccgccggtttgttcgggcggggggcgcctctttgtctcggtctttcgggggacagcctgtgctcgttcctatggcgatcctgtcccccggcgctgggctttcctcttttccacccccgcaactccccattccgaagccaggaacccagcaggtggaggagagagaggcgtccgggggcttctctgcggcccgcaaagccgagccagcgtctgcttccgcacggatgcgatattgaccagggccggggcgggttagattaaccttcctccatcctcacttgtccaagtgggagaggattggattctgttcttgaccgcgtgaaacacaaaactgcatctgggaacattgctggtggcctgtgtgtagggacgagggtgacggtgccatagatcctggttcttgaaaaatgtaga

SEQ ID NO: 129402 - DNA, 1032 bp, Homo sapiens
cagaagttcaagaccagcctggccaacatggtggaaccccgtctctactaaaaatacaaaaattagctgggcatggtagtgggcgcctgtataatccaagctactctgaaggctgaggcaggagaatcgcttaaacccaggtggtggaggtttcagtgagccgagatcatgccatcgcactccagcctgggtgacagagcgagactcccatctcaaaaaaaaaaaaaaagaatattcctatctctgaactcatggcaagctattttcctttaagttctagaaagtttctttgaaaggtatgaaacttctgtctcattactcctagggatatgattttacattgacaaaattataaaatgttatggtggtctaaagggacatggtgtgtaaagtatttgataatgactaagccaagcttttcatcttctaggtcttatttgactggatgacgagaattgggtaccacatatctctatacagcctttctacttcctttcccagacggcctctggcagtggagggaggccagtcgctggaggacataggaataactgtggacactgtactcatcctggaggagaaggagcagaccaactaggaaagaagggagagctccctgtttgcatgaagtcagttatgctatgaccttctggcacaataaaggcttcactttcaaatcacactataccttgattgagctcatggcagtaaactttgaacattgatatccatgggaataggattagaaaaggattgctttctatatataataatctgtggactgtgccattttacagtgtaccaaatgagaatgaggttgaaatgtatgcagtaaggtactcagtaattaattggtattttttcccagctgacatgatttctcagtgttagaaaacaaacccttagaactttcctttctgcctcttcaatccatcttaccacacaatatttcatgattcaaattcttcaaagtcttatacgcaggaatgtttattctgctgtatttctgtgaaattaaaaacttggaagaag

SEQ ID NO: 129403 - DNA, 1047 bp, Homo sapiens
tagccctatgaagcagttagttggaatgggagcatctgcagtgatttgcccatggccattccagccgtaagtgatgtagtcatggtgggaaagcaggactgctgtttctactacagtgtcttgttctttattcatttgttttctttgcaaagtcagatcctttatttgcttccttttttgccatttacagccttcaatttgacccagcgcctcgtcgtggtgagcctcatgttacacggcgcaccccagactacttcctataaatttctcctgggaaacctgcctttgtatgtggaagtatacctggctttttaaaatatatgtatttaaaaacaaaaagcaacagtaatctatgtgtttctgtaacaaattgggatctgtcttggcattaaaccacatcatggaccaaatgtgccatactaatgatgagcatttagcacaatttgagactgaaatttagtacactatgttctaggtcagtctaacagtttgcctgctgtatttatagtaaccattttcctttggactgttcaagcaaaaaaggtaactaactgcttcatctccttttgcgcttatttggaaattttagttatagtgtttaactggcatggattaatagagttggagttttatttttaagaaaaattcacaagctaacttccactaatccattatcctttattttattgaaatgtataattaacttaactgaagaaaaggttcttcttgggagtatgttgtcataacatttaaagagatttcccttcatttaaactaaattactgttttatgttgatctgcatatttctgtatatttgtcatgacagtgcttgcatcctatttggtgtactcagcaaataaacttttcattttaaacaaaaacattcatttattgtgttgtgcattaaatgaaaactttattttttctagaccaggtcttgctctgtcatctgggctggagtgcagtggcacagtcatagctcacttcaaccttgaactcctgagcccaagccattctcctccctcagcctcctgagtagctgggac

SEQ ID NO: 129404 - DNA, 1043 bp, Homo sapiens
tgcacacgtatatatacacatatacacacgtatacatatatgcgcacacatacatgtatacatacatatatacgtgtatgtatatacacatgtatatacacatgtatacatatatgcacacacatatatacatatatacacgtatatatacatatgtatatacacatacattaattagcatgtatgtatacacactatatataatactatagctaataatatgaatgagataggctctaataaaaggtattattagaaataaagagattattgatgaaaactggcccagttctctaggaagaaagtattctaaatttgtatttacctagtaatagcttcaaaatatataaagaaaaaattggcataattcatgagggaaaattgagaaattaattatgattgtgggagaaattcagtacacatccttgccaagatttcaagcatagatacggcaaaacaacaattagcgagctgcatttaacagactcctaggcccacgaattgcacagtattctttacaggtacacaaactattaaagatggagaccttatatagtaatatagacgactacatttccacagagagtacctgtagtttttgagtttagttttttttaaatgtgtctgtgtcaaaatcataatattataatgaaataatgaatttgtttttatcctgcagggatacaattggtgtcatgatcggaatgtggttaccattttcagtgcacccaattactgttatcgttgtgggaaccaggctgctatcatggaattagatgacactttaaaatattccttgtgagtaactgtaaattttaattgtatatactttcagaaggaaaattttaaatgttaaaaatagaagatttctgtttctgaaattggatgaggagtatagcaaagcccctctccagcaaaaataaccattagctggagaacattatttttaaaaaataatttttcaaagcttttggaaattgtcctaagggcatacagcaggtggagaaacagttaattcaagaaaacctactaaatctcagtaa

SEQ ID NO: 129405 - DNA, 1180 bp, Homo sapiens
taccataatgtcttcaaagttgtagcatgtatcagtacttcatttcttcatagctgagtgactattccattgtatgaatatgttatgtccattcatcggttgatcaatatctggtggtttctactttttggctgttattaataatgctgccatgaacatgtataaactggatttcatttctcttgagtatatacctaggagtggaactgctggattacatggtaattttaggtttaactttggaggaactgccagacagttttccacagcagctgcaccattttgcatttccaccagcagtgtatgagggttccagtttatccacatgtttgcaacacttattaactgtcttttttattatagcctttctaatgaaagtgttatctcgtggtttggttttcacatacgcttttataaggcacttttcaagtgtttttttccccaaattttcttttaatagataagaaatgatagttttaactttgtaattgttgatttcacttttctaacaggcaaaggaaattttaacaaaagaatcaaatgtgcaagaggttcgttgccctgttactgtctgtggagatgtgcatggtcaatttcatgatcttatggaactctttagaattggtggaaaatcaccggatacaaactacttattcatgggtgactatgtagacagaggatattattcagtggagactgtgactcttcttgtagcattaaaggtatgattattgaaattcaatttttttttcaagatttaaaccaggcaaaaggcaagaatgacagtattgcatatcatctgttttatggtctgttcagtttatagccccttaaaataataattggttttacatctttttaaaggagaggtgaaaaggataacttctgtgtattcccgataaatgtatcattctctcgagtagtccatagctgaagtcttggaatcatatttgactttatcacttatccgttatattgagtcagtagacaagtctttttaaatccttgctttgaaaagtctgttgttcctgtctctttctattttcacacagtttatcacttcacaattcgattgttacaatagcttagtaactaatatttctgcctccaagatctgatcccccccaaatccacctggcatacgctggccgatgaaatctcttatttaacccttttatat

SEQ ID NO: 129406 - DNA, 1021 bp, Homo sapiens
ggagggaggggagagaaagagcgagagaaggggaaagacaagtcgggagaggccggtaggcgtgaggcgggcctgaagcggcagcgggcggccttcgtccggcgagagctaggccgaggacccgcgccgcgctccccggcacctcaccgcgtccttcaccgactcccgcggcgcgcggccgggcggggaagggcgggcgggggtctcctccaggctgcgcgctcggagccgcctgctgggcttgggcggggcgcggggcccgcggccgccctacccggctcagtcctccccctgtgggacctggcgacggcggcggagggagaggggagcggcgcccgggccggggccgggggcgggtggggaggggggagggcggcggccgggctggggctcgggatccgcatcgggatcgggccgccatggacgacaaggcgttcaccaaggagctggaccagtgggtcgagcagctgaacgagtgtaagcagctgaacgagaaccaagtgcggacgctgtgcgagaaggtgagggcgccgcgggggcgagtgcgggagcgcggggctgggacgggccgccgctttcctgcccgccccggtcccgtccgcccctggcccggcgcggcccaccgggggcctgcggggctgtgggtccggctccggcgtccacctaggcggccggcccatcggttcagggcccggggcgttgggctgccctcgcctgccccttccacctccgcctcacgcccccggccggctgcccagatcccgggcgtggggggctcgggtgcggacgggcggggaaacgtagccccctgagccaagcaggaggttggtcggggtcgcctgcgctccactggggagttcctgccactctagcatttcccgagtggactagcgagagcgacgtccgaaaaggaccattttcagaccagtttctgaaaatgcaactaaaattaaccagaatgtcgtgcgtattaatgaacttgttaataaatgcagaatttttgtcaggtgaacggggcacc

SEQ ID NO: 129407 - DNA, 1369 bp, Homo sapiens
acaaaaacgtattagtctgttataacagagagggaagaaatctttggtgggaaggcaggggttacagctggtagtttaccagttatttatagctatttacaagtaatgaagatcatcaggcaggaggcatatgaattaaaaaactatactgaacaattgactagtgatagttttctacttttaaaagcctccattagaaaatgtctaatgcacaaaatagtttattacaatattggaaatatatttaaaatgtagagcatatcatcttcagtaggaaaagtatctaaatccaaaccacggcagtcaaactaggaaaatgttaacttgtatagtgccaatagaatgggaaaacgtaaagcttaagaactcttcccctggataaaaatttcaaatatatatttccattaaaattttatgaccctatatatttaaattcatttttatgtatgtgttgcacctaataggactacaggatctcatcccaaaagcgaaaacaaaatagtaccaagttcatgtgacagtctgaaaagaaatcatttaacgccaaaaaaggttgaaatgcaaagatcactacctggctcacttttacccttagagaacccaaaagacacttgcgcatcaaagtcggaaagcaaaatagacttaactgtttcatctgatcacttcagtggacaacaggaaaatttaaatagcatgaagaaaagaaatgtgaacttcagtgctgctgaaacaaaaagtgataagaaagattgtgctgcttttgcaatttgtgaccaaaaaagtgtacatggcacattttcaccagaccatgggacgcttttgcagaaatttcttaaaaattccccagatcccacccaaaaatcctgcctttctgatataaacccagaaactgatgtttctcttgtgcctgatgcgtcggtgctctcaaagccaattttctgttttgtgaaagatgtccatcctgatctagaaatgaatgacacagtctttgaacttcaagataatgatatagtaaattcatctattaaaaattcctcatgcatgacttctccagaacccatctgtatccagaacaaaattcctactctgcagataaacaaactacagcctacagaaactgagtcagaggacaaatacatgaaggatacattgaatcccaatactgtgcatacttttggagcatctgggcatataacccttaatgtgaatcaaggagcagagtactctctttctgaacaacagaatgacaaaaattcaaaagtcctaatgcagaatgctgccacatattggaatgaacttccacagtctgcatgtaacccaacatataattcttctgagcatttatttggaacttcatatccatactctg

SEQ ID NO: 129408 - DNA, 1077 bp, Homo sapiens
tgaaagaaagcaagaatgttcagttgaacaaatcctgatttcaagagaactgttggtagaccaaaacctgtggaataattgcaaacacacattaaaaccatgtgctgttgacactttggtagaacttcaaatgatgatggaaacaattcaattcattgaaaacaaaaaaaggcacttagaaggtgaaccaacattgcgaagcttgctttggtatgatgaaacactgtatgctgagcttcttggaaaaccacgtggatttcaacagcagtctaatttctatcctggtttccaaggaagattaaaatataatgcattctgtgagttacagacttaccatgatcaattagttgaattgcttgaagaaacaaaaagggaaaagaattcatactatgtattcttaaagtacaaacgacaggttaatgaatgtgaagccataatggagcattgttccgattgctttgatttttctctttctgttccatttacctgtggagttaactttggagatagtttagaagacctggaaatcttaagaaaaagtactttaaagttgatcaatgtatgtggggactctcctaaagttcattcgtatccaggaaaacaggaccatctgtggattatcatagaaatgatctcctcaaaggttaattttattaagaacaacgaggcagtacgtgttaaaatatctctttatggtctggaacatatcttttttgatgctgcaaaaaatcttgtttggaaagagagaacacaatccttcagcaaaaaatactcacaaaagaaggacgaagaaaggctactcagagtgaataaatgtgccttttctaagttgcagaagatatatgatactttgtctaaagatttaaacaatgaaccaatttcccctattgggcttgaggaggatactataattgcttccagaaagtcagatcatccaataaacgaagcaacaattagcatagaaaattctaaatttaacagtaatttgcttgcacacccagatatttgttgtattagtgagatattggatcaggctgaatttgcagaccttaaaaaattacaggatctcaccttgag

SEQ ID NO: 129409 - DNA, 1923 bp, Homo sapiens
gaacagagtagtactgcaggcttaaatgaggttttgcaatttgagaagagttcagataatgttaattcagaaataaaatcgacaccatctaattctgcctcctcctcagaagttgtccctggtgattgtgctgttcttactaatggtttggataccccttgctttaaaacttctgttaatgattcacaatcttgggctcacaacatgggctctgaggactatgactgtatacctcccaataaagttaccatggcagggcaatgtaaggaccaaggtaatttttccttcccaatttctgtgtcaaatgtagtgtcagaggttgagaaccaaaaccacagtgaggagaaggctcagagagcccaacaggagtccggtaatgcttatacaaaagagtacagtagtcacatttttcaggactcgcagtcttctgatttaaaaacaatttatcagactggttgccaaacgtctacagtttttccactcaaaaagaaagtaagcattgatgaataccttcaaaatactggaaagatgaaaaacttcgctgacctggaagacagttccaaacatgaagaaaagcaaacttcatggaaagaaattgataatgatttcactaatgaaacaaaaatcagtccaatagataattacattgttttgcaccaagaatacaaagagagtgagagtcataattcttttgggaaaagctgtgataaaatattaattactcaagagttagaaataacaaaatcttctacatctaccataaaggataaggatgaactagatcatctagcattggaatggcaaattactccaagttttgagagcctgtcacaaaagcatcctcagcactctgtggagtatgagggtaacattcatacaagtttagccattgctcaaaagctaatggaactgaaattggggaaaataaatcaaaattatgctagcattataactgaagctttcccgaaaccaaaagacataccccaggccaaagaaatgttcattgatacagttatttcatcttataacatagaaacagctcatgacagttcaaattgcagcataactagagaacatatatgtgtccataggaaaaatgaaaatgaaccagtgtcattagagaacattcagagagactataaagaaactgcttatgttgaagataggggtcaggatcacaatctgttctgtaattcacagttaagcaatgatatatggctgaatgttaatttcaaaaaacaaacagatagagaaaaccaaaatgaggctaaagagaatagtgcttcatgtgtagaaaacaacatagagaacatatatggagacaaaaagcaggattctcatacaaacgaaaatttcagcaatatagatgaaaaggaggacaaaaattaccacaatatagaaattttgagttctgaagaattttctactaaatttaacttgatttgcagagaagataatgcagtgtcagcagcaactgcattattagagagtgaagaagataccattagtgccgtgaaacaaaaagatactgaaaatactggaagaagtgtagagcatttggcttccacgacatttcccaaaactgcaagttcttcagtgtgtgtagcctcaaatgctgcaatacagatagctagtgctactatgcctgcattaagcctaaataatgacgatcaccagatataccagtttaaagaaacttgttcttctgaaagtccagattttggtttgttagtaaaacatagggtttctgattgtgaaattgatacggataaaaataaatcacaagaatcatttcatcaatcaataaatgagaacttagttcttcagagcattgaattggaaagtgaaattgaaatagaattagaagattgtgatgatgcttttatatttcaacaagatacacatagccatgaaaacatgctt

SEQ ID NO: 129410 - DNA, 1192 bp, Homo sapiens
gtattgtgtactgtacataatcatacatgctatacttttatatgactggcagtgcaccaccatcaccacagacatgaaagtgatgcattatgctatgacactgtgagacctaagctatcactaggcaataggaatttttcagctccattataatcttacgggaccaccattgtatttttggtttgtcgttaacaaaaatgtctactatggcacatgactgtattttaaatgcaatctgggggtagaaattgatagtttcaagttgaaatccactatatgaagttcattatagattgagggccttggatggtgggaaggtcccagaggcttgttgccaagagacagacattcttactctcacccattgtctgaacaagatctcctgctatagttactagcctttggaattttgagagcaaggaatcccagctacttctttacagaaggatatacttgtgctaaggacaagttaatactgacaattgttagcattctttactttttagaatttaattgtattttttcctccaccattgtattttgggtttagataatttaaacctagccgtaagtcacctaaaggaacgttggttatttagatctatatccagatctattggaaatgaaggcatttcatccatgtgatcatcatggatctggagttggatgtagtaattcagtgagactttgggttgttccctccttgtgaggtggattgaaagtgctttgtgtgaatgagcgtttttgaaagtatatgtgttagaagaagggtatgtgtgaaaaagcgtagccaaatgagtagactgcagttttcctaacaattctagatcatcttttataattagcctaaccattttttgtccaattccccttgctttatgagtttattgatgtacaagcctagtcgttatttttaaacaaccatagcataagacttgcttggaaatcctgggaaggtgaagtctgtttctcttctggtggctgtgagcaaggaagcctcgttgctaccagctttcttcttgtgaccatcatgggagctggatgtggataaagataaagctgtgcacagcagagggagagttgtggggaaaaacaagttcttcgtatcattgaggggccaagttcagaatctgtgtgtggtaagcagcataatgcttccccaaagatgtccacatcctactccccagaacct

SEQ ID NO: 129411 - DNA, 1096 bp, Homo sapiens
tattgagatagagtcttgctgtgtcgcccaggctggagtgcagtggagtgatctcagctcactgcaacctccgcctcccgggttcaagctgttctcgtgcctcagcctcccaagtagctggaattacaggtatgtgccaccacacccagctaatttttttgtatttttagtagagacggagtttcaccatgttggccaggctggtctcaaactcctagcctcaagtgatctgcccacctcagcctctcaaagtgctgggattacaggtgtgagtcaccatgcccagctgatatttttcatattatataaaaaccaaagttgtaaactcattttcttttttgggcaactggcaaattgagatggaaactttctgacagttgactaagaacattttaccatttacttttgttgaagaacttttaaatgattgtactgccattgccttttatgtatttattgacctttttgcttaataaccttgggttgattttaggccaacaaaatggaaatgaaagaaactgctaaacaggatacactgtggcaaatgagctcaactagcaaacccgtgttgaatactcgtgaagtcaatcctttgaagaaattcaccattcctaagatcaggaggacagctgagaaaggtaatatttctgtggttgggaatttttttagtaactattactgtatttctctgattcttagtttatgttcatcttttattttgactctatataaaattaggttaattcaggtctctaattccttaaacatacatgtacttatgtttccactcaaaatagaatagatgcacgttctgcatccttcccactaagtacacctaaaaaccctggacatttttatgaaacaaatatgaaaagactttcgaaactggagagaagaccaaccaactagggaatgtgagactcagggaatggcatagcagtaagttccctcaattttctttttgtttcctccatatctcagactagatgcccccaacacagaaatgccagctggcacagacctcccccaaaagccccaagaaaaacctcttctttcttgccagtgaactaagaaaagggcagcctagaaagttgga

SEQ ID NO: 129412 - DNA, 1013 bp, Homo sapiens
tcaccgaccaccgcacccgacagaatgagtctggtaaaaatcttcatgctttagatccctgaaacttggatgtacttgttagctccaagctgaagccttagctaagggatttggccattagctgagcaacataaagtcctccccgatcttctaactccttttgaattaaattagaaagccatgacaaaacgatcgttttgttgaaggcccactccgtgtacacggagtaggcactgaacacacagtttgcttcaggacatggaaagtctctcaggagtccgttcctgcgcgggccccacctacgggcttcgagcttccacgtgcagggcctctggctccgcccccggcgcagtgcgcaagcgccgctgctttccgagctgcctgctcactgtgcgcacctcgctggggggtgctgctgtgttcctgaggcttccagggaaggcagtgggcgaaggtctgtaccgtgctaagattgagtctgaggaactgactgagcaaagaagacagctcaaggtttgtggggaatgtggcagatgaggagaggagggttagcagctagtttggtgtgaggtaaattaaaattaaggagtgaagaatgttaattatggggagtctcagacgctactcttctggctcggagcttcccgattaaatttatttttaaaaataataaattttttaaaaatgttaattatcattgattcagggactctggggccaaaggtgggcctccgagggccagggcagccgactctacaggtgaaatgtttagctttcctcagatgcgcgggttcccgcgctttcgctctccctctgcccccgctgagccccacggagctggccctgcgtccttgtttgcagctgaggagaaactcgctgctctgaggcagcgagaggagagagcgccacaacttggtggtggcctccgcctcgccctggctccctggaggcgcagtttgtagtcagcagaaggcagcgcggagcagccgcgttgcgcagggcgcgtggggatc

SEQ ID NO: 129413 - DNA, 1059 bp, Homo sapiens
atcactgacaatctaataaacttgtttatatgtgtgattagtttggattcttaattattttaaggaaagcatctcagctctattgggccccaaaagttgattttgtgtttatttcattatgtcatttgtgcccccaaattcgtggtatctttataaatttcaatgcagtttgtctggcttccaaaatcatgtttaggtaggatctatagaaactagacctatcagaactggaaataagtaagttgagaagatcaaaaatgtgccaatccagtctattacagtgcctttattgtaatttattaataaggttttatcacctggttgagccgggagataacacttgcacgaaagcaagtatgccttcaaaacctttattgcaactcacatgacattgaaaaggccatttctatatgctgatattaaaagttccacttctcatatatgaaaatagggacaaaaaaattaattttgaattttccaggacaaactgacatcatatgccagaatgtcatagtagataaactcatgacaatggttttattggatttttatcttctgcatctatattaaatcacaacagaaggccaagtgaacctgctaatatcttcatgagggcagagggctgtttcttccaagccagggataaattcaatataaaggcactatgtaaatttgcattccgaccttggtactttgcctaactcaagggtaatgttaaaatttgaaaagaaaaaatcgaaacaaatgtattaaatctccttgagcaacaatcattgaccataaatagaagatgatcaaacctatcaatcagtcaaagaatctagcaggtatgatgactgaaatgatattcccataccactatggttctttattatataaagagtttcaggcccagtaaatttttgcctcaaatagctattaaattgtgtctaacttctaacatcagaaaatgaagtttagagaatagtgccagtgtgaaccctaagcttgcttctgtgactatctgaaataaatgcaatatttactaaatcacagcctctcaccaaagatatttctaca

SEQ ID NO: 129414 - DNA, 1881 bp, Homo sapiens
agtatttctccaatatttaaatgctgaaactatccaagactattattcacaaacaacggattatattttaatactcagaaactgtaggaaggtttgttaaataagatgaatatcctgtgattaacttgccagtatgttgggttcagtgatttattatgcctggtcttttctgattttagttaatgtttttaaagtttgttaattctctcagaagatgaggatgccaatttatatcccattatacaccctcaaaagatgaatttatagaatgggccatgtctttaacatgcttctatatagtcattcttatacctaagattcagatgctcaaggaagggacccatttagacagttatttaatgttctttgactatgaactaatcctaattttaattttagtacttttatgttcttaccagctttcaccctaattaaatggggcactacaccgcagagtttagcctgtggtgtagcagagcccaggtcatctgtcacagagaatcgtaatcttacattctctctctcctctgaacaatagaattttgaggtgggggagaatcttagtttataatgaggcaactctagttttatcacactcagaaacaacaaaaatattcaaaatttaactttctgtgcattccatttatttgcaaatatatatcagtatgattattacatgagtaagagatcttcattttttactgtcatccctgatttgccaaatttgatggagaacctccacagagttgcatattattttatttgttccacatgttggtgctttgttctctactgtccttttgtcattatattatctctgaacatttccatttagtgtttctatttagagtaaagaaatagaagcatgaaaattaataacccatgcatcatattttttgctggactttataggaatgaccagctaaggctagaaacctcagtgtttaatactgttttcaaaatttgattgttacatatattgtcatttcagtgactggagacaagatgtatatgtagacaaatagataaaaacagggtaattaaaccagtgtggtttttttttattttaaaggaaaacacatacgacttatgtacattgcatggcagagtattactaaaattcgcctaaacaaaccgtcacgatgttttcaggttttatggtaatgctttgactatatagtatttggatttgaatcctcataatcacaaagtctcttagttgtttaaaacaaaaaacaaagactatactgattctagaaagtatcatctccttgattatatttgtgctaagtgtatgaatctgtgctataccagtatgaaaaaggtaaaactgtatatatatttacattttgaaaagtagcattgtgcattttagaaaaatatttgtcaacttgtggcactttggcaaaggaatgtgcaattataaaggttaatgccactttatttttttctaattcccagtaattattcttactaggctttagagtcaaaatcaaacccaattttaagactagcacttttttcctactggtaattcctgtttttctaattacacaaaatgtttaacttaaactattctttgcaatgagttttagctttcctcctctatcctaatttcaaaacctttaatttaagaaccatttaaaattaatccagtggtaaccagaagaatattttaggtatcatgaccacttaatcttgtgcctgattttagtaattttctgataaaaataactgaattcctgaaaaagaatattcaaactttttaattagttttcattggtcataaataattgagtagttgatgtccatatagtcataatttatctaaactctggagctgccaagacaactaagtacacagaagtgcttaaaacacac

SEQ ID NO: 129415 - DNA, 1048 bp, Homo sapiens
tttgcctgaaggtgtctttgggggtaatatgacaccctcattttacaagagataggaaaaatatttgtatgactttgacatcatttaactagtctttcagaacttgaactatattaagtggtacttccactgttcagtgtctgtttttcttattacactgattttgcttcagaatcagtgagattatatagacgtcattcagaatatttgtttttatccttcaactcgaagagttttctcacctctttattttcaagttgaaaacattattataagagtatgttagcgggtcatttgactctgaaaaaaatagctttttaaaggttgatcacactttaatcttcaatttcaggatagtaaagaaccattataatttaggccccagtgactgtcataaaacagcttttaccagaccaccatcttaatactgatattttcctctttcatatttgaactatatttttttctataatctagctcttagaactctattttcctttgatactaatgattcctcttgccctcagaaatgtttacatgaaacagcacatgactgtcctttttgttgatcccaaaactttttattgttcattctagagaggcaaataatgtccttcagtgtcactaattgagtttttaaaaggaagatttgatagctaagaatctgttgtcttgtatcaatttatcatttttacaattgggtcaagatatatttatgcaatttttatgttaatagcataatagcagtagcaatataatgtgtggcttgggagtttcagagctttttaaaaaaaactaagtatgtgcctatgcttttcctttttaaccatattgaatgtgtaatgttgagttagaagacactgtgtgaggtaagaaatggcagttcaaggggaacaagaacattcgtttattcagtcaacaaatatggattgagttcctcccataggcccagcattgtactagggaaattgctcactatttttatttttcccctctaacctaaggtggagatgataatgaatagtaaaattacatgttttagatgtct

SEQ ID NO: 129416 - DNA, 1667 bp, Homo sapiens
tcagaacttaacctcccctcaattttcagcttctaacctaagctggacactaatattttgccagtaggaaccttttattttttgagacagtttcgctcttgttgcccaggctggagtgcagtggcgcgacctcggctcactgcaacctccgcctcctgggttcaagtgattctcctgcttcagcctcctgaataactgggattacaggcgcccgccaccatgcctggctaattttgtgtttttagtagagacggaagtttcaccatgttggccgggctagtctcgaactcctgcctcaggtaatcctcctgcctcgtgcttccaaagtgctgggattacaggcatgagccgccgcgcccggccaggaacctttatatggtacaatgaattccagcctgaaaattccccaagttctgagcctttacttcatacatatttaccaaatatatcaattattatattaaacttagaatgaagaatgactgtaagatttataatgactaaagttagtttgcattatttttcttcaagcgttattaaaccgtactcctctttaagcaagtttttgggtcactaggtaactatgtgatttggtttgttgatcaccatttattgtttgactcactttttcaaaggcccaaatattatatttaatgacataccaagctctaattcaagcagtgccctctgttaaggtgatttgcatctgacttgaagcatattaaataaaatctacattttatttgatgcaaatgttttatatttatataaaaaattaatcttgggtaaacacaacttgattcttaaattagattcttaataactcaattctaaatgattacttattaaatttgtcacaaaataactataaagtgaacgtgaatgctacattactcagtatatctatgctataattaataaactccaaaaattagttgtgtattatttggactactatttcaatcattcagaaatttgttttaaaaaatccttgcagtcttgctgctgacttcatagcgtgcagtagtgtgatatggagatgatgcactgtctttcagaagccttggctctatgccttctagctgggcctggggcaagtcatttagcctctgtggaccccagcttgcttatccataaattgagggaattggatcagagtgatgatctctaagaaccccttcaatttctgtatccctgaagtcagtgaaacttctcttaaagttagtttctactttcttctttggccttttctcattttcttcccactccccttggtttcgtctctcatctgacatttattgaccatcctttccttcttggcatggttcatatttagttatggccactttacagtgttgcagtatgctgcttctctgcctaatttgcccagttcccatttttaccctgccattttaattttacatataaattatcttggaactaacacaaaaactagttgatcatgatatattatatatataatcaataagacttatcttttggccctgtacacaaaagttttaaagaggcaattcttccagttccaagagatttttttagacacacaacctaaaacttgttggagtatattttaaacttaagtttcccatttgaaaaatcctaactccttaacttgcatttaagtttaaaagcagagacagtttctt

SEQ ID NO: 129417 - DNA, 1085 bp, Homo sapiens
cccggccagggctcactttaaacacagagaggctaaatgcataaatccaggtgtttaagattttgtatgctatcatattggccagctttctgggcagtgattactggaaatgccagtttctcacccgcctcctaaactcaagttctgtctgtctggtcttacttgacatcagtccactggtttcatactccctggatttcacaaccaaacattcagagtcttcagagccaagcgactggtctttcagtctcaaaagttgaccctttacgtctcaaatgacatttctcaacctcttttttttttaaaatatatatgcagtataaacctatcatttatcaggagtagaaaaaaattgccttagtcaatctagttaatctttgaatgcctcacttctggtggtggtgtgtttgtttgtttgtgtgtttgttttcaattgtggttaaaaaaatgcatagcataaaatttaccatcttaagcatttctaagtgttcagtaatgttgtgttcagtagcgttaagtatattcaccttgtcatgcaaccaatctccagaacttttttgtcctgcaaaactgaaaagctatatccattgaacaactccccatcttcctttcccccgcaagcctggcaactaccattacactttcttctcaaccttttctttaaaataagcaatatgttttcttaacctttctcccatccataatgggtttacagttattgctatttagctctccaagtataaagcttatctcctgtattgttagaattctcacatgcaaaaagatttacaattacaaagcaattgtgctaataagatatgcttataatctttgagtgaaggtattttatcctggaagcttttccactgatttacagggggaggtaagcctttattcctcttgagacctatggatctcactttatgcttcctggctggtttggtattttatttgtttgttgaaggtttaagtttagagttaccagggcaattaggcttaaatcctagaatttccttggctttttcctgtctacattctaagactgttttaccataacactttataacgtaagtagtagattggaa

SEQ ID NO: 129418 - DNA, 1077 bp, Homo sapiens
cttagtttcaaaataaatcttatcaatatttttggaagttttattgatttcttacaactttttcctgccatcttattgatgtctcacaacttttcctgccatactcctccctatatcattccactcattttcatatttaattaccaaatttcctcctctttctcttaattccagtacaataaacagataattctccatttacagatacatatttttccccattactatagggcactaattttcaaacttcagtgtgaatacaaatcatcttgatggtttgttaaaccacagattgctggccccagctcagagtttctgttcagtaggactggtgaggtggggagaagaccaagaatatgcatttctaacagtcctaaggagagtggatgctgtgatctagggggaccgcactttaagaaccacactgctgtcagctgatgagattttaccttagctacagaagatagtgatggaaaaactcggtcaaaacaactagggtatctgggtagaaagaagactgagagctactccttcttctgccttgacaagcttacaaatcttgaaacaagcaactttttaataagttgaccagagttttgtaaaaaattattttcttcccttttgaataacctttctgattccctctcatttttcaacagctatcttgagagaaatctgataggaattaacagttatgaagcctcatgtgaaaagcttagcttttaaatatatggagactgatgcatatttttaatttattttgtaattatagtatataaatcttggtaaagaaaagtgaacaatttctctacctaagaattattaatacaagtttaatgactattaaatattaggacttaaaagaccttggaattaatttaatcccttagttttccattttgtgacatacatcatgtagctcaaattgttcatagttactagaatacgctaagtaaacagaatttaaaggctagagcttaaattgctgattatctcaagatatataaatggtgagaaatatactaatttcttctaaaagcatatcgcatttttaccatcttcctgtatcctctctgt

SEQ ID NO: 129419 - DNA, 1092 bp, Homo sapiens
cccttgccattttgtagaaactttcctcagcttcccatcagatattctaagcaactttaccaaaagaagtcacctacgtgccaaaactgccgagcaaaataaaacaacagagccatagaaaatgatgtaggagtaaggataaagatatatacagacacccaaattcacaacattccttatcatttgctaatttacttcagagactgttgtattttatttcttggttcttcaaactagcaatgtggtttattccaatgatttgtcagtctagaatgtcaatagaacaaaatcttttgctgcttagtaaatgttccaaaaagggtatctcatgttataatcagttgtaaaaatagaattctaaaattccattcattataatcctctttccttcttccctcctgtacactgtaccctattggaagtgggtaagggcattaatttctttcactatcacatggacccactccatcctatttatttgttcagaagacaattgaaacataatagagaccagagctgctctttgaaaatctagaaattgccctgtgagcttgatctatagactgtaagaaagaagggttactacttcactgaactgttctccacgctcttgccagatttctatatgacagtttaggatgaatagaaaacagatttgacttgggatgacatgaactgaaaggtcagttcctccagcttttcaatacacagtgcatcttcagaaaatatttttgacgagcatgattgacaggtaatttcagaaatgaatttaggctgggtgtggtggctcatgcctgtaatcccagcactttgggaggccaaggcgggcggatcacttaagttcaggagttcaagaccagcctgaccaacatggttaaactccgtctctactaaaaataccaaaattagccaggcatggtggcacgctcctgtaatcccagctagtcagaaggctgaggcaggagaatcgcttgaacctaggaggcggaggttgcagtgagctgagatggcaccactgcactcctgcctgggcaacggagtgagacgccatctcaaaaaaaaaaaaaaaaagaaagaaatgaatttggtccc

SEQ ID NO: 129420 - DNA, 2573 bp, Homo sapiens
acttttttttaacttagatatcatacttgagctagttaacatatcacttaatttgaaatatattaactataccaaggaaatatcaaggaaattttgaatgaatcccattggtatttacttaaagtgcaaatatatgtgtattttaaatatacaaatattcagttcatcctactagtttcctttctctcttcctagccatcttgccttcctgtattcccctcacaaatatattggtctttttcctgaagtagtgcacttcaggagtgccaggatattaaataatttaaccaagtgttatcttaaaccgtattccctaatgaaaaacacccatatttaaaagctttaataaagtatcacgttcagtcaatttttactaattctgttactattatctttatccaaagaccttgcccttataagagcaaatgagtattagaactatagtaaaaaggtatatttctgttgaaatactttattagcatgaagcctttatctttatgagaaaggtataatgttcatttagcaacctcatcaaatccaagtttaagcaaataggtaactctagacccgattgtttaaagcattgatttttcactgaaggaccaagagtctgtcagtagtcttgggaccaaaggcagtgggatgatttggggaatgagtaaaaactggagtgctgtgaggttacaagtacagctaaactgtctctctggtggaagaatataaaatggtcaatataattttttaatgaagttagcattattactagtcctataaacataaacaaagctgccttaatagttttgtgagcacccgtccccaaaaatcataattctcttttcattcccatcaagagtgcattttgatatgacttttctattgaccaccaagaaaaaattatctgaaaaatgaaagatcccatacttgagtcctgaaagatgctatctaattatgaattaaagcaaccagagtaaaagatccaatacaattgtaaatatctttaaaaatgtgggttgaggaagaagaattttttcatggattggtatccgtgaattttatgaacatgtcataaggtttaaaaatttaaagcattgctttaaactttagaataataactctatatttggtagcataatgtcctgtttacaaaatgaaagaggtgttgttaaaagataagatcctcttaaacatattttaaaagcataaaagtttgctccctttattttcatgctgaataattcattataaaattcattaaaaattcatctttaggaatgaattttgcttaaatttaggctaaagcatattaataatttcccatccttaattgaagagcttcccatgttggtgctttctggtaaattatatttttcaaactttatgttcttttgaatatttcttatgaaaaattacatatttttattgaggccagtgacatccaccagtaaataaaaacataatgaattagtgctgctatagtgaagttactttgtgatatgaatatgaagaaaaaaactcatttaaatggaatatatactttcctgtttaatattgtttacttatttctgattaagtagcagttctctgtcttcacattttaccctcttaaacttaatttttgcaaaaaatttttctattcggttttcattttcctagggaaagggaaaaattgtccctgatgaaaagtgtttatagtatttaaaagagttgctcaaagtgtaagactggggaaaaaaagcttatgttgttttttttgtctttatcaaaataatggtataaatctgattatcttacttgatctgattaaagtcaggattacttttatcagaaacttttatattcaaaacatatttagtattttatttttcttaaagaaaatggttctcttggataatacagaaatcttcaggattttgttgtggattcaatgaggttgttgcctagaggtggcaaacagaaaagaaaaaatagaaaagagaaagacagtggctgattattttgcttgtctgtaacgaaattcatctaagagaaataagtcattctcaaaactcaacctctgtttaacctttaaaagagcatttgagaaagaataataagacgtaattctgccaaggtgcggcctgaccctgagtaaatcattcaacttctgttggatgatttcctcatgtgaaagatgaacagtattgtgctggaagctaaggttccctcctactctaaatgtttaaaattctgtatcagtggactgtgaaaggaaaaatagatggataataccagagttggaaagtgtgagagtttatctgtttacattaaaaacaactataatgatgcagcaacctgtgatgatacccaacggaacaatgcaaaaaaatgtcagttttataatatgtatgtatttctttagccacacaaaataaaattttgtttctagtccttattaagaccaagttgttgtatactaactacgtaactatcctaaactttaattttttaaaaggaatatttttaaatattgattatttcccatctccttattatatcaaatatctcattatttggaaggagcattgcttttttct

SEQ ID NO: 129421 - DNA, 1045 bp, Homo sapiens
ctgatgatgtttgcacctaataatccaagcataatgtggtacaggctcaaactgtagtaatataagctaatagtatgaaatttggaaacgggttcctcttgatagttggcagtgtgctcctagcaatcgaaagcagcactaatctgttgctttatgcaaaagatgcaatgtattataaagatattaaagttcctctacattttataattttccttgttaaagccccagactgccatgtccctgaaacttgagtcaaacacaagcttatttgcactaaagagcatggccaaaaaaataaatgacagggtggaaaagctagttggaacctcttgaaataattggttctaatatgagaatttcacatttgtctatttgaaagctgtatggtccaggcagacaatctgtcagttcactaatttaataatgcactttaccttttgtatatagaagatgtacatttatgccacttgacaggtgggatgtgtttcaataactatgtagctagaatctataaggtgatcccgtgcatgcatatgtttgtgttggaactgttgttgtaacaggtttccattaaatcagtgtaatggagaagggtagaagatgcttttgaaacaaatcccagtatatttaacaaagaattttaaagtagagttcacatttgatgtcttaagaactagaataaataaaatactatttctaacccaaattcttattacagttgagactatatttagttgagattccccacagtgccctgacagttaatttggggaatttgtctagacaaaatttttttcaatcattgtttcattgttgatatgtgtttaagtaatgaataaatatgcagtacataatattatactcaaattaaaagtgtggttagctgatgtggcattatttaaagaacattcagactaaagaagtaaggtttcaagttaaggaaatgcaaggaacctatgaacagtcactaacacaaatatgatatctcagaattcacagaagtactaaccttccccaactaaaaagggtattgggggatttagtg

SEQ ID NO: 129422 - DNA, 1033 bp, Homo sapiens
tattcagctatattttcttctgaatgaaattattgtcttttatcttggctttattcacctcccacacaataagtccatctaatcatatttaagagccagaacactgatttcaacccccaaatatcactctcattgatgagagctggctgcatggattcaaatcagaatgtagctcttcttttatatgctaaaagtaatttaaaattatatcagcgatttttttcttccagagttttgtcccccaatacctttacgtgaggtcactaagaaaacttgatggtatgaattaaaaaaattaatttcattggtttatgttacttaagaacaagcaatcagtaaccccgacatatatactagtgttggtttgcagattgtatttcacatttcctctagtagcgtgaaggaatctcattagttcattataattgtggaccatctggatcactatggaacaactgaaggttaggagataatgttagtactagagctaatagcacatggtgggtgttgagactctaaaagtagcaaggatttttaaacagtcctaactgtaaaataactatgtaggcttgctaaaaaagtagtttttggtctatgaaggaatgatgtgcacttgaattactgtactactgattgttattgctgcccatcatagtgcctattaataataatcaacctgtcagattttggcaaactggagctgtgaatattctagtatttgattgttcctatcgctattgctatgagtgtatacactctcttaaagtcttcctttctaaaatatttatatccattaggtctaaatgatttccttttaccttttgggtctgataagatttgggtatgtgtctatatctatatatatacacacagacatatgtatatacatgtatacatatatatgtgtgtatacatacatacaataccatgtcagacttaaagataaatatctttaactcattgtatataaacattattaaatttagttttccattaattatttaagtaaagaattagttaagcagccagattt

SEQ ID NO: 129423 - DNA, 1855 bp, Homo sapiens
gcggagcgcgggacgggcggcggcggcgtgcgggagcggccccgggggcggcggagggatgcggggagcgcgggcagagccggagcggcggccgccaaccggccggcagtggctggagccccgcgctgcggcgccgggggagccgggcccggcgtgggggtcgcgggcggcggcggggcggtcaggccgaggggcgtctgcgattgttctcaacacccctcccccaccccatcccgtgtgtctgtttgttacttgcagctgaagatggaaagagccaggcgaaggggaggcggcggcggccgcggccgcggaggcaagaatgtagggggctctggcctaagcaagagtagactctatccccaggcccagcactcccactacccccactacgcggcctcagccacccctaatcaggccgggggcgcagccgaaatccaggagctggcctccaaacgagtggacatccagaaaaagaggttttacctagacgtgaagcaaagctcccggggccgcttcctaaagatagccgaagtctggatagggagaggccggcaggacaacatcagaaagagtaaactgaccctctccctgtctgtggcagcggagctgaaggactgtctaggggacttcatcgagcactatgcccacctgggcctgaaaggccaccggcaagagcatggccacagcaaagagcaaggctccagaaggaggcagaagcactcggcaccctccccaccagtctcggtggggtccgaagagcatcctcacagtgtcctgaaaacagactatatcgagagggacaataggaaatattacctagacctaaaggaaaatcagcggggtcgcttcctacggattagacaaaccatgatgcgggggactggcatgataggttattttggccacagtttgggccaagaacagactattgtcctcccagcacaaggaatgattgagtttcgtgatgccttggttcagctgattgaagactatggcgaaggagacatagaagaacgaagaggtggagacgatgacccgcttgaactcccagaggggacttctttcagagtggacaataaaaggttctactttgatgtgggctctaataaatatggaattttcctgaaggtaagtgaggtgagaccaccttaccgtaatactattactgttccattcaaagcttggacaaggtttggggagaattttatcaagtatgaagaagagatgaggaaaatttgcaacagccataaagaaaagagaatggatggcagaaaggccagtggtgaagaacaagaatgcctcgactagagtgaaattgaactccatcaggcaaaatttaaaatcacaaattggctaaaagtactgatccattatcctttgaagaagtttttcctcttttttggcccgttgttattagtaatacctctagtagttgatacttcaggaagtctgattctcatgttatgttacacatagatcactataattcttacgggaattccaaccttcccagagctaaatagtttagctgcttcaactgctccagactattgaagtatgcaaatcagcacaaaatgtgacattctgacattctaaataccataactaagatttacattgcactatgacataatcccgaaaaaagatacatatacttaaatagaagtgtgactttcccccaaaagtatttcaattctacttcattaaaagctgctaagcttacctgtagggcagttaccacagaaacagaaattgacctccggtatatataaatatttacttataaaagtacaagtagacgtatattgtccgttgaataactgaatataccatcaaaggatcaaatcttattacc

SEQ ID NO: 129424 - DNA, 1028 bp, Homo sapiens
cggagctgatgtgtactgtgtgcgccggggaggcgccggcttgtactcggcagcgcgggaataaagtttgctgatttggtgtctagcctggatgcctgggttgcaggccctgcttgtggtggcgctccacagtcatccggctgaagaagacctgttggactggatcttctcggggtaaagtgtcttcctattcccgttttcccagctccgtgccccggggtatctatagtgctaggcttctgagacacgtggaggcgcttaggcccgcggagcaggcccctgggctgtgtttgggagattctggaaaaacagactttctcccttttcctttcccctctggagcagctgggaaaggcgtctctcggagcttccgccattcagaaagtgtttccccgcccctgacggccccagcttgatgtttaccttgcgcgcttagttaggattgctctttctagtacggcctttattatggcagaaattgagccactacaggtctgcacagcaaagtcgagggaaataacctgctgtctatgatttagcaagtgatgatggatatttttgagttcaaatcactcagtctttaatggattttcttttctttttttcctagttgaatctcagttgttctcaggctaggtttgatatgaaaaatactactccctattgaagagggtaatataattcttaggatgctaatacaggagtctgtaagtcggagtacttcaggctttttatggttcggtacatttctttttaggggtgggatattgggataagtaggacagttcagatcttgatgtcattgaatagtggtgtctacctaaaaggaagaggctggggcacaaaattataatttaaagtgtttacttcagccaaaatgaggacagctgcccaggactcatttcccagttgccttggggagtgctccttcagccttggttacaagcaggtttttaaaggcgaaggggaagagtgggctgagacaaagttggtcaggaattgttattggtttacagagataccattgc

SEQ ID NO: 129425 - DNA, 1066 bp, Homo sapiens
tcctgagtagctgggactacaggtgtgtgccaccaagcccagctaatttttaatttttttttttgtagagacatgctgtgttgcacaggttggtcttaaactcctagtctcaagcagtcctcctgccttgactttccaaagtgctgggattacaggggtaaaccaccatacctggccatatcttttggatttattggtcatttggattttcttttgggaattacctgttcatatttttctccatttttctgctgaataatttgtcttttcttacttatttttcaagaaattttacatattttctggctgttcattgtcagttgtatgtgctccagataacttgaacagtctgtggttgccttttaatttttgaattatgtctttagttatgcagaagtttaaaattttaacataaattaatttacactatttttctcactttagcatgagtctatcagatggggatgtggtgggatttgacatggagtggccaccattatacaatagagggaaacttggcaaagttgcactaattcagttgtgtgtttctgagagcaaatgttacttgttccacgtttcttccatgtcaggttggtatctctacatttcatttttatatggctgataattgtaatatgtcaactttatccctataaaattaagttcttttattagctggccgttctctcattatctcaaatttatttaagtatttatgttctacctgattcactcacattccttgttttatttaattttcacaacatacctgtgaggcattgacattttttctgttttagagaagagaaaactgaaattttaagaggctaaatgaccaggatatgtactgctattgctagcaggagtggcattcaaactgattattttttcttgtcatttatcaatcaggactgtttgctttagttaagaaatactcaaggtcaatgtgtttctgaatttaaaattactgttaaatacaaatttacacataaacatggtatgtataagaagtaggacataaatccatcatacttgacagaacttatggaaataacaagaaaatgtt

SEQ ID NO: 129426 - DNA, 1032 bp, Homo sapiens
cttagtggaagtttggctatcaattccatcacctgtatttcacatattttattaatgaagttcttaaattaaattctcatatttagccaagtattcatttggctgggaggtagaaagcctactaaccaactttttttcatgaacaatatttttaaagtccaagatttttaatacctacattagggaaattctagaattaaattcttacaatgtggactgcatatgaggcttttagtgacagggaatttgttgaaggctatctgtgggttgtattttggtataacatttcctaattttatttgtggtatgttcatttgatatcatttggtaatacctgaaaacaggaactgattttactgtgttgctttttcatcatttctagctgaaatgcacagagacctggagccttaacagtctggttaaacacctcttaggtaaacagctcctgaaagacaagtctatccgctgtagcaattggagtaaatttcctctcactgaggaccagaaactgtatgcagccactgatgcttatgtacgtgcttaaagatctttagaaattgtgatgtgttttaaaaacattattataaatgactttagaaaaattttattatagtagtggcagaaactctaccaaaatattttatatcaatttggcattgaaaaatgcttaggaagacatttagtgaaactattcattttcgatattaattagcaagtaccaatcaacagattgttcaatgctagtttattttcattgtcatgaagccaaattaatgtctaatttgtatgttaaaaaatgtgaacttgctgaaaacatgaaaggctaataaatccaggctgagcaagcataaatagtactgatgatggatttgatatataaacaattcagaatgaaaataattatagtacagtttctattttaaaactggccttatttcttatatataaaatgtggtgaaattttagaaaaattgcctccaaatttagcttgttgctgccattagatatatttttatatttacatgtttgtat

SEQ ID NO: 129427 - DNA, 1987 bp, Homo sapiens
gttaagggagggagacctgtaagacagcaaagtggaggtggtgcaagaattagttgtgttggctgtagcacagaggacagtttgagttaagagagttgggactgagaatcccgaggaactcttagtgttgaacatttgcgtggaggaggggacaccaaaggagttgccatagacatcgaggaaattaggaggtgtggtgtgcagaaagccaagtgaagaacatgttttaagtaggaggatgctatcaactgttttaaattctgctgagagtttgagaaactgaggacttagaattcatcattagatttggcaatgcgccaatcatttgtaatcttttaaacaatagttttgctgtactgggtagcaaaagagtgatttgaggagtggtcatttggagcatatgctattcaaacagagaagagtccacgggctttggtaacatgaaggtcctataaccatagcaagagaatgaggtgggtggaagtcatattaacgtgaatagaggagtaggttagatctgaggaatgtgggaacagagacagggtctcattatgttgcccagcctggctcagactcgtggcctcaagcgatcctcctgcctcagcctcctgaatacctcgggtttcaggcctctgcatctggcttgaaaacaacattttctcagaagcttgttttagttgttttagaaataacgaaggcatgtgtaaacaactgttctagaagcttagtttggaaagggaacgtttattgatgcatataacacttatatgttgggtgcttatgtgtcaggcactgttagagttgctcgggaaaatttacaaaccaagcaaaccatgccccttcatttcctttgggtgaagtgagggagccatgtggttatctgaaggaagagcttagcaggattagagggaagaaagtgcaaagcctcctagggtgattggctggctcttttggaggaacagtacctataactgaatgaaatgagtgagggtaagagtggcaggaaatgaggctagaaaaggagcttgggccatatcacgtagggcctcgtaggctgtgaatctgacttcatttcttattaatgaaaataaatacgatgatgggtgatgggaaacccatagaggatttggagcagaagaatgatataattaaaattttattttagaaatatttttctggttgtcgtaagaggaaaaatatttagccccagggcattttggcagagagttaggaggctattgtaacagcccaagcaatagacaataattgtttggattaggcgggtagcaatagaggtgatgagaagtcgtagcttctgtaggtatttggaagatatatattgtgaaggatttgctgatgaattccctgtaaggggtgagatgtaaagattcatagaacattaagatattttggtcagatcatctgatcaatggaaaggtcagttatagtggacagattatgagaagaacaggtttgggtgagaaaactttagatttcagtgttggatatcctaagttttagatgattattgatatccaagagatatcaatatttgggatcaatttgggaaatatgatcccaaagttcaaggttgaggttggagatgtaattcagatccgatggtagttaaagcagtgagactgaatgagataaaatagggagtgaatgaaataaagagtaggtgtgatattgacctcaagggcacaccagcatttagaggttgggaagatgaggagagagcagcaaagaggactgggagggccactaatgaaggagggaagtacaggaggtgtttagttctgaagccacctgaagaaaatgtttggaataggaagaagttgtcagttgctttaaatcattcggggaggttgagtgagatgagagtctagaactaacagttaggtttgatggtgtggaggccatcagtaaccttttctttcttttttttttttgagacagagtcttgctcagtcacccaggctggagt

SEQ ID NO: 129428 - DNA, 1055 bp, Homo sapiens
tgacacttttagggttcttttatcacagtttatcaaacacctttttttttttaacaaaaaacaaatttacaaaatctttccatgtattcaacttagaatttaatgaaatagggtttttttttttttggtggtcatgtatcatcaactttctttacatttaattaaattaatcaacaaaaaacatatagttgacataaacaaatttgggaccaagcactactgactcttagtaaacatacaagtcaactgttggtgcagaagtgccttgatgctagagagtagcctgcaagctgtaattatatatgggcattagggaatgaagaacagccttaatactattgatcttttaagtgaaggtcagcttagaaagcttttacttgttaaaaagcttcacagtttgtccttgtagttaatgcaattgaagttgaattaatctttcttaattttttttttagggtttctatcttactaaaggatatttcagaaaatctatattcactgaggaggatgataattgggtctactaacattgagactgaactgaggcccagcaataatttaaacttattatcctttgaagattcaactactgggggagtacaacagaaacaaattagagaacatgaagttttaattcacgttgaagatgaaacatgggacccaacacttgatcatttagctaaacatgatggagaagatgtacttggaaataaagtggaacgaaaagaagatggatttgaagatggagtagaagacaacaaattgaaagagaatatggaaagagcttgtttgatgtcgttagatattacagaacatgaactccaaattttggaacagcagtctcaggaagaatatcttagtgatattgcttataaatctactgaggtactaaataaagaggaagcacatttttagttattagtaggttctggcagactttattcccgtaaagagacagatagtaaatattttaggctttgtgggacatacagtctctgttgcagtaactcagttctgttattgtagtgtgaaagcagccacagacaaatgtaaac

SEQ ID NO: 129429 - DNA, 1958 bp, Homo sapiens
ttctgttatttcagtgtcttgaatattgtcaaatgacatttattagctactactggtactactgaatcttaataatcaatcttcaagccattaactgaccaatggtttcttctatcttaatgtattagtaattattcatttagagtaaaacatctcccagaacatgaaagaatacaaactttattcatgttacgttgtgacaggagactttgttggatgcgcctgattttcctgccaattcacagcttcattaaaacagtaatgctttgaaatatggcttaggaaacttcacaatgatcattaattacacctaatttctggaagagtatatgcatgtatgtgttgcggtattctcccttgctgtggcaggatgtcacaaatttttatccacattacgaaaatttaaaaattgatatggttttttctccctacgttgatatcagatattttgttttatctgacagctggcccaatgtactcctactttgccattataaagaattcaaaagcttcatatttgcattgaaagttctcaaacactttgtaaagatgatgaaagtatgtttcatcatctatgtagaatagtcaggtgttcttgcaattgattacttgctaccgagaattgaatacctactgagtgcataatgtatagaattctagatattcacttttgtgtgtttttacagttgttatataccttagtgtggctctaaaagtggaggtgacagctgtagctcttaatgtcttacactgagtgatgtttagaatcttaaattttcttttataattttagaaaaaagtatacttttctttcttatttttataaccagatccaaacacatttgcatgtagataggcatttttagtcttgaacattcatttttacttttaatcctcacttttattagtttcgtatctttttgtatttcatttcccctttcaagatgccttgagtcctttctttttaggaatgatgttgtgaataaattatttgataaaatgtctttacacctgagagtttataaggatagtttgaaaatcatgtctgtaaaataggttgatctcacctaaaaataataccatataattaaaattagaattattattgtgttgcttattgactcttacatatatcaaaaaattgctgagtcttattcagccagagcttttacttagtatgatattcattcctatatttacttttttctcacctttctcatactttcttttacttactcagcattttcctcctttcctccctcctttcttttcttctttccttcttttctcttcctttcgtattcctggtccatcttagcatgtaatctttctttatgaaatggcatgcagataggtctactgttcttacagtaaaaaacttcaaggcctcatgtctttcccacttctgtttcccattcacaacctttttagctgattcttttggtactttaccactatatcttgccatagtttatgtacctggctcctacttaattttttgtttatttgtgtattagtcgtaggcattatttatcgactcttctctctgaaagatgaaaggttagctctctttcacattcttaactgcccttttttcttaccttgtccatgtatttctaaccccctttcctcctaatatgtttatgtcataattttggctagattagtgtatacgatttacataattattactctgtaaatgctttttatgatctctgagccatgtagtatattatggctatttttctttcttatctatttgtatttttattgttattacctaaaaaaaaattttctatgtcttatcactaattcttccctaaaatttcccacaattgtgtaaacttacctcagtatattcatagatatgagacattctatcaattttaccctcttaaagatgcagagataatgcattatgtttcatcccaccatctttaatgagaagcttccatctt

SEQ ID NO: 129430 - DNA, 1045 bp, Homo sapiens
attttacttaagaatgaccccaaagcacaagagtactgtgcctaatttataaattaaactttttcataggtatatacatataggaaaaaacataatacatacaggatttggttggtactattctgcggcttcaggcatccactggacgtcttggaatgtatcccttgtggataaggaggaactgtatatggttaacctaggagctagagtcaacagttggaagagactttggggataattacatggaagggcatggtgggtggtcgtttcagatgacaagaatgtttttgaataacggatcatttgtgtcttcagactttccagaactccttgagaattatgcagaggtatttaatcagtcagaaggttgaatagtcaaattattagtgagtgaagtctattttgatgaggattttactaatgctgtcccttagatattataagtaaatcgttgttttcttttgaaatatctgaaacctagttaacatggactttcatttgttcttgtaaagatatgcaaagctatttgggagattgtcatcatctgatatttgatattcatgggctttcttcacagaagactagaaattaacagagtcatgatgaattatggctgcattgactttaaaaaacaaacacctccttaatgttatttaacaattttgaataaatttgatatggcaaacaaatcagttataatcgattgagaaaggaacttaattctaatacttgactggtgtcccataataacccataatactaagagacagttttggagggcgagaagtcctgaagagctgatagagataaaggttcaaatttgagcttctttcagtgttccttacgtcaatgcttttagtttctcatacaaaataaaataaagaataacctttttactgggaaaaggtaaaaattaataaattgtagaagcattgtttgaagccaaaaagtgtgtgacatgtaaattgaaatgaaaaaccttagagtttttgatactttttcaaagcagctaaagaattgatacttggacacaggaagaattttt

SEQ ID NO: 129431 - DNA, 1011 bp, Homo sapiens
aaaaaagtaagaaagttgccaatacagttttacatattcctgtgatgtttttaatcgacaggcaccttcttactgagatacgtaatgagaagtttcgattatacaaattaaagatgatggcaaagatggaaaaatatcttcattctagcagatgtaggagacagtatgtattatttattttatgccaatagtatggatttatggatgatgctcttttaagacaacaatttggctaaataattatcagtattttgaaaaaatattttgttgctgttacatgtgtgctgaatttttaaggctaacttctttgtgtctgagtaaactgaagtcaaataatgaagtcccaagtgaatcaattaatggtgattttacctcattattttcaggaatgaacttaacatatacgtttctgttcttttatttaatttaaaattttgtcttgggtagaatcatcttgtctcattttgaggacaaacaagtacaaaaagcctccttgggaattatgggaactgaaaaatgctgtgataattgcaggtccaggtaaagatttcttattatagatggacattctaaaagtctttctttctcttccttttcatgtttaactgaatttttgttgaatgataagtatttcagttttttaaacaaaacaatgaatgtgtttagatatgagaaagcaaacaatattaaagtattttgcttaaaaaatagataaagcaataaaatggtagccctaaatctaaacatatcaatagttatgttaaatgtaaatgatctaaaatattatttaaaggcgtaaattgtaagaattggtttaaaaacatgaccctgttctgtacgttgtccacaagaaatccactgtaattatatagataggtttaaaaaagaatgaaacattacattccatgaaaacattaatcaaaaggaagttggagttactttaatatcagacaatggacactttggagcaaagaatattatcaggataaagaaggatattatatgatgtaa

SEQ ID NO: 129432 - DNA, 1949 bp, Homo sapiens
gaactcctgagctcaggcaatccacccgccccggcctcccaaattgttgggattacaggcgtgagccacagtgcctggcccagaggagatatttaatgaaaaataataatcattagataggcagatttttagaaggagggcatcgaatgggttcttggatattggacacaataagaaatattgagctaaaagtctgaaggaattggcagatatactgttacaggtaaacactttgtagaagaaaataatgaatgagactttcttttgagattttcttagcctcttagttgttcccagttaaagcctcatatttttccttttcatgacaataaaaataataataaaatcagtaataaagtgaatatatgagatgttaacctgttcctttatgacaatgtcctgtttaccaattaacagtgtgtttttgtggtgatgggggcaagacaaatctttaaatggtggaaagcaaagaaagaaattataaaacatgattagttgtattatacgttgtttttggttgttggaaaaactatacatttattgagagaatcattaggaagctgaacatcagctatattgctggagtgatactgtttcagtggtttcttgacctttttgttgttgttgttgttgttgttaaacacagaccaactacggttgaaaacgtaaaaaggattgatggtgtttctgaaggcaaagctgccatgttggcccctctgttggaagtcatcaaacatttctgccaaacaaatagtgttcaggtaaaatactgtggtttgcaggagctcttagagaataagcattttttgtaaccatttcaaaagtaccctccagaagcaacatttgctcactttatttgcatttccatactggacacttagaaaatgaattaaaattgtttttacagtcaatctgttgtaaaaacatgtcagttatctacttttaaagatgatactaaaaagtagttgtccaggctgctgatgtctttctatttcattgggaggttttgtttttaaattggaaacattattttaggttgataaattataattttacattcaaatgtggtagttggaatttaaagctggaaagttatccttgctatgagttggtcaggagctcagccactttcttttggtttagcatcttctctaatctccctccccttccagtaatgctgtcttttgatagtaagtggatttcatattattctcttcagttttaatagtgtttccttcatatccttttattattgcttgttctgccctaagtgaccatttccagaaatgtcatttaggattttctctaaactccacgtagcagactctataatgcatactctgcagaaggtgaggcagtgggaggtagaggggagactactagactaggagtcacggaatcaggactttagttcttccttacagttgttcacctggtgaacctgcacatgtcctttaatttccttgggtctccatttcctcagctatacaatggaaatgacacttcctcccccacatccaggaaacaacagatgacattagaaaatagaagacatgggataagtataaaatgttgaaagagttaaacacattcaaggcaatattaagggattattttttacttccaagaagctcctggaagctttgggcaggcacagttggatcctactttagaaaaatctttctctaactataagtagaaaacccttctgctttttgaatgtagcatttccctcttttgatatagagtatctttggcaactttgaattttctttttcatactcttatataagacatcatgtgaaaattcttatttcttactgagtttttggaaatgaaattataatgtcttaatagtttgagaaagaatatcatacctaccagcggtaattgagtaagttccctctctttggacacttgaaagtagtatcttctttcatgaattagtg

SEQ ID NO: 129433 - DNA, 1058 bp, Homo sapiens
caggaagacacagatcctttgagggtggtagagactcctaaagtctgctgattcatacccagctggccccattaacaagagaattaaagagtggctagaaagggactgaagagttcactgggggcccatccaaaaagctgggggtacagacaactgctgattcccagccagtcatggattttattttgagacaggtctcgtttggtcgcccaggctggagtgcaatagtgtgatcatagctcactgtagcctgggactcctgggctctagtgatcctcccaccttaacctcccaagtagctgggactacaggcatataccaccatgctcggttattttttttttaattttgtagagatggggtcttgctatgctgcccaagctggtctagaacttctgggctcaaggagtccttccaccttggcctcccaaagtgctgggattataggcatgaaccactgtgcctggcttgccagtgatggattcaaagtcgcctctgggttgtaaccaggaagcatgcctgggccagactgagagggctgaaggatgacggcatggtttcagtgtgtgagtgtgcatgtatgtacgtgtgtgtgagaatgtgggtaagtgtgtgagcctgtaaaagtgtatcatgagtagctgtctcttgggaggagagggaatcaggaaccttggtcaaataacaccatgtactggcatggaaaggcactgttctgggcagcagtcaagaagacagaggaggactaactgtatatgatttgggcaatcatttaaagtatctgggatttatttccttgtctaataattagcaaggttgatgtagatgaggtataacaactttaggggtagaagaaagctatgattcaaagtcggcattttattagatcagtggtctctgatttggtgtgatgtgttcctggtatgttttcgcttagaacaaggttgtttaacccatggcccatgggcttcatgcatcctaggacagctttgaatgtggcccaacacaaatttgtaaactttcttaaaacattatgagcttttttgtgattatttttt

SEQ ID NO: 129434 - DNA, 1127 bp, Homo sapiens
tcgtttcaatattgaagtttcctccaagtgagctgttatcacttttgtcttcaagagaatgctaactcactgaatctctttgagctttttatgctttacactgtggattttggagtttgctttggtttttccactagttctttaagttaaatttaggtaaagaaatttaaaatcatcaggcttattcttaaaaactcaagtattatcaaatgatggatgatagagatatgctttgggaatatatccaagtacttcaaatgatagaagttagaacaccaggagacatttagtaagagattcttctgctgggtgaaatcaacatcaacatcacctggaaactcgtgggtagtgcaaatcccctggcctcaccccagagctcctggaatgaagctgtccgggatagggcccggcatcctgtgttttaataagctgtttgtgggattctaatgttcgccaaagttttaggatcatgcctgcagagaatcctgctcactatgaaagtttgcatgcctgagtaagtcaaaagagatctttgaaaatagtatctaggtttgagagacttgctgtgattgtataattttagcaaatgtgtcaaaacaaatttttacttgcaggcaatatcttgttagtacagagaaataaaacaaacaaacaaagattataaataagaacaaaagtaattcatccaagagccatgtgaaaatgaaaatccttgaaatggaaaaaaaaaaaaaagtttttcagactaccctgtggaagtagtaagttacattgaaaggccgaaatcagccaagatcattttttgttgttttgttttttgttttttgagacagcatctcgctctgtcactcaggctggagtgcagtggtacgattttgactcattgcaacctctgcctcccaaattcaagcaattctcctgcctcaggctcccaagtagctaagattacaggcgcacaccaccacacctggctaatttttgaattttttgcagagaggggttttgccatgttggccaggctggtcttgagctcttgacttcaactgatccgcccaccttggcctcccaaagtgctgggattacaggcatgagccaccgtgcctggccaggccaagatgattcttgaa

SEQ ID NO: 129435 - DNA, 1031 bp, Homo sapiens
aatattaatttggctaaagagtacataaggttttttttgttattctttcttcttaaaaatagttttaaaaatgggttaataataagcatgtggctaattagaaatccttatttctgcatatattgtagtcaagggatatctcctcttgtatttatgtcaccagttttcgtacgtgaatgtacttgtgatgcttatctcgatcaaattgaatcttagtcttggcccattgatgttctgtcttaggattcccaagggtgttctccatagaaaagattccatggccacatgtcatggctgccttagaaattcacagtacagatttgcaaaaattcactgagatgcattgttgtaaagagacctatttaactttttttaatgcaacatttattttagcatagaaccattttttttaaatctctctttcttttaaagcctaacatttgattgcattactaggaatagtattccaggaaacagtgccaaggcctattaggagaagtttgattttaagacttatccctttaagattatgttaactgtaaatatgattaccatgttttcttatagttccatctagttcaatagttaaaatgttaattgcattgggtcaagaaaggggtctttacatacaaacacgattgttcctagatttgtataaataggaaagaaaggttgttcttgagggtgttgtaataatcttggagttgtaaattcttgggatgttgttgtaatcttatctcagaatttggggacttaagaaaagctacagttttcttactttagaaatttactccttctgtggcattgaaaatcaagatactatgccccaccctgatattgttcataatttatctattattgctagtggtttcatggttatacatgaaaattcttccagcaaaccatgctaaatgttgggctggaaaatcttacagtgcttatccatttttttcctcactatttttcaaaggtacctgtcatgaaggaaacttgtcatatatgatcaaagtagatatatagctgataatcca

SEQ ID NO: 129436 - DNA, 1072 bp, Homo sapiens
tgggtggagaatccagcagcagagaagctcaaccttcacattggagcctctggccttagggtccactgaccagttgaccactggaaaaggtgtgttcagaatgggagcgtcctgaataacccaaggattctactgatttcaacagaataagcttagcatctaacctttcagattttttcagtaatgtgaactttacattttctcaagtcacattattcatagatgttctaattccccagggatcgaagtatagcattaaggaaaatcccttctcaataaaaaaatggtattgggtgaggggagggggacagaaaaagctcttagatgttctatagcaattaatggttgccatataaagatacctcattgtcattagataatggttaaaattatatgaatcttttacccttgatataattttgaaattcatcttaaaaatcaattccttaaaataaaagtagtaggggaaagaggtagtgatgggtggaggctgggggatgatgcagagaaggaaaaaaataagcaagtggaggttactaaatgtagcattggtggattattttgtttgtttggcataggtaatgagttttataataaaacttactatagtatatcaagataggctcctttcatatatgaacccagaaacaccatgaaaaattttttaaaaagttccagcattttattatgaaattttcaaacatagagaaaaggtgaattaatcattcagtaaacaaacttatgcccactaccaagattttacagttaatattttcctatatttgcttactgagtgtctacccatttatctatcaactttttatttttgatgaaatttcctgtatatatgagttcattttacccccaaatatcccagcatgcatagtatatatattttattacattgtttaagagaacatgtaggtcatggattatgctatcaaatagaatatatgtttctctcaaataagccaccatatttggaccgagggttttctagtcatcatatttcagagtataactcagacagtagcagccttcttgttcctgttccctaataattactccttcc

SEQ ID NO: 129437 - DNA, 1053 bp, Homo sapiens
tttttcctacaaacatgcatgttttatccaaaggaaattctgacctctaaccccattcacactttcctttcttactcttttattgctatagaggatttgatgaaggcagaaaggcaacttctgggtcctagtcccaagggtagaactaatggagaattcttttattcttcacctcccatccttctccatttccccatttacattctttttccaatttggcggaaaaaaagcaatgttataggaagctggctgtctgcagattagtcttagcaccaaggtggaatgacttttgggggaaaaacagacacatcccaaagtctggctcatgtagtccaagggaaagagtacttgtggcagtccataggattctctctctgatgtgttgtcctagtctttgtataaaatgttggttttctctgtaagtgttgggtattttcagtgtaacagctagagcaatgcccagtaacttttttttttttttctgctgaatatgtttgctcttaatggttgaggtaaggtgaataattgctcttggtgtaagttaaagaccacttttctaaactatgggttatcatgcttggtattttctcctatctgcctgacttgaggccacctgaaccccattttggtctttgaaatttagctgaccttggccttggatgaaatgctggtgtattgagtataatagttttggtttaggtcaaaattggggaattcagtgccgtatatttcaactgggtgctttttgaagaaatcataaattaccctagtttagcataaacacctgctgatattgtttctgaatatttacatgaatattgatcattgagatcttactatctttcaatttgaatgctttaaatgcttcaatagatgttttctacaccgtgaaattgtatgtcctttgctagaatctttgtaagagaggtctcactgctttgaagtcaaataaacctagaaaataagcataggaattatttttaaacaccatttactgtgcagattatagagagatgaactcaaggataactcatgttgctcataaacttgtca

SEQ ID NO: 129438 - DNA, 1119 bp, Homo sapiens
tggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctgtgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttgtaagtagagagagagagagagacgatgatgatgatgaataaaaggggtgggtttgaggtccccaaaggacatttccctttcttcttgcattttagttgcctggttttgtttaagcaaagcctatgtttgagatgcttgggatggcattgaagggccgagtaaaatgatcttgcaaactccggatctgaaccagtgttgtaacagcagctctctctagccacatggctcaatctggtaccgggaatgaaaaacttcagcatctgcaagtcatgcttgaatttaagttaaattcaatttatttctaacacattttaaaattaaaacatcacgccatctcttat

SEQ ID NO: 129439 - DNA, 1147 bp, Homo sapiens
atcttttgctcctaggctacaaactgtgcaagtatgttactgtactaagtagtataggcaattgtaacacaatcgtaagtatttatatatgtaaacatatctaaacagagaaaaggtacagtaaaaatacagtattataatcttatgggaccactgtcgtagatgcagtttcctgttgaccaaaatgtccttatatggcacgtgatggtatatgccatattttgtttatctcttcttgcatcagtgaacacttgggttacttccacctcttaaccggttaataatactgatatgaacatgggtataacattctaattatgttttgttcatctgtggtgggtgtgaaagttaaaccaatggaacctttttttagtgaatttagtcaaatttctgaaaaccaagaattcctatggaaacatactgataaacatacttttcttattatatattaaaaatgcttgtagggaaaacccagcttctaatagtactctgggtttgtgaagatgcagtaagtgcttgctagagagatgtttttaatctagagagctagagcagagacttagagttcacttgtttcttctctttttttcaatcatttataagatctctcatcttaactcattaaaactggctgattgactttgattactgacacacccaaactatttcaaaccagttagttcaaaaatgcagttgcctctttgaattatttataaaaaggatctcattacatttttccatagataacgatgatggcaaaggggaagaagggatcattatgccactcctttaaaatgcgggcttctggcctggcacggtgactcacacctgtaatctcagcactttgggaggccgaggcaagcggatcacctgagggcaggagttggagaccagcctggccaaaatggtggaaccccatctctgctaaagatacaaaaattagccaggtgtaatggtgggtgcctgtagtcccagctacttgagaggctgaggcaggagaatcacttgaacctgggaggtggaggttgtagtgagccgagatctcatgactgcactccagccagggcgacagagtgagactccatctcaaaaaaaaaaaaaagtgacatgctggttaaaggtccctgtccatatcccccttttgcaa

SEQ ID NO: 129440 - DNA, 1033 bp, Homo sapiens
taaaaatatttaagtactttgacatatgttaccccctaatacacagagggtgctcagacagcatttgctacaggagtgaaccctggccaaagctgttttaaccaagggacagtggaggcccagagaggttcgttggtttgcttaaaatcacacatccatgggtaagcaaggtgatggataatcagctcaattgagtcagtttacattgtatacacataacaaagcatcatgttgtgccctgtaaatgtatagaattatgatttgtcagttaaaaataatattaataaagtaaataaaatcacacatctcacattgagaggagggcagcctagacccagatttctgttagccccaggaattgaggcatatatgggagactagcagacaacacacataggaaacttttgccacttaattattattctttttctcaagaccactatattcatttgggtttgttcttatgcttttttttttttttagcaaattaaaaaaaaattatccttgaatgattctaggttagctttttgactaatggatgttggaaggagctcagtgacaaaggccagggattattttgcttttcctcacctcttcctttgttcctcctcatcatattacaaccttctgcttcaggattccttctgctttttagcaggattgacatgctgggccttacccggaaaggcaaaggctgatttgattagggaggtctttgttccaggtatctcacatcagagagccttcataacaaatgagaggaatggattagaagtttcctggggataattttttgtctaccctttaagggaaatcttgccttcattaattacatctcaaatggaatatgtggaatatagacattttcataatcaacaaggtgattttcattttaaaatgcttaaaaaatgttaagcagcatgtatgcacgcacacacatgcaaccaatttcttccacctttttcttgttttaattcttaaaatatgaatttttaaatataaggaaaatcctaaaagcagaaactaataaata

SEQ ID NO: 129441 - DNA, 1115 bp, Homo sapiens
aacttcacctagatagactaagggaatgtattccttattgaaaatatattccacctcattcatttacaaataaggtgtaaaccttcctggaaaaaaattcacaagtgccattataaatgcttctatggataaagaccttaaagctaacccaaagttattttgccacatatacttaggtgtcttaaataaataatatgcattctctcgattccatccttgtgaatttgcatttgggttcccacttcttcaaaagagagtgtgtttgttccatggccaattagtttgatagtacatataagtaattttgcatggataaaaactaaccatgcaactttaactctgcctttaattaagtaatcattaaaaatgaaacttgtctacttcctcctgttctgtagttgacggtgattgaggggcttggtatggctgtagtggcacaaaaatggaaatcagtaaattagagcagttgtcagacccagattctgattagctaaacagcttgcctgggttagtgattaatgcagttgtagggaatgaaatctgctttcctagaaaagtcaatagagaacgtttaatgaagtagaattatgtgacagttgtccagttgtgtgaaccatctttgaacttagtcaaatgcagatgtaattttatattaagactttaaaagaatggaaaaatggcttcaaacataggagaacaaaattttctgctttctttgtttacttcttattttatgtcaccccataaatgtgattggtacggcttttgagattattggtttagaatttcttaccctttgttgtcttgagccatcttttctctagaaacatgctaatattacagatggttcaaatgttcctataatgtcaatgtgtaaatccatattgagcaatgtagaggtccggctgtgaataggacaaagaaaaaattaagaaaatatttaaatgtacatacctccttttctaggatttaataactcgaattatttataaaatgttattgacaactttattaaaagtataagttacacgttataagattcacacttcaaagtgtacgattcagtgtttttagtaaagtcacaatgttgtacaactcattaccactatctaact

SEQ ID NO: 129442 - DNA, 2143 bp, Homo sapiens
ctgcatctcttatagaaatactttttttgtcttttctccctatctctttgttgtgtacaatcagcttttaaaggatccagtggtattaattttgcattgcggtcaatcagagatcttatgcaaatattaaatattgcacaggcatcataactaaatttagcatttcatttggaatagttccttgtgccataactccctgatggtgtttataactcagcatatttatatttgtatgtgcatttttatgtatatgcatttctctttggtctcataaaaaagtaaagtgtgtatttttttctaactctacagtcattactaaatgaaaattaagttgtttttaaggcatattttttaaaaggaaaatgatgttaatctgaatgaaggttaaatagaatcccttataacactctggcactatgtggtcacatcattgaatttctgataactttcatattatactttagtctaactactcaagatcagtttagttttctagtgtttaggaaagcttaatgaaaaatataagacaacagacaactagaaaactagacagataaactgaaacagacaacagaaaactagataatatagacagagcgttttccgtgaatgaaaactaaaatgcatcagtttgactcacagtggcctcctgccttctgctaagtatgcacaacctaaaggtaatattttaagtctcattctctgacaatgtagtttgcaaacatagagaaatattcagatgtagaagaatatggcttctctaatggccttgtttgtttttagctacaaggtgacatatatagttctggaatgaaagaggcgtcatcgggcagaatatttcagtggctgtattatgggcctagcaagtaacctgccttggaattcctctttattattttgagaacaaaggcatgccatttaacttttttcagcctcagttttttttttttttttccaactgtgagaaagagaaagtgtcacctatttcttgttaaggactaaaggtgttaaaatgctagaatgtctggcacatagtagatatttaatgaatgtcagtttatcttgtcttagctaagaattttcatgctttactatacagataactcttggattttatctgcattcatttcttctccaaaaaaagggaaccaggaagaagagaagcaaaagacataactttacaatgcctagctaacattatcaatgccaaacacctactggtcgtggtaaaaatgatttctacttcaaaagacaagattgctgtaaaaaatcattgctacactatgaagttatgctgtaatgttacgctatgaatttgttgtgctataaagaggaaagaagatgtttaagaacaaaacatgctatccagagcacacctccatttttgcaattacaaaatgtcttctttctttgcttctcatttctccagttcctccctcgtgacctaccttgaagatcacctataagcagaacatgataaatagcatgcccagtagaaatggtagttgtgagcacatttaaagtgctctgtgatgttttactctcagctgtattgaaatatagttggtgatgactcattctagaaatatgactattaagaatgagtacatttatttcttcaataataagaaaaccaacagaatggtaatcccagaatcttagttctacttttaacatttcacacccagtaagttggataacggatggcagagtgagcctgcgtaggtaataacttattattattacccttaccgtacatggcccttttccttgtacttttctccttgagccaataatgactttgatggttcagtctttctgcactttgtagaaaccatatcccaaacagtattttctagacatcaattctagcatgtgaaagaatctagacagcctctccgattttcatgcttctgggacagaaaagtatttatcacaggtaatgatgataatccagttaaatttgttatgcctttccttactttcaaagttaatttccatttttccattttggatgctgtgttttatggaaattgtctgtaaagagtctactagccttacatgtaatggtcagcagacatatttgatacctttctttttcctttagtaaaaggagttgtaagtaaggagcaagtgaaaagtg

SEQ ID NO: 129443 - DNA, 1050 bp, Homo sapiens
tacatgcaaatacaaagaactgtgttaaacatcttaaaatatttgcctatggggaggaggataggggtgggataatagggggaaaaggaataaacaaatcaacagataaataaccagagggaggggaaggctttagaatctaaagagaactatattcgatcttaagtatatactgtttggggcaatttatgtaacttttttgtggtttagtttccactcctgtaaaatggggtagtagcacctattcaatatgcttaccataagaattaagtgaggcaatatgtgagatgctttctttcccctttagctccatggagtaaagctgttgttttaaggaaagtctgttgctttaagggaattgtgcttcattatcatatgtttttaattcatttctcttttctcttcctgcagggcttaccacccaaaagatgggaggcagaagatacccacctgagttgcccagagcccacagtgtttgctttctcaccactccggactccacctttgagctctttgcgagagatgtggatttccagctttgaacaatccaagaaagaagcccaggcactaaggtggctggttgataggaatcaaaacttttcatctcaagagttttggggcctagtattcaaggactgatttcaaaaatgatcagaatgaaacagactagagccttcttgaggtttattttctaggttgccttaatatttgaacataatagctattctgttgactatccatcaggataataattagttgctgcagtactcataatgagccctttcaaggaatagatgtaaattacccttaggggtagccactatattttttatactaaaaaaggaaatatttcttatggacactggttatcttccatgtccgtgtctgtggacccacatacttactgccttttgtggaaattcacctagagtgagtactttccttgtgcaatggagggagacgatctagctatagattcttgatactcacctcactctcaacagcttattggtatttggcaaacctggtatcctgcagccgagcatgaac

SEQ ID NO: 129444 - DNA, 1051 bp, Homo sapiens
tttatttttttttgagatggagtttcactctttttgcccaggccggggtgcaatggcaccatctcggctcactgcaacctccacctcccgggttcaagtgattctcgtgcctcagccaccaagtagctgggattacaggcatgtgtcacccacacctggctaatttttgtatttttagtaaagatggggtttcaccacgttggccaggctggtctcgaactcctgacctcaggcgattgcccacctcggcctcccaaagtgctgggattacaggcatgagccatggcgcccggcccatattgtcattttaaatccaaatgaagattttaaaaaaaattcagaatctattttcttaggaactaatggtgccatgtatttttccttttgagatagaggcattcaataaagttgaaaccagcacatccttttcagcaggtctgctagggagcagattaatggaaaataaaactaagactccctggttcattttgggctcgttccagctgtgctgtggattaaaacgacttcagcgttgccctgtctcacccctccatcctgattttgtgttatttgatcttaatattcatatgtaccttggatcagtgaatttgctatttttctcataacgtcattcaccaattctaatcctctaattcctttcatgcaaactcaacaatatctctgtggtgccattatttttcctgatcactagctccaagttactgggggaggatttattttcaaggtttggcatctgaatggcccagaccataacacccagtggctttctccagctcattattagacagaggggacttgatggtatgataggaaacccgagtgagtggctgttaggggtggtgatcaggaacaggcagcctgcctggagggtctggcctgggcagacggcactgtgttggggcccccgtgtaccagttctgctttcaggttgcagaggagagaagtggctctgctgttttactgggccaggaactcagctctgcacttgacttcattacaaaccatcagatggaagagtcaacccaataac

SEQ ID NO: 129445 - DNA, 1084 bp, Homo sapiens
ggaggctgaggcaggcagatcacgaggtcaggagtttgagaccagcctggccaatatagtgaaaccccgtctctactaaaaatacaaaaaattacctgggtgttgtggctggcacctgtaatcccagctacttgggaggctgaggcaggagaatcacttgaacctgggaggcggagtttgcagtaagccaagatcgcgccactgcacccaggtgacagtgcgagactctgtctcaaaaaaaaaaaaaaaagaggcaaaactatttctggatatcctacagacttatgaaatggaagggaaatgtatttgttctaagtgtttagtagaatcgttggccattcttgttggttgatatttggaggctgtgtccactccctgatccctgaaacctgtgaatatgttactttaggaggcaaaagagactttgcagatgggatcaatgtgacccactttgaggtggggggattatcccaaattattcatgtggaccccatgtaatcacatgagttcttaaagatggagagcctttcctgacatggtcagagagaagaggtgatatcagaagagtcagagagatgcagtgttgctggctttgaagaggaggaaggaggccatgagtcaagaatggtggtggctctaaaagagaaacaagaaagaggcttctctcctagagtcttcagggaggaatgcagccctgctgacccctgggtcttagcccagtgagacccattgcagacttctgacttcagaactgtgtgataacaaatttgtgatttattgattgattgattggtttttgagacaaggtcttgctctgttgcccaggctggataccattggtgcaatcatagttcactacaacctctaacttctgggctcaagcaatccttctgcctcagcctcctgagtatctgggattacaggcatgcatcaccatgcccggccaatttttttttcttttcttttttttgacatggagctttgctctgttgccgaggctcaagtgcagtggcgcgatcttggctcactgcaacctctgcctcccgagttcaagtgattcgattctcctgactcagcctcccag

SEQ ID NO: 129446 - DNA, 1382 bp, Homo sapiens
ggctaagtcagggtctgaggggcagggccggggcctggctgcgagctggggccgggggactcggaggagcggggacccagccccgccgcgccgcctgcagctttccccagcctcctcccagcagaggggaggcccgacagggaggggtcccatcctcatgaacggtcacaaacagggcgctagggaagcacgcccgacccccgcggtccccgcgctccaggattcggcagactgcgcgcgtcctgcctcccgcggatcgcactgggtcccaacagggttcccagctccaggctgcgcccatgaacaagcccagcattgcggacgggcgcgcgcagacgccagcgtggtgaagacgcgggggcgcgcgcgcggcgacgagactgccaggggacgcttcgcaacaccgagagtctcagcgtttctcgagataggtgaggctgcgcgttccggaactggtttcccggaaggagcatgtctgcgcccgcgatccgaccggaagttgcacgctgagccgcggacaccatgcagtcggatgatgtgagtctcctccggttgttcttacacccggggtttgcgcagggaattttgcccattttcggacacttagaaaacgcgtacgcagcgggtctgttgcctcgtgccgctctggatgtgaggcttccggaaccccgattttccaacataggttctcacgcgtgtctagcaggggtttactgcccgctgccccggccgggttgtgagcacaggactccgtcacctcagcccatggggtcgatgtgtcccgtccttcgtgcctaccaatgcaggacgtcgcgtcatgctgtcagctgtcagctgtcagctccggacttggggtggggggcggcccgggatttggcgaagctgactccaagtttaagcgtccttctcatccatgtgcgcgttactcttccatctgcgtttcctgtgtaggcttttctttacatttgctctacttctgcctaagtcataatttcggaagtatcctagattcattcattgagttttttgttggagaaataacagtgtgcttacagtgtgccaggcattgtggtaattattgaggatttggttaaccagaaaaaatgtcccacctctcctggaacactgatgggggagacacagtaaacaagtgaacaaataagttaacaattacactatataatcatactatgaaagaaagaccagagatgatgaaggacacttcagatagggttactcagggaaggtttctctgaacagaagatgtttgagttgagatctaaaagataagaataagccagtcactgaggagctgaggaaaaagcaatccaggcagtaggaacagtaaagtacaaagagttgaagatatgagagaatgaata

SEQ ID NO: 129447 - DNA, 2678 bp, Homo sapiens
ttttagatattgaagagatgtcatataaaaatctggtgctcaggaaagaagtctgaccagaaaataacaatttaggagtcatccatttagagatgatacttaaagccacaagcctaaaagagctcccttattcttcttacctgtttcctaccatcccccaccagacacacctataaaattcttaaagtgtgttttattcttttgccctcttcatatttttcctttaacagtggtaaagcttttttttaccccagttcctcaaggcagcgcactcaaaggctgtcatactcttacgcatgctatgtggcctttagacctgctattttgtgatactttgtttacatatctttcccctaactagatagacgaaactctttaaagagtatactttctttcattcagcaaatacttaagtggctactgtgtgtcaggacttggagatgtcagtgccttacataaattaagtatataatgctgaatgaataaagagcacattaagtacaggaggatagcagtagatagttttctttgccctcaatgagataaaattatggtatgtatatctaaaaatctaataccatgaagccttttttttttttttggagatggattctcactctgtcgcccaggctggagtgcagtggcgtgatctcggcttaccgcaacttctgcctcctgggttcaagcgattctcctgcctcagcctctcaagtagctgggattacaggcacctgccaccacacctggctaatttttctattagtagagatggggtttcaccatgttggccaggctggcctcaaactcccaacctcaagtgatccgcctgccttggcactcaaagtgctgggattacaggtgtgagccactacacccggcccatgagagcctttaataatggataatgaacataagtaaaaagggaaagttacgaagtatataaaatgtgatttcacagagtatgtcaaaaaaagtctggaaaaatatttacagaatagtaatgaaattttatctctgggtaatggagttatgattattgctcatctgtatttagcttttctataagaatctgctgggcttttttgttttgttttgttttgttttgagacggagtttcactcttgttgtccaggctggagcgcaatggcacaatctcggctcaccgcaacctccctctcctgggttcaagcgattctcctgccccagcctcccgagtagctaggattacaggcatgcgccaccatgcccagctaattttgtatttttaatataaacagggtttctccatgttaatcaggctggtctcaaactcctcacctcaggtgatccgcccaactcagcctcccaaagtgctgggattacaggcgtgagccaccgtgcccggccttgctgtttgtattttaaaaagtaaacaagtcaggctattttacaaaacatttcttcctctcattcctgtccttgggcattgccttcttgaattaatatagtatctcttggggcagaggatttgaaatgggcttttactttgtcttgcaggttatctgggatacactaggaaacaagcaattttgttccttcaaaataaggtgagtctcaatttacaacttggtcaaagattccttcagttgcctctttggcaacccattttataatctttgtttcttttctcccattctagaaccaagactcagagcttctgccgaaatgaatatagcctgactggactgtgtaatcggtcatcctgtcccctggcaaatagtcagtatgccactattaaagaagagaaaggtaactccccagttttaacttctagaagaactgctccacagcttttacagggatgttctttagtttctgtaaataacactaaagctattttactttatcttcaggacagtgctacttgtatatgaaggttatagaacgagcggcttttcctcggcgtctctgggaacgggtaagccttacaacaaaactacagtgaccgctgatcaagagcatcaaagccacatgcttgaccatgatgcccaattccatgaccattaacttttgaggccatcctcattaggccatgggtgtcactgacagtgaaaacctaatgaatcatttacacttgcccttcaaacttcctgtttctgtttggtaggtccggcttagtaaaaactatgagaaagcactggagcaaatagatgaaaatctgatttactggccccgtttcattcgacacaaatgtaagcagagattcaccaagatcacccaatacctaattcgaattagaaaacttacactaaagcgacagtaagtatttggatcattcattatttttaaatctctctttttatggagcttgttttgaagttgagaaattgtgaaacttcggggctttctattcaactttgtggagtctgttatgatgtactaaagagaaactttagctttgactaaaggtgtgccctttgatatggcaggacttttaaaacagtagaatacaacttgattatcaccctccttgtctgaaaatctttcagaaaattttattttcttttttgttaagacggagtctcactctgtcgcccaggctggaatttgcagtggcgcgacctcagctcactgcaacctccatctccccggttgaagcaatcctcccacctcagcctcctgagcagctaggattacag

SEQ ID NO: 129448 - DNA, 1049 bp, Homo sapiens
tgaaaactaatttttaaaagtgatatgaaatccccagaattaacagaataccttctctaggactgttaggccctaatgctttttgactgtgatctacatagaatgctaaagatgatgtcagacttcgacagaaaattcttttttcttagttcactgaagtcttaattttagcatggtgaatgccctgagaatcccagaatgcctgaacaaaaatggccggattaaaatacatgtaaaaatatatgactttttatagtattaaatttctagaagcgtttagtgtatcttgctgtattgagctgagccctacagcaccaaccttgggctccaaggcttgtttgaatcgctagcctccgtgaatgcctgaagctcagccatcctgccctgcacatgagtagacttccattttagtcaccaattccaatccttttttcttctcatccttaaaaaggaacacagcacatgacagtggattttctgatatattttctttcccttaggaggaaacttgttcctttgagtaagaaggtggagcgtagggagaaaagaagagaggtaacttattgttgagatattcataccttctacattttctttctgggggtctcttatagattcagtcaccatcattatgtaaactgttgaggccttggataatggttcactaatagataactattagttgcctaagacatttaatttttcatattttaagattatgattttcagcacaggttaaagtatgtgtgctttggggatatatgtaatggagaacagaaagaatccacaactcctttttctgaatttcttgtggtcaaatatttcagacttcagaattttgatgttgcatattttacatactacataaaacctttagtagattttgagcattctaatcaaatggaatttctgcagtgaaatacaatacaggcatgcagtgagtaataacatcatggaaaattgggtatccgtcccctcaagcatttatcctttgtgttacaaacagttcaattatccttacagttattttaaaatgtacaattaaataa

SEQ ID NO: 129449 - DNA, 1084 bp, Homo sapiens
tcctgggctattgtgtggtagtacaggttgatgtcatgtgtcatctccaatgagagatcactggaggaagagatttttacctattctgtcacatggaatctagcatgattttagaaaatgtaaacgaatgaagatttctgttctcttttctcagcttttacaaagtctggctccagagttgctagattatttctgagacacttaaatgtatatagacttacatgctttgtatctatcaaagcctgtgttagaatttaatttagaatgttgtttacaaaaccataggaatttcaaaatggaaatgttcccaaggaagtttacaagagaaagaagaagaaatctatctcgttggaaaggcaaaagccagtattagcaaggaggggaaataattacattgtctttcttataaacaacttggtagtttcttccatttttataagatgagtaatgagcactgatgaattaaacagatttgctctttcccccttataggaaaaggcattaatagctgctcagctggacaatgccattgagaaggaattactggagagactgaaacaagatacggtgagaaagccattagctttggggtactgaaattttaagtggtagtatgttgctaagacatattgggaatttttttttttttttttttttttttttttttttttttttttttttttttgagatggagtcttgctttgttgcccaggttagagtgcagtggtgcaatctcggctcactgcaacctctgcctcccaagttcaagcaattctcctgcctcagcctcctgagtagttgggattacaggcaccaccactgcacccagctaatttttgtatttttagtagagacagggtttcaccatcttggccaggctggtcttgaactcctgacctcgtgagccactgtgcctggctgggaaatgttttttaacatgatatgaagatctccactcgaattttatccctggaataaaataaatccatatcggcctggcttccttgctttaattaatgcaagcacataaaatgctttggttacccttgatactccattcactataagagacctttcccttttt

SEQ ID NO: 129450 - DNA, 1009 bp, Homo sapiens
ggctctttgaaataagtttttattctctttttaaaaattagtgttgtttatacagacaacatgactaaagtatgctttttccttattatttccccttgtcagcaaaatgacatttgtcccaatgcatgggttttgtagactattacattttaaattattttaaaatgtaactccatagaagttacctatttgatactaactgcagatgatttaaatgttcaaaagaacatgcttttttaagacactgctggctctacacttaaaaatattactcatcaaattaagtattctgatttaatcactgaggaaaaagtaatattctccacagaaagtggaacttcaagtgtaatatccaaatgtagttaaagccaatctgtgtttatgttcttcagtatggcgacatctacaacttccccattcatgccttcgacaaagccctggaacaacaggaggcagagagtgactcttcagatactgaggaaaaagatgatgatgatgatgatgaggaagtaagtcttgtttttgttttgccaaacctactagataccatttgtataaaactgagaaacagaatatcatcttcagtccgctaaccaaaaatgatatgtcttcttttttctttcatgtgattaattttggtttagcactggttgctctgttcttcaggctaaccaacaaaccattaacaattttagtcttaatttattggtcttctaaaattgttcctgcaaggtgacaaattataaagcctttcctgtctatatgtagtttttaaccataatgaggatgttttattgctaataatttaaatcaagaataagaatgatctggtagccctaaaatttttaaaattcagaagcattaaatttagaaagaactaaattttcattgcctagtgaaaagactgtggttctcattatgttattttgtacttacttagatgtctaatctgaatcttcattatgtattctgaacctaacagttatgttttatttataggatgtgggga

SEQ ID NO: 129451 - DNA, 2220 bp, Homo sapiens
tcgagaccagcctggccaacatagcaaaaccccgtgtctactaaaaatacaaaaattagctaggtatggtggtgcatgcctgtaatccctgctacttgggaggctgaggcagaagaatcgcttgaacctaggagatggaggttgcagtgagctgagagcgcaccactacactccagcctgggcaacagagcgagactccgtctccaaaaaaaaaaaaaaaaaaaattaaaattcagctggatgtggtggcggttgcctgtagtcccagctactcaggaagctgaggtgggaggattgttgactacagcagtttgaggctgcagtgagccatgactatgccactgcactcctgcttgggcaacagagcaagaccccgtctcaaaaaaaaaaaaaaaaaaaaattaaagaaagggacaatttctgaacacagacatagacaaatcaatgccctagtctgttctagattgaggggacaaggaagggagtttggagaaatctagtgttttccctcttcctttatcttttctctccccgtaataggatatggataaactggatgccagcagtgatgaagatcaggatggtaaatcctccagtgaggaggaggaagaaaaggcccttagtgcgaaacacaaaggcaaaatgcccttgagaggaccactgcagagaaaacgagcctatgtggaaatagaatacgagcaggagacagagcccgtggccaaagccaaaaccacgtgatttccctttcagcatttatacccaggactgaacatgcagaactgttttttttttttttttatcttaaacacatacacacctccagtttttgctcttttgtgttgtactgaacacaatatttgtgtttttattatttatgccacgtcagtggggcaagaaatctggagtgagtgaagaaagctaagttgtgaacaagagtgtttttatagcatatgtgttgaagtaacagcttgtgcccgagaaacttaacagatgagttcttgaatctgggatgagatgacggatgtaaatatttctaaattttaaatgctacattacttggtgtccttttttctcccaaactttatttagaaatggaaggagttcaattttttcttgttctactttccctattcttatggaggtaaaaggaaaggaaggaaggaaaaagcagctttcacttacaaagtttcgtgtaaaaatatctttttttcttaaataactccattcatacaaattgggatgggaagaaaatcctttcctcttgggaaagtaatacaagtcttaagttccattgtagggtgcgccttcagaaacctgctgcacttttctgatatagttcaccacttttctgtcttcacagctttggggaattttggccaggagaccctgaaacatgaaaccaaacaggctttgatatttttttttttttaattactttccccttttgcttgattcttcttccttggtatcatattcaaaggaggaaagaatggatgacacttagggacaggtcactaagcagaataggtattagttggttttttattatttttaaatttatatagctctcatgtattgaaggtgctactttaaaaactgtgttaatgtacttgcaaatctcctgctggctcatgaaacagcagaattccagccaaggcaaattcagttggatctagggcttgaaaactgcccaagattaaagagctaagatgaaatagtttgaataaactggtaaaataacaattcatactatctctacatatttttaggatatgaatttttttttcctgctgggtagattgtccagtgacttatggcatgaatttcttttcatgctaccttcaatcttcaactaaagatttctaaaaggggtaagaaatgaggcagtagtttattaaatacatagaagtacacagctattatatgctgtggctttgagaagttaacttttgtggaatatgaaaccaaaggaagaatttccatgtagataaattaagaatagggaaaaacatctacctaaaagatggttgtccctaaaaaactggaaacatctgaaatgctctatttatgttattattcctgggagcttatagcccattatttttactttttttttttaattcagaagactagaacagaacttaaattttacaaacttttgatcataatgcttttgcccatactgtctcgtccttagccccagtgacatgtgctgatcct

SEQ ID NO: 129452 - DNA, 1026 bp, Homo sapiens
aggcagaggttgcagtgaggtgcaatggaaccactgcactccagactgggtgacggagcgagactctgtctcaaaatataaaaaaaaataataaaaatttaaaaaaagcatactaatgtaggatatacttgcttggaaatcattccaactctggcttgaggtaggtgtcaggaactggaacccaaactgtggagtcagcagaagcatctcttgcatagctgaaaattgaattcagccagagaatctagtgccccaacaacatacagtagctattctgcaccgtattctctcacttccttataaatgtgcaaggaatccagagtaacatttccccatgacaacctttcccttagtcatattggtaactaggttgcatttgtttactatctttctccctacggaattataatctccaggataacggaaaaccacatctattatattctcccaaagtatgttcagtacctagtattaggtatacaaatattcaaagaatgaatggactggaagagaatgaatcaatggatgaataaaatcgaatcagattgtcaggtctttaaagagcagagaccaagattccaagaagggagagtgaataaatgtagggaggtagaaaaggaatatgtgtgtatgcgtatgagggggtgaagcatgggaaatggaaaacagagccgattataagttgaataacgagggctgagaggcacccaaaccataggaaaatgaggagtatttagatagagatgaaaacttttttctcccagtcacgcatctgtccataaatatgatttattgtacatttcacattgtattttcacattgtaagttaaattattttccacctttcattaaagtttttttagggttttttgtttattgtggtaaaaatacatataaattttccattttaaagtgtacagttcagtggcattaagtacagtcacaatattgtgcagtcactagcattgtccatttctggagctttaccaaggcgatgaaaacttttagaaaggttaatagttacaa

SEQ ID NO: 129453 - DNA, 1072 bp, Homo sapiens
tcaattttcagctatgcaagagatgcttctgctgactccacagtttgggttccagttcctgacacctacctcaagccagagttggaatgatttccaagcaagtatatcctacattagtatgctttttttaaatttttattatttttttttatattttgagacagagtctcgctccgtcacccagtctggagtgcagtggttccattgcacctcactgcaacctctgcctcctgggtccaagtgattctactgcttcagcctcctgagtagctgggactacaggtgcgcgccaccatgcccggctaagttttgtatatttagtaaagacggggtttcaccatattggccaggctggtcttgaactcctgaccttaggtgatccaccagccttgccctcccaaagtgctgggattacaggcgtgagccaccgcacctggcctctagattggtattctgatcactgctctgcagatgttaaatgatgtgctatgaagtactctattctcaattagatttaaagaacattaggattaacaaagttaagcaaatgttttattgcaacacttctaaatgacctttaatcttctaatatgcattctaaatctagagagaggtacaacctgtatggtttcccaacctatttgaccacagaatttttttttttttcctgtggggcatcaaagagtacctagatggagattctgcaaaacaccaatctaaaccattcttaagatatatagccaggcacagtggcccacgcctataatcccagcactttaggaggctgaggaggggaaatcacgaggtcaggagttcgagaccagcctggccaacatggtgaaacaccatctctactaaaaattttttaaaaattagccaggcatggtggagggcacctgtaatcccagctactcaggaggctaaggcaggagaatcacttgaatccaggaggcagaggttgcagtgagctgagatcgcgccattgcactccggcctgggtgacagagcaatactccatctcaaaaacaaaaacaaaaacaaaaggctgggcatggtggctcacgcctgtaac

SEQ ID NO: 129454 - DNA, 1678 bp, Homo sapiens
agtcccaactagttaggtggctgaggcacgagaatcgcttgagcctgagaagcggaggttgcagtgagccaagattgcaccactgtccttcagcctaggtgacagagtgactctgtctcacaaaaaaaaaaaaaaaaaaaaaaaaatgtgtaaatatcatgtatcactaagtcacttagacttagtgacatagtaacagtagacttagattcctaaaatctggattaaagtcccagctctgccatttttccgattttataaattagcaaagaatggtcctgaggagaatgtattgatttgagactgtcagatggagattaagaatgtaaaaaagtttgaaaatgtaaagtaatgtgcagttcatatatgattactagtatcttagaattctctggtatggaccctaaggacggtagattaatgaagttctagagaagtcagtgagtattgtaaatgcaaatggatgaactatgcaccgtccttccattccttcctcctaggctgtgctcctgtgtctgctggatttattccccatcctggagaaaaccctgcactggaaaggagatggagctcgacccaccacccattgtgatgaggtcctgcggctgatcctgacccacatggagccagagcaccgccttcttttacgcaggacctacgcaagaaacctgccggctttcgtgaacaggtgaggccctgggcttttatttattattattttatacagacaggatcttgctatgttgcttgagctgctctcgagctcctggcctcaagcaatcctcccacctcagcctcccaaagtactgggattacaggcatgagccactgcactggcgtcatattttctctttcatctttaggttggggatcctaactgtccggcacttaaagaggctggagagagtcatcattggttatctggaggtttatgatggacctgaggaggaagctagactgaagatattggaaaccctaaaacttctcatgcaacatacttggcccaggtaatagcagccttaaggtgcaaaactcagccgattttctcttgagaacttgcttggatgtatttaatacattcagtacaaagtattaaatgtatactatgtatttgaatacctcccattttcacacacctataggattttaaactgagaaaatggcattagaaagataaaatatactatagttacttgaggtgctcatagttgactcttttaccaggtatcagttccagattctgacagttaaatcgcttctctttgaaactctagtatatcttttttgttttttttttttttttttttgaaatggagtctcacactgtcgcccaggctggagtccagtggcgcgatctctgcccactgcaacctctgcctcctgggttcaagtgattctcctacctcagtctcccaagtagctgggattacaggcgcccaccgccaggcccggctaattttttgtattttcagtagagatggggtttcactatgttggccaggctggtcttgaactcctgaccttgtaatccacccgccttggcctcccaaagtgctggggttacaggcgtgagccaccatgcccagccttttgtttttgtttttgtttttgagatggagtattgctctgtcacccaggccggagtgcaatggcgcgatctcagctcactgcaacctct

SEQ ID NO: 129455 - DNA, 1012 bp, Homo sapiens
gtgctggggttacaggtgtgagtcaccatgcttggctctagggtagtcactaggagatacatggttgtaggtggtggggggatggataggtggaagataaaggttactttgttcagtttatgtaggtccattgcagccttcaattccaagtctctgtaagggctgttttcttaccctggtatggaaagcataccccacccagaggaatcttttatcacttgctgcatgcagaaagagacaagtcagctcaccctttctgaatctacagtttctgcaatattttcaactcgaaacaatcatgcatattttgggatggcatgttcttcatgcttcatacccataatccaatttcaaagatagtcaacatgtgccaatcttgggaaactattcttttaatttgacgatttgtctggttgcagccagctgctgatttgctccagtataacagagcccaggtcctataccatgccatttccaaccacctgtacacaccagagcaccacctcattcaggtaatagtatgatttcttcataactgggtctggattctctgaatttgagtagaaggttgcattgtgtgagtagtagtaattgagagacattttcctgccttggaaagtgaggatgataactaaaagcgttgccaagttaaaaatatctcagcaccaagcaggcctccacattcctgagtctccacagataagacagtgttttttattcatctgagtcaattgtatattactttgggctgggcatggtggctcacgcctgtaatcccagcactttgggaggctgagggaggcagatcacctgaggtcaggagttcgagaccagcctggctgacatgccaaaaccccatctctactaaaaatacaaaaaaattagccgggcatgatgttgtgcatctgtagtccctactactcaggaggctgaggcacaagaatcatttgaacccgggtggcggaggttgcagtgagctgaggtcacgtcactgcactccagcctgggtgac

SEQ ID NO: 129456 - DNA, 1005 bp, Homo sapiens
agctctggttataattgactccttctcattggataggctgtagacccaaagccctggatgattatttggtgtaagttatggaagttattttaatccagatcttagaatgtatgatatagaatcaagagttatcttatgtgcgatgtattttttttttcaaagacatgaaaatactctgtttagcttgaagtagttttttttttttttttttttgctacttatcaccatgtcacttaatgtaattctatgtattcacttagggaatcctggaagaataaccctgccatcaaacatgttttctcatggactctgcaacaggtcactcggccctggctgagccagcatctggaaagggtacttcccgcatcattggtcatttcagatgactatcagactgagaacaaaatcctgggtgtacactgtctccatcacattgtgcttaatgtggtaagcaacctctggcttgtcatctgtgttgacaggacagactgagtcattcctggctgttcttcatttctagtaatgctaagtcattcaactttacttatttgtattttctccttatatttttcctctatccacctggtagaagttgtatcctataggtaatgtaataactaaaatgataattatagaagaaacaggaaggcatgggtcattatcaaactgaataaccagatgttgagaactggtcaacagttgattttctttctttctttttttttttttttttttttgagagggagtctcactctatcacccaggctagagtgcagtggtgtgatcttgtcccactgcaacctccacctcttaggtttaagcaattctccgcctctgcctcccgagtagctgggattacaggtgcgtgccaccatgcccaactaatttttgtatttttagtagagatggggtttcaccatcttggccaggccggtcttcaactcctgaccttgtgatccacctgcctcagcctcagcctcccaaagtgctgggattacaggcgtg

SEQ ID NO: 129457 - DNA, 1051 bp, Homo sapiens
aaggcccagaaacgttgtgatttgctataaatgacataactggatagtggcaaattggaggtcataactgagatgttcgggctcagttgtccaatgctctttccagcccttaggacgactgcctaggaaaattggaaattctgtcccacttacttggagttaataattacaaaatgtggccgggcgaggtggctcactcctgtagtcccagcactttgggaggccgaggcgggtggatcacttaaggtcaggagttcgagaccagcctggccaacattgtgaaaccccatctctactaaaaatacaaaaattagctgggcatggtggtggacgcctgtaatccaaactactcgggaggctgaggcagtagaatcgcttgaaaccaggaggcagagattgcagtgagctgagatcgggccactgcactccaatctgggcaacagagcaagacatcgtctcaaaaaaaattacaaattactagaatttggatgggggatttagagaggatttaaacttatggtttgaatttagacttggggatcttgaatctcattactgcttgttagagaaggatgactatcagctaagaaagccatgtttaggataaaaagtgaaaagcacctttagattactgttagctgaagttctttcaatgagtttccacttgctactttgttagcactggagtaatgagagaaaaagtatctgtaactgtcattttaccaggaacacggaattaaaaggcttgattttgagtttcgtgcttctatttgttgctctgagtaggaccagattagacagttatctgaatctgtttgtttctaatataaagataatatacttggcggagtgtggtggctgacacctgtaatcccagtactttgggaggccaaggctgtcagatcacttgaggccaggaattcaggaccagcctgggcaacatggtgaaaccccgtctctactacaaatataaaaattatccgggtatggtggtgcaagtgtgtaatcccatctactcgggaggctgaagcaggagaatcgcttgagcctg

SEQ ID NO: 129458 - DNA, 1024 bp, Homo sapiens
cattttcccgagcctggatctttattgctttacgaccatacgtcgtgaaataagaaggtgttgcggcagtactggcggaagctagccttgcgttttgcggcagcaatatgagctaggtccggatcctgttagacaccggcgggcgcgagccgttgcaggtacctgggggtggttaagttggtgacatggctcagaagtttatttctttaaatttttaagttttttttctttttagtcttcagaaaggcaacagtagtcttttaacgtcactgttaaaagtgtaagactcttttactccctgagagtcccctttccctttcttgcgtcctttcctctttattcttttttttttttttttttttactgagacggagtctcactctgtcgcccaggctggagtgcagtggcgcgatctcggctcactgcaaactccgcctcccgggttcaccctttctctttattcttatcccggtcagactcgccccctcctccaagacatctctctgttttattttatttgattttagttctctttgggtgatcgctccttccctcttcaacggatccctccccgcctccatcctcgttctgtgggagagaccagccttctggtgctgcagtcaggaatggagcttgacagcgctctggaagccccatcgcaggaagactctaatttgtccgaggagttgtctcactccgcctttggacaggccttctccaagattttacactgtcttgcccgcccggaggcacgacgaggcaatgtaaaagatgcagttcttaaagacctcggtgatctaatagaagccacagaatttgataggttatttgaggggactggtgcacggctccgcggaatgccggagacactggggcaggtagcaaaagccctggagaagtatgcagccccctccaaggaggaggaaggtggaggtgatgggcactccgaagcggccgagaaagcagcccaagttgggttactgtttcttaaactgttagggaaagttgagactgctaagaattc

SEQ ID NO: 129459 - DNA, 1876 bp, Homo sapiens
gcactccagcctgggcaacaagagtgaaactccatctcaaaaaaaaaaaaaaacataactgatcacatataccatgccctcatcctacctctagttggtattaagtgccacatcaccaaatgtattgggcaagaaaggattgaaaaccattcttctaggacagtaatttccagtgcagtggaaacttctgtgataataggaatgttctatatccatgccattcaatatggaaaccatgtggctgttgagcacttgaaatgtggtgagtgtaactagggactgaatttataatttcatctaattttggttaatttaaatttaaacagccacatatggttaatgactaccatgccatcaatatagttttgtaaaggatggctaaaaagtttctctgcctggtagaacagactaggctagagcttagttttcttgtctggggttgaatgagtgagatggttccccagttcctcacacacctgctcttttctctctgcagcagacctgcgcagtctgtctggaagacttcaaggggaaggatgagttaggcgtgctcccgtgccaacacgcctttcaccgcaagtacgtgggaatgtgtccagggtgcccgtcgaaggagaaataatcagggagcatcttctggaaacttccagtctctgccactttctatttgccccttatccgtgatgccccaggtcctacgtgaacaccgagcaaagcccagagggattaggttgggacaggggtagggatattcttcttttttttttgagttggagttttgcttttgttgcctaggctggagtgcaatggtgcgatctcagctcactgcaacctctgcctcccaggttcaagcgattctcctgcctcagcctcccaagtagctgggattacaggtgtccaccgccatgcctggctaatttttgtatttttagtatagatggggtttcaccatgttggccaggctggtctcgaactcctgacctcaggtgatccacctgcctcagcctcccaaagtgctgggattacagttgtgagccaccacgggatattcttgttttgagagacaactggagcagcgtggtctgtctggttagagattaccattcctcatttgttctcaggtgtctggtgaaatggctggaagttcgctgtgtctgccccatgtgtaacaagcccattgctagtccctcagaggccacgcagaacattgggattctattggatgagctggtgtgagtgctgccgctacaccgagacctggagaagacctcttgcctcatggatgtctggtccctctgcacagctccaaccaacaggactgtagggtgatgacgatcactttcccagtgatgagaagggtggtctaggactgggcttctaccctcagtgcaagaccagtgccagatgtgcccccacttcctgcctcctgaagccttcttccctgctactccatgctggtggcctcacccatcaagaccactgtctcctggtactggactatctacctgccttgtccctgttctgggggaaggtgtccaccccgatcaagaacatggagaaagtcctctttcaaggctcccattaggaggatgagctgccttgacccagaagggatgagacgggctcttacctctctacaaccttccctccccttcccactccttccggagtaaggttagaagggaaggaaggaaagatcaaggaaccaagcgcctccacgggaggcgagggaggctctgtatgaaacagaagagcagggacataaaggaaaatgtcagtgtttacatgggacctatggaaacaaaggctggcgggcgccagctgactccagagtaagagagggcccttcccctgccaggacccacggtgctatcca

SEQ ID NO: 129460 - DNA, 1022 bp, Homo sapiens
cttagtcctttatcaacccttgttggcttgcataggtccaaagtatgccctgtggtgtgtatgggacaagcacccctccctgccctcggaagaatgcccaagcagccagccagcctctcctgctttgaattgttccatttaacctgctttctctaatttttttctctttctcccagcaaactgcggaaccaggcacagagtgagcgatacggatataaggaggtaaagtgctgcgtgtttcccagaagcttccttctctgcctgacctgataggaagaggcaaggagggcaggctcaggttctcctgggcaggaatccccctggcctcacctctgggtctccctgaggctaaaccccttcagtgtctgaagtccggcttgccccaggcagtccaggggactcccttcattggttgatactacctggctggccccagtggttggttcttctttggacatcatgcctcctctttcttttcaggtggtgcttaaaggtgatgccaagaagttacaattatatggggtaagtgtgccaggaaagtgtgcaggagggccccagcaggtgaggcagacagcaccttgctccagttctctgcctggacgcttttcagaaaactgcttagtccatgccttcatatctcctttggccaaataatggagacacatctcagcaagtaattaatatgtggaattgattacacctggaacagcctcaggcagaagacatgaagggatcacagaagggtttagataagtagtgccccacagccccaggagtcccacaatacataatttttaccaggaggatggtcgtaccctttcatgccatagacagaattcagctaactttccctatgttcagcccctacatcctggttgttatcataggaaatgaggtccttttacttttgtatataccccatcttaacagactagatctgactagtgtgttcattcctgtggctctgccatttctctcccaccccactcccacccatacaccagttccttgagtcccctcaa

SEQ ID NO: 129461 - DNA, 1038 bp, Homo sapiens
tacctgggattacaggcatgtgccaccatggccggctaattttgtatttttagtagagagggggtttctccatgttgttcagactggtcttgaacttttgacctcaggtgatctgcccacctcagcctcccaaagtgctgggattacaggcgtgagccactgcgcccagcctactttaattttttttttgagagagggtctcactccgacaaccatgctggagtgcagtggcacgatcagggctcactgcggcctccaactcccaggctgaagggatcctcctgcctcagcctcccagcatagctggaaccacaggtgtgtgcaaccatacctggctactggctaatttttaattaattaattaattaatctactttttggggatagggtttcactacattgcctatgctggtcttgaactcctgggctcaagcagtcctcccaccacggactctcaaaatgctggaattacctgcaggagccaccttgtctggccctctttgcacttcttagaaaagtgactgagagatcctgtcctttgactcctgtgaagaagcaacccttccctcaccccttcagaaactacctggagcccctctttcctggggctggtattctctgtccttatacagttttaaagaaaaacttactacagtgtcagcttttgaccagtagactattttgccatttctttaatagtaacacaagcaaatgaaccatctcctcttgactatgctcttcccaccgacctctttatcacgtgaaataccaagctcactgattcaatcagtgggagataaaggggaagcctttatcaggcaggataagttggtggggataaactgatcagaggacttgcggggaccatcgtgcttgtggagtgcacagatatcctctgtaatagctctgaccaggttctgcaagttcccagaactggaaaccaaaggaggtttcagctcataaaaggtgcctggaagaactaaggaaacggggggttagaccctcttgtaacatcaaatagtgcgggggaaggaggtg

SEQ ID NO: 129462 - DNA, 1231 bp, Homo sapiens
tgggaggaaaacccaagaaaatttgcattttgatgggggtgggggaagtttgagggctatcatatagaagatcctttcttttatgttttgggactcagttcaagaggagctgcagtgggctgactaacatcagcaaagacagcccgtatatccttgggctctgcaagcagttactccaagtcttgtctgcagactgtacagtggaacagccatccaaccccaactggggaaacttcattaaggcagtgcaaagtaatcagtttcagtcctggcctctggctggcttgaaggacaatcccttctcagctgtaggtggcactgttgtatctattgtaagaagcgctgtacttcggctagctacatcactgctatttaaaatggaggaaaaagagaaaaaaaataaaatccaactccctcttcctccttgtcccactccatctcctaacatgcactgtacaccctacctgggcaaacctcctccatgccacccagcggacattatatgttgtttaagcttatatgttttgtttaaaatcagtggttctcttaggccctttgcagtgtatgtgcaatttagctctgggatgtttcatctgaagctcaactgcctgagatgatacttgcttctccccattctcctcccctctaccctccctatttttcctttccctgctataactcacattcacatagtgatgggtggtattggaagacagactggggaatagtctgtgtcttggactctggaagaggcactggttagtaatagaaataaaaaccgcaggagctgagtggcagtgtgtgctggggagatggcaacttgaccgaaatgggagcgtgggaagagagccaactcttgcttctcccatttcattctttctggcagttcagaaaactggtttcccctgggttgacaggcttgggccaaatatgagaattaaattctgacatctagttagaggtagtgaggttgaggtggtggaagaagaaccactccttaggagtgcctcagcttccccagtgctgagatggaacgttgtactgacccattaggcaaagccttatggacaatattaaaatgatgtgtatgggaaaaaaaagtgataggtttaggagatgggagctaattctcaaaacattgtagtatataatgaaaagacagaaaaaatacaagaaaaataggtaatatttggatagcaacttaaactttgcaaagttctcccaccctcaa

SEQ ID NO: 129463 - DNA, 1082 bp, Homo sapiens
taaactttctcagtaatgaggattcatttgtctacctcaactgactgagcataattatggtctgaatggagctcattttaacctttaagaatctcaaatcttgtctttgtaaagttcaaaagagcttgctggtaccaggtggcatttagagagtaaaatcttttcttagtcatcagaatatataagttcctcctactatggtgtaaaggcgagtttttaaagacaccacagtgcaaaaggactgccagggtgaaaagccgagagtgaaatggtttcttcagatgatttagcaaatctctagagaaggatttgtcttaagaactcattgcttaagttcagcatagcggcactcgtgttctaagagactaaactgcctcaaaagggagagaaaataattgtctagccagattgtatttgtaacctgtttatccagcagatattggatgaagttcagcacctctggtgtgtggcctgtgagtgtggttgtgagtgtgcacatgtgtccagcctagaagacgacggcctgtggattgatgacaagcgtttatatcagcctgaagagaacctccaaatctcattgctgtgtgatatgccacgttttgtcctttggtggcagacttggataacaacatcaattcatcattttatttgtctcctaacacaggtgggctgacctgcagctttatgatgtaaaagtttgtgtttgtatttgaaatattgaaaatgtatttgaatcataggcaaccacaacccaagaacatttttgttggcaaaatgatttaatatatgcataaaatatttaaaaattttatcaattctaaaaaatatatttttctttgggaagccaaggcaggtggatcacctgaggttgggagtttgagaccagcctggccaacatggtgaaaccccgtctctcctaaaaatacaaaaaattggctgggcgtagtggcaggtgcctgtaatcccagctactcaggaggctgaggcaggagaattgcttgaacctgggaggtggaggttgtagtgagccaagatcgcaccactgcactctggcctgggtgacagagcaagacaacgtctca

SEQ ID NO: 129464 - DNA, 1049 bp, Homo sapiens
ttttcttttctctggggcaatatcggtgaaatcttttattcattttcttagttatttttgttttgtttgtgcacatttcagctccatgaagttatgcttattttaattgttttcattatttgtggaagcccggttgtattttgacaagcatggcttgccatctggcatacgtagaatctaatcttgtcttcaccatttactctctgtgtgacctggaggaaatcactgtggcagtttcctcatctgtaaaatgggcatagtcaagtttatctcctggggcttgaagtaacatatgtaaagtgccattgatttgcctttaacttcagttttgtttgtgtgccttaacttttatacacctatattgtaagtagtttttatttataattacattttttttctcatcacaccaagaccttctggaaacaaaatagtttaacatttctaagggattagggatgtatggccagataaatgggatatgtccatgtactgagtccattgtttggaagatggggtgggtagagatagaagatttccttgtggtttaatataggatcaattttttgttaatgattcatggaaattgaagatacaacgtgtttttttattggcaggttgtgaagatttcagtgtacatctatttaatcactcttcttaataaatttttgaaatcctcagaataaattgtcagtaaagaggtttacactgatttgtcccataataacatgataacagcagtaagcttgccctctgagtgttaaattgaatattgacatataatagatcaaagtttatatatgtggaagttgttttttttctcccccctaacatcagaattgcttctgggtcagcaagagttgactggaagttaattggttgaattagcacagctaataaataacccatcagagtgtcagactcagatgcgtagacaacggatgtcaaggagtcccatgtgatcggtgccagcactttccaacataggctgagcatttgtcagtgtacttcaggcactttcaagtcatcagcatggctgtacatattttgag

SEQ ID NO: 129465 - DNA, 1049 bp, Homo sapiens
attggaataaggtttccgaaatatgttatgatgggtgggagtgtggaattgcaagcaaagcaaagagtgtgaccaaactggcaacgttggaaactgatcatagactgtttgaggaatggcaggtcccctgataaaagcagtgccaggagagagttgctaagcctggaaagagccttgcaagagtattcaaagaataagggcttcgtttcacaggcagtgaggaactgtcgtcatccttaagctggacagtgatgtgttcagactgctgggtctattcttcctccgttctttccttcctttcttccctcttgatgatttccatgctttgtggaggttgtgttagagtaaaaataaaaaatacataaagcgtggcactgtcattctctgctagtggagatgcaaactgacacagctcttctggaggaaaaataggtgatacataacaagaccaacttttaactcaggatcttactttcagtaatttatgcaaaagatctacctgcaagaatatgaaaagacaagtggataagattatttactgtagtattcttggtaatagcaaaatattagatgttttgctattacctaaatattcacacctaagagaatggttgaataaatgatagtgcagctacacagtggagtacaatgcaactgtaaaatagagtgaggaaagttactgtgaattgattgctattgaataatgtccaggatatgctgtaaagtggaaaggcaaagtgcagaagggttactctgagatattccttacttaataaaataaaaaggatatatgaaaaataagcatgcacctgctaatttgtacaagagaaatactggaaagataaatcagaaaccagtgaaataaattacctataggaagtggatgaggaaggagtagaaggaagaggaccgaggtagtagagatgaggaagaacagcacttctcttatgccttagtttagcttggcctttaggaagtagagtagactgggcatggtggctcacgcctgtaatcccagcattttgagaagccaaggtgggcacatcacc

SEQ ID NO: 129466 - DNA, 1105 bp, Homo sapiens
ggccacacatgaaatacactaacactactgatagctgatgagctaaaaaagaaaaaaaaaattacaaaaaatctcatgttttaagaaagtttacgaatttttgttgggctctgttcaaagctgtcctgaactgcatgtggtccatgggccgcaggttggaccagcttggcctatcccataagataacttagaattcaagaacagaacttaactttgaggtcaataatgtctttgtagtgactcattactactttttactgattacaggtcatctagacaagagtccttatctgcctgatgttttctgatctagattttgtactttgttgaggggcctaggtgaggaggcattattagtctaagcagcagatattaagtattatacgacatggttcagacaactgctgtttgactggtactagttactaatgggacagtgagaagacctaaaagtttttctttggttaagtgaggagaggctcaagaaagagttagcagggatggacaggggaaaagggaagcctgagttagtggaaaataatttaaattgccttagatttaattgatagagtttgcaatagaaaggaaaggcaggcaatgcatggtcacttgcagtgaacctggtttaattaacctcgcatttccactagtgcagtcttttgggtaggtgaggggaaaatgctgtgggatagaattgaccttgccttcctacacatgcatatggaaatgccacgcaggaactttacagttaatattgattcaatgtcagaagcacaacattgattgcaatggaaaagactgttggggggaaacttctgaaattttcatttggaatgtgtgaaagtgcaagccctaattattggcatatgtggcgatattgagggtatgcactcaggcctgtgataatcgacttctcatttgctatagaggcaactttttcataccagtttgattatgctttatatatttcttactaagaagaaggaaatgcttgctatataaccaaaagagattcctattttaagccttttctatgtcacaatgtatgtgtgtgtgtgtgtgtgtgtgtgtgtgtgtgtgtatctgtaaatataatcttagaggt

SEQ ID NO: 129467 - DNA, 1052 bp, Homo sapiens
caataaatgcctcttaggtggaaaaaagactgtatttattgaaacaggcttgtaattggaagataaagatttggcttacatttatgcctcttttagctcttgctaccttttgttcatatcacctttccagactccattttcttcatctgtaaaataaaggggaaagggttcaatgaagtctaaggtctcttttaatcactggctaataaaaccagaagtggtgactagaaaaatagttcaaaactgctagctgatgcgctacagttatggggcaaatagctattgcattattccagctgatcttcagttcagccatcgtggtataattccatttagatccaatctagatacgtttttgcagggcctctatcatttttcagaatgtttgaaaaacaaaatacatttaggcttctaaccttgagtttggaaatctgaaatatacataagatgatatgaacgagcctgactttgattaccatagagtggcatagctgggggctgcaatgaaaaaacctataaaatttaactcgagatgaaccatgacaggcctccttaatgcgcggatgctttggctttcgagtgtattctttcactgtattatacaaaatgtggataaagtgataagtgggtttaaaaatgattgtataagtgaagtgcaccatctcactgtaaagtatttggccccagggagaccacaaatgtgatgcagcctcatttcctttcttttaagtgcttcctggggctgctcagggttgctttggatgggttggttggtttgttgtttgctaagctaagatcatattaagtcttgatttgttttttttggaaaactgttatccaaaggggaattttggagaagcagaaataaaggcagagagattaagagacaggaaaaagaggaagatgagtgagagatgagagattaattcacgaccctgtatagattattcgaaacagtttaaaagaacaggagagttatattggggggccattgggcttgcttgaagtccagtggttcgataaaaattaaaacacatgagttcatgagtatg

SEQ ID NO: 129468 - DNA, 1082 bp, Homo sapiens
cttccagaaaaatagaaactgagaaaaatcattgccagcaggtttgctctatatgaaatggtaaaattttccagcataatcctatacacaaaaaattgaaaaatgctagtaataaaaattatctgagaaatataaaacatattttactaattttataatctctttaaaaataagtgactgcttaggggaaacaaaataaaaagtgtaatggatttattacatgttggagaaaaatgcatgaaaacaacagcacaaggtataagagaggaaaaaatataatgttcaaaagtttttatactatttgggaagtgctataatataatttgaagataggctgttttgggagcaaaaacggaaatttccctctaccaacctaggtcctgcgatcaggggcctgcaaattaaatgacaatagacagattaacagaagaaaagacaaggtttatttacacaggcatgaaggagcatttgatgaagagtctcattgaacagctggaaagaggggtttatataccaactcatagaagaaagcaagggagaggaaaggacgtctatggaaaaatgatgggcttttaggaagactaatggcaggtctgatagtttgcgataatgcttgtctgtgcaatttttcatcccagtgctaggggttggcctccttactggttgtgaagctcccccaaggagggaatttatggcagtatcactctcagaaggctctgactttagtcagataagggaagctctgaaaggcttcttttgcttctgctacaactcaaaatatagttgcttccagtgcaataagtaaaaaatgtaaattgtgaatcacaaagcaacaattaaaaaaaatatatagctaataagccaatagtggaagtaaaatgaaatcacacagaacactaaattacttcaatagaaggtaggacaagaggaagaaagacacaaacaactgagcaaatagaaaatgagtagcaatatggtagccatggaaacacatgagtcataaaaaacttataaattagattttatcaaagcaaaaactattttgaaagatacagttaaaatttccaaatgcaaaccacaac

SEQ ID NO: 129469 - DNA, 1104 bp, Homo sapiens
ggcagaggttgcaccccagcccgggagacagacagagactctgtctcaaaaacaaaaacaaaaacaaaagtgatgaaaggataagacatgtggggaaatcaccttgctgctgtcctttgctttcatcattttgaatacagaaaagccttatattaaattttaacaaaattcaaaggctgaaataaggaagaaaaacgaggtccctttaacatgctatcatgtgctcttagatgacagaaagttttatgtaccctccttttcctttctaatcttgaaatttttggagtatccatcaaaataatgagaactaaggttttattttgctgatcaattttagatattatttgcgaactatatacctgaaatggtggaactgtttgctaacaagaggaaatacaccagttcctatgaagcactcaaaggaaagaagtaagtagtgttttaagtataatttctacagtttaagaaattctattagccatatatctcgttctagacatctattgtctggcttagctgtagaacccaaggtgaatatatcagcaacatcccgtattcactaaaaaggactgtgctaaactaaataccgtaagaaaatgatatttgctacttgacccaaaccactacatagatgctcataagaaaactaaatcaactaaaatgacagataatgttgtaattcactgtcaataaatattactgattatggcactatttgtacattcctttccactaacttctcctatagccattaccaattgtcttactcattttccttgtatgggtaacttatggctaactttacataatggatcggattaaagccatgattccaatttaaaataatttagttcagttgtcttagccaaagctcccctaaaccatcgggggctcatttacggatgaggatttgccagcatgagaagtttctaccctgtcttctatagcgcctcctagatgactgattttttttccttgccacagccatgtgttcccaggaggaaaatggagtggagttgtttttatattatttcttcttggattcatgttaccttagcttccattaggtttttttttcccatctaagacaaaaagaatgaaatg

SEQ ID NO: 129470 - DNA, 1008 bp, Homo sapiens
agcctttccctagtcaagggtctataaatggctcagccaaggggaatattccaacaatcccttgtgaagagatgtgccaactcactgagatttctatcctattgcagtgccatcggtaaagagaatgaaaaaatgtctgaagggaatctcctctcgtatatcagggcaggattctccgccaagggtatctgcaagcacttcgagcatatcaaacttcaccaccaggtaaaagctgcagagaaccctggtctcctatagtttttttgagaatcagtgggccatatatattgtatttaaaccagaatatttgctttataaactcctatactgaccaatggaattgttcctccccaaaatgagatcatctccaccttgcccatatcattaagctaatcaaatacacctctttcttccattgctcaaatcatctgtacccataataacccaaaagttagatacccaactttctttcacaccacctttcaggcactttagaaatgtaagttagagccaaattttagcagctccaaatagcttttctgttgttaatcaatcccctatttccaatacattcaagatgtgattgtcttagtttttgcatctgcaaaatatgggcaacaaatccctcctccctgcccttttccttgcagccttttagtacactaaaacctccactaaccagaaagaagagttggaggaggatgacctgcttagttgattttaattagaggggcaattcaaaagttctattattccaaactttaatgaaaatgactctgtaatatcttgacaacatttcagtttattagggataatataccaggaagatctttgatgattaaaaactgtgattatctaagggtaaatatattatcaaagagtcgttatactgtggcattacataatgttataaatattttgtacgtttttaatagtgattaaatgagattaggtatttaaagcactttgctgctgcagccagtatggaaaacaatatgcaagttcttc

SEQ ID NO: 129471 - DNA, 1042 bp, Homo sapiens
catgatccatcatttgatcagaaacacgaaactgtcagagctgtcataccaactggaagactattagggttgctgaaactcaccattttagcaattatgtcttattctgaactgtacgaaataaacatccgttgagcaggaagccaaacatattttcagtgggaggcaaatctttagaaaggtcaggaagttggttgcagattgagacatttgagaccaaacgatggaaatagcagaagttttattagatcatatttattaagaatgcagacaggttgccatgattgatatttcccttatgatacttgatatggaatatagttcagaataccaaccaggtcttttgttaagtttaggatgccttctagctttaaaattgctaaggaatttgaaatgtgagcctctaggaaagaaatatctggattgcaaaattcggggtatctttaaacttggtttcatttgcaaaagggtcaagtagaaatgatcaatttaagttattttgaacaaataggacatcctccccttcttccaatagtcaccatctttcttaatcaggagacagtttagtgccacagtttcttggagaaattgcctctctagctgtgcccattaatgcacttggccatgtatcttgtttctaattgtttagttctactcagaaaagcaattgttggactttagacatgttacattaaataccgttagaggcttcattattcaagttaaaactaatcggattagctagagacaattatttaatagatttggttaagattcatatcactctaggaaggctctccagacaagtagctttatttcccctcgcagggagatctctcttggaaggagggtacagtacagtatttcccagtatatgctaatttggtaaactttaattgttgaaatgtcagatgttacttatttatcctgttagacttcatcaatgcctgtttcatagaagattgccatttaacccagcaaaggactggcataaagaagaatgatatatccatttgaagtattctgagtctttgtgtgtcta

SEQ ID NO: 129472 - DNA, 1089 bp, Homo sapiens
agacctctcagcaaggcaatctttactttctgcagaaagggtgttcagtggcagatggaacaatggcaagagcacacttgaacaaaggaaaagcagacatatttatcccttatgcatttgggtcatccttactgctgggtcctgcatccattggctggagctggaactcacagtcttaaacttatacccaatttgctaataacctaaaacttttctaaataggtaagtgcaagaaagaatgaagaaggagaggaggttgcttacgaaaggtttaaggaagcaataacatttccacataaagaaggtgcataagctatgagttaagacttgcctgggtctgtccaggcatgcctgagtaagccaaagcaaataactgggcaaaagtgtaagaactaatagttgacaggaggctttagagtaaggagctattattcctggtgtctattattttatttttaaaccaagatgagctttgaagaggaacttttctgctttctacagagtacaccccagggtgttaaaggaatttcaaattgactgagactcatgagatcagtgtgtagccatttgtgaatgacttgcaaaaactcttccaaaggaaagccacataacccactgcctcccacactcctcctacccgggattttcaagggaagagctgcaaaatggctggatgtcaatatgcagatgcttaaatgcagaagaatctgagcacagttgatgaacttgctgcctcctggaggtccacagtgagaggcatcatgcctgaatttcaggaatgcttcaaggcacagtttgcaagtttaagggagcacggctgggcatatccactccctccctgacatcaatgccattcggcatgagattgtgttgccctgggctctgcctctttaagccgtggtaggggtctcatacaccccatcaagctcttagagagagaataccacttcagtggtagtttaacattaaacaaattggtaaagtgcaaggctcctaaagagttaagcagctcagccttcactgagctagggaggtactagaggaagtcaagtcaggttacttttctgagaaggtggctctgtcagagaa

SEQ ID NO: 129473 - DNA, 1010 bp, Homo sapiens
gctgccttcagatcttgtgttttgtgccatacccttcagcactgcttgttataaaaggaatgaagagttctcattgcaaaagtcatatgaaattgtaaataaagcatcacagacaacagagacacattcagacacaaattgtcctcccaccattgattcagttactgagacattgtattcaccagtctattcttaccagccgagaactaactccctctcttttcctaagcaaatagcatggaatcagagtagaacaaacagtattatatcatctcagatacctttaggtgacaatgcaaaagaaaatgaaaggaaaacttcagatgaggtttatgatgaggatccctttgcatattcagagccactatagacctgcccatattcttcacgtgctcttaacttgctgcttacaaatcatctcctgagatgctaactttgaacaaagaaaataagaatggaagcatgccatttttctgcccattgcttagtggttcatgaaggccacactgttttgggtgagacaaaagtctaatgccactggatcttgtgtgataaataaagaaatatatgatcaatgcttctgtaaggaaagttcattgctcctgagtagaaaacatgttaatttgagctgcattaaagaagtcctccagtacttgctggattccccaggtcaggaaatacaggtaatcaagataaaaatgagaattactcagacataggaaggaagtaaagagacccccttcagtcaagaatcttacattttcttttatcccagaacaggcaaatagtaaactagtatatatttccctctttccctccccatcgtatttttcgttattccattgtatttttatttcatttctttttataggagttgagaagcaccagatgaggagatgtgactggaattggaaaacaatttgtctataagacctgggcatatgcctggaacatagtagaggtttcataaaaatgaatgttagagtaccctgggatagggtgcctgagtg

SEQ ID NO: 129474 - DNA, 1315 bp, Homo sapiens
gcaggaaaggacgcaactgcagatcggtagccggaggccgccacggtaaaataagcgcctcgcagatgtccgcgccccggttacgttagacctgggaggcagaatccacgccctgcgctcacgggcccacgcacgcacagctgaactttgcagtcagtcaccatagttccagatcattcagcgttcaggatcccactcctccgcgtcctggtgcctgaacgcggttggacctaggagcctagaggctcgcagtttgggacattgcctttctctctgaccacgggcttggggatctgtcaggtgcaaagtgccaaagtatatgggggggagtgtggcttcaggcttgttcagagccctgtcctgtttagggccaaaggaataactgggaaggtggatgcgaggccaacgaatcctaccttgaaactctgctcgcctgctggctctgccactccagcatctgaaaggagtaaataatggtttcctttgaaactgcaggcaattaggagtgggagactctgaccagaattacatagccacaactgcctgtcatttggcatcctctgtaatttgggccaaagtactgcagctgcctctcttccctactactggtaggaaaggttcagtgacagcacattcgtgttcacaggaagacaaggctgtgttctgaaccctacccagctggcacgggttctcccttgagcaacggctgtatccggagccagtgcttcctcagtgcggtgggggctctaattttacagttaaagaaaggggaacgttgactgagaacgaggaggaagcgagttgtagatctagccttgtgttcacacgacaccaggctggatatgagtcactcgcagggagctcagcttggtgaggtcctctcgctgttgtggccttttctcctgcacgttggaccacacacattttcccgtgtcttttccctaggataaaggctcactgatggctcagttgggagcagttgtggctgtggcttccagtttcttttgtgcatctctcttctcagctgtgcacaagatagaagagggacatattggggtatattacaggtaaggcagagacagggagaagccggcaacttcctgttaaatagctccctttcctggtcattgctttcctagcagattctgctgaacatctctatttatatttccttgaataggggagccttttcagatggagctttttatgtcagtaaccacgggaaagagaatacacacacacacatatatatgtaaatttagaacttcacttagtagtccaagatgatgccatgggtggtgattaataaatgtgt

SEQ ID NO: 129475 - DNA, 1335 bp, Homo sapiens
ttacgtcaatcaaagcaagccttaggatagtggttcctacaataaaggaacccattatgtcactgtttattttattggttttttttttaattctttgcctaatataaagcaaagaagcacttataagtcttgggttgctttctttttagtaacctccatgaccaagtgttttgctttatgtctttatgaactcttcttatatgtgctgttgtgatgcttgtttctggattgctaacagcaagttctaaaactctgattggaattcctctctcctttaattctttctccccatcatctgcttacatgttccccaaaaaggcttttaacttcatcatttacatataacttgattagaaaggtaactctattgccaaaacatatatttcaattatttataaagtacttcaaattattcttttggttggtcatgtcattggactccagcattagtgcaggtagttgataaccatattactggacttaactgccctaatggattgccacaagcccaacagatatgacaaagtaaaacagacttcttatcttttttttttttgagacagtctcgctgtgttgcccaggctggagtgcagtggtgagatcttggttcactgcaacctccgcctcccaggttcaagcaattctctgcctcagcctcctaagtagctgggattacaggtgcctgccaccacgcctggctaatttttgtatttttagtagagacgaggtttcaccatgttggccaggctggtcttgaactcctgacctaataatccactcacctcagcctcccaaagatcacaggcgtgagccaccgcgcctggccagactttctcttatctaagtatacccatggattctgctgtctttttcttttttttttttagacagagtctcactttgttgcccaagctggagtgcagtggcacaattatgtctcactacatcctcaacctcccaggctcaagcaattcttacatctcagcctcccaagtagctgggactataggcatacaaccaccacactcagctaatttttttccttttctttttttgtagagacagggtctcactatttgagacaggttggtctcaaactcctgagttcatgcaatcctctcacctcagccccgcaaagcgctgggactgcactagtgggttctgctgtctttattccatttagcctatgtgcctatttttctccttgcaaaagcatgaacaatagttttatgttttaccatcaggcttcctagaatattaggatctagctgagaggaagaaagggatctgtagccatggctgcagcacatgtcactctctattatatgtttatag

SEQ ID NO: 129476 - DNA, 1049 bp, Homo sapiens
atcgaaccaaagcacagaggggtaaaataccatgcccaagggcatatggcaagtaaggggtggaactggggttcaaaccaaggacactggctctagaagctatgttctaagtcactgcaccgtattatcaacaactaacctgacccctgtctacagtgaagggccaggtagaaccctactagagtacttcattcttacagaatattcctttgggagaagttcccttgtgaagttagggctcatgcttcctatgttgggcccaggtctccttggttactgtctcacactgatggaaggggactgtgctcactggcatatcccactctgcccttgtgtgcactcacagctgccctctgggggctctccagacaagctggcccaccaggacactcagctcgggtgaaaggtgaaattagtcaaactctgaaatgccagaaccgtaatcctcactatcatttattcagaggcagaaaaagtggcccaggtggctgagatcacctacgggcagaaggtgatggagaaggagactgagaagaagatttcagaaattgaaggtaagcagaagtggcagtcatgcctgagtcctcctcagaccccgccctgtggccagtgggttggggagccattgcctttgccctttaactgtgctcaaggatgtcatgatctctgtgcaacagcagcttttctccatgtggagacttgagttttgaggctattgtggccaggctagcatctgttttctacttcagagagcatttgttcattcagcaaatgtggctggagtgccagtatgtgcccaggattttgttaggcatgagaaaaaggaagtcccgtagaccctgctttcttggagttcccaggctagcagggccttggagcggtgggagtgtactctcagcagttggctctcccccttgccttagctacttctgctccaaagttggtcagtgccacggttttgggctcaaagtctgttctccaggtctatgcagatattaagccaggtttgaagaagacagattttcagcacctgtcagacaggagctgga

SEQ ID NO: 129477 - DNA, 1627 bp, Homo sapiens
ggaaacttttaacttttgcacctatgctccaagatctgagatgactgtctcttacagaaatgtaacaatgagaccacaaaaagtaggtaggggcataaatataggaaaattgaaggggcaccactcccctccttctctaatatggttcaacataagtcttccatactttttttttttttaacagctgaagctaacccctgaatatctgcagctgatgaagtacaaggccattgcttccaacagcaagatttactttggcaaagacattcctaacatgttcatggactctgcgggcagtgtgagcaagcagtttgaggggctagctgacaagctaagctttggcttagaagatgaacccttggagacggccactaaggagaattgaaaaaaacttgatatgactgcaaatgatacttaagcagatctttattttttaagatgaatcagaatgttcctccctccccgactaccttctctgactgtcttccagttactgtggtgaaaaagaagaaatgaacttaaatccactccctttctagggaaaggagggtggggactgatgatggggggttttatttcaggtaagcagtttatatgacttccaataagatttgtaaatcatgggcttgacctttgacctctagacactaattttatcctttgaggctggcttaattagggatgctgtcattaaggagagggagaaatgtagagtgttacctccaactcatttgatttcccttacttgggaaaatgcagtccagtgttctcacctctgcctccaaggtaggagatgtctgtgggtgaggctcagcaactgagcaaatatgtgcctgtgagtttgccagtagagctgtgaagaaacagctgcagagaacatttgaccttcctggcattcttgtctgcatgtgtgtgagttattttagaggtgtgctttcttgagccctcataaggaagtactggtgctaggttttgcaagattttgtatacactttgctccttgccctagggctcagagtggtggtttctgactacatttctagagtcagagcttgatcaccacaactcaattatttcggcatcttttcacctatgctgtgatttgttttttttttttcttctcaaaaattctgttcattggttccactcagcatcaagaagacagggacaaacaactcaagtgtcttaacagctgctggagtgggatccttgttatctcttagccactgcaggacctgcctgacaggttatgtgtgcacctcgagatgaagtgtctttctattattgtagagattctgtagtgaagaggtctgacaccatgtgtggaggaggaggaacgatcagtcaagagatgtcctggtcttaatgcctgtggcttgtgctgggagtgggtctgacttagtgataaaaggactctattcactaagtagcctgtgtttttaaatccagggctgcaggcagcaacgcaagtcaggctgaacattcagtctccagagacagctgtgtggagcaaatcagagttcatgcccaagtccccaggttggaatggctgtgccaaaatccattcaaagggttttctttttcattactaggtcagaacattttgagtcaccttgggagattcagg

SEQ ID NO: 129478 - DNA, 1187 bp, Homo sapiens
caagtcctgctgcagctgccccaccccaagtttctatcatttcctctttaaacaaaaaatatgttatcctacacattagtgtcaatccaatggttgtctcttatctgtctaaatagcaaaatcatgaaaatcagctgttttatttgcataggacaactaacctgtctgtgtaactttgtttttattttaactcttactagaaaatctaatcttaaaacatttgaattctaaacatgtaaaatgtgacagcctgcaattttgtagacagtgaagtaatggctgctatttataaatggaacatctatcaaaataagtaactgtttataaaattcagtttttgtagggttttccaaggaaaaatcaccttggttgaatgtttctcactcattaaactttgcagaagtgattcatattcagtactgtttttaatcactttttaaaatataaggaccgaatgcaaggaaaccaaagtttattaataatttttatataactaaaataaaatagatgtggagggatctgtgatcatataaaaagggagggttactgaaagaattttagcaatatattgattcaggaaaaggagctgttttataaatgatcattcactgttcctatggttctatgtatctttcaaaccgatacctttactatttaaagagcgtaaatagtgaaagtaagatggtcatacttactgactttatctatttaagtttgatggagataaactatatcttggctagtggctactgtgtctgtgaatgtaaccagtacttctttaagctctattcagtagggttccagccactgcttttttgttgtttctagccactgttttttttttcttgtttccttataaaacaggtaataaccaatcattttgtgtttgtatttccattcctttttatttctgcctttgtgtagactgatgattaagtaggcaaactacttctactttcaaagagccccaagggcttaatgaccccatttgtaactgagaaatgattcttgttttagtaatcattctataaatgatactgctggattgattgccgtgggttgatagctggaggaattgttttggacaatactaacatgtgaatttatgtcttagttttatttgcagtcttgctaagtaaaatgagtctttgtatctacttttttattaaagtgaaatttagcaatag

SEQ ID NO: 129479 - DNA, 1032 bp, Homo sapiens
taggtaacagagcaagacttcatcccaaaaaaaaaaaaaaaaaaaaaaacaagaatcatagtaaaataaaattaagaaagacatggagatcttgagtaactgaacttatttcccttaaggtataaaaatttaaataacctgtatatattttgtaacagctttattagggaggtaagtgacttacaatacattgcacatatttaaagtatagaattcgacgagttttgatgtatgtttgcacctgtgaaaccatcacaacaaacagtgagcatatctatcacccctaaaagtttcctcctgtcccttggtaatccctctcttacctgtcccacttctcttcctcaagaaccacttacctgcttttgtcactgttaatgtacgtgagtttacattttttagagttttatccaaagggaatcatgaagtatgtactcttttttgtctgacttctttcattcagtgtagtgattcatcatgttcatacctgtatcaaaggttcaattctttttatcattcagtagtattccattgtataagtatattacaatttgtttatccattcacctgttgatgaatgttgggttgcttctgatttttgactgttgcaaataagttgctatgaatatttgtgtacgagcctttgtatggatatatttccctttttcttggaataaatatataggaatagaatggctgaatcacaagttaagtgttatgtttaactttttataactgcaataaaacaaacataaaatttactgtcttgatcttttatttacttttttttttttttttttttttttgagatggagtctcgctctgtcgcccaagctggagtgcagtggcgtgatcccggctcactgcaacctccaccgcccgagttcaagcgattctcctgcctcagccttccgagtagctaggattacaggcacatgccaccacacctggctaattttttacgtttttagtagagacaaggtttcatcatattggccaggctggtctcgaactcctgaccttgtgatccacccg

SEQ ID NO: 129480 - DNA, 1029 bp, Homo sapiens
ttaaagacatgagccactgcacccggcctgggattgtgtctttcatctggaaacccccaaaggtcaccatcactcctacaaggagtattttaaatttttaagacctaagattatataaatactcttagatcttaaaaaaattacttgatgttgcattgggagagaatggaagataattactgtgagtgggccaggtgcggtggcttacacctgtaatcccagcacttgggaaggctgaggcaggtggatcacctgaggtcagaaattcgataccagcctagccaacatgatgaaacttcatctctaccatacatacaaaaattagccaggcatgatggtgtgcacccatagccccagctgctcgggatgctgaggcaggaggatccctcgaacccaggaggtgaatattgcagtgatccgagatcgcgccactgcactccagcctgggcgacagagttagactccatctcaaaaaaaaataaataaataaaaaattatggtgagcaccagtcaatgaatatctttatggggcttggattaacagtgtaacatagtgtgaatagaagcatgggctttgaaatcagacagaccttgggtttcagctacactactttccagtattgtaaccttggataagttacctaatctctctgtacttcagtttccttttttggcaatggtatcatgagaatgcttacttcagagggtgtggttaggactgaatatgataatccaggcaacattgttagcacagaaccctacacatgttgttagctattcgttaagaataaatgtatacagatcaggcatttgattgcaaccatcaaagcaccagtattcaccaaatcttagtatgcaggaacacagtagaggcatctgttttctagataacgtcctagagtcagactacctgggtttaaatcccaattatcaatagaaatctgaaatcaactataggtcaagtctttattgtatcatttcttgataattagctataatatgccctatttaaagactgaagtaaatgtt

SEQ ID NO: 129481 - DNA, 1035 bp, Homo sapiens
atttaacatgtactttatactaaattttttgcaactccattaaattaataaaactataaaaattcttgatttagaaaagtaattctcaggttcatctggcattttggcaatgcaaatcttcctggtatcccaaaaaagcaagattttttcttttccatgtctcctagctgttttcagctgaaatcctgagatggaggaaagagaatccaactgatagttcttttcttgagaaatttagaacctgaccagaagcagagcaacatagaaaaccccaagtataaagttactctttaggacttgaggctctttcaagaggttctcttgttgggggtcacctcttctgtcgtaaggaagggaggaaaatggagccttcctctggccatttacccttgcagtatacctgttttctgtttcttttcttgaaggtaaacatggccttccaccttcagagaccatagccatcgtggagcacataaacgccaagtgtcctaacctggagtttgtggggctgatgaccataggaagctttgggcatgatcttagtcaaggaccaaatccagacttccaggtactggggggtcggggagattgctcgtgtgctaaagaagcagggtgctggagtgctattgcagggctggctgcagtggggattgcagagtcatcccagacactgcctgttgagtgttctagccctcttttgaactcttctcagaaggaaaagggaagaacaggtttccaaagccccacaaacctttttcaactcaacttgaacttggctaaaacatagtctttagagaatatgagatttcttcctctccagtgactaatagttttctcgaaagtgggatagtttgcaaaaaaccctttcagtaacgtctggcaattttggcaggccttgaaatcataaggaatacataaccgttgtcagagaagttcagattcagacacttttgggcatcgttagagaaggcaggagtaaaataggtgtcatctctttctgtcagctgttattgtccctccgggaggagctgtgta

SEQ ID NO: 129482 - DNA, 1008 bp, Homo sapiens
ccgtattggccaggctggtctcgaactcctgacctcaggtaatccacccacctaggcctcccaaagtgatgggattacaggcatgagccactgcacccgtccgaggcttaatcttatgtgtagattcaccaacaatcttatatgtacatcaacagctgtaaatatcaactgatacaggtgtgctagattggcaacgcaaatacatgattttctgaaatagcaaataacttgataaagtttcaaaaatcaaaatataaacttgcattcctggaaaattgtatttcttaaaacagtgcaaaaatacattgcattgataagtaaaatggaatttgatcagataattataaggatatttttttcatctacctgaccgtggcacattggagaggtaggtgggctgtgctgtgtggctgcgtctcacactggacgtctaatgtccttgaccccctccgagctgagtgccagccacactctccaaccactggaaatccagagaaacccaacttgtttcctatatatgccctcagaggcaattttacctctgaggagaacaatcatcctgaagccatcttcagctgtgttattattcatagaaggctctgtttttgtttttttttgttttttttgagatggagtttcgctcttgttgcccaggctggagtgcaatggcgcaacctctgctcaccgcaacctccacctcctgggttcaagcaattctcctgcttcagcctcccgagtagctgggattacaggcatgtgccactatgcccggctaattttgtatttttaatagagacagggtttctccatgttggtcaggctggtctcaaacccctgatctcgtgatctgcccacctcggcctcccaaaatgctgggattacaggcgtgagccaccacgccccgtccatagaaggctcttgagagccagaatgggggcacagcttcagcactggctccattttattattttaaacctggtcctcgataccttctcttttttcccacag

SEQ ID NO: 129483 - DNA, 1024 bp, Homo sapiens
catgatgctgccaaatgtacttttgtaaacttaaacattatgattcctgtattatttcagtgagagctacagtgtgatatttcagagtctattaaataaaaatgtgagtttgaattacaccatctgtgccaattacaaagcaattaaaagatttattttttatgatctggtgtagtgactgaatataacaggtgggggcattggaaccgacgggaagcagctatgctggtgccttggcattgtgccagcctggctttggaggagggcttccctggggtcacagacgcagccaaagctacaccatgggtgagagggattctgaacttctaagggcaagaaaaaggacatttcaagaattacaaaaatagttacccctcactgcaagagacttttgaattgcctctagatggcgacattggctaacctgagggacaagcactggctctccactgtcagtagtttaccttatgagggactcctggttactcagtctggtggaggccagagaggacatgacgctctcaagtgatagtgtgacttgcagagcctcaggggttcgataccagctagcctgggcaacacggtgaaatcttgtctgtaccaaaaataccccgcccaaaaattagctgggcatggtggcacatgcctgtggacccagctactccagaggctgaggtgggaggatcgcttgagcctgggaggaagaagtcacggtgagctgagatcgcaccactgcactgcagcttgggtgacaaggtgagaccccatctcaaaacaaaacaaaaacagcgaataaggaggaaagccagggaaggctcaatcagatctagataagggaaggacaccaaagtgtgtctagggtgtccccagcaggatgggatattttgcagagagaaaattgagccaggttgtgagtttgtctttcgttacgcatgatgggtggcaggttgggtttcttccagattttcatgaaagccagttcctggagtttggacggcttgctctcctggattgggcccacctg

SEQ ID NO: 129484 - DNA, 1054 bp, Homo sapiens
gtgggaactctgcttgcttctctcccacaaaatgggaccccagccgggagagagttctggaatggactcggtgtgccccctctctctggccagatttcaaactctgaagtagagaacaggagactccagggactggccctccttcctgtgaaaagcttgacattaggagtgggagaagggcgtgggagggagggaagaaagaagccgaagatgcctggccaggccagccagggctctggggcagagctagtgtgtggttgggcaggacatctacctggctggcccccgtgaggttttagggtcagaggacggagcaggttgaggaggcgtctgtcttgtgggggttgaagagggccgaggctgaccctatgtctgtgttggatggagctgtgggtccaaggctccctccttccctgcccaattgtggccactttgcctgctttcctcccaggggacagcctagaatggtgggaacatttttctgcccattggatgaagctgtgtgtgtgtgtgtgtgtgtgtgtgtgtgcatgggcctgcgtgcatgttcatccccatcagcagtgctgtaacacccagctttctacctgcccataaaaatgccagacccagccaggcacagtggctcatccctataatcccagcactttgggaggctgaggcaagtcgatttctttagtttagaagttcaagactagcctgggtaacatagtgagatcctcacctctagaaaaacttttttctttctttatttatttttatttttaatttttgtttttgagacagagtcttgctctgctgcccaggctggagtacagtggcatgatttatcttggcttactgcaacctccacctcccaggttcaagcgattctcctgcctcagcctccagagtagctgggattacaggtgcgtgccaccacacctggctaatttttgtttttagtagagatgggatttcaccatgttggctaggctggtcttgaactcctggcctcaagtgatccacccaccttggcctcccaaaaagctgggattataggcatgagccaccg

SEQ ID NO: 129485 - DNA, 1150 bp, Homo sapiens
agacttaaaggacaagtaaggtggcctgaggaaggtgaaagccctgtgtccgcaaccgcgtgggctgtgggagtgtgtgggttgaggcgggtgggtgaggggtctgtggagcccagggcctgctccgggagcccctctcccactgggaacgcctcctcctagtcctctctccatcccgcccgcctccctcctccctcctcccttcgcctggcttctgttccctccatctgcatttctgtgttcttgtccctgagcccccgccagcctgagtcctcaccatggagcatgacatcactgctcatccagcactcagggtgggccaccacagagggctcacattttccaccatcatccgcacccaccccctccagggtcccccattagactgaggctgtccttggcatctcaccgcatgcccccagcccagcactgtgccctgcctggcaggtgcctagtacacaccctgtcactgctgctgctgctgagtcccggctgagcccacctccctgacaccctgtgtgtgtctgtgtggacgtccctctcccgctgtaggtggctgtggcgtgggaaacctgacagagccagtggccgtttcgctgcggcactgggctgagggagccgaacctgtggccgcttggtggagccaggaggggcccggggaggctgggggctggacctcggagggctgccagctccgctccagccagcccaatgtcagcgccctgcactgccagcacttgggcaatgtggccgtgctcatggtgggtgtgaggaggggtgacaagtcgggggggcagggacacgggctgggtggaaaatgggggtgggtgtactctgaccatttgggaccatggagaaatacagaaaggactgcagccctaattgggccccatgagtggtgggatgtggggaaatggccctttggcctctcctacctctccatctttcaggagacagggaggtccggcctccatgcctatatccagatagttggatctgatggatctggaactcccgatggatctggaactccctagcctggccttcacatcctgcactttctgagaccagatttttttttttttttttttttagacggagtctggctttgtcaccaggctggagtgcagtggcatgatctcggctcact

SEQ ID NO: 129486 - DNA, 1065 bp, Homo sapiens
ttcaagaccagcctggccaacatggtgaaaccccgtctctactaaaaatacaaaaattagctgggcctggtggtgcacacctgtaatcccagctactcgggaggctgaggcaggagaatcacttaaacctggaaggaggaggtttcagtgagccaagatggcgccactgcacttcagcctgggcaactgagccagactctgtctcagaaaataataaaataaataaaacaaatagggatggttctgagagaggcagcaattcagtataaggtttgggtttgatcagacgtatgtttgaggtagcctctaagagcctggataaaacttgggcttggccctgaatcaaaccagcctgcaaaaactagtgggctgaaatgtgacttctttacacaaatgtttttgtgtctttagaatgactataccaagtgtcactcctgtctatgcagaaaggtacataatttgtgcatctgatatctgaggcaagtttagcagatctaagtaagtcctagcagaattttctaggagttgcacgatagctcctttgacccctctaactcttgccgtgggtttttcctaggtctccggcgagtgagagacctttgtcgagttctgcagttgccaccaacatttgaggataccgcggttgcctactaccaacaggcatatcggcactctggcatccgagcggccaggctgcaaaagaaggaggtgttggttgggtgctgcgtcttaatcacctgccgacagcataactggcccctaacaatgggggccatctgcacgctgttgtatgcagatttggatgtgttttctagcacttacatgcagatagtgaagctcctgggactggatgtgccatctctgtgcttggcagaactggtgaagacctattgcagcaggtacgtccctggtgggagacagtaggatgggatgggatgggtccttagacctgaatcctttgacctttggccatctctttttttttttcttggagtcttgctcttatcacccaggctggagtgcagtggcacgatctcagctcactgcaacctccgcctccggggt

SEQ ID NO: 129487 - DNA, 1040 bp, Homo sapiens
tcggcctcccacagtgctgggattacaggcgtgagccaccgcgcccggctagcgttccttttttaacttcttaaggtactgccccacgtgtaaagacgttctcccctggtgaatgacttgtttttgtgtattttctttgtctctcgtgatgcatctgcactgacctgcagattttattttgtcctttttgcagactggaagtgtctccagaggcgcaacccacagccaggcttccttcccctactgactccccttcctctcttcctcctcttccttctagctctggccaggcatctgtcccctctgaattgggacatggtgcagacacacagtcctctgagagtccttctgtcttctcctctctctcatctcccatagcagctcccatttccacatccactccaattgaaagctggcctctcgtagacaggggccaggccaagtctgaaggaccacccttgctccctaaggcagagttgcaaactgagagtttaacaccggttccaaattctggttcttctgccctgggatcacttttcaaacagccatcctttccagcaaataaagggacagaagattctctgatgggcaggacccgtgagacaggcacagagaagaacaccagcagccttgagttggaggagtctctcccagagcagcctgaaacagggcgacaagaggaagaacttccgagattcccctgcaaaaaacaagactacagcccatcatctggagaagcccaggaagtaccgtttgccctttcactcagcagtgatggagctgtgagccctgttggggagcttgcagcaggaggagacagagacttggagagtcaggctgggtctcttgtggagagcaaagccagggatgcagctgaagaagtggcgccccctcttcccatgggagcatcagtcccttccattgattccatgatgcggaagctggaagagatgggtctgaacctccgcaaggaccagaagaaaaccaagaagcgtgtgtcattttctgagcagctcttcacggaagaggcagtggcgggg

SEQ ID NO: 129488 - DNA, 1016 bp, Homo sapiens
gagtgatgaagggccatgttcttatatctattaaaactcaagagggaatttggttgcatatgaaaggacttaggtattataaagggttagatacttggaagaactgcaagtttaataagatgctgaaataagttgccaacagaaatgttggttattaaaaaaaagaaaaaagcaagggctagatagttgtttttctgggagagttggatgcagaaaaacgacatagatgaccacagaggtccataatccacaaattataagcaatgggtgtttgtttttatacctttaggtttcctaagaacatttagattttgcttaataggttggaaaattcaagtaatgttattactgattacatttttcttttcttggaatttcccttaaagataatattgagccttactggaaacctccccaggtctttcgaagccacagtcccctcccactctagtgtaggaaactgagatagctcagtgctcaagcctgaattctctgtaggttctagaataaacaaccctaaactgcttataacagaggaatgaaatgactaaaaaggatgagagtccttcagagttgttctggtgacatggaagatattccctcatggtttttttttgttggtattgtttatgatttcatttgtaagacattcagttagtatggagaaagttctacctgctttttttccatcttcttgtttctaaagtttatcctttttttttggagacagggtctcactctttcccaggctggagtgcagtgacatgatcacagctcactgcagcctcgacctcctgggttcaagcaatcctcccagctcagcttcccgagtagctgggactacaggggtgtgccaccataccgagctaatttattttttggttttgtttttgtagagatgggatctcactatgttacaggctgtgcttgaactccagggctcaagcagtcctcctgctgtagcctcctgaagtgctgggattacaggtgtgcgccaccttgctcagcctcatcca

SEQ ID NO: 129489 - DNA, 1030 bp, Homo sapiens
taagggtgagggctggagcaggaagggatgggagaggccctgggtgcctgcagacctgctgatctgcaggattcggcagggtgcttctctcctgcccatgtggcctttttactccattcattcatcaacatttactaaggacctgatgtgtaccaatggcggtggctatgccaagggttgccttaggggacagagtgataggacatttgttttgcacccaggccaatgagttatatgaactcttccagattgcttggggagataagagagcatcaggggcttgcaactctggcaaaatctgcctgggagcctccctggtttgcttaaatgaatatgagatcaaacctccctcccactcataatcatcccagagcctctggcactctgttggagacctttgaaggtaagaagagtggactggcaatgagggaggtttgagggcaagggggacctcacaccctcctttctcattgtccttccttggtaggaagcagagtctaaaagaagttgtagagaacatcatgctaaccaaggaaaaagtgaaggagaaactccagctcctgggaacccctgggtcctggggtcacatcaccgagcagagtgggacccacggctatcttggactcaactgtaagggtctagggggctggtgtcccccctttctgacctttggcctgtatttgagcattaaacttcactgactaggtgaccagttcctagcttcactccagattttgattctgtcctctggaaaatgggctgctttaaagacacttctggacccccagaagtaccgacactccctatccttcataaaccagcctgggtgcccggtgcagtggctcatgcctgtaatcccaacactttgagaggccgaggcgggtgggtcacctgaggtcaggagttcgagaccagcctggccaacatggtgaaaccccgtctctactaaaaaataaaatatgaaaattagccgtgcatggtggtgcatcctgtaatcatagctacttgggaggttgaggcaggagaatcg

SEQ ID NO: 129490 - DNA, 1082 bp, Homo sapiens
caagaagctatgcatggaccccgacatactcctcaatgtggtggaggtagaggggccccgctcagaaactcctccctagagctgacttacagcctaatgttcctctcctccccacacctcttaagtcatccaagaccttttccaggtttgaatttgcctggcccttcaatggtaactaacatggaggagcacttcacccccaaatgccctggggccgccactcctgggtgggggtgaagcctgatgagaccgtctgtacctgcagcagatcccacatggctgtgtccttgtgatggggaacattatcgactgcaagttgacaccaagtgggtgggcaaagttgatgtccatgataaaggtaaacccaatctcccacccgaccttcctgtctttgactctctgctctctcctccatctgtctcattctttttttgttctcctttctcctacagagcaagcagatattcccattttttgatattccctgtcaaggtttatacaccagtgacttggaagaagatactagaatcttacaatactttgtgtctcaaggctttgagttcttctgcagccagtctctgtccaagaattttggcatttatggtatggtacaggcagaagaagggagggtctgttgctgaagtggtgctgcgctcacagcacagtgatgtttttgatatctcatccttgggagggagccaaggactctagggagagcactatagaagcagaagtggggagcactgagctagaatttggttctgttactaaatctagtaacagaacccaacccagcttggcttggatcatttcaccccctcaggcctctgtttcctcaactataagatgagagggtggggctggcatggtgggtgacacctgtaatcccagttgacacctcctaatccctcctttgggaggtcaaggttaggtgatcacttgaggccaggaattcaagaccagcctgggcaacacaccgagacccggtctctacaaacaattaaaaaaattagtcgggcatggtggtacacaccagtagtcctacccacccggggggctgaggcaggaggattgcttaagcc

SEQ ID NO: 129491 - DNA, 1013 bp, Homo sapiens
gaatcgcttgaactcgagaggaggaggttgcactgagctgagattgcaccactgcactccagcctgggtgacagagcgagactgtggctcaaaaaacaaacaaacaacaacgaaaaagaatttggaggccaggcttaatggctaatgtctaattccagcattttgggacttggaggcaagaggatcacttgaccccaggagtttgagacagcctgggcaacatagtgaaaccccatctctcccaaaaattagaaaaattagctgggcctgacggtgcatacatatagtcctagctattccagaggctaaggcctgatcctgggaagtttgaggctgcagtgagccttggtcgcaccatggcactctagcctgggcgacagagtgacatcctgtctcaaataataacaataataataataataataataatttgtaatgaatgatgcagtgaacacttgctgactgtcttcccagaattccttctcccctctcccattcctaagagcacctggaatctcagggggaatctttctcggctggcaccaccctaggctctaggtggttggtttaaactgatggagtattccattctcagccatgttaagattagggatgggcgagggactcaactgaagccaaggagaaacaacaaaggggcccagggaattcaggaaaggaaaagtaaacgttttataaaggaaaaattttaaatatcaggacccctacaaacttcttttttttttttttttttttttttaagacagagtcttgctctgtcacccaggctggagtgcactggtgctatctgggcttactgcaacttctgtctcccaggttcaagcgattctcctgcctcagcctccctagtagctgggattacaggcacctgccaccacacccagctttttttgcattctgagtagagacggggtttcaccatattggccaggctggtctcgaactcctgacctcaagtgatctgcccacctctgcctcccaacatgctgggatta

SEQ ID NO: 129492 - DNA, 1011 bp, Homo sapiens
caatgaaattttttttttaaaactttgcctttgtttttctttattattccttgcaagttgttgtcaggaaaaaagaaatctgtttctttaaaaaaaatgaggtataggccgggtgcggtggctcatgcctgtaatctcagcactttgggaggccaaggcgggtggatcatttgaggtcaggagtttgagacaagcctggccaacatggagaaacccatctctgcaaaaaatacaaaaattagccaggcgtgatggtgcgcacctgtagtcccagctactcaggaggctgaggcaagagaattgcttgaatatgggaggcagaggttgcagtgagttgaaattgcaccactgcactccagcctgggtgacagagcaagactctgtctcaaaaaaaaaaagtataaaagttgtacaaaaagagtggatattattaatacagaagatattgtttaagaagatatttttcaaaagcacccctgcctgccagcatctccccccaggcttggtccactgcctggtatttttatggaagacatctggcaattccattccttggccattgccttagctcagaccttcatcgcttcttaactgaattaactaaaatagtctccacttggccttcttgcctaattctggttcccctccacaagcccccagagaatttttctgaaatataaatctgatcatgtcattccctttctcgaaatcatccagtggtgtcctaaaggttttggggtaagagtcagataggcccttaaaacgcctatcatttttatggacgaagcctacttccctaacttgatttcccaccactccctcaatatgcttttattccaaccatacttaaatgcactaaaaaaattctcatttttttttttttgtatctgtaccttcacacatggtaccctctgtcatccattcaaacacagactgtactttctgctcatctgtccaccccagcaatacttttttttttttttttttttttttgaggcaggggcccactct

SEQ ID NO: 129493 - DNA, 1091 bp, Homo sapiens
aggctgaggcaggagaatcgcttgaacccagggaggcagaggttgcagtgagccgagattgtgccactgcactctcaaaaaaaaaaaaaaaaaaaaaaaaagaatgagaagatttagaacagaaggtacttctggatctcaggacattatggtctattatagtagggggttcatgagaatgggaccctaaggaaccagaaaggggagagaaggtggcgtatactttgctagggctgccataacaaatgactacaaactgggtggcttaacacaggaggaactgattctctcacagtgctggagactaacagtccaaaatcaaggtggcagcagggctgtgctccctgtgaggcgggaggggaagatccttccttgcctcttctcttatcccggtgtttgctgacaatccttgggattgtttgactggagctgtatcactctaacttctcccccatcttcacaaggccttcccctgtctgtctgtgcccacatttctctcctcttataaggacatcggccattggatcagggctcaacctaatccagcatgacctcatttgaacctggttacatgtgcaaagaccccatttccaaataaggtcacattcacaagttctgggtgttaagacttcaacaaactttcaaggggacataattcaacccctaacagagggtatgatggggaaggggaagacagaattgctccagacctttccaagcttatcttattcctgctgcttcaaacccccatttctttttctttttcttttttttttctttttttttttttgagatggagccttgctctgtcgcccaggctggagtgcagtggtgtgattttggctcactgcaacctctgcctcctgagttcaagcaattctcctgcctcagcctcccgagtagctgggactacaggtgcatgctacaatgcccagctaatttttgtatttttagtagagatggggtttcaccatgttggccaggctggtcttgagctcctgacctcaggtgatcctccttccttggcctcccaaagtgctgggattataggcttgagccactgcatctggcccaaacccacatttctaagg

SEQ ID NO: 129494 - DNA, 1028 bp, Homo sapiens
ggagtttcttaggcctgaaggacaagaagcaacaactctgttgatcagaacctgtggaaaacctctggcctctgttcagaatgagtcccatgggattccccggctgtgacactctaccctccagaacctgacgactgggccatgtgacccaaggagggatccttaccaagtgggttttcaccatcctcttgctctctgtctgagagatgttttctaaaccccagccttgaacttcactcctccctcagtggtagtgtccaggtgccgtggagcagcaggctggctttggtaggggcacccatcacccggcttgcctgtgcagtcagtgagtgcttagggcaaagagagctcccctggttccattccttctgccacccaaaccctgatgagaccttagtgttctccaggctctgtggcccaggctgagagcagcagggtagaaaagaccaagatttggggttttatctctggttcccttattactgctctcaagcagtggcctctctcactttagccatggaatggctccgatctacctcacagcagtgtcagaaggacttcgccagggttttgggagctccagggttcataagaaggtgaaccattagaacagatcccttcttttccttttgcaatcagataaataaatatcactgaatgcagttcatcctcggccccctttccctccgtttgttttcttttcataatccacttactcccttcccttctactctgcgctggcttttgacagaggcagtaaattaggcctaatcctcactcttttcttcctaatcttcatcaaacaaaaaatgaaaagtctgtctggacgaaggggagtgagcttgagcctttgatatcttgctcccccacccttcctgaaactcttgaaatccagttgccattgagtagcaaagccacgctccccacaggacttggacagagggcccacagggggatgggctggctgtggccaggtttagggcagggggcatttgtcccctccatgctataatccagtggtgccttac

SEQ ID NO: 129495 - DNA, 1109 bp, Homo sapiens
aggcccctccagactataggcagctgcccctttaagcgtcgctactcctcccccaagagcggtggcaccgagggagttggggtggggggaggctgagcgctctggctgggacagctagagaagatggcccaggctggggaagtcgctctcatgccttgctgtcccctcccctgagccaggtgatttgggagaccccctccttccttctttccctaccgccccacgcgcgacccggggatggctccgtggcctcacgagaacagctctcttgccccatggccggacctccccaccctggcgcccaataccgccaacaccagtgggctgccaggggttccgtgggaggcggccctagccggggccctgctggcgctggcggtgctggccaccgtgggaggcaacctgctggtcatcgtggccatcgcctggactccgagactccagaccatgaccaacgtgttcgtgacttcgctggccgcagccgacctggtgatgggactcctggtggtgccgccggcggccaccttggcgctgactggccactggccgttgggcgccactggctgcgagctgtggacctcggtggacgtgctgtgtgtgaccgccagcatcgaaaccctgtgcgccctggccgtggaccgctacctggctgtgaccaacccgctgcgttacggcgcactggtcaccaagcgctgcgcccggacagctgtggtcctggtgtgggtcgtgtcggccgcggtgtcgtttgcgcccatcatgagccagtggtggcgcgtaggggccgacgccgaggcgcagcgctgccactccaacccgcgctgctgtgccttcgcctccaacatgccctacgtgctgctgtcctcctccgtctccttctaccttcctcttctcgtgatgctcttcgtctacgcgcgggttttcgtggtggctacgcgccagctgcgcttgctgcgcggggagctgggccgctttccgcccgaggagtctccgccggcgccgtcgcgctctctggccccggccccggtggggacgtgcgctccgcccgaaggggtgcccgcctgcggccggcggcccgcgcgcctcctgcctctccgggaacaccgggccct

SEQ ID NO: 129496 - DNA, 1210 bp, Homo sapiens
ttgcagtgaatcgagatcgcaccactgcactccagcctgggtgacaaagactctgtctcaaaaaaaaaaaagaaagaaagaaagaaaaagaaaatgagacacttttgtatatctatctggaaggatcacagatacatagtcaaattaaaataagcaaggtgcagaacagtgggtatatatgactgctatttgtatagaaaagaaaggataaaagaatatatatatttgtattgacttgtatctatataaaatatgagccgagggataaaccagagactaatggtagttacctgctagggagatgaaaactgggatgaaggcaagtctctattatatgcatttgttatattttgatggttgaataatgtgcacgtataatctattcaaaatattaagttataaaacacaaaatcacaaaagagacccaatagtctatagactaaggtggcaaaagagggagcccttccccctgccatctgcttgggcgggggaaaaccagactgaggaatgagagcagggatgagttggcagaggaggaagaagccaagtgtctcaacattgatggatttgctcataaaaccatccctaaccggagtcagaaatttctcttcttacagtgtcgtttggttattggcctaatcattccccaaactcaggcacactcaggtggtttgagaaatcctgtcttttttgaaaatgttaaacatttttacacacttcttccaaattacaaggtcacccctaaggcattgacatcattgaggttgcttcactttccggcacccctttcccttccccctccaatgctgatgtcctggaaaaaaattgctgaatggcatgcattgattttggagattactttttgggaatcttatgatatccctttgagataactggcaacaacactctggggtgctgcaaaaccctacttgggagtgactgccttgctggtcaacaggaagccacagccaagactctgtgcccagtggggcctgcaccactctgtcatgacttgagtgggggcagtaagaggtggaaggggccagaggctgcctcttcactttcacccccatggatttccatggatccaaaggcctgcttggggttcttcatgggcatagaagtcacttgcttgggagcccaagacaaaccctgctcatgggtgagcagctgggtccctgggagacgaggctggttctttttccttggg

SEQ ID NO: 129497 - DNA, 1119 bp, Homo sapiens
ggcagcctctggccccttccacctcttactgcccccactcaagtcatgacagagtggtgcaggccccactgggcacagagtcttggctgtggcttcctgttgaccagcaaggcagtcactcccaagtagggttttgcagcaccccagagtgttgttgccagttatctcaaagggatatcataagattcccaaaaagtaatctccaaaatcaatgcatgccattcagcaatttttttccaggacatcagcattggagggggaagggaaaggggtgccggaaagtgaagcaacctcaatgatgtcaatgccttaggggtgaccttgtaatttggaagaagtgtgtaaaaatgtttaacattttcaaaaaagacaggatttctcaaaccacctgagtgtgcctgagtttggggaatgattaggccaataaccaaacgacactgtaagaagagaaatttctgactccggttagggatggttttatgagcaaatccatcaatgttgagacacttggcttcttcctcctctgccaactcatccctgctctcattcctcagtctggttttcccccgcccaagcagatggcagggggaagggctccctcttttgccaccttagtctatagactattgggtctcttttgtgattttgtgttttataacttaatattttgaatagattatacgtgcacattattcaaccatcaaaatataacaaatgcatataatagagacttgccttcatcccagttttcatctccctagcaggtaactaccattagtctctggtttatccctcggctcatattttatatagatacaagtcaatacaaatatatatattcttttatcctttcttttctatacaaatagcagtcatatatacccactgttctgcaccttgcttattttaatttgactatgtatctgtgatccttccagatagatatacaaaagtgtctcattttctttttctttctttctttcttttttttttttgagacagagtctttgtcacccaggctggagtgcagtggtgcgatctcgattcactgcaacctccacttcccaggttcaagcgattctcctgcctcagcctcccaagtagctgggactacaggcg

SEQ ID NO: 129498 - DNA, 1036 bp, Homo sapiens
ccgcacccagcctgggcctcaggttttcaattctgtaaagtgttggtgctggatttgaccgttaagactgtttttagcgcttatgctctgccacctccaccctatgcccctagactatttgtgacgaaagaagaaacagcaaacaccaaaccagctgctcagaggccacatatacacgcatgatttcataaaaatgaatggatggttgctgtgggcaatggagaggagagacagggtaaaggggtagcaaaaacttccacctagtttttgctccattccaagaactttaaagccagaagggtggattatgaatgttagaatagaactgcctgttacgcatgtagtcttagacagggtataaggctgcgatcacctgaactctttttggcttctttagtccacctcacatgaacatatacagacacacatatacatgcacccaatcatgatgttcacaggagagagtactcttccctgctgttagaacttctgctcatcaggcggctgctgccacttctggctctgccagacacatattctaaatcacagagctattctccctggcacataacccccgagcaccaacatgtaaacagcagcctgagggcctgaactcagtgcattcagaggcccacagacgctgcctgcttccaagggcacagaacaaaggtcatctgggggctgagggccagcgcagtgctctctctgggcaatgtacacttctatcccgagttggatgacctctccggcccaggcagtactaattcccctcgggccagtcattaggacgacttcccagaacagtaggccagctgtctccacccctctgctgaccatcaaaaatgaaggtgagagtataattgggtacatccccagggaagaccatttggcagtatctttcaaatttgcaaatgcatagaccttataacatagcaaaatctatttgtagaatatactcacatacaggtgaaatgacatgtgtttaagttattcattgcaacatcatctgttagtaaagataagaagtaagctcgat

SEQ ID NO: 129499 - DNA, 1190 bp, Homo sapiens
aaaaaaatcctgcgtcactgctttctctttccccctctggcttgatccctctcttacctcctggaaggaagcctaagcatttgggcctgggttgtaggtgggactcgtgacctctcccagcctctggggagcagcttctccaatagtcagggatctcaatgaccttccttccttccttccttccttccttccttccttccttccttccttccttccttccttccttcctttcttccttccttccttcgtgccacttgcaaaagttcaatgattattcagaaactggaagaaggatttctcttcctacctcaggagagaaagaagcatttcttggtcccttcttccatttatgaccaggagctaaaagagaaggcactgctagaacacactccctgtccacccctgtctccccaggcataaggctttcattccaggccagtccttaggcaccagaatgcctttggtttccgcataaaggagatcccttctgtctccccttcaagtcctctggatctgaccttgggaaacaaatcaggtgtgtgcagagttggctgtgccacattacagaatacaagaaaagtcttagcttaggggcttcttttcagttctgatagtttttatctctctgccttctggttagatggtgggccattgccatggtgggggcctggagaaggcagactggcaggtggcaccagccacagcctggctgggagtgaaggaagttgttttggaaaagggaccaactccttggatgcctgtgtacctgttagaaatgaacctttactgcacactttccacaagatgaaaaaaaaaaaaaaagaaacaaacctttactgtgttataatggacaagcctccatttcctctctgggcctcaggttttcttttctttattttttattttatttatttatttattttttgagtcagagtctcgctctgccacctaggctggagtgcagtggcctgatctaggctcactgcatcctccgcctcctggattcaagcgattctcaagcctccacatcctgagtagctgggattataggcgcccaccaccacgcctggctaatatttgtagttttgtagagacagggtttcaccatgttggccaagctggtctcgaactcctgacttcaagtgatcttcctgcctcggcctcccaaagtgctgggattacaggcgtga

SEQ ID NO: 129500 - DNA, 1031 bp, Homo sapiens
cctcagcctcccaaagtgctgggattacagatgcgagccacaatgcccagccccaatcgtttgttaacattcaactccaattcctcctcttcgtgaagtcttttctgaccatgccctctgggagtggtttctctttcgctggcatcccaccttcactggcactcacttccctcctctaccctagtcatttggcagttacttcttatgtttaagcctctccctctagagtggaatctgaaggtggccattgtgtctgacacctcttggtatgttccagcacctggccctagcctggtgcctagcacatagctgtgtcccgtacttgctgactgatggatgggtaattgacgcatcagggcaggcattctttctcagtccttgtttaatgacattgagacttgaagagcttgctatccagagacttgttccctctgagcaagcaggggttgtgctgctgggtttaatttatgttgctctgcctttcatgctttcaaaggactttcccacaacagactggggacctaaaggtttgtgccactagcaccagggctcagagatgagtggtgacagatgcagccaagtgtgccggcccttgacctggttccgcttctgcaccagggttggagctttctgcagccatggggtctggcgcttcattcccagcttattcccatgtggagtacagtctctgggctttcacgtggaggtgtgggcttgcatctgtgagtggggggacccacccactgggtgtacatgactatgtatatggatgtgatgactcttggtgaggggcaggtgagctgggcatggtggctcacccctgtaatcccagcacttcgggaggccgaggcagtcagatcacttgaggtcaggagttcaagaccagcctggcctggttctactaaaaatataaaaattagccaggcatgttggtgggcgtctgtgatcccagctactcaggaggctgaagcaggagaatcgcttgaagccaggaagtggaggctgcagtgtgctgaggcctcaccactgca

SEQ ID NO: 129501 - DNA, 1115 bp, Homo sapiens
tcatgagcgctccaccctaatgatctcatctaaacctccttacctcccaaaggccctacctcccaatcccattacattggggttagggcttcaacacgtgaatttggggaagacacgaacattcaatccattacagacaggaaccttgaggactgttgcctggggcgggtccacactgcgcttcggagtggtgacactggccggcctccggccctcgggaaggactccagggtaactgccttccttttcccttctgcggactccaacggaaccctggactcagtcttctagcctcactggatctcacaaaaagcaaccctctcagtatggacatatttgaaaactcaaagccgatggtgcagtgttaattccatgagttttgtggataaaaagttctgggttcaaagtccactaacttcctatgcaccctttacaaatcactctgaaattccatttttttttccacgagtgaaatggaggaagcactacttccccatgtaaaacctaaggcgtcatgttgggaaccgtggtggactcacagggaatgcccagcgccgttgagcagccgcctcctggttcccaggctgggcttctgccaacaggccctcagtttcctttattggagacacaaaatgtgacatttattaagtgtcccagcgcactggggaccagttctgcccatggactcgcctctgtccctaacctctgggttggcatgtacatgagaaaacatgcgggtcaacaaaaaagaaagacatgggggtgtgatgggaaggggtagccggaatgtcctcgaaagccaccccagagcgtgggaagtgctgggggagccccagggcgctcccatggggtgaacgctgcgccgcagctccctctagtggcactcttggtgagactgtagggtttgatttgtgaatatatatatatatattttttagacagaatctggctctgtcgcccaggctggagtgcagtggcgtgatctcggctcactgcaacctctgcctccagggttcaagcaattctcccgcctcagcctccctagtagcgggattacaggcatatgccactatgccaggctaatttttgtatttttagtagagatggggtttcac

SEQ ID NO: 129502 - DNA, 2349 bp, Homo sapiens
gaggggcagtcgctgcggggcggcgccagcgcccgtgcggaagagcccgtgagcagacgggagtgggtcggggggcggcgggggatcccacgtggaagcagcgtcctggagctgggtggggctgcggcgcggactacaaatcccaggggcgtggggcgggagaggcggaaggggcgtcctggggcggggcggcacggggcgaggcggagcgaggctggaggcgcgggagggcagcgagaggttcgcgggtgcagcgcacaggagaccatgtccgggggcagcagctgcagccagaccccaagccgggccatccccgccactcgccgggtggtgctcggcgacggcgtgcagctcccgcccggggactacagcacgacccccggcggcacgctcttcagcaccaccccgggaggtaggcgcgggcttggcgacgccgcttgccggctcctgggcgggcgggaggatcgggaatcgcggattggaccgggtgtccaggctcaagggcgccgtgattggaaagaacggaaaaggggcatcggagagacagcgagggtcatggaagtggccgcccgcttcccctctgagtgcgtcttccagacccgagttacaaactgccccgtttgtttcctctttctgttaggtgtcagacagctgacacctaacaaacacgcacgcctccaggacagccacatgccgagctgtgctgccccttgtgggtgttgggggcgctcccgaagcgggagagggcggagttagggtggcccacgatccaggagaggcctggcctggtgtttttatgggatgggtattatctgttgggataaacgattcctgcagggccctttttccttcccgaagcacgccgagttttgtgttggactcgcgcgctctgactgaggttcggatctgggggtgcttgcctgctccagcagcgcctcccgggcacctgtggcacgttccccatttacgcgagtgggatctccgcgggggggaccctggcgccacggccagggctgtgcagaaaaacacgttcttctgtccggggagaggaggaggcaccgtgtgacctccctgggagaggatgaggaagaggaagctgagctggcacgggtgggggggccagcctcgggctgccctcaggaacctggcattccctcccagccccggagccccagcgcacagacgctgatgaaacctacgcgcctgtttgcatgatgaaataaatcctcgtggctctctcctcccctctcattgtcgcactgcccccacccctttttgctcctctcccttcattctcctccacgctgctttccatactactagaaaacgcgacagatcctggcgcttggctaggtggcgggcgggggccacatgcttattttctcaggcagctgtcccaccagcagcgagcgcggccagatccgaggtcctctgctgtttgatccaaaacatacactgttagaacggttagggatcttgtccagccctgccgtcttattctacagagcccggcattgaggccccagagcttgaacacgtgtctgttgcccattgtcacaccgttttcccagattggacaagaaatagcaaccaggcagagaagggagaaatgcttccttttctattagaaatgagccaaggaaaagctcgcaggggctcttgttgccattcccgactcatcctctttcccttgctgggtcttttgtagtccatgctgttctcctttgtctctgtcacaatggtctaccaggacaattcctgacaattttggagttctttcaaatgagggtgtaagtgtctgctggatttgttcagggtgggccctgaggccggcctgaaggcgcaggtagcccttttttgcactctttattgctggattgttgggtcaaattggaagccaggatactgtttataggcacttctggcccgggtaccaaggttcacacctgtaatgccagcattttggggagccaaggcaggagaattgcttgaggccaggagttcaagaccagcctgggcaacatagtgagactccatctctacaaagaaacaaacaaaacaacaacaaaatgttgtcctagctactacagaggctgaggccagaggatcgcttgagcccaggagttggaggctgtagtgagctatgattgaccactgcactccagcctgggtgacagagcgagaccctatctctaaaataaataataaatataaaatataggaacttcaaatccacttttcactttgggttgggaagtggggagtgggcagggggctgacagaccacagcaaatccccttccctttgaaggtctttagcagtagggggagtggggaagggacttctgca

SEQ ID NO: 129503 - DNA, 1248 bp, Homo sapiens
agctgggactataggcacgtgccaccatgccctgctaatttttttatttttttgtagaggcagggtctctatgtattacccaggctggcctcaaactcctgggctcaagcagtcctcccacctcagcctcccaaactgctgggattgtaggcatgagtcacctcacctggcctccagtttgctttccatggtcattaaccatttgcacactgaggctctgctctgaggttagctgtccagagtacttaagataatttaattgccgaagggagtgtcatgtatgaatatttgagtctgtggagtcttaaaaatatccagcgacaccataaacagctcattagccagcagaacctttgagtgggtcagaaagaaactttccctcatcaatctccacattcccagctccgtgttgcatgtttgactctgaagcctatatacaggcttggatggcagttgtgccaaagacccgtacctggataaggtgaatccgaggtgagcaggtagggctgcaggtgttaatggcaccctgtttggttaagcaaacaaggtctgtgcccaggaagcttaccttggagcagctcccaagtctttggacatgaaacaggcagtgctgggaagaaggggatgtaggctgggcaccaaagccagagcacagcccatgtcctgaggccttagtcacatggagggaagaaattattaaggatgggttaaaagagcttggacattaatgcagtgagggagaaacgatggaccctcttctcacatttacctgagcttccttttaaagtgtttgaaggagctgggtgcggtggctcactcctgtaatcccagctattaggaaggctgagacaggaaaattacttgaggccaggagttcaagaccagcctgagcaacatagtgagactctgtcggtataaattaaataaataaaattttttaaagtgttggaagcattccacactgtgtcccttattaaagatttggtggggggttcctggtgtagagcactccaaaatccctccaatccccagactcctttttattattattattattttgagacagagtttcgctcttgttgcccaggctggagtgcagtggtgcaatcttggcacactgcaacctacgcctcctgggttcaagtgattctcctgcctcagcctcccaagtagctgggattacaggcatgtgccaccacacccggctaatttttgtatttttattagagacagggtttcaccatgtta

SEQ ID NO: 129504 - DNA, 1456 bp, Homo sapiens
cagagtcttgctctgtcacccaagctggagtgcaatggtgcgattttggctcactgcaacctctgcctgggttcaagcaatcctcctgcctcagcctcccaagtagctgggattacaggcgtctgccaccacgcccagctaatttttgtatgtttaatagagacagggtttcaccatgttggtcaggctggtctcaaactcctgacctcaagtgatccacctgccttggcctcccagtgtgctgggattacaggcgtgagcttccccacccggcctacacctggctaatttttaacttcttttgtagagatgggatcgtgctttgttacccatgctggtcttgaacccccccattgctttatatattgaaagcaaactactgtcaccacaaagcatgccttgaaaaaaaaatatcattcctatatttggtgcacatttggagtttaaaatcctgaaggatactggctaacaaacatgctgaagtttatgatggttcttggtttccgtgggcctaaaaaggagggaggacaccctcaccctgtcccttccaagtgtctctcctgagttgcttacctgtcctctgatttatccctgctttgactgataattggttgctggtatggatggaactgaataaatggtgaaattatgtcacctggaccctgcaggtcatgataataactagaattgtatggggcttacattgtgtcagccactgttcaaatccacacagtaatcctatgaagttggcactaccatcatcatcatcatcattgtcgtcgccaatctggagaagcagaaactgaggcacaaagattttaagtcataacttgcccagagtcatgagagctagcaaatggaatgacagagctgggtttccaaaggatttcaggtagaatgagcctcagttattgtccccagatagttcaagaccgaaccttgaactctacccccagcacacaacgggctggatcccagctacacaaatggtttgaggtgtaggggtgctcctctcttcttcccttgccctgctgggaggcagggttctgggtttccctgctctgcatctctgggttggcaatcaaggtcagccttagctcacctccctcacccctcgggcactggagaactggggtgagatggatgtttctctgggccgggggtttagggtcaggctgcttggaagcaggaagatggaggacttgggatctgtgtcccttggtgatctcctcttacgcctgtctgtggacttcacacacttggctgtaatcacttgtttacgggtctttctcgactaaattacataaggtttggatctaggcactttcactacatctgacttttttaaatccctagcacctcgcatggtgctagtacaaagtagaggttcagtgagtaagtaaatgagaccagcacacctactttcaggaaaaaaggattgagcaaagaccggcaa

SEQ ID NO: 129505 - DNA, 1416 bp, Homo sapiens
gctgaggccggcgtcatgcttgtacagcctgcagaaccgcgagccagttaaacctcttttcttggctgggcacggtggctcgcacctgtaatcccagcactttgggaggctgaggagggtggatcatctgagatcaggagttcgagaccagcctggccaacatggcaaaaccccgggtctactaaaaatacaaaaattagctgggtgtggtggtgggtgcctataatcccagctactcttttgggaggcttaggtaggagaatcgcttgaacccaggaggcggaggttgcagtgagccgaaattgggccactgcactccagcctcggagacagagtgagactccatctcaaaaaaaaaaaacaaaaaaacaaaaaaaaacttattttctttataaattacccaacctcaggtatttctttatagcaatgaaagaatggcctcatataccaagcattcacccattgttgacctggccctctgtcccctctctccccaggtgaagagtcacagtttgagatggacatttaaagcaccagccatcgtgtggagcactaccaaggggcccctcagggccttcctgggaggagtcccaccagccaggccttatgaaagtgatcatactgggcaggcgttggcgtggggtcggacaccccagccctttctccctcactcagggcacctgccccctcctcttcgtgaacaccagcagatacctccttgtgcctccactgatgcaggagctgccaccccaaggggagtgacccctgccagcacaccctgcagccaagggccaggaagtggacaagaacgaacccttccttccgaatgatcagcagttccagcccctcgctgctgggggcgcaaccaccccttccttaggttgatgtgcttgggaaagctccctccccctccttccccaagagaggaaataaaagccaccttcgccctagggccaagagttgggccccgtctgagcttttttcaactctgtttggtaactaacaccagctgctatctgtacagtgctgctgctttttttttttttttttttttgagacggagtttcactcttgtggcccaggctggagtgcaatggcgcaatctcagctgattgcaacctccacctcctgggttcaagcaattctcctgcctcagcctcccgagtagctgggattacaggtgcccgccaccatgcccagctagtatttttttgtatttttgtagagacagggtttcaccatgttggccaggctggtctcgaactcttgacctcaggtgatccacccgccttggcctcccaaagtgctgggattacaggtgtaagccaccgtgcccagccttgtacagtgcttctaaagcgtgggcctgtccttatttgattctgactctgatcctgtgggtaagtagaacaactg

SEQ ID NO: 129506 - DNA, 1542 bp, Homo sapiens
tcgtgcagctgctgaatggcacatgggactggatttgagtcctgctactcttttttttttttttttccgagacgaagtcttgctctgtctcccaggctggagtgcagtggcacagtcctagctcactgcagcctcaaactcctaggttcaagcaatcctcctgcttcagcctcctgagtagctgggactacaagttcacaccaccacctggctaagttttttgtgagtagagataaggtcttgctatgttgcccaggctggtcttgaactcctggtctcaagtgatcctcccacctcagcgttccaaattgttgggatgacagatgtgagccaccacgcccagcccataccctggtattcttgatctcttgtttttcagtagcaaggcagctgcctcgcttctgtgctttctcccccttctctcaaccccaagcctgtcgagtttggcaccttcccgtcagggcccattccatgcaagagtcaaagggaagagcccctgccttggccagtgtggcatctgatctgcgggcactcgacctttgccaattgatcgctttgtgtgagctgtcatgtgtggcacaaacacagacaagctctctgccttgaaaatttcattgaaatgtaagatttgcccgaaagtaaaggtagcataggctgggcacagtggttcaagcctgtaatcccaggattttgggaggctgaggtgggaggattgattgaggccaggagtgggagaccagtctgggcaacgcagtaagaccccgtctctacagaaaattttttaagtagccagacatggtggtgcacacctgtggtcctagccactcaggaggctgaggtgggaggaacacttgagcccaggagttcaaagctgtggtgagccacgattgtgccactgcactccagtgacagagtagaggcttcatggaggtgatgctacagctggaccctgggaatgagtgggttgggggaggcaggggcccagtgttgccaagctcagatggtcttggggagctggggtgttcagggaagagacatagtagcctgctttggtcagagcaggcagtttgtatgggtgagaatgactttaacaaatggccaaagaagggtgaggtttctgaaggtcttgaatggtaactaggcagagatctttgctgagaagcaataggaatttcttattacagggtatgctggtgggtggatggcctatgaacaagaggcagtggctggcatttacttaacaagctccgagcacatagcacttgtccacctgctgtttggagagcagcagaccttcagtggccaagttgcttgcttggccttttctatagctgggttgcagcccccttccctcacaaggactgaaagcagctgagtccaggtgcatggtgatgtgtggcaggcctggcctttggcacgttgcctccaagcacgcagcaaagtctgtccgtatggatggaaaagagaggctagggatgggccaccactggtgcaaagaataatgaaagcttcaagtaggctcaaaggagagattgggtcagc

SEQ ID NO: 129507 - DNA, 1784 bp, Homo sapiens
gcgcagcctccaaaacctatgctcttagtgccacactgtgaatagaactgaagtctgggctgttctgactctgagctataggcaactgggatactggttggagatgtcagaacaggcagtgacaggtgagtgtcaaggtaaagcaggtagaggagagacctggagccaggaagtcattcaggtgtttggtgagttgcttagaattcatgggtttggggaagtgaggtagtgaaaacaaaggagtataaggttgatagccttttctcatttactcaagggctatttgttgagtgcctactgtgtgccaggcactgttttaagcactaggggtagagtggataacacaaagccctgccttcaaggagcagaccttccaatgatgcagcagccatgtgtgcactctgctttcattgcagacatcacaaacctgacctcctcgaaataaggtgcagaattgagcatgaccaacacttcctctccgcaagcagaggacatgtgctccttgctgtgggacaatcagtcctgcatggaggaacaagcaccccagtaacagcatagacggagataactgaataaagccctgttttttcgtcagcaggaaaaggcaaggaacccgctttctgccggttaaccggggggaaagtgcaacccttaaggattaggttttgctgagtttaacacactccagagagtatgctgcagggagagtagggaagagaagggctcttgggccacagcaaagtgaaggtgaatccctccaacccccagctgcaaatcagaggccgtttcctatgcaaaacagcataggaagacgtttttctaaggaggagccttaaatccgtccttgtttgttccttggtcttgggttctgcgcggaatgatgttgcaagcctcgtctttgtgctgccgcctgctggtagagttcattaaagcaaggaaggctgggtacgtctaggaaatggttattgcactccgttaggtgaagaaaagtgaggatgccatatgtattcaagacttaagcacatttctccacattttttctatcgagatcatgcaactgtatcctcattgtctgaaaggaatacttaggaagaagttttccagacacagtgggcaggattgtgttgtggggcagaaccagacatagtatagaatctgcctgcgatgcccagacttggtttgggacaagctagttatagccctgcttcctcccttcgaccaagcgcagccatgcacatggtcatactgccctttgatcctcgacccatctctctggccagcagccgccagctgactctatctgccaaggaattccagccaggaacactgtttactcttgtctggcatttctcaacccgagcttctaccatgaggttgcatttgaacattttcctaggtactgcactaccttccaaaaacagtcaggactctgggctgttcaaaacttcttccttagcctctataggataggtttcagatttgcataggaatcctggatattcaggttatcctccaactcctgggacagtttcagcttttttttttttttttttttttttgacacggagttccgctcttgtctcccaggctggagtgcaatggcacaatctcggctcactgcaacctccgcctcccaggttcaagcaattctcctgcctcagcctcccaaatagctgggattacaggtgcctgccaccacacctggctaattttcgcatttttagtagagatgaggtttcaccatgtcggccaggctggcctcgaactccagacctcaggtgatc

SEQ ID NO: 129508 - DNA, 2197 bp, Homo sapiens
aacccaggccccgccgccaatggctcgccctgcctctgcgccgcttggcccgtcccctctcaagcatatctcggataacgccccttccgcacctttcacgggcggtgggagctgaggctcctgtcgttatctctgatccttgcaccctggcaggaagctggtagctcacactttaacgggaggccttcacatattccagaaaagaaaccactttgcagtgccagactggaagaagtaacggtcactctgaaaacagggtgggagagctgcctctctttgaacctctcccaggaccaactctaacccaggtagatttgactgtaaaggccggttaggcttccctgtgctccgtgggtccgcgactgtctgacatgtccaccttctcagtatcctgacagtaccttgggcatccagtctgagatcaggcttagctgaaaaagctgcaggagtatgaagttcggctgtaatttgatcatcatttttgggaataggcattttgaggtttgtcttgagaattcttacttgagcgctttcattatcttatagggaggcaaacttggtcgatgtaagcggtggcttggagacagaatcatctaatggaaaagatacactagtaagtatttttagttgtttgcaagacaaaatagggtttgttttagttatttcttcttcttcttttttttttttttttgttgcgacggagccttgctctgtcgcccaggctggaatgcagtggcgcgatctcggctcactgcaacctcctccccccgggttccagcgattctcctgcctcagcctcccgagtatctgggattacaggcatctgccaacacacctggcttcttttttttgtctttttagtagagacggggtttcaccatgttggccaggctggtctcgaactcctaacctcagttgattctcccgcctcagcctcccagagtgttgggattacaggcgtgagccaccgcgcccggccttgtttttacatttttaagcgaatcaaaaatacattcaggccaggcacggtggctcatgcctgtaatcccagcactttgggaggctgagacctcaggatcacttgagaccagcctgggcaacatagggagacccccgtctcttaaaaaaataaaataaagtaaaatacattcaagtcaactgatttgagtctcgaactgctctgacacaggaaggtgctggggatacatcagaggtgatggatactcaggcgggctccgtggatgaagagaatggccgacagttgggtgaggtagagctgcaatgtgggatttgtacaaaatggttcacggctgacacatttggcatagatacctcgtgagtacttttcatagtttttgtgagaattgctcggtaaaataaatctgaacatgctcaacagttactttgtgggcaaaataaatgcaaagtatttcctatgtctcctaacccctattcagcaagtaggatgttgaatcaggagttgttttaattcccttagcatgttatctgcttactgagggcacagctctggtagatacaatggtgggtattgcccctccttttgagttgacaacctggtttggagacaaaaaaaaatgcaattacaaagtgttatataaacaaatttagaacaatataaaccttgtgttggtgttttggatttttcagaaaggatatatgtggataaagcctgttgtccaaaatttgagatgacccatgctctttatgcctgaaccatcctttttttcctttctcattgctgctgactcactcctttaggtatattgtctactctcctcagcaaacctatttccaatcatgtacctcttctagtgaattaaaatcatattgtgattgagaatgaaagacttttttccttatactgactgtctgttggaataattgtactgctcgctctctgtaatgttctttatggtttgtattatgctaatacatttataaaagactatctaaacataaggctgcattatcgtgaaattaatccaccttgggtgagattgtgaagaaatacatatatgtgtgtgtgtgtgtgtgtgtgtgtgtgtgtgtgtgtatatgtatatatatatacatatatatatgttttcttgtttttttcttgcgactgggtctcgctctgctgcccaggctggagtgcaatggcaggatcacagctttctgcagcctcgaacttctg

SEQ ID NO: 129509 - DNA, 1049 bp, Homo sapiens
ctatgttgcccaggctggtctcaagtgatcctgaggtctcagcctcccaaagtgctgggattacaggcatgagccaccgtgcctggcctgaatgtatttttgattcgcttaaaaatgtaaaaacaaggccgggcgcggtggctcacgcctgtaatcccaacactctgggaggctgaggcgggagaatcaactgaggttaggagttcgagaccagcctggccaacatggtgaaaccccgtctctactaaaaagacaaaaaaaagaagccaggtgtgttggcagatgcctgtaatcccagatactcgggaggctgaggcaggagaatcgctggaacccggggggaggaggttgcagtgagccgagatcgcgccactgcattccagcctgggcgacagagcaaggctccgtcgcaacaaaaaaaaaaaaaaaagaagaagaagaaataactaaaacaaaccctattttgtcttgcaaacaactaaaaatacttactagtgtatcttttccattagatgattctgtctccaagccaccgcttacatcgaccaagtttgcctccctataagataatgaaagcgctcaagtaagaattctcaagacaaacctcaaaatgcctattcccaaaaatgatgatcaaattacagccgaacttcatactcctgcagctttttcagctaagcctgatctcagactggatgcccaaggtactgtcaggatactgagaaggtggacatgtcagacagtcgcggacccacggagcacagggaagcctaaccggcctttacagtcaaatctacctgggttagagttggtcctgggagaggttcaaagagaggcagctctcccaccctgttttcagagtgaccgttacttcttccagtctggcactgcaaagtggtttcttttctggaatatgtgaaggcctcccgttaaagtgtgagctaccagcttcctgccagggtgcaaggatcagagataacgacaggagcctcagctcccaccgcccgtgaaaggtgcggaaggggcgttatccgagatatgcttgagag

SEQ ID NO: 129510 - DNA, 1482 bp, Homo sapiens
taccagtgagaaccttctagatgctgaattgtccagtataacggataaggtcttattaactttcgtgacagaaaaatccaggtatttataaaaatatgagccctgttttggttttgacaacctttttacattttaagactatgttaacatattaacattttaatttacctgtcactgaggggaatggattcatgttaacttctcataaagaggcgtacagcctgtgcagcatggcgaaaccctgactccataaaaaaatacgaaaattagctgggcatggtggctaatgcctatagtcccagctacttggggggctgaagtgggagaatcaacctgagccagggaacgtcaagtctgcagtgagctatgattgcaccactgcactccagcctgagtggtagagtgagagcctgtctttaaaaaaagaaaaagaagtgtgtgtgttcacaagttcactaattcgtataatttggctcttcggcagatcctgtctacctttcatgaccaactacagttttcattgcaacgtctgccatcacagtgggaatacctatttcctccggaagcaagcaagtaagaacaaactctggagtatttgaagatgattatccactggaaaagaaaagggatctgggcgtagcagaatcaggagacctttgcctagtagctggtataaattcagttggggtttagctctgaataattgcaattgcccatttcaggtcacatgatgactccattttgctgctataattgttattttctggaccacttatcgagtattcccttggtagtagagatgtagtactacagataactgtttcttcctttttgtttttgatagacttgaaggaaatgtgccttagtgctttggccaacctgacatggcagtcccgaacacaggatgaacatccgaagacaatgttctccaaagataaggtagaggtggaactaatgtgattgcagttatattgaagagttaggtggaacttctaaatatactccctaacaagtactttcttcccagtttttattgaatatatgacagtggattcagtgattaccttgttctctttttttttcaagatggaatgcagtgatgcgatctcagctcagtgcaccctctgcctcctgggtcccagagattctcctgcctccgcttcccgagtagctgggattacaggcatgcgccaccacgcccagctaattttttgtatttttagtagagacaggatttcaccgtgttggccaggctcatctccaactgacctcatgatccactggcttcggcctcccaaagtgctgggattacaggcgtgagccaccgcacctggactgttgtgttttttttgagagagggtctctgtcacccaggctggagtgcagtggtgtgatcatggctcactgcagccttgacctcctgggctaaagcaatttgccttcctcggcctctcaaagtgctgggattacaggtgtgagcca

SEQ ID NO: 129511 - DNA, 1057 bp, Homo sapiens
cacctaggaattgacttttagagttagtggttgattattaattccatacttttaagtataaaatgttcattaatagtaaaacactacttctttttagagtaaagaaagagatgtattcttggtaaaggaacacccagatccaggcagtaaagatccagaagaagattaccccaaatttggacttttggatcaggtacattaatatgttttacattttctttttgattttaagccactcggggataggtaatcaggttctgtttacatttgtatatttgccacataacacactgccattatatgcacatagcatggtggactccaaaaaaatagtgactgatatgagagtactcaccttcaaccaagagaccagtgttgtatagtgtttttgttgtgggtcttccccaaaatgttatgaatttcttcaaatcacttttttttttaactttagtttcctcgcttgtaacatgtaaaaatgctatttcaaattacttctaatcttcctgccatcttaaattttgctcttaaaaactttctttgttgtgaaaagaatttgttttgaagaatttgtgttgcatatctaacataacaggcaaacgaaaattgctgttttttgttcaacagcagggttcacatttggcaagtcagaatgtcaaatcttaaagctgtgtctttacatgtttgatttgccagctttgaaaatgcaagattcagcccggtgcagtggctcatgcctgtaatcctagcacttttggaggctgaggcaggaggattgcttgagtccaggcattcaagaccagcctggacaatacaacaagacctgtctctcaaaaaagaaaatgcaagatttcacatagaaatttagatttctgtcttgtaaaatgaaaacatctgactgcatggggcctgaattcccacaggagctgagtgaatggggcttaggcactctggtttgccctgtgccctctcctgcctctacccaagttgattgattaattgccatttatcgccattctgaaactattctgatccttacacttggcctacctcacacata

SEQ ID NO: 129512 - DNA, 1453 bp, Homo sapiens
tactaaaaaatacaaaactttagctgggtatggcagcaggcacctctaatcccagctactcaggaggctgaggcaagagaatcacttgaacctggtaggcagaggttgcagtaagccgatatcgcgccactgcactccagcctgggtgacaagagtgaaactctctcaaaaaaaaaataataataattagccaggcgtgttggtgtgtgcctataatcccagctactcgggagggtaaaccaagagaatcgcttgaacctggaaggcagaagttgcagtaagccgagatcgcgccactgtactacagactgggcaatagagtaaggccccatctcagaaaaaaaagaattgtcaattttagttcccattctgttagaatttctcttgttttatgagcatccagattgactgacttacgtagactccttttttaattggatgtatttttgcaggaccttagtaacattggtcctgcttatgacaaccaaaaacagagcagtgctgtgtctactagtgggaatttaaatggtaagtgtttacatatctcattgctgaaatatttggaagctattgaatccagttgtgcctagaactggccattctttgggttgacccttaacctggatacttactaaaatgcttttatagttcaaactcaatttttaggaactagccaaggatttggcagatggtaatagaggagaactttttgtcactttacaacagtttggtcttgagtgagacaggtttagcataagacaaggaaccatttcaaggtcagatttgctgtgtttatatctgtatccttataactaacattaaatttagaaagattcatctcctctccactctttttctgcaattcagctgttacttttaacagatttcctgtgcccatcttctaatttttcttgccctgaaacttcagctcattcacatgatagcatttctatattaaccacccattgcagcttgttcttctgttaacccatctaatagcgggaaaacccctcgttactaatggttatttaataagagttggggtggctgagagatatttagctgttcatctgatatatgggatcattaacctgtcttttggagtggtcgcgtcttaaatatctgatcatttctactgttactaatattttaaggtgggttggaaatagctagtgtgttatctttttacaacatattttcccgttttaattgttaaaatttgacaaatacatggtgccacttctgttcttacaggtggagccacttttggaggtgaattcctccactgtcttctttcagcctctcagacttaagtattttgtggtttggaaaatgctttttgctgagctatggtagaagctaaaaactacataatttgaagcattatgaaaatggcggcaatagcacttaatatgaaacagtagttgagtttaatgttagtatttaagagctt

SEQ ID NO: 129513 - DNA, 3763 bp, Homo sapiens
ccaggagtttgagaccagcctggccaccatggcaaagccccatctctactaaaaatacaaaaaattagccaagtgtggtggcaggcgcctgtaatcccagctactcaggaggctgaggcaggagaatcgtttgaacccaggaggcagaggttgcagtgagccgagatcgtgccactgcactccagcttgggcaacagagcaagactctgtctcaaaaaaacaaaaatttaattgttttttgattatggttacttaaactagagatgatgacattgcagcagtttaacattaaacttttatgaaaaataggaataacatctgaggtgttcaccaaaggaaattctgcataaaaagtctggtcctgtatatgcagaatatgagccaccttcaatgtcttgatcctttttattgcagcagaactgctagtaattcccaagcttgccccaaattaagatttagtactctgcagttgtttacgtaaaggtgttttcctgcagttcagggacatttcctggaagagggaaaaataaaactaattgagaggaatttgaactggacaaaaatttcaaagtacctatttcagaaatacacaaggtaatcttccttgtggctttagtatgtagctaaattttttgtataaaatatgtaaattgtctattcctatttattgcttttagttccacaagccaggttaatctaacctgaattttagtgcattggcacaatcttaataaatgttgtatttgacgaatgggtatggaactaaaaattgcctagcaaatcgaaagccttctttcttatttgtgtcatgtgcaaccacgatggagatctagcagtactggagagaaacacctttttagtacttctgtttccgttttccatgttggatgtattttgtcttgttggatattcaggttcaatgctttagcagatactgtgcttttatgatgtttatggactgtattgtgtagttcaagcaagtgaacatcgacttacagtgaggatattctctctttatgggtgtttgtattaatttggatgaaaaaaaatgtgcccatacagttgttttcattctttttagctgtgggtgtttgggatctgaatgagtgagaatgcatttgtgtcacaccctgagaaagtataccaatagttgcagtttattaggaacaaaggttgaaaactgtaacccaaccatcatagtgctggattcatttgagtttattgccagaacccagtgttcccaggctatgagatgctcagtagattctttgaaaactagggtgaaatccaatatgcctttggaaggaaatcctcctgtggtgttacacaaatgcacattgggtgtgttggtccctatggaatttcagtatccacatggtgtttcccttgtggctcattgaaagcaatctgccttctcttcaaagggggaattgcagcaggaagcagcggaaaaggacgaggagccaagcgcaaacagcaggatggagggaccacagggaccaccaagaaggcccggaggtggggagagtgcccaccctgcccccctcactatttaagtattatttggtgctgggaaagtccagcagagggaagagagttcaagggtcggaggttaaaaagcctgtccattttttctaaaccttgagcactttgagggacaaaataaccccaggttggaggccaggcgcagtggctcatgcgtgtaatcccagcactttgggaggtcaaggagggtggatcacttgaggccaggagtttgagaccagcctggccaacatggcgaaaccccatctccactaaaaatacaaaattaggcaggtgtagtggtgagcgcctgtaatcccagctacttgggaggctgaggcaggagaatcgcttgaacctgggaggcgggtggcagtgagccaagatcatgccactgcactccatcctgggcaacagaatgagactccgtctcaaaaacaaaacaaaaaacaaaaataataaccccaggccgggcacggtgggtcatgcctgtaatcccagcactttgggaggctgagacaggtgaatcacctgaggtcaggagtttgagaccatcctggacaatgtggtgaaaccccatctctactgaaacaaaaaacaaaaaaattagctgggcctgggggcacgtgcctataatcccagctactcgggaggctgaggtgggagaattgcttgaacccaggaggcagaggttgtagtgagctgagatcgcgctatcgcactccagcctgggccacgagaacgaaactgtctcaaaaaaacaaaacaaacccaagtttaagtgtcatgttttacatttaagtgtacatacatttgttagtacaaaatttatagtagtaacaagtatagtgtcttctggtgataagcctggggaacctagggagtgaagttctgttaaggcgacttgagaaaggataggtggggagggagtgaaaccagtgttgaatgttagctcctttagctccttaactttctgcttctcccttctcatgccttttcccttccctttgtctaaagctgaggtgatgaaatccaggttgcttatttatttatatatttttgtgagatggagttttgctctatcacccaggctggagtgcagtgatggaatctcggctcactgcacaagttatttacttagattagcaagatagcaagtgcttatgtctctgagcttctgttcattactttataataatcagtatactaaagactatcaccctaatcacccccattcctctcctcccttccccccccccccccccccgcataatgtaccagctcagtttcatagacatcaattcatgtttaaagaccactgggaagatatccacaatctacaagtaatttcaccaaaactaccttgctcaataaagctaatccttttcacttccttgttttgcctgaagagggcagagttacttatttgagtaatgagaagtatttgctgtgaagttgcatgtattctagctgaaataaaccagaggcctttcttacacagttgaatgcatttgagctaaagggggttttagttttttgatgttattttttcctttctgcagtgaccctttgttttctgctcagcgccttccccctcatggctacccattggaacacccgtttaacaaagatggctatcggtatattctagctgagcctgatccgcacgcccctgaccccgagaagctggaacttgactgctgggcaggaaaacctattcctggagacctctacagagcctgcttgtatgaacgggttttgttagccctacatgatcgaggtatgtaaagtattggagatcatatggatgcagggttactttgaactgccatcattagccttgtcagtctagaattaggtgtacatctcagtctgttgccactgcctcacccccatctctgtctagattcatccagaatgtgcaagaaattctgttccttcctataagctccagccgttttatttatatatatatatatatatatatatatatatatatatatatatatggttttttaaaactttctattttgaactaattttaaacttgcagtaaagttgccaaaaataagttttctttctcatcaagcttttcctaatgataatatcttagaaaaccatagtacagttatcaaaactgggaaattaacattggtaaatattatcaacacaactagagaaagacctttcaattttaccagtttttccactcacacttaattatttctctttagtctat

SEQ ID NO: 129514 - DNA, 1798 bp, Homo sapiens
gattgcttgaacttgggaggcggaggttgcagtgagccaagatcgtgccactgtactccagcctgggctacagaacaagactctgtctcaaaaaaaaaaaaaaaaaaagataagccaggtgcggtggctcatgcctgtaattccaacactttgggagaccaaggcgggcagatcacgaggtcaggagttcgagaccagcctgaccaacatggtgaaaccctgtctctactaaaaatacaaaaatgagctgggcgtggtggcacgcgcctgtaatcccagctactcgggaggctgaggcaggaaaattgcttgaacccgggaggtggaggttgcagtgagccgagattgcaccactgccctccagcctgggcgacagagcgggactccatctcaaaaaaaaaaagataatcacatgtaataaaaactaagtaacctaacaactttctcttttttgttgctttctcattccttgccagtatcttatgctgagatttttaaactcctcaactaatatttcaaacacctgacctgatatttgtgatttttaaattgttttattggactaatgtttttgtggcaattgtccccaagaacctcaaataagttgcaggccttcttttaatctctgtcaccgcagctccccagttaaagatctcagatgaccggctgactgtggttggagagaagggctactctatggtgagggcctctcatggagtacggaaaggtgcctggtattttgaaatcactgtggatgagatgccaccagataccgctgccagactgggttggtcccagcccctaggtaagctggggccttaatatggacatcacagcagatagagaggatagaccatctggccaagggctaaggcttcaaggctgttgggtttaccagattgtgggcatagaattcagttcctgagggttgagctggtttgctattcccgggatatttttgtaattctttgcttgtgagaaagtttttaagcaattttacaaaattgaccaaaaaacataaaaagaaataggatctttttccttcagcaaactagatttgacttgcaatcttctgacttcctgtgtatgtttttattgggacaggaaaccttcaagctcctttaggttatgataaatttagctattcttggcggagcaaaaagggaaccaagttccaccagtccattggcaaacactactcttctggctatggacagggagacgtcctgggattttatattaatcttcctgaagacacagagacagccaagtcattgccagacacatacaaagataaggtgagtttgtcctctcccggcagattcctggctttgaaggcctgtggcagccagtgcttatcactggcttgtgtgatctcttaggaactgagccacagctcacgttttttcctaacctgttgctatgacattttcagaataacagtaacaatcggtgcacaaatagtcatccattcattcttctacccatctatcatttgtctttttttagtgcactacagagaaaatgacagacatcaggacactttcccactaagtacttcaggatacataagctagaattcagcctgtttaattcattcttttgatacaaaatgtatataaaatgaagtacacaaattttaagtgtacattcactgagttttgagtttgacctaaactgttgaaatgtaggatccactaggcatgatggttcacgcctataatcccaacaatttgggaagccaagctgggaggactgcttgagcccacgagttcaagaccagcctgggtaacatcac

SEQ ID NO: 129515 - DNA, 1058 bp, Homo sapiens
aggagagaggattacttgaggccaggagttgaagactagcttgggcaacatagtgagacctcatctctacaaaatttttttttttttttaaagtaagctggccttccatggactccttgggaccacacctgtttaagcgtgcttgtttatcaattcctttccccgagtcagttctcacttctgctttttcactttgaagttctctaagactcttatgtcacatctctgaatcctcatgttcctcctttctctcccagaattacactgaatatcctctcttgaccacttcaattcttcagaaaaggctgccttctcttcccacaagagggggctttctggttattgcatctttagatctaataattatttctctttagtatttctttcctaaaaacagctgaaactcgtttctttatttcacctccatctccttctattagtgtcctgggtggcctcacagcattagcatttttatgaaaaaaatgtttccagcttaactttcttcctctacatcccacttccctttttatttttggtgcttgtggctggcccagatgtgccagcctttctctgactgtgctatgaccttgggcagacatgtttccagcaaccccggaagtggaggcagagaaagttctgaaggacactgagtgagacgttacagctcctagtgcccctgggccacaccacaaggtctactctcccactccaggttccctccctttggacttgatacctcctctgataaagaataaagacactggacttgcttcctcagtctcttgtagatttcccaacaggccactatttttttttttttttcattgatcattcttgggtgtttctcacagagggggatttggcagggtcacaggacaacagtggagggaaggtcagcatacaaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcacc

SEQ ID NO: 129516 - DNA, 1329 bp, Homo sapiens
agccccggactttgagaccagtctgggcaatacagtgagatctgtctctataaaaaaattttaaaaattagctggatatggtggtgtatgcctgtagtcccagctgcttgggaggctgatgtgggaggatcacttgagccaaggaggttgaggctgcagtgagccaagatcacaccactgcactccagcctgagtcacagagtgagaccctgtctcaaaaaagaaaaaaaagcctgaatagtgcatattaacatgctttgaaaaatcgaaagtattataaaaattgaagatgttgttattacacaagttatgcactgttcttgggtgagtgactagcagtctggcagcagcacttctaacatattttcctagagagttctttttttgtttgttcttttttacagttctgaagtaaaaccatggtttttgtttcagataatattttataaaaatggtgtcaatcaaggtgtggcttacaaagatatttttgagggggtttacttcccagccatctcactgtacaagagctgcacggtacgtacatgtttccatcccatgagcaaaacttgagggaagcagatgaatgggttgtgatgacaaagttactgagtgctggaacgaaatccaagcagcctcagagtggcatgcgcatgtgttgttaccattactgtttagtccagaaacagtttgggcatcttagggagtatttgctggatagaaaaaggtcctgcagtttgtgtgcgccatacttttcccttgagcacgtggtgtggtgttaccgttcagtaggaaggatataaatacacatacacaaatcctcctgggatgtcatgataacccaccattattagtcattgttgcttacaatgatttttttttttttttttttttttttttgagacagtgtctcactctgttgcataggctcaccatagccttgacctcctgggcacaagtgatcctcccacctcagcctcctgagtaggtggggtgtgctaattttttggtttttgtttttgtagaggcaggatctcactacattgccctggctggtctcaaagtcatgggctcaagcagttctcccagctcagcctcccaaagtgctgggattacagagaggcatgaggtaccacatctggcaagttttttttttttttaaatatgatccaaacatgaagaagggtactatcattagggcctgttggttttaaaaatatataggtagataggtagatagatacagatatatagaaaagttggggctgggtgcactggctcacgcttgtaatcccagcactttgggaggccaaggtgggtggatcacttgag

SEQ ID NO: 129517 - DNA, 2864 bp, Homo sapiens
cacacctgtaatcccagcactttgggaggccgaggcgggccgatcatgaggtcaggagatcgagaccatcctggctaacacggtgaaacctcatctctctaaaaatacaaaaaaaaaaaaaaaagaaaaaaaaaagctgggcctggtggcgggagcctgtattctcagctactcaggaggccgaggcaggagaatggcgtgaacccaggaagtggagcttgcagtgagccgagattgtgccactgcactccaacctgggcaacagagcgagactctgtctcaaaaagaaataaaaaattagccaggcttggtggcacgcgcctgtcgtcccagctactcaggaggctgaggcaggagaattgcttgaacctgggaggtggaggttgcagtgagccaagatcatgccactgcactccagcctggtgacagagcaagactccgtctcaaaaaagaaagaaaaagttaatgcatgaagatttccatgtacttttagtctgtcagtaggcaccattgaagcaggtaaaaaaaaaaaaggaaatctttaaacagtgtaaaccaaaactatctgagacagatctcaatcaatttagaagtttattttgccaaagttaaggacctgcctgtaagaaaaaaacagaatcacagaaacagtctgtggtctgtgcctttctccaaggatgaatttgagggcttaaaagttttaaaaagaaaaagggctggacggagtggctcacggcagtaatcccaacactttgggaggccaatataagagaatcagttgagcccaggacctcgagaccagcctgggcaacatagcaaaaccccctttctacaaaaaaatacaaaaaattagccaggcgtggtggtacatgcctgcagtcccagctacttgggaagctgaggtgggaggatcccctgagcccaggaggtcaagggtgcagtgagccgtgatcgcattgttgcgctgcagcctggacaacagagtcagagcctgtctcaaaaaaaataaaaagtaaaataaaggggaaatgcgggctggaggggaaagtaggagggtatggtcatccacatgttgcaagagaaaaggagcagataggggaaagtcaattatgtattcatctcatgcccggtaaatcggcacttcacataaggtaaggtgaacataaagtagctgcctgtggggatatttaacgttttatctgtaggtgtctgcttagcaacaaaaggaaaggcagtttcttgcatgactcagctttcagcttaattttttccttttgacagagcaaattgggatcctgaatttttatttttctttgacaacagaaatcaacacagatctcttttagttacctaattcttgatggacatcaggatgttgaccacttttagtaatatttaatatatatcttatttgttccatttatcccccgagtattgtagccacatttaaagtgaaaatttcctgtgtcaaattaacttttccaatattttttgtccattttttccatgtctgcttgaattgaattcgctccaggtttccattaactttggaccatgcttcaagtatcctccgaaggatctcacttaccgccctgtgagtaacattacaaatggctgcatgtgtcctcagcatctccgtggctgctgtagtcaccgtgttctgtttctcattcctcctgcagatgagtgacatgggctggggcgccgtggtagagcacaccctggctgacgtcttgtatcacgtggagacagaagtggatgggaggcgcagtcccccatgggaaccctgaccaggtccctcttttctgtcaaggactttctgggaataatactgggggttttgtttttgtttttgaactgtctcaaatgttctcccaaagatgctaaaaacacagcctctccttttagcaagttaaaaggctgggtaggactgcgggagactgcctgcctttcaccattttctccccacttccagtgactgctcttattttgtgtaccataagccaacaaccgctgactccaggattgcataagccccctgtgaaatcggtgctgtactgcataccctgccagctgtgacttgttatcctactatattttctaaggagtgaataatattgtccgagtaactaacttatttaaaagacatttccttctgtgggcattgactgtatcccacctgttttccaaggaaatggtaacctgtttctgagaacacctgaaatcaatggctatacattccaaaccaatctaaacgctatttccttttggtgtgggtttggttttgttcattttgaaatacacttttgaacactgagatccgtaaaactactagatctctggaagtgtaattgtgaaagaaacttgcttgcagctttaacaaaatgagaaacttcccaaataaaacttgttttgaagtttatgtgacactttgcttcccttcagattgggtgcctcttggtgacagtgttcagaaatgtaagcagcacgaggaagggagctggcactgggaggaagagccgggtttctgagttgtgttttggctgctttcctattgctcccattcttgccaatcagccaccccctttcctgtgaaaatctgccaccttgaggagaggaacaagagtttaaaagggctaatgatctccctcccggtcttcccttggaacatggatgttgatatatgtgcgggtggtttcctgtcttgcttatcttcctttgccctgagctgatggctaaagggcagttttcggactattaaagactgaaatgtaagaatgagccttctaggctgggcgcggtggctcacgcctgtaatcccaacactttgggaggccgaggcaggtggatcacgaggtcagggg

SEQ ID NO: 129518 - DNA, 1069 bp, Homo sapiens
tgtggctcttctgaatatcttatcattttcctgtttaagagagttcccacacttcaagacaatattggtattttaacatagtagcattgattaatatatttgtctcccgatgaatcacccagacactttgatttggccactgcatatctctgaacaggaaagcctatacaggtcgagtgtgattggaggctgaggctcagccctagacacctattaatgcgtgaactagtcttcaagggcagacctggttataaagcttctagatcatcggagtttgaggtactccaagaaaatgagggtggtgttatttagaggaagctgaatgttaactctttgtaatataaattaccacatataagttgtatacacactctccatctaaattataaaattagctttttgtatatattttcacaaatcaaaggttacaggtaatgatgttcttctcaaacttcaaaagtgtgtgtgtgttttaatacagttcatttgaagggctcagagaatatctactcttcacagcgtcctatataaaatagtttctgtaatcagatcaacagtgataacttgttttattccagtgtaaaattaaacaagtgggaaaatatctccacagaaaccagaaagacacaattacatagtttgaaggaggcaattagaatccagcaaaccagtgggtttgttaaaagcctatttcttgactgtcagcctgttctcttgaaactacaatatatgttgctttaaggtatctttaaacaagtaactattttctcttagctggtagtggatgataattccattttagaaatacttctctacaactatcctctctcaactctgaggctcctagataaacaataattttatccatgtcaaaaataaactaagaaacaatccgaataaattataataaatacctttactagttgtaaaattttaatacctcaggaaataccacagtgttcccactaatgctattttttaattttttaatttagtttgtcataatttggtttcatcaactcctttgttttttccttctttttttttttttgagatgaggtctcactat

SEQ ID NO: 129519 - DNA, 1598 bp, Homo sapiens
gctcattttgtatttttagtagagatggggtttctccatgttagtcaggctggtctcctgccctcaggtgattgcctgccttggcctcccaaagtgctgagattacaggcgggagccacctcacataaattctcttgactcctgggaaagggaatttgctttcaccatattaccccttcttccagccacttctcccagaatactaaacttttagcctgtttaagcagagaagttgccagccccaaacaaagttgacagctgtggaattatcttactactaattggcatcataaataacagaaatgttaactaatattgtttatcctctcatatttggcactgcctttccttttaattaggtaaataaacagttataatcttcatcttccagggcccattaatcagctattgcttatagaattctttaagaactcatttaggttatgattatggaaattaaatttttatgaaagatcctggtaacagagtctaaattattgaattgcataatttcccagtagttcctttccttttaatgagccttaatttagtttgactaattaaaagctttgtccagaactcctctagtgtgaagttgtaatctactagcatagatttttttttttttttttttgagatggagtctcactctgtcgcccacgctggagcgcagtggcacaatctcggcccactacaacctccgcctccggggttcaagtgattcccctgcctcagcctcccaagtagctacgactacaggtttgcgccaccacacccagctaattttttgtattttagtagagacggggtttcaccatgttggccaggatggtctcgatctcctgaccttgtgatccgcctacctcagcctcccaaaatgctgggattacaggcgtgagccactgcacccagctgcatagatttttttaacagtacaatattaaaacaaagactgatgtttgtgtgaattatgattctttattctgactggtgcctatgaaagcaatagggaaacatgtctactaatgagttttgtctttttccacagagaaagcttggactatatttctggaaggcacccactgtggggtgctgcttgttctgtggtgttgctgtgcagcggccgggaggagcagagggctgcaggagaccctctgagattctgctttgtgcacatgtactgccagcgcatggcattcttgagcccataaagcaagacttctcaggccctgtggttagcatcccccacacccatatcagccactagcattttaaagatggttttaggtgggtacataagggcccagaaaaaaagttttacaattattttaggggcctgaaccctcatgtcatagctaatcagtgaatgaagttaccttttaatccaagagcctcatccctgttttcttggtactaaaaactttcaccaatctgaatcctagtgtcatactctaaacacgaaccccacccatcccactgtcaccagatggagatcttagacttgcaggcttccagtagggattctcctgatgagcgtgtgtaccagtgcagctgggcacagttgggaacagcaggctggtcttcaacacctggcttca

SEQ ID NO: 129520 - DNA, 1957 bp, Homo sapiens
ctggctgcttacaccagtaccatagataacacgtttctacggtaccttgtcttttctgagtctcatcagggaagtgccctttgcaaagggtaattatttggcagttggcacagttaccagctcatcagaataaaggctgcttgtagctggagcagcccctgcggcctcttgtgccctttagttgctggattactgggatgtcagggaaaggattcaggctggtggctgggctggggccttgggaaattcaggaggctgtggtgtactgagtggtatggattatttcaatattttagtctacattacagctgttcctgagcgtaccaggtgaacctcagccctgccccatgcttcagaaaattattaaggttcttaaactttctgggagggtcatgacaagctgtctggctgtccaagtagggcctatcttgtctttgtccctcctttggtaaataagtatcttcttttgtagaaggaagccatgggtgcaccaagggttggtttcttggagctggggatgcagtccacatgcttgggtgcacacctgcaggcctgtgttagaagaggggggtttggagcctgctgcccgtattacctgatgacacccttctgctcaggcatgttcccgaagtctgtggccatgccagccagcacacaggtggagcctcggcgcttggcacagcgcacgctcacaaagtcacggggccccaccaggtttcctgctgcctcggcagccagctcgtgagtaatgaatgtatcttttccgatcttctgcaggacctaccaggccatggggaaccagaatcacgactcagcctgtgttgggctaagcaccccccacagctaggggtcctctctttgatacagcattcacactgggctctcctgggcccctgccacctgcacctggactttgctcaccttgatctccttgacattggggttccactcccccattgcttccatgcgctccacgagctcttcatagagcctctccatgggctggtccaccacgacctccagccggaacaccttgcccacatctgggaccactttactcatcactttgtccccattgtcctgtcagagaaaggagcccccagaaggtggttagacaaaaatattcttggccgggcatggtggttcacgcctataatcccagcactttgggaggccaaggtgggtggatcacaaggtcaggagttcgagaccagcctggccaagatggtgaaaccccgtctctactaaaactacaaaattagccagacatggtggcaggcgcctgtaatcccagctacttgggaagctgaggcaggagaattgcttgaacctgcacggcagaggttgcagtgagtggagattgcaccactgcactccagcctgggcgacagagttgtctcaaaaaaaaaaattttatatatatatatatattcttagtctaggtcccataggcaatacaaggcaagatggggaggggaacagcaaaggaactccaagttgagcacgaggaagcctggaactgtcctaagatagagtcggtaatcattgttgccatggccttgtgcatctgctgacaactggaggaagttacctgctgccactggaccctttttaagatttttttcttgttttttttttttgagaccgtctcactctgttgtccaggctggagtgcagtggcacaatcacgggtcattgcagcctcaacctcctaggctcaagaaattctcctgcctcggcctcccaagtagctgagactacaggcaagcagcattacacctagctaatttttaaattttttgtagagatgtgatctccctgtgttgcccaggctggtctcaaactcctaggctcaagcaattctccagtctcggcctccaggcgtaagccactgcacccagccccactggaccctttgtcttggtggtgaatgatggtggtatgggtaggtccaact

SEQ ID NO: 129521 - DNA, 1051 bp, Homo sapiens
cagaggttgcagtgagccaagataaagccactgtactccagcctgggtgacagagcaagactccgtctcaaaacaaaaacaaaaacaaaaaaacaaaaattagccaggcatagtggcaggcacctgtaatcccagctactcaggaggctgaggcagaattgcttgaacttgggaggtagaggttgcagtgatctgagatcacaccattgcattccagcctggatgacagagcgcgagactctgttgcaaaaaaaaaaaaaggaaaaaaagaaaagacagggcgttggggtgttcaccctagtctttgcactttaggggccctgtcaggctgagcaaggccccacgaggcctctgcatttcccactcacccttacccaggcgcagcacgtgctgggctctgactctgacggaatctcttccctttacagtgaccttgaggctgcttttaagccagattcactgggcaagaatattgggagtggaaaaactcacactggaactgcccctggcccaggccctgctccctgtgggagggagttctgtgtcctgccaccacctcacagaggcagaggggagccctaaaaatggggagcagtgccggggccccatgcactctcgctgtctccccaacaccagacagggtgaaagggacaggatctgctcagagccaggcctggcacttggagcccatatagaacaggggagtcacccccctggcccccgatttccaccccggtgatgcagtcggggaatcctgtgagcagaggctgcctagaggtacccggccccttcctcaaaacctcctccaggaaaccttcctagaccatcctggtcttctggaatgctggctcctcccaccacacccttactgtcagtatcacttgaggggcttagttctggtcctgatttgttgaatggtttgtatgtgtttgcttgtctcttctgtggaattatctccccaaggcaggtgctgggtccactttcccccttaaaagctgtccccaccctcagcactcacctccagcagagacacaggggactcttgctcctt

SEQ ID NO: 129522 - DNA, 1039 bp, Homo sapiens
tgaatccgggagacagagggtgcagtgagccgagatcgcaccattgcactccagcctgggctacagaatgagactctgtcttaaaaaaaaaaaaaaaaattagccgggcgtggtggcaggtgcctgtaatcccagctactcgggaggctgaggcaggaaaattgctggaacccagcaggtggaggttgcagtgagccgagatcatgccactgcactccagtctgggtgacagagtgagactcagtctcaagaaaaaaaaaaaaaagcaccccgtccccatctgtaactttccagcttttcaccctaccaagtattgccatctgacatatattttacctgtttactgtctgctcccctccctcactagaatgtaaacccttaaggatggatttctatctgtcttgttcactcttgtatccccagcatctagaatgatgcctaatgtgcattaagtctcagtatgtatttgttgaaggatggatggatggatggatggatggatggatggatggatggatggatggatggatggatgaaagcatgaagtaagttcaggctggcttaccaatatgcttcagagaccagtacgaccccaaaaggtgaagacagttgcgaccactgagcggccaggagtaggataattagtagtgatcagtccttacattgaatatggagatgttcccctactgtggaggcagcctttagtgcaggccatagcccttcaggtgtgaagggtttggaggtaattggtggtaaaaaaattctgagacccggtgtggtggctcatgcctgtaatcccagcatcttgggaggccaaggtgggcggatcacctgaggtcaggagttcaagaccagcctgaccaatatgatgaaaccccgtctctactaaaaacacaaaaattagttgggcatggtggcacatgcctgtaatcccagctactcaggaggctgagacaggagaatcgcttgaacctgggaggcagaggttgcagtgagccgagatcacgccattacactctagcctgggcaacaagagtga

SEQ ID NO: 129523 - DNA, 1030 bp, Homo sapiens
taaaaaaaaaaaaaagtctaaggccacattgcctcaataacctccctcttggattctctgcagtgggggagatagctgtctataagcagccctaatttttttttttaaggaaattaatcgtggactaatagaaaattaatcctgactaatatgggattttggatcacataaagctctgttatacaaatacttattactgcctataatcccagcactttgagaggccaaggcaggcagatcatgaggtcaggtttcgagaccagcctgaccaacgtggtgaaaccctgtctctacttaaaatacaaaaattagccaggcgtggtggcacgtgcctgtaatcacagctactcaggaggctgaggcaggataatcgcttgaacccaggaggtagaggttgcagtgagctcagattgcgccactgcacttcagcctgggtgacagagagactccatcttgaaaaatatatacatatactgatcactattaacctcattgtaagtatgtatcctatagtagtgttgtcaggcatttctttgaaaaacttaccggtccctaggagaaggatatttcagttcctgtcacagttatgaaaaataatctgagcctgatagaggaatccatttgccttgagatctgtgctttctattcttggtcttcaggtgaagttttcaaacctgtctcttttgtaggacttggaaaaggagagtgacacacccctccagcaagtatccattgaagaaattctagaagaacaaagggtggaacagcagaccaagctggaagcagagaagttgaaagtgcaggccctgaaggaccgaggtctttccattcctcgagcagatactcttgatgagtactaatcttttgcccagaggctgttggctcttgaagagtaggggctgtcactgagtgaaagtgacatcctggccacctcacgcatttgatcacagactgtagagttttgaaaagtcacttttatttttaattattttacatatgcaacatgaagaaatcgtgtaggtgggttttt

SEQ ID NO: 129524 - DNA, 1089 bp, Homo sapiens
cagcactttggaaggccgaggtgggcggatcacaaggccaggagttcaagaccagcctggccaatgtggtgatccctgtctctgctaaaaatacagaattagccgggagtggtggcaggcacctgtagtcccagctactccggaatctgaggcaggagaattgcttgaaccagtaggcagaggttgcagtgagctgagatggcgccactgcagtccagcctgggtgacagagcgagactcggtctcaaaaaataaataaataaaaataattagaaagcttggaaatcatgtttacctaaatcttttcaaaataactgattattgagttatgggcctttacccagtagtttaaactaaatatctttggtttttccctatacacttacagcaaacttagtgctacatcagactgtggagcgtattcatgtgggcaaaaaatacggtgatattcctcgagggatttttgtggtcagaggagaaaatgtggtcctactaggagaaatagtaagtgaaaactattaagctgctgtagatcttcatattcatgctagttagacttctttttttgtcttttcaaaagagaataaaaatattctccacatttatctggcttctcctaggcaactaccaaattaatttagggaagctacagagaatactttgtttcagtgccttaacaaatgtgttcattaatatatttgtttaatagcagaaaattgacaaagcttgatttatatatgctggggaaggtgtgtcttacatacgttggaatattttgcagtcatttaaacaattggttacaagtggtttttcatggcataaagctaatgcacagtatttcagggaagtacatattgcctgtacagtacaatgtgatatccatattagtaaagggggaaagggaaagagtagctataggaaaagcttttccgttacctatcccgagaatggagttcagtcttacttggatccttagctcacagccagggagagggtattttggtatctgtgccagaaagaccagctggcaggtgaaaggttaaatcagattttctgaggtattgttgctgtaggtcttcgtgtgtgcag

SEQ ID NO: 129525 - DNA, 1071 bp, Homo sapiens
ggcagagtcactgtgtttttcctctgttctgcatctagaaagtactttaggcatggaatgaaagaaattttgctgggtgcgctagtaactggcttattttcattcttcagtgtcagctcaaagtcacctcttcagagaggctttcccttgccacccttccttctgtaaccacttctctcccttcatcatactgccttgctagtttattattccattgtcctaatcacaataggttattttcttatttatttgtcctcctccaacatgaatataaattcataaggttggtgactttctaagtctcattctctactgtatgtctagaccccagaacagcacatgccccctcagtaaacattgaatttctgctctagcttattattagtcttcattttaaatgcctgaagcattgtgtttttatttaaagccttctatggttacaaacaaaatgtgagatagaagctcatcttttgaggacaaaataattctacaaataagataatagtcatctagattaaatttgtcaatttacagatataaaaactgacatgacatgagatggtttaagtgtcaaacataagggtctttggctaggcgccatggttcacgcctgtaatcccagcactttgggaggtggaggtggatggatcatctgaagtcaggagtttgagaccagcctagctaacatggtgatacaccatctctactaaaaatatgaaaattagccaggcatggtggcaaactcctgtagtcccagctactaaggaggccgatgcaggaggatcgcttgaacctgggaggcagaggttgtagtaagccgagattgtgccactgcactgcagcctgggtgacagagtgagactctgtctcaaaaaaaaaaaaaaagaaaaaaggaaaaaaaaaaaaccaacataagggtctagagccagctagtcaggcttcctggtgccacgccctgtccttttcccactctgccacactgctctgattcttttcactactgatgttatctaaatccgcgttgctgtgctgcttttttcagttttccaatgaacttgaacttcacattaa

SEQ ID NO: 129526 - DNA, 1052 bp, Homo sapiens
tgttgcactaattaaattagtagtcttgaggattagttattggagaaggatagaggtgatctaatgtctctgattttgctaatcatcttgatgtagtagaattcctttatatagcatttggtgtggtggcattgtcgaaacagataagaacagctttttactaggtaataattgttttgtcatagagcatttgatttaccatgtactgaataattagcagttttatagttggggtcctattcccttttttcttttattttttgtttttaagagacggggtctctcttgaccatactagactcaatcacctgagctcaagcgatccacccacctcagcctccgcagtagtgggacaagaagcgtgtgccactgtgcccagcttattgctttttgtctattgcttttttttttaatccttataacctgcctctatcaatctatcttaaaatgatgtatgaatgttattaagagtgaatttatttttctttttttcttaggagcagccaccatatcctagctacaattctaactattggaattctactgcgagatctagggctccttacccaagtacatatcctgtaagaccagaattgcaaggccaggtatggtttaaaaacagagactttctgaactttttcttaatgaatagatttattttcaaaacctgtgcagattttagagcagtgatgagtgtgtgttttttttctttgctttaatgggctccatcaatctcatcttaatgtttttagctcagagataaggaaatatctaggcaaatatacctatagcttgaggcataataaattattttccaggacccagaaggaacaaacataaaatatacttatttttgaaaactttactgattacagacatttaatttaaaatattttaaaattataaaaagtacagaaaatatatacattttaaatctagcatgcagggctgggtgcagtggctcacagctgtaatcccagcactttgggagaccaaggcaggcagatcacctgaggttaggagttcaagaccagcctggccaacatggtgaa

SEQ ID NO: 129527 - DNA, 1954 bp, Homo sapiens
ctgccacagggcaggttccagccattataactcaaaaattctgtgccttttgtctgacagggcactcccttttatcttcttaggactgtgtttttttgcaaatgattaaggagaggggtccaattttattgttagggaatcttttcatgtacctttctggtcaagtgaaagatgtgggctaacaaatttgatgttgatgcattcccattaaaacagctcttttcctctttttgctctcccactccaaggattcttcatacccctatagccaatcagatcaaagcatgaaccggcacaactttccttgcagtgtccatcagtacgaatcctcggggacagtgaacaatgatgattcagatcttttggattcccaagtccagtatagtgctgagcctcagctgtatggtaatgccaccagtgaccatcccaacaatcaagatcaaagtagcagtcttcctgaagaatgtgtaccttcagatgaaagtactcctccgagtattaaaaaaatcatacatgtgctggagaaggtccagtatcttgaacaagaagtagaagaatttgtaggaaaaaagacagacaaagcatactggcttctggaagaaatgctaaccaaggaacttttggaactggattcagttgaaactgggggccaggactctgtacggcaggccagaaaagaggctgtttgtaagattcaggccatactggaaaaattagaaaaaaaaggattatgaaaggatttagaacaaagtggaagcctgttactaacttgaccaaagaacacttgatttggttaattaccctctttttgaaatgcctgttgatgacaagaagcaatacattccagctttcctttgattttatacttgaaaaactggcaaaggaatggaagaatattttagtcatgagttgttttcagttttcagacgaatgaatgtaataggaaactatggagttaccaatattgccaagtagactcactccttaaaaaatttatggatatctacaagctgcttcttaccagcaggagggaaacacacttcacacaacaggcttatcagaaacctaccagatgaaactggatataatctgagacaaacaggatgtgtttttttaaacatctggatatcttgtcacatttttgtacattgtgactgctttcaacatatacttcatgtgtaattatagcttagactttagccttcttggacttctgttttgttttgttatttgcagtttacaaatatagtattattctctacttcttggtacattttgtagtaatatgtttaatataattattcaagagactatattgacagccagatagtatggcagttctgaaaaaatttatatcttttcaccacttgaatatactgcaatgtgtagtgagtaaattgtctccctttttctatagatcattaggttagagtttttttcttcttttttttttttttttttttttaccacttctgctgttcatggtagtagtggaaggtaaatttggaaatggcattgacataaaatgaaaatgtttacggacacttttcttttttgcttttttattgtatttggataaagatccacttaaaagttatctgttttttcctgttttttttttttttccccaaagtgtagttatgttttcactattgctgcttctatagagggcattgtgatagagagttacagatgaaacattaaatgccacagtgagtagaaataattactacaaaaagtaataaatatgattacttggtaatatcattctccatctaaaatactagtttcacctgtgagcagatttcagctcagtttatagttaaaaacaatgagggtaaaatgggattcatgctcagggaatgaatcagccatagttagagtgggaaattattattttcttcatttaaaggtagattttatgtttatttccctaaattgcataagataaaat

SEQ ID NO: 129528 - DNA, 1231 bp, Homo sapiens
tctgcacccaccttgcccttatgttaacatcttacgtaacaatagaacatttgtcaaaattaagaaattaaccttgatataatactaactaaagtagaaagtttaaaaagtagagattttagtcttttcactaatgtccttttactgttccaagacccagccttgcatttagctatcatgcctacgtcctgtcttccagtctgtgacagtgtatcataacaggggatacctgatgttgtaatgtatttctggtgttgttaaccttgatcactatgctaaggtggtgtctgctaggattcgctactgtaaacttactgtgttttccttgtaattattgaatatttgctggagatacccggagactatgcaaatgtcccgtttctgcttaaacttttgctcattttactatccattggcagatcttgcttgtggcagttactactgtggtgttctaatggtgattttctatttctctcaatccttctacatttattattggaattcttctgtaaggaagagttgtcagttctggatttatatttttaactataataagatattcaggataagtatagatttagaacttaaagatgttaaatcatgttaaaattattccaaataccaatatcaaagaaaactaagttggtaatctatctcagaaaatatatgaacttaagaaggaaaatagtatttatgatttgtagaattggttcaacttttgacttaatactgactttggactgaattcaaagttttcttgaaatttcacatctggactttttaaagtgtctacatttatattactttggggatcattttgtcaaagtcttgaataaagttacccagtcctggcatgataaacacaactatgtttttttttttttataataaccctctgttgttccaagtatgaatgccaatgaaactgtttaaacaaataagccctaatgaagtatacaggggttggattatatgtgtctccacatgttggtgcagaattcttttaaatgcttttaaaaatggggttctgaaaacagtttttcagttggttaatgtaaataataccattaaagctaggcaggttaaaaaaattttgaagaatgtagattaaataggcataaaaaagtttttgggggatggatagttgatggagcttttcttttacaactttacttttttttacttatttttttaaaaaagtaaggagtttacctcaattcgtagaagttac

SEQ ID NO: 129529 - DNA, 1003 bp, Homo sapiens
aggcctgggtgtggtggctcatgcctgtaatcccagcactttgggaggccaaagtgggaggatcgcttgagcccaggagtttgagaccagcctgggcaacatagtaagaccctgtctctacaaataaaaaaattcgcaggatgtggtggtgcacacctgtgatctcagctacttggaaggctgaggtaggaggatcatctgagcctgggaggtcgaagctgcagtgagtggtgaaagtttgaaaatcactgtcagagcccaaagccctggtcttgttattgtatagtcagcgtcagagacaactgtgaagttttcttcactctggatgcctaggtgttaatctgggattgaggacttctgcctctaaaaacaatgattccagctttggatataagatccagttgtttatgacccctacattcttggttttgctctttaaacaacttactggccattagcgttatcttctgcactaggagcatggggtcagcaagctactacctgagatcaaattaaacccctgcctgcactttactgggacacagccacactcatcagtttacatctcctctctggttgctttagtgctgcaacaggagaagtgattagttgtgacagagccttatggcctacagaacctaaagaatttatctggccctttacagaaaaaaagttcgctgcctcttgcactagaacattgaaagggaaaaagtagagattgttttacattttacctgttaaggcttgtctggtaaaaggctgatatacaaccacaaacaacagccagtaacattaagtgtgtttttattatttattatttaagacagagtctcgctctgtcgcccaggctgcagtgcagtggcaagatctcagccactgcaagctccgcctcccgggttcacaccattctcctgcctcagcctcttgagtagctgggactacaggagcccaccaccaagcctggctaattttttgtatttttagcagaaacagggtttcaccg

SEQ ID NO: 129530 - DNA, 1241 bp, Homo sapiens
ttaagattccattagttgtgtaatggtaggggcctggagcccaaaaccttggcgttactaggacagggcatgacccagctgacttggagtaaattttctgcctttaactacatttagattggaaattagggtaaaatgtttttgttgcaatctagtttcgagcatgtggtcctgtgattctgggtttgttttataacttatggactgagtaaaattacccagtttactgagagaattgagaactctgtgcaatggttgatctaatagaagcattttatttaaagcttccacccatccagttgctaatttatgttatttctcttttaaattatgtagattttgttgttgttgttgttgcagaaatggctccgtaaaatgattagttttgtgcgtgtgtgtgtgcgaacagttacacagttaagttcgttttcctgatagttttcttttgtctttagagagcgaaatgtcatcagtgcagtcacaacaggagcagttgtcccagtcagatccatctccgtcaccaaactcatgtagttcctttgagctaatagacatggatgctggcagcttgtatgaaccagtttctccccattggttttattgtaagataatagattctaaggagacatggattcctttcaactctgaggattcacagcagctggaagaggcatatagctctggtaggtgaaaattatgacttggaatagacaaagactctcccctcttcaaactataatataatggtccttatagtgagtgctatgaaaaccaaattttagatttttccagttacataatttcttacagcattttatatagaacttctgcactaatacctagccaatcaataatattcaagaatttggtctgtattttgaaaacagtatctattattatttctgcatagttacccaataatttttttttccttagagttgggggcctaattatattgtctaggctggtcttgaactcctaggttcaagcaatctttctgactgggcctcccaaagtgctgggattacaggcgtgttacaccctgtgcccagccccccagtaatatctttaatgttctagcttatgttttactttgttttataaagaatgtgtaaggctgggcacagtggctcacacctgtaatcccagcactttgggaggccaaggcgagcagatcacttgaggtcagagtttgagattagcctggccagcaatggtgaaaccccttctctactaaaaat

SEQ ID NO: 129531 - DNA, 1050 bp, Homo sapiens
ctgaggcaggagaattgctcaaacccgggaggcggaggttacagtgagccaagattgtgccactggactccagcctgggtgatagagtgagacttgtctcaaaaaaaaaaaaagaaaagaaaagaaaaaagtatgtatagagtggggtgcagaagaatgaactctctaacttgtcacttgtcttttcttcttttataaaacaagaatgattctatttatactgaatcatcatgatggttattaatttaccttatggttcctcaagcaaattcagaaaaatcacattatataatttttttaaggggcactgctatctttccccagaaaaagaacaaaactgggtagtatttttttcatatttcattaaaatcaggaatggttttgacggtttgtaaagtaggtagtgaaaaagatatgaattaaattccattttgtttggtgtttagtcaagtaggaacttttcattcatgtgtttcataacattatttagagtataactgagaattgtatgttgggagatttattttgaaatatgtacttcttttccccttttcaatccttgaaaggaaaaggttgtaatgggagagttgttcctactgatgggggcagatatgatgttcatttgggggagaggatgcggtatgctgtatactgggatgaactggcatcggaagtgagacgatgtacgtggttttacaagggggacaaagacaataagtatgttccctactcggagagcttcagccaagttttagaggtattcttttgactctttttttacttattctttctttctcttatttaataatcttttctttcctttgtaatttattttgtgaaatttccagaaagactttggttctgtctgcatcacattataaaacataataaagcatttctatttacaagcaagtttcaggataaagtagtcttattttcagattttttttttttttttgagacggagtctcgctctgttgcccaggctggagtgcagtggtgcgatcttggctcactgcaacctccacctccccggttcaagtgattctc

SEQ ID NO: 129532 - DNA, 1078 bp, Homo sapiens
ggaatctcccaacagagaaattattattttacacaatccaaaggtaaaacaaagcatttctcttgtcgggataaaaagttaattgcgctattagggagaactcaattggtttcttttgctaagcactctgtgtaggataacctttgtcaaattttatattgaattcacagttatgaaacttaaaaacttgtagccactactgttatttacccaactcagcttatacaaaataattttcttatggaaaattatgccactgtagaataagaaaatcactgacatattatgtgagcatgtcttccatgtagaaagggactattgacagatctgttagcctaatatattttcacggttctcatttcaagccatacgagttgtatatcaaaactccagttcagattttactgtgtggtttgaaagacatgattctacacttaaaactgcattgtatagagatgattgtattgcagaatatttttattgctctgatctgttctgtttaagcttatggtgcattaccagccagttgcagggtctgatgattggggttcaacacccacggagcagggtcgaccaagaactgtgaagagaggagttgagaacatctctgttgacattcattgtggtaatgttaatcgtttattttttcttacctttggatgtatttgtttactccttaaattgtgacctttttctgtggatttagattacctcaaggcttaaaaatcatctttaatcatatgggtttattccaagttgagattagcatcacttcgtctactaagaatcttaatagatgtaaaaatatcttttaaaacatatggtaggatgggtaaaatttggcaatactatccaggaagtcactaagtacagatgaactgatttagtcctaattccaagaagtgtgattccacctacttgactagaaatttatacctggtaataactccttgtccttgaagattttcaactaaggaaaactgtttttcagcaggacctgattatgcactgctatctaggtagggtcacttatggttttataatatatttaattggattataatattccttttttctt

SEQ ID NO: 129533 - DNA, 2153 bp, Homo sapiens
catggtggcacatgcctgcaattccagctatttgggaggctggggcaggagaatcgcttgaacctgggaggcagaggttacagtgagctgagatcgtgccactgccctccagcctgggcaatagagcgagagtctgtctcaaaaaaaaaaaaaaagaaaagtctctttaatttattttcttgattaccacttacctctctgtctacatctgttgttttcttgcagtttatttatggaagaaatgggtttgacttgagggttttttatactctgaattttgcttatcacattcctctggcttcattacacatgttcctttgtcctctttttgttttttcctataaatcgacaattgtttgttataaaatgtttaagcttgaaggcttaaaattggaagcagctattaagtgtatttaggtttcctgcttatattatttttccttttttcagagatctgcagcgaataaccctgcccagcattaaccgcctcaggcacttcaccaatgacacaattctggatgtcttcttctacaatagtcccacctactgtcagactattgtggacacagttgcttctgaaatgaaccgaatatacacactttttctacagaggaaccctgatttcaaagggggtgtatccattgctggtcatagtttaggtaacaaaatgagttctgtgtgaccagagaagactatcacattttaaagacacctgtttttgaagcacaatgtcttttatcagtatgaaattcagaggtctagaagtggtctgtggtcaggaaatttggaaggggttggaagggtggcggtaaattggaaagaaagactccttgctgtatagatttgcttacatatgtaattggcttatgccttttttgtataacagagagccatttagtgctaatgcttagaaattgtcccttcttctattttacttataggttcgcttatattgtttgatatcctaacaaatcagaaagattctttgggggatattgacagtgaaaaggtaatttagatgttcagctaggttttcttgtagttttccttagtaaggatttatagattttagacttattttttgtttttagctgagtttagtttcatgtcatgacattacatttacacttattttcattttaacagacttttaattatctctgtcattcttggatgatagaaggaagatagtaacatgcttctacaaataataattgttatattctaaaccatagttatcttattttcttttgtgaatatgcaccactggctgggcgcggtggctcatgcctgtaatctcagcactttgagaggctgagactggtggatcaccttaggtcaggagttcaagaccagcttggccaacatggtgaaaccccatctgtactaaaaatacaaaaattagctgggcatggtggtgtgtgcctgtaatcccagctacttgggaggctgaggcaagagaatcgcttgaacctgggaggtggaggttcagtgagctgagatcgtgccactgcactctagcctgggtgacagagtgagactccgtctcaaaaatatgcactgctgatctgttaatagagttatggaatcattgagctaaatgaagtttgcatatgaacaaatgaatgaattggctacaaattgatatgatttatagaaactctgttcgaaagtattggggacttgatgtttaaacattattttagtaaaaattcctataaccatgtatcatctgtaggattgatttggtacctatttctcctgttggaccatgagttcctccagagcagagcttttgtcttagactattttatttctatttctatttcttttttttctttctttttttttttttttttgagacagtctcttgctctgtcacccaggctggaatgcagtggcatgatctcggctcactgcaacctctgcctgcagggttcaaatgattctcctgcttcagcctccccagtagctgggacaggcgcatgccaccgtacccggctaatttttgtatctttagtagagacagggtgttggtcagactggtcttgaactcctgaccttgtgatccgcccacctcggcctcccaaagtgctgggattacagatgtgagccaccatgcccagcctagactgttttatttcttaagcact

SEQ ID NO: 129534 - DNA, 1020 bp, Homo sapiens
cctggctaatttttgtatttttaatagagacggtgtttcaccatattggccaggctggtctcaaactcctgaccttgtgatctgcccgccttggcctcccaaagtgctgggattacaggtgtgagccacccgcctggccgatctttggctctctttctagaaattaaacacattttcttttttacattcttttttttttcttttcctggaaatgaaatctcgctgtgttgcccggggtggagtatagtgggtggtctcggctcactgcaacctccaccttccaggttcaagcaattctcctgcttcatcctcttgagtagctgggattccaggtgtgcaccaccatgcccagctaactttttgtatttttagtagagacggggtttcactatgttggccaggctggtcttgaactcctgacctcagatgacccatgtgcctcagcctcccaaagtgctgcaccgctcctggcccttctttttttacatccttaaaagtattattagcttcagaagtcttctctcctctggaattctcctaccatttatttatttatttattttttgcttttttcttttcatgagagttttaccaatatctacttcacatcacataccataaaattcacccttttaaagtttacaatttaatggtttttagtatattcatagagttatgtaaccattaccactatccaatttcagcacatttccattgtcccttagggaaaccccatacccatttgctgtcactccccattgctccctgcccccagcctctgtcaaccactaatctactttctgtttctacagatttgcttattttggacattccatataaatggaatgtccttttgagccatgtgtctgacttctttcacttagcataatattctgaaggtttacctgtgttaacagtacttccacattcagtttttctggtcactgaatttctaactccatatcttattagttagtttttttctttttgagtcggagtgttgctctgtcgcccaggatg

SEQ ID NO: 129535 - DNA, 1753 bp, Homo sapiens
gatgtgaaattacaaagtctgtgtattcgactctggcattctctgtggttgccttccagttgtgactgcagctcttctcccactttcttccctagacggacattgagggatccttccccagaaaatccacctgtttgttgctgcaattttcctctcctcagctgcgtcatttcctgcatgttgcctgccacttactcaccactggggtctttggaagataatcttcctctttggaaatgaatggaaaagcaaaaggccctattacttttaaccactggcttcatataaacacttgccatttttttctgcatagctgggggtggtttgtgtctttaattctttgatgatagtttatagttgccacactttattgattagtacttgacagggtgtaaagcctattttgggtttgatttgttttgggtggggtagacatgtttttaaggaacttattgcttatctttagaaaatgttctagtttggaaacagattcttgagattcagaaggcattttggagtacacttatctcttgtttgtgttgaactgaaggctaagtctcagtggacatggaaaagacttttgggtgatttatttttgaacctgcatttctttcttatgtgtagtgtatgaagaaagactagaatgtagctttaaaaaagtgttgtttactctcttagaactgacagacttattgccagaaatcactgatgttcattgtttttgcaactgtttgagctgctgtaagagtctaaagttgacaagttagttcatgttaggtgcatctttataaagcaaagatgttgtatatcctaggcctcccttttatatttgatagaagttatttgctaatagcttctattcttacgttgaaaatagttgtaaaagctgatgaacctgaaattgtgtagcctctacaggctgctgaggttctaaataaaaccttttagtggtgcctttatggtgaaacagaatttgtcacctgccatttctacttgagctaaggtagtattgtgtatcctctttccttcttaggtatccataatccacaaagcatatttaaaaggctcttggcacgggcagcattggttgagcaggtaggtttggctagggggaaatgtttaacttgttctgaaagaaaaacttatgtctgtagggtccaagaaacagctattccagagtcagtgtcagctgagtctggaacatatgaagtgaggtttacttctaagaacacaagtgactgcacactaattttgtcaaggcatcttttcactactttgctgtagatttttcttcttcattggtcagtttgtcattgtctttgtagttctctttatgataatcctttatacttgctctcagattccacaggcctctgtttatagagtggcaaaggcaggcgagctgtggtttattgtttataaatttttttataaatgttatggtattcaaagccactgacatttaatatttactgaagccattccttagacagcagtggtctttatccctttctggaaagaaaaggaaaatgaagggtaattactgtcaccatggagattgtagaggtaaggttggggtataggtcaggcctggcctttctttgtcatctgcttatagtctagtgctaagtatgccactaagtttcagatatatggaatactttatttttttaaaggtatataaactctgagttattgagaattaagtattcactgtatattaaggggaagcttttgccaagttgtggtcttc

SEQ ID NO: 129536 - DNA, 1082 bp, Homo sapiens
ttcttctaccgctgcttccctgatgggctagcccattctgacttgatgtgtacaggggataaggacgtggtgaatgagggccgaaagagcttccccagtggacattcttcctgtatgaatatcatatggactctaccctatgcttgttttcacatcattgaatttaacctagaaagctagtagggatgggaaaatctgactactcttgtttctacaatttggaaaatccccccttctttagtaactccacagtttaacaagtctgagccttgactatttgggtaaatattacagaacagaaaggtagtttaccttcatgagatttgcacatttaattgttatattatttgcctagatcctgcaatcttgtactagcaataaaaatacctttaacgaagagtttctatgtgtcaggtactttgaagcattttcatttcttacctaattatagctcacaataatccaatgaggtggggactattgtatttatgagtcccatttatagatgaggaaactaaagcatcaacaagttgatacatatagctagtataccgaaaactatactcagataaaacattaactttggggcactaagtccttcatttttctttttgtttccctttccttcacaatgacttacactataagtatacacaaaaaaggattaaaacaccctcatggccgggtgtggtggctcatacctgtaatcccagcaattgggaggccaaggcatgcaggtcacttgaggccaggagttcaagaccaggctagccaacatggtgaaatcccaactctactaaaaataaaaaaattagctgggcatggtggcacacacatggagtcccagctactcgggaggctaaggcaggagaatcgcttgaacccgggtggtggaggttgcagtgagccgagatggtgccactgcactccagcctgggcgacagagcaagactgtctcaaaaaataaataaataaaaacatactcatgcttcctagcctcctatgtggggatgaatgaggtagcttcctttaaaagacaaaccacttaaaagtttttcttgttccagttgcatttgctggtc

SEQ ID NO: 129537 - DNA, 1050 bp, Homo sapiens
cctccctacgatcagttttattgtgttggtaaagacgccattcagagccagggcaaggctggcagctgcaaagcaaagccattagttgaaaggatctgtctaggaggaaaggtatggtcatggcctcgttatgagagcagccgtgctgtttctgagatggatagaatccaaccaggcctgggcacaaaaataattagggtcctcagtgatcactcttttgtagccgagaacttttgtactaggccaaagacatttctgaggtacaaataacccagtgcatttaggcacagggctgcctgccgtgtagcctgcgtaaccaagtccctgcagtgctattttcctctcccgcggggatagagttcctttaggaatgcagaactcagtggcctccacacaggctcaccgtggctgaatcccacaacgacctcctaggttcccagcacgaagaaaccggcccgaaagggctagcgctcacccaggcaggcttgtctgctgtctcttgtgtctgccttcttgagaaatttggccaggaagatcagagacagtggagagagaaatgcaataacctgaatcagaatgtcagaggttaaaaacaatccaaaaaaaagccacactcgtgctcctacaggaaagagggatgtgacacagcaggactcactggagctaacataaggtctctgagtgcgcgtaaccgggcgccaggcagcgccaccagtgaacagcagcgcccgtgcggctcgggccccggtacctcaggctgaggcacagagcgcccgggaaaacgttgtctcagcccaaagaggctcggacaccctcctctctcaatcaggatcttaaacactcgagccctaggaggcggaacccagcgcacagcagcggagtgggcagtgggtccctacaaaggccgtctcggggtggaaaacgcacaggtgcccgcgggaagccgggtcatggggagggaggaaagacgatctttctccacgcacaaacatcggcttggtggggaaatactccgcctccacgtaggggttccggtagagccacatctcc

SEQ ID NO: 129538 - DNA, 2711 bp, Homo sapiens
tacctagtaaccttatgaaggtagggagggtagatgctctaccacattccttcagctgtattgagtgttccatttgcttatcaatttagagctcttctatggaaagagggtgaaaatctgttttgtgcctcttttttttgtatgtaaatgtgcaattatactggattttctcttgtaaaaaacactacaattcttttactgaagctcctaaactgccatttgcctgactccagcaattaattctgcggtgactcattgggcttccagtacttctgttgattagatatggtcccaaaagaaagagcaaaatggaaaatgcgatccatgtcaccaaatataattgctacaagtaacatgaaatacagctcaccaaaacactaaactttgctcttgagcaattatatagtttgatgtccttttaaaaaataagaaaagctaggttttatcatactaaaattttattttgtatatgatgtttggttttttaaacttactaacataaggatttcctttaatattccaaatacagttcttgaaacagtatccaacatgaaatcttatctccttgcttttagacttagtgctatttactatctaaagacttttctatggtaagccagggtacatcctatatactacagataccttaggtttcagtatttttatgcagcttcttcattgtgtcacattttgttttcatatctgtaacagagctctgctgaaattaaaaaaaaattatgattaataggattgtttcaccatttcagaaatcagagtagaaaacaaaatagctgccaggtgcagtggctcacacctgtaatcccagcactttgggaggccgaggtgggcagatcatgaggtcaggagtttgagaccagcctgaccaacatggtgaaaccctgtctctgctaaaaatacaaaaaggagccgggcatggtggcacatacctgtagtcccagtttctcaggaggcagaggttgcagtgagccaagatcacatcactgcactccagcctgggtgacagagcgagactccatctcaaaaaaaaaaggtaaccatagttctgaagtctttggccatgaatgttctttaatggtctaaaaagcggttttagtcatgctggtgccaaggagttctcctcacacctccatagcgtcaatgttgacctatttgatatatttttaagttgcagattatagatgcagaaagagaaaattgtcctttatgtgtgcatgagtatacatgcactgtgcctgtgatacaccaatgaaatattccaaaagacattgctcactcatagtctgaagttggtatttgttaacttttaaatctatatgtggtcagagtgtaagtggctggtttttattcttgtccaacaatgaaataacttaaagcagcatgggctaatggtggtattttttttaaccacatgttaatttgttgaaggaagaagtgaacataagatttttgataatcagcctaaagcttcagaaactggatcagtaagagctaaagatgaaatcctgggaaactttctcaggcactgtgcaggggagggaggggctggaccgccactgctgcgagggaagaatcagaagagctgcctgtggctggctgagaagggcaaggtggatggctcttcattcctggaaggctgaagcagccagaggcagtgattcacctctttaatgtctaatcagggagagatacaggagtgaggtgggttttattttcatttttgttttaacaagttcccactcttatcttaattctcaaaaatgatctggcctcatctatagaactggctgagttggggaatcatttaaaatttgggattttctgtacaagtcaagaacatatgtgaaagctaaaaaagtaatggaggcagggggactgctcccagctcccttctgccatttacacaaaatatttgaaaacatgtctgtaaataacgttgtggaactgagatattgagtatctaatcatgtaaaggaccctcagatgggacaggctattggacaactttcctggttcatgaagtggaatttcctttttgagtagtttcttgcatggtgtattccaataggtcaaacccagacctactgtttgcaaacaggccatctgtagagaatacaatctctggactgcccaggacttgttgcttgtctttcatttcattttaaatacaaagctcttcctttagcattcaccttgaagtcaaggtgttggctgccacatgccatgtcctcttaacaagataagaaaacagtggctatggagccctcacagctgggaagctgacattctatacttccatatgagaaaaaggacattggaaagttgctttatttctgggcagcgtagactaaagttacttttcacaaggctgatgcatccagcctcccccagttgtccaagttggtgcagacatgaattgatgaatggaaacactttcctttggcctagggccacctagaattggtctctggttatttgtaaaacaaaaagtagaacttgcttccattttcagatggactagggaatactataattagacagctttgcaatgaattaacaaatactgaaaagttggaaatgtgtatatactgaaatctcaccaacttttacctggggtggggtaccaggagaaagggaaccccctttctcctggtaaagggtaaggggggggataatgtttaccacaggtacga

SEQ ID NO: 129539 - DNA, 1126 bp, Homo sapiens
caaacagataagcactggagaatatatcctacacagtagtccttccatcagacagctctccaagttttgtttctcatttttctttcttctttctggcctaagctctcatgtatcccctcctatactagttttgcttcctgcttggagcagaaaaggaaggctgacagcaaaacaacagagcagttatcagaactttgagatctctaatcagaaaataccattcctaaacctctggcccactaatcttctaaatagcattattccatggtctatttgtttctagaagcaaacttaaaaagcaactaaatcccactttatcctaattactttgacttgaaggtcatcaaataaaggagagaacttagtaaattacccaggcagcctcacatttcctgatctgtcagttgtcaaacaccagttggtagcaaaatgctgctgcctgtgatccttgactgagttggatgtttctgggagagacttaatttatgtaaaaggtacttttcttttctttctgaaggaccgtataattgatgccggcccaaaaggaaattattctcgcttcatgaaccacagttgtaatcccaactgtgaaacacaaaagtggacagtgaatggagatgttcgagtgggactatttgctctctgtgatattcctgcaggtaaaaaagtgactcgttccccatgctttcctccctaggaagaaagaatatcctatagagctaggacatggttcttcaaggcttgatgcccaagaacttatttaaataagaggaaggttatatttagaaaacgtattcaaataaaaggagagttatatttagaactgagtgttagctgccagtgagaggtaaaaatctataacctcaaaagggaatttagtgagaacttttatgtaagagcgggtctgacaggattctgtgtccgcagtcctgctgaacgaattctccaagttagctgctgtccatagagtgtaaccagatgttttagctgttgttttctttttaaaacatattaacagtaatgagcttgtgttaacagcagctggttccttagttgctgggatcttttgttgttgttttcactttgaaagatcattctgtttcaaattagacataaaagcctctga

SEQ ID NO: 129540 - DNA, 1055 bp, Homo sapiens
ttttatcaatagaaaagattaaatgttttaaagaccattggcttatgttcctaatgattttccacaatcagaaaacgtgatgcagtacttctttctcttcagctagggactaccaacagttctgtgatactaagagctatgagaagggctagtggaaatttgtggggtggggggtgggagggagaatggggagaatgggacagaaatctgataaaataagccaatacctttttgtttttcaagacatttattttcctctaaaatatattagtaagattggtaagtccttatagagaatattgacctagattgaatgagcagtgcttttgaggtgaaaaggttaatgattatgtaattataaacacaaaatgttgaatgtacaatatttgctcttattttaaaaggagcttatcactgtatgccttttagaacagcttaaataataaatagtggcaataccagatgcagacaggacgtggagaaagtggatctcatgaactgctggtgggaacataacgatggtatagcaactctggacaatagtttggcagtttccttaataaggaaacatacactcaccatatggtgcagcagacacactcctggccatttatccaggaaaatgaaaatctatgtccacacgaaaactttcaccagaatgttcatagcagctttatttgtaaagccaaaatctggaaacaatccaaatgttcttccatgggtgaatggctaaacaaatggcagaaacactactcagagatttaaaaagaacaacctgttgatatactcagcaccttgggtagatctcaagagaatctgcctgatttttttctttaaagccaatctcaaaaggttctgtactatatcattccattataaaacattcctttttttgtttttttggttttttgagacagagtcttgccttgctctgtcacccaggctggagggcagtggcgcgatctcggccctctgcagcctctacctcctgggtttcggcgattctccagcctcagcctcctgagtagctgggattacaggcatgtgccaccacg

SEQ ID NO: 129541 - DNA, 1047 bp, Homo sapiens
agattattctaggaatagtcttttttttttttttagacagggtctcactcttgcccaggctagaatgcagtggcatgatcacagctcactgcagccttgaactccagggctcaagtgatcctcttgcctcagcctcccgagtagctggggctacaggtgcccactatcatgcccagctaatttttgtactttttatagagatagggtttcaccatgttgcccaggctggtcttgaactcctgggttcaagcgatctgcccacctcagccttccaaagtgttgggattatagctctgagccaccaagcccagcctgagaatagtctttttaatcaagtgaagttcctttgcaacagaagagtagtaaagacttgccatgaaaagccttacaactgcttttgcaatgagttgccagcaagtttggctttctggtaagggtaaaatgaatttaaatctattacaaggcaaaaagctgctcttagggtcacttggagacttctgatcattgaagtagagcctcttccctgtggctacagcatgcacagagcatagtgttcagtgagttatatcctatttctttgttaccccatcctggtggtaaacagtaacttccagaaaataattctaaaaagaaaaatctcaggccagatgcaaagcattgggaaggcagcgtaaaactactatcccatcaattttcctttggtttttggtatttacatactttgtatcatcttattggcagcactggaagaagctgcaaaacgtttccaggaattgaaagcacaaagagaaagtaaagaagccctagagattgaaaaaaactcaagaaaaccccctccctacaaacacatcaaagtaagtctttatctctggcctgggattgccaaataaaataagaaacaaagtaagtctttactatgaaagcattgttatttaatagatgagacgaaatgcattactctttagtagttaaagaccctctttgacttgtgcaaacttttgctaattatcacagtcttctgtaaaacagagcttctgttggaagcat

SEQ ID NO: 129542 - DNA, 1061 bp, Homo sapiens
tagttaaccatggcactggattaaaatacaacgatgacttgctttctttcttacctctgaaggagaaaagaaagttgctacttacatgtttgaaaaacctctcaaatctactcagtcaaaagattttatgcttcaatttggtcatatgttaagagtttagcttctaaactgatacctcagtagcccatagtttaaaggagtaaagagtacatggatgcttttggtactactcagaagctctgagtttctggccactgaaaccctgaaaagtagctaaatacgttcacttgctattttaatccatcactgtagatatgactcagtccctttgttattttcccccaatttgaaacaaatttaatgtgctgaaaagataactttctcctttttctttctttttctctctcctcttttctcagttattaagactgtttatttgtttcaaggtggaagattgctctgctgtgaatcgtgcccagcttccttccacccggaatgcctaagcatagaaatgccagaaggctgctggaattgtaatgactgtaaagctggcaagaaactacattacaagcagattgtttgggtcaaattgggaaattacaggcaagtttttccaagaacaaagaggaagtattcaatcattgtgcagaccagtttcatactctggatacagagtgacttggagatagataggtagacagcatggacctacttccttaaaaaaaaaaaagaaaagaaccatgttttgaggctgggttcttaaggggttgggaaggttatgttcctaattcattattgaatttctttttctttttctttgggattggttggttgattgtttgtgaggcggtttggctctatcaccaaggctggagtgcagtggtatcgcagctcactgcaccctccacctgctggctgaagccatcctcccacctcagcccccaaagtagctgggattacaggttcacaccaccacccctggctagttttttgtatttttagtagagacaatgtttcgccatgttgcccacgctggtctcaaactcatgagtcaagcaatc

SEQ ID NO: 129543 - DNA, 1045 bp, Homo sapiens
ttgaaaaaattctttgtgttgcctgtttgatgtatctttgctctttgtcagacatctgaagtggcaactcatgactaaaagaaagtgagactaagcaagtcgattggaacatattagaagtattggagagagtactggcttttttgtctgttttctgcagtcagattatatcaccttattgataatactgcctacttccaaaacaaaaaaatgaacataggtttgacttactccataattattctgcctgagacattttaggaaatgctttattttcttgctggtacctatataaaattagattaattcaattgttgcttactttgttttcagtactcagtattaactttgacatgaattgaaattattttgagccctctgtttgcttaacttgaaccatatcttacttctcttgtatcctagttttcttgcatagcaccaaggtggaccattcacatttttttttatttcccttgtgtattttaagcatctttatcatgatgattttctctgatgattctggctctgtatttcctctgaaataagacttaaaattaagaactattccataatgttaaaaatggccagcctgacttttctaggtcagtactaataatcacatgtcctctaaagctgtttgcagacttttctccctgctggtcattcctttctgatggaaaaaaaaaatgaataatctcattttactttaaatttatagacaaattccctccctaagtgtagagcacttgggcatctgatctctaggttggtaaattgaatcaattaatctatactgagatgtagtcccagaaaaaaaatcttgatgattgaagtaaaagcttttaagcagaggaaatacagtgatttaattcatcatgggttgtatatggattttctttttgtttttatgttaatcagaagtttgaaaatttataggaagacaagattttctggaaaattggtagcaagccctcagaaggttggagcatgtgatttgataaagttgcatagagggctcttacccttttgcttatgagactttaaa

SEQ ID NO: 129544 - DNA, 2132 bp, Homo sapiens
tttttaaggagacataactgtaataaatccacacacagaaaggagcactttagtcatttctgtttgggtattagaaaacttagcttgttttgcttgtttcttgccttatacagaatttttccctccacatagattttctcttagttcttggttattgggtgtttaaaatcattaagctatttcttaaggactacaatgtctggaaatattttttgaaatgtttcagggtttgacatcactcctcttccacatgccacctaatcgtggagtcacaagaagtgtgcggacatttttcagtgtagtgcacattctttagcatctcctttcatcttagagggttgtgtaaaataagttacttaacattctatgcctttctttgtaatggtaattttaaatggataatgtaggctggagttttcttttcattttaacagtaaataatagcaatttattttgcatatgtaagtcaaactttactaaacattatctgaatgaattgccacagtttccctaagaagttatctctccatagtatacaggtgagaacactgaaacctagattaaataatttacctaatgacacacaagttgttaaatggagggactagtatttgtacttaatccttcttatttcaaagcccatattcctttacactactccatctccctctattaaatgtacaaagttcatttcaacattatataacttttttttttgagacagagttttgctcttgttgcccaggctggagtgcaatggtgcagtctcagctcactgcaacctctgccttctgggttcaagcgattctcctgcctcagcctcccaagtagctgggattacaggcatgtgccaccacgcctggctaattcttttgtatttttagtagagatggggtttttccatgttggtcaggctagtctcaaactcccgacctcagctgatccgcctgtctcggcctcccaaagtgctgggattacaggcgtgagccaccatgcccagcccatataacttttattagaagactctggctgagcaccatggctcatgcctgtaattccagcattttgagatgctgaggtgggaggattgcttgagcccaggaattcaagaccagcctgggcaacatagcaagacctcgtttctacaaaaaaatcaaaaacgtagccaggcatggggacaaatggctgtagtcctagctactcgggaggttgaggtggtaggatcactcgagcccaggaggttgaggctgcagtgagctgtgatctgccactggactccagcctgggtgacagagcgagaccctgtctcaaaaaaacaaaacaaaaagaagattgtcatattgttagtaatttcaagttccattctgttatttaggtcagagatatttcttgaattcgtctcagtgtagagtatgaagacaatgcccacagaaaaaagtaaatggtaatttccctccccttcaaaatgatctcttaaataaaactgctgccgtaatttgtattgtaaatcctacatcattatacactgatccagtaaccaagatagaggatagagaaatgtcccctggtctcacagttgcctaggtttaggagtggcttatagctacatcatgaattaactgggggaggggtaagggaaagaagagggaaccacaggtagctttagtgttttcctccaagtagcatagctgtaattggtagatcaaaaagattgtttttattaacgcttaagttggtaatccttttatattgtggcagggaaaaaatgaaaatgtttgcattacctcagtaaagttcaggaaattatggctcctttaaaatcatgtaccaggcctggcacagtggctcatgcctgtaatcccaacattttggaagaccaaggtgggaggattacttaaggctagaagttagagaccagcctgggcacaaaagctattatagaccccatctctacaaaaaaatttaaaaattagcctggtgtggtggcatgtatctgtagtcccagctactcgggaggctgaggccagaggatcgctagagcccagaaattcaaaggtgcaatgagccatgatcacaccactaccctccagtctgagtgacagagcaagactctgtctcaaaaaatatatata

SEQ ID NO: 129545 - DNA, 2371 bp, Homo sapiens
tctgcattctcggggagaagtctgcagcgatggtctccgtggagatcctcagcagaactgaacagcctctcggagggaacactgcttggcggagctccaagaaaagacatcgcgatcgctgcgagattaggaggcctgattgcgttgtgtttccaccattccacagggtcggcggaccggggagtgcagggctctgtcagattcagtgacagctccgtctccgcagcgattgaggaaactgtggactgagattcctgtacaatttcatcccagaaactccagacttgtagtctccatgcaagatttctttgtcggcggcttgataaacagtttctttgttttcgattttgatttcgccaatcatcattattggcattttcctgcctggtttcttcttcaagactctgaacaattgctttaacagtcaaatgatttttttttttcggtttgagctggatgggtacagcttaaatcatgggtccagcctaaaaaccaccatttaacttacactgatcaatttcaacatggactgtttttggttttttgtttttaaataaagcatcattaatgcacatctgcaggggtttgccaaacagcccaaactgtatacattacaatcattaaaagttcttattttttttaatattagtgccgttatcatggagaacagcatgacagctgtctttggcagtctgtcatttttctagcattttcagaaactcatcggaaatggcggtacctgtgtttcccttcgaaagcctctcagtacagcactcctgttcctctgttaaaactccttgttaatccagtgatcttttaggccaaggaaatattttgtgatggtgttctgggtccatacaccagcaatgaaggagatagatttgtgtacttgtgttttttaatcagcattaacatgggcaggcaccctcatttatagatgtcaggaaacattcagtgaaaaacttgtagaatgggatgtgataacgaggttccagtaatctgagcagtctaacgaggcccacctcctccaccacagaacgtggctatgttccaagtgctactctcactcagcctgttgcggatcttcatggcctcaggagacttgtttctccatgggctcttctggactgcacacttccaccatagcttgctgggttgatctagatgtctgtttgttgtatggaaattttgggggaaaaaatccaaaacacaaactgtgggttgaaatattaaccgtctccttggttccttggtattcaccgtgcctgatctgcacatttcatcgtggctgtttctgtatagcctatactgcattagcccaagagattgttgctttgtaactttttgcactattgttttggctggatttgtattacacacagttttaaaaaaaacaattccacactattctctgccttttttttcctatttatttcttcccgcacaaattccacatagaggccttcccatccagctctacgtgatttggctgcacttgaacactgattgtccatttacagccctcagcaatgtgccttctaaatggcatgacatatgtagatgtgctgcagcgcttgttaatggtcacaataaatgccacttcaccaaggaagtctcagatgaacaattatgaacatccaaattttattggggggcaataatcaactgaattgcaaaatttgggggaaaatggcactatccgtgtacgaatcgaatacaaatcaaagatttgtcacatccctaataaaaacaagatggagatgtctctgcaaccatatttgtaagctacacagtgtgttgggttttatgtcttccccctccaaattgaatggttctttgaattgctccaaatccatcagctatcctgcaattttcatagaattgatttttaggttggaacgtgggctctgttgactgaaaatagctttagagaggagaactgaattaaatgttttgatagagcggttgtaaattaaatcagtcactaccaggaaggtcagaagttctgaagttttgactcattatttcagtgttacaaagagagctatgctttttccacactaaagatgagtttgagaaaagaaaatattctcccacacacaaaaaaattaaaacaaaccttaagtactattttaggattaatttcagtgtgttgtattaaggtgccagcgagatttcagattcctgtaaacctctaaagaaaaggagtcgcgcctcaactgatgtagaaatgactagttcagcatacagagacacatctgactccgattctagaggactgagtgacctgcaggtaaatatgtgcaagggtctggacaaagtgttctttcttgaacataatgcttttcccttatttatttggggaaatcag

SEQ ID NO: 129546 - DNA, 2222 bp, Homo sapiens
tgggggggttgcattttgactgaagtgtattaaaccagtgtaatcaatgtagtaagatacatttaaatcaacttttcaaataaaattttagaagccattcttctttaaattaaactcacaatcagattttttcttaatttttttgttaaagaatatccattcttacagcctaaacacctgctagcaaacaaaacaaattctgaatagaattagttccaataagttttatattttttaaaccatttatatggaagaatgtgagcttttctatttaaaatatttccttcatgattttaaacttccaaatttaaaagctaactttgtgggtgctctgtggtatcaccaagcaagtgaaacagtttttccagaatatttaactaaaatttaaatagtatactaatttgtcattcatttatcatattaactttcatatttcatacttaggaaattatattccaaaaaatctttctaagctcttgaaaatctatagttattcattaccaaaatgaagttgtgattttgccagctggttcccaaaatcagtctgtgaccagtcagttttaaactaataagcagaatgagtataaaaagtgggacaaattgttaatgccactgtgttatagttagtagtagaacaataccagtgattgtttagaagattttatatttgtattactaattgtatcttataaaagcgtttctgttgtatgtttttttacctgttgtaaaaaaaataaaattttttttaaaaagcttagaacaatccttaaatatttacaaaatgtgtttcaacattcatatttcaccacatcttaaagaaacatgaaattcaatttatagcttaaacaggaactcctccaaacagcctcctttctctaattccaatggttcaatcctcaaattaccacgtgttttacatatacattggcagaataacttctgatctcgctctcctaatgtaggatcaagacactgttcataagacactcaagaaagtgcttttgcaatatcacaaacttattttcttaagtttgtactagcagcaaaagtattgagcttccagctgtatggagccctgtagcactctctacagagagggtcctgattcccagcaacttagctgtgagtgcaggcgcggaagggtcttaaagtggcgtgagttacattaacctgagtatcatagtaagtaaaaatttatcctaacgtctttggggcgggaggggtttttagcaacattggggccggttgcagaaacaacccctctcctgccttccagacactgaggaaagtattcttgttctcttcatataccaagggaatggtgggaaaagtctttgctagagagcatgtggctgtgtgttgtcacttgatattcagcacaggcagctaggatttaaaccctccctgatcttgagacagagaactttacccaaaagatgggactgagttcagatttcagatacattaatcactcatcattgcttagattgatgaaagtatcttttccctctgttaataattaaaagggaaaaaaattctttgttaatgctgtatttttctgtccaaacaggttgaaacagttcctcaggctacagtgaagactggattacagaaaggtgagttaatattataatgttgctttgcatttccttgattaaaaccaatttttaagaattatttgtacttcatgtatttttgtctgtctctgtaaatcgttgttgctcttcagtgtgaaattgcagtattccccagtgttcgtgtgtgtgtgtgacttttagagttgatcttattctgtacctccacgtgaaaagtcttacttgttttggtaaattggagaacacaacgtagacttgatactgtttccaacttttctccataagattctggggtttcactggcttataaactagggatgtgacgaatccactttttttggtattcgactgaataccgaatagtagctattcatgtttgtcaaacatggactatgacaaatcagacaagacaagctgattgaaaaaatcttgccacatttatttttacagtgctgtaaaatctttttgtaaattaaaatgattcatagcatttatggccactattagatgaccttatgcgaatctatttgagatatgcacaaagtttaagaaagcttaaacttatatctgtattttctgtgtgcaatttgactacagtacaaactccatagcatgattcgtgcgttt

SEQ ID NO: 129547 - DNA, 1045 bp, Homo sapiens
agagtataacagatcccttgatagtcaaattaatgattaggttttggtcacattttttgccttccctgcttttcctgcttttgttattaataacaacagcaaaacttacataagtgcaacaagcactgttaaccattttatgtatagaattaattaaactcatttgttaaaatgcagaatgtgtggcactgattgaattttgaaccaataatttctaacatcaggtggataataaagtttatttttatgcatccttcagtcccttcattccctaattatatttacctaaagatgtttatgtgcctttaaaactaatgtgtctgctgttttagtttgacttttcaatttttaaaaaaccaatccccctttatttgtataatttaggaccctttgtgaatcccagtctcagcttatcagcctttacaatttgatctgttaaataatttatatgctcctgaatgtttagcattttttaatgattttaattaaaattccaaaagtaatgggtaagaaaagcaaggaatgtggtcatatcttaattacatagatgtcaaggtatccttaagtgagtttttgtttgtgtgtttaaatcatttcttaggctcagtagaaaagaagcaacagagaagatcaattagaactcgttctgaatcagagaaatccactgaggttgtgccaaagaagaagatcaaaaaggagcaggttggcttcctacatgtagagagttaaaacattgtatttgtaaatgttgtggcttacattcctgtcttaaaagaaagagaaactttcccccacactgagtttcctttctggactatcttaacgcttctgtcctggtgggttccagtgctcagttttaatacagccatccctgtgattctgcttcaagcattttcacagaaaacaggtttcaggagatgggaagccagtggtgcaagacttaaaaaatccttcacatttatttagaagtttctgttatcagcagaatgatttcatgtttttatgatttttatttggaaccatcattgagttccttttttttttt

SEQ ID NO: 129548 - DNA, 1326 bp, Homo sapiens
gttacccaggatggtcttgaactctcgaactcaagggatgcacctgcctcggcctcccaaagtggtaggattacaggcgtgagccactgcgcccggcctctgtatcagtttttaaaaccagtgaaatactgatagtcattttaaattgcagagtgcttctatggctaatgcagtccttgtttcccttatgataccctacatttgcttataatttgcttacacttgctttttttaaagaccttaatctgactgaaaatatgacctcatatttcctaaagaaagcatatggacaagcgatcagatgttttatatgaacttaataagcatttgcgccaagccttctttgaacatttttatttcatcgttgactgctatggatagtaattttttacccagacaagtacttttcatcctggcaaattttgcaggatgcttttttttcctctacactccattcttgaatcggtaaatttactggggcatccttgtaaatttgatatgacatgtagcctgaaggttgctatataatatagaatcctaccttaggaatgttaataaaaattaagaaagacaattctaacttttctctactccttttctgggatttgaccaaagaatgatgtggagtagattgctgagattctagcatttgaaatgaacttgcttagtagccaaagaaaggtttgagcttggaacttacttctgggtgttaactttgtgaattgactcttgtcatgtgtagagttcctcattgtctgtgacaagtttgtacctgtttctttttcttttactttaaaccatctgtcttggtccttgttcactcttctgaagggaaaaagtatctctttatgtctggcaaggcacatttgtgataggatcagccatatctgtgattcttgtgctgcataaccaagaatctctcccagtatagaaggccatctggctcaaccatttttcgtcttgtcaatgtgacctgctgattaaaggttaggagacgggatgtgtcagcgaggcagaagtgaaaaaccagcattgttgggtgtctgctttagtgcaaggtcctgtgttcagtagttctcttatatattttcttatccaatcctcatagcagcaacacagtgaagtaggtacttttattatcccatattttaaataggtaaacagaatctcaaagaaatcttaatttcataacctctcctcctaaacactgccttatattacagggaaagcagttaaattcacctagtcatcatttacagaggttggaggaggcagtcttattatagttccttcatttatataagaagggtattggactagtcatct

SEQ ID NO: 129549 - DNA, 1023 bp, Homo sapiens
tatactttttttaatttaataaaactttgttttcacaacagtgtctttaaatgttttgaaataatagaatgagaattttaagtagcttttagaattaatcatattcttttagtggagtgaagacctactttaatggctataccctctttttaagccatctaaattaaattctgttctctaacaagtaacatattttaaaaatcttttaaattgtagaagtaatttggttttttttttacagaaaagacgaataataaaaaggtatagaatatcttccttcaccatttccctcatgtcattcccaaaagataattactggtatcaattttgtttacattgtaccaaatattttcaaggcatgtataaattacatatttttaaataaaaaattggaagatattggtagacatgcagattactgacatgaaataatactgtagttaccattcctctgcttagattttcttgttttggatatttctatagaataaatttctacaatgtgattgctagatggaagagtgtacatatcttgaattttgatagctacttccaaattgcctccctaaagggttttagaaacttctttctttccttttttttttttttgagatggagtcttgctctgtcaccaggctggagtgcagtggcatgatctcggctcactgcaacccccacctcccaggttcaagcaatcctcctgccccagcctcctgagtagcttggactacaggcgcacaccaccacacccagctaatttttagtgtttttagtagagacggggtttcaccatgttggccaggatggtctcaatttcttgatctcgtgatccacctgcctcagcctcccaaagtgctaggattacaggcgtgagccgccatgcccagcccatctagattatgtttaatacttagctcttgtaagtagcaatggtatgcatatcttcatacttatccatattttttacatctctcagtgcttttcaaatatacattcttagaagtagatttgcaaggtcagagt

SEQ ID NO: 129550 - DNA, 1072 bp, Homo sapiens
ctgttcctttccccccatttacttcttggtgtcaatttggggaaaaattgtaaaacgagaatctcccttgatgctgtcacccggagatctttatattctgtgatcaaatgtgagtcacattcagaagatgtttttaggggggctttgcgtgtatgtacatattaaattgatttcaaagacaggatccaaatacaggatcactgaaacattaagtgatcattcagttagaaattagtatatgaatatatttgatagctttctctttatacttcacagaatctatgcttaagcttgtctttatgtactgcgtttaaaacaaaatgaccctctagttttttaacattatgtatcttaaaaaaaatttttttaaataatgtttttgctgcataaattgccaaacatgctaggttttcaagaaccagcatagctggttcattactgtagactgtctgcatgtactccattcctgttactatggaaacacattgagtgtggatttatcataaaccttgagaaatattccttgcaacagttcatataaagaaacatctggatcccttgtttatcctggggtgaaggaagaccaccgtcttcctctgtgttgtgaaaatcatattatattccaccatttttttctagctgtaaaaattctcatgtacatctatcaagtatactttgttttatagtatgattgattatgtttactagaacaactttggaaaatagattgattttcatgctgattcagttaactacaactatgacaattgtattttgagagcttctacattctgaatttcagacctacattaataaggttttaaatatatatatacatatgagtttctttttttaatatattttggtctttggttgggttaacactccctctggaagtttatttgacttcattccagtctcttggaactttaaaccttcatgaaagttaagtctagaactaaagagaatctcagtgacatctaagtgagctaagttgttagtctcattttaccaaggatattacctgaggagactgtaactgcttttatattctgttactacctccatgcaa

SEQ ID NO: 129551 - DNA, 1801 bp, Homo sapiens
ccatttaaagtatacaatgcagtggcttttagtatgttgacggggttatataaccatcaccacaatcaattttagaacatttccagaaaggtttgaaccagtttaaacccagcaatattataaagttttgttttaaaaacagcatttattcataacatttaaagtagtacagtatacaggaacacaacagcttgtgtgatatatactttatatgcatttgagagagattttagaaagtccttcatgagaagatgatgctcctacgtcccattttaagaaaacctgacatattaagcttaagctgattaaacaaaatatgaggtatatttttttgaattataaaattattctcctgagcctgggcgacagagcgagactctgtctcaaaaaaaaaaaaaaaaaattctcctggacagtcagaatgtctttattgagagagtattgtgtatggtttaaaatttttttaaaaaattcaaatttgatttagaaacactttattttagaaaacatctgtggaaagtatgttttacctatacagttaactgtagcaaacttatcaccttatagaaaatatggttttcttttaagagaggtttgctttgttctaattgaccttccccccgaaagttgttcttttgttatgttcgcttaagccgtttaacaaaacattttttaaaaactgggtgggctggctgggcgtggtggctcacacctgtaatcccagcactttgggaggccgaggtgggtggatcacttgaggtcaggagtttgagaccagcctggtcaacatggtgaaaccccatgtctactaaaaatacaaaaattagccagtgttgtggtgcacgcgtgtagtcccagctactcaggaggctgaggcaggagagtcgcttgaacccagaaggcagaggttgcagtgagctgagatcgtgccactgcactccagcctgggcaacagagcgagactctgtctcaaaaacaaaaacaaaaacaaaaacaaaaaacaaaactgggagggcagtgaagtatagggcaagagtcaaggagatctgagttcctatccccacttcactttaccactgaagatcagtgttcttatctctaaaagtgcaaatgaaaattattcttggagttacagggattcaaattagaagtactagagtgtgcgtagaactgtaccagacacatagttgataatgaataacttttttaatagaagaaaaatagtgtacacaaaatgaactagtctttagtcacatgtttaatggaagaagaactgaactcaattggctaaactcactttcatagaagttaaaagttgaacatcaactaatacctgaagagaatctttgcctaggttatatgagtttttcttaattgttgagagaattcatgctggttcaagtttgaacatgaagttaactttccagtccaattttacttccactgttttattacaactcatgatggctaaagcttcactaaagcttggtgttctgattaaacaaacaggtgatgtgaaatttggatatatagtatgaaattctgaattttctaacttttattacttattttgaaaactacatgttgaatactaaaatactacatgttgaacctaaaatactaaagcgataaacaaaaaaaacaaaacccaaactggtctttatagaaaagataaacttagtaaattattatttagatataataaattgcttagtgccttaaaaactacatatcatctttggcatacattctcttttgccttttttgggggaatggaggatacaagctaaaagaaagtaaa

SEQ ID NO: 129552 - DNA, 1035 bp, Homo sapiens
agcgccgaggaccgtgctacccaggccgggctgccagccgcaggctcctctctggcagcagcggcggcgcggcgacccccgtccctcggcctccccttcccatcccacctcccgagccttcctcttcccgcagcacgcccggcccggcccggccgtggccctcctcagtgccggccgccatggcagaggcgtccggcgcggggaaaatctagcccggggatttcatgcggcctagctcggttccgcctcctcctcgcgcggccccagcggctgcccgcaccccagccccactccgggcctccgtgtctctcctgtgatcgcactgacacggccggggggttagaatggaacaaactgaaggtaaagtgcgtgtgcgtgtgtgtatgtgtgtgtgtgtgtgtgtgtgtgtgtgcgcgcgcgcgcgtgtgtagtgctaggaagggctgaggagggaacgacggggagggggcgacctagggatggagcgccagaccccaggaggaatggaaggggaagcgggtggcctgaaagggctcgaggggagtcctgacggaggagcagatggcaaggtggggggtgtggagggaattggggggtgggccaggggaggtggggagtgggatgggagtcggagtggcgctgagctgggaattgggaaagtgggatgggggcggggataaggatggatcggggaggggcagggaaaggggagaagagttgcatggagattacagacctgggtggactgataaatagggagatttggggatggagtgtaggaaccagaagagtctgggagaaggggataaatttgctggagaaatggggcattttatgggaatgaagggagaaatgaggaatggaagtgaaggaaaaggtggattaggaaaggggatgaggcaggctgcaataggagaatgggaaatagacgcaggaaactggaagacaggattgggctagggaaggaaattaactgaatgatgacagggatgagaacgatcgacttagcgtcagagtgggaggaagagaagggga

SEQ ID NO: 129553 - DNA, 1024 bp, Homo sapiens
tatgcttcctagcaaaatggtggctaatgaaagccatatgtgctagaagagtggctgcctcgcagattgcggctgcctcacagattgctgcagcctctgcaggcccaagatggaggtgtcggaagcagccaaatctttctgattgccagtctgtttctccaggaagcttcattatatccagaaagatcttactggggagtatatccatcccatctcataaggtactttgtttccagggtgctgatcctactggtggatcattcagaaagttaatcaggtgctcctaaaatggtttttggaacttccaagttcttactcagaattccaagccataggagacaggtatctaaggtgccaagctgattccattgtgcaaaaaatttcctctctgaagggacgtacacatgaaactaaaaaaacaacatgatggggggtgggctttatacaaagttgagtggggtgacaatggtacagaggaaatgggactttgcaattatatttttctaagtggtctgaacttggtctcactacccacatcacctggaatggttaccaggcctcaaaggactgccccacgggctaaacagctgatccgctctctgaagccagacagtcttatctgggaggtcctttacagatgccactgttgagggccggaagctgaagagagtgagctccatcctcaagtagtcctttatgctccttttgaactagccttgctgttctgggccgtcatttgtgatttggcctggagtgtctaggcgtaaaaaacaaggactgtaggcattagtcacagacgtgtaagttcttaaggagtgaatgctatttttgttttcttaatcaaaatagtgaccacaaagtcaaatctgagattataatttaccttggtaataaaagataaaggagatttacaaaaaacaaggtatgtgtgtgccttgggatgcttttctgggcttaccccatctgtgtcttcatagattctctgtcctgccagccatgtctttggtccacaggagccacttcc

SEQ ID NO: 129554 - DNA, 1665 bp, Homo sapiens
aagcccgaggagatgtcggaggccctgagccaggccttggggcaagagtgggcttgaggggcagggggctagactagagagtatccatctccaggagacgtccctgaccttacagtcctgccgcaggtacatgatgatgcgggactgctggcatgcagtgccctcacagagacccaccttcaagcagctggtggaagacctggaccgcatcgtggccttgacctccaaccaggtaaggctgcccgtgccagagccagagctcaggccgtccccactgcgtgcacgcacctccctgagcagggaggaggggcccggcccatcgctgcttcctctcgcccatcacaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggc

SEQ ID NO: 129555 - DNA, 1981 bp, Homo sapiens
catacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccctccttgctctagggtgaccccactcttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacaggtaataatactttgactcccaactttttgaaggcattccttgcttgctattctagtggtggaaggtgtgtatactaacaccttctgggcggtgaaggttcatgaaatgcctgcagaaacattcattccactttctgctcgcagttgggtgaaatacagagaggtggagatggggtgcctctcaaggtttgaacttcaccagccccaacttatgccactctctgtttcccccgaaagactggtcttaggcaaacccctgggagagggctgctttgggcaggtggtgttggcagaggctatcgggctggacaaggacaaacccaaccgtgtgaccaaagtggctgtgaagatgttgaagtgtaagtgatgcttctgtccttgcaaagaaaatcttgtcccattccaagcaaacagcaggcctcgggcccagcagaacagcttctctggtgcctttgctgcccacacctgctccgctgcctgcttggggttacctgggagtggagggggtgttctgcaccttgagattgttctatgacgtcactctgttccttggcgtcaacctgggctgtggtcaggtgtttatcctggatccatcgcttgcaggctttcctcaccacatccctgcccactcactaccacctattgcaacaacggctcccatgagagggaagagaaaacaagtttggatgaagtggggaggagagaatcaagtcccagggaaaagcagcccctcgacacataccccactcccttagcctttatcctgccctcctcccttcccaagtaaatgagtctcaacgtgttctttaaagcggacgcaacagagaaagacttgtcagacctgatctcagaaatggagatgatgaagatgatcgggaagcataagaatatcatcaacctgctgggggcctgcacgcaggatggtgggtgccggccagactggctttccctgcccagcggggagaagatctgagctggggtatcagtcccaaggcctctctcagccacagctagggaagggggttaagagaggctgctttggcagaggtttaaaatgtgttatctcgggatctgggctccgctcattggtgttcattcaggaatacagatacctagattcacacacgtggtgtgttaacagaggcagctgagtaattatggtctaagagcgctcaggctgggtgcagtggctcatgcctgtaatcccagcaatttgggaggccgaggcaggaagatcacttgagatcaggagttcgagaccagtctggtcaaaatggtgaaaccccatctctactaaaaaatacaaaagttagccaggcatggtcacgcatgcctataatcccagctactcaggaggctgacgcataag

SEQ ID NO: 129556 - DNA, 1836 bp, Homo sapiens
gcctccatggttggctggtgggttttaaaggggaaggttgggaggaggcctgtggaaggaggagggccgtccacacccgtggggcaaagcgtgttccatgaaaccagtgctgtgcgtgctgggatgaaagcctcccagcctctcgtgctgaagggaaaggtggaccgaactggcttagctgctgtggcaatggggtggggggtgagtcctaatcagaaggtgggagaagagaataacaaaatggaactccgccccctgccgccacatttccttaagttttaggagttggggcctatgagtagaatttgaaagaactaccaaaaaagcttatttttggaaattaagtcagctttgcctgtggtttggctaggaataaatatttacctgtgtgcccctacagagatgacacagacccaaagtgggacattgagcaaggcacaggctggttcccctcctgtcctctgtcctcattctgtgagtgccaccatcaccaggtactgtggcctgcagaaataaacgaggcaccaaccctgccctcagggaccccgtgtcttcttagggacagaggactcagaaacatctgtgtccccgcatgttaagtgcatgcacacagtgctgaggctttgcagagaagggccatggctccctgaggagaccaagaaaggcacatagaagtgacttctcagctggcccttgcaggatccctgggtgcctgtacctctccagtccagctgagcaaggaggctcaggaattaatgaagatggggcttgtgtagcacgatggttctaggccatcccttttccatggctcaagtccattgaaggcagcctccaaaatcagggggttgcctgatcctcctagtgccacaatcccagtcctagctagaacttgccatggttcttctccctaaaagttcccaggggacaggagacaggtgttgcttttctaatggagcgggacctcgcatggacggggccctccaagcctgctaacaccctgttcgcactgactcagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagtggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctacc

SEQ ID NO: 129557 - DNA, 1551 bp, Homo sapiens
tggtattgtgttggtgtctgtgggttccctctctgccttctgtgtgttccttggctttgtgtggatccatgtgaggactcacggggacacggttttgctgtgttacaaatggtacttcagactgaagttgtgagtgagtggtgattaagagaaggggccataggccaggcacagtggctcacgcctgtcatcccagcactttgggaggctgaggtgggaggatcgcttgaagccaggagtttgagaccagcctgggcaacatagcaagaccccatctctacaaattaaataaattagccaagtatggtggcgtgtgcctgtagtcccagctagtctgaaggctgaggcaggaggattgcctgagcttaggtcgaggctgcagtgagctatgtttatgccactgcaccccagcctgggttgacagaatggtaccccatctcttaaaaaagagagagaaggggttaggcattcccttgcatactcgcatctgctggctgtgtatgcacatgtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagtgctcagcccaggggtggggcttgctgcttgcaaagagcagcccaccctcctgtactgccatcctattgcctttgaagaagg

SEQ ID NO: 129558 - DNA, 1056 bp, Homo sapiens
gggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcc

SEQ ID NO: 129559 - DNA, 1090 bp, Homo sapiens
aacatggtgaaaccccatctctactaaaatgcaaaaataagccagccattgtggcatatgcctgtagtcccagctgctccagaggctgaagtgggaaaatggcttgaacctgggaggcagaagttgcagcaagccaagattgtgccactgcactccagactgggcaacaaagcaactctgtcttaaaaaaaaaaaagggtctttgtcatcccgtccagtggcatgatcatagctcaccgtagcctccaactcctgggctcaagcaatcctgtctcagcccactgagtagctgggactacaggcatgtgccaccaagtctggctagtttttaaatttttttgtagagacgaggtctcactatgttgcctaggctggtcttgaactcctgggctcaaatgagcctcctgcctcagcctccccaagtgctgggattgcaggcataagccactgcacccagcccctggacgttttggatggtggactttgagtagtttggggtaggaggactctggagtggcgctgacagtcctcaggaaggagtaagctttgccatgccagggaggatgcagccgtgctgaaagcatcccaactggggaggggggggggcgcggtggggagggacagcccctggtagagagaatggggctgggtggagagagtggaagccaattgcagggagtcttgaaggtgaggcagggatgtggattttactctgtacacagggtagattttgatcaggaaaataatgtcaagcacatgacagcttggaagcaggagtctgagctgcagccccagggaggccatttaaaagattatcccggctgggcgccatggctcatgccagcactttgggaggccgaggcaggcagatcacgaggtcaggagctttagaccagcctgaccaacattccccttctctactaaaaatacaaaaattagctgggcatggtggcgcatgcctgtaatcccagcaactcaggaggctgaggcaggagaatcacttgaacccgggaggcagaggttgcagtgagccgagatcgcagcacttcactccagcctgggcgaaagagcaaaactccatctcaaaaaa

SEQ ID NO: 129560 - DNA, 1037 bp, Homo sapiens
cccagtgaggtagtgaactccccattgtgagaggtagggaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggcggctcggcactaaattacagtgacgaggtgggacgcacaaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaatttaaaaaaaaaaaaaaagcccttctccaaatcccctgggtcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcgg

SEQ ID NO: 129561 - DNA, 1381 bp, Homo sapiens
ttagtctcatcgtgtgaaaccttaagagaatttctttacggtggagaaaaagtaactttatgaagcccattcctttctctactctggagaggctggtgacccagccccaccattgcaggaatgagacgggattgcggggatatggcaggcacttggggtgctgagagtccaggtgaactgtgagctcaagcacccatgtcgggcttgggggaccagaagacacatcctgaaacagctgaagcctctactaattcatcagcaagtttagggagcggcaacttttccctgcccagctgctggcgtttccttccccatacaatttctgctgagtttgggggaggggaggttgttcgagaggccccagctgggagaggtggggggagggcgatacattcttttccttaaggaacctgaccgaactttaaggtcagagctcagtggagagtgggagctgcagggttacctctttgccgttgattcatctctccaccctcccccactcttaatgatctttccattacagaacccagaccaggaagtgcatgacaggtcgcagctgcagacacatggctgggaggcctgggctccgggccagtggtgggagagtctgagctcccctccagcagtgggacccctgcacacacacacacacacacacacacacacacaccactttaacaacttggtggaagatgttctttcttatgcactgtcacaggtgatgacgagttggactttgctttgagtttaggatgtgatttatattataataaaggcaggagaagacactccccctgccccggtccaacctgagtgtttagatccccccaacttacagtccacctaagtggtccttaccagatcctgggagctttctattatcgtgcagatgccccaacttcttttcccaaaataggacccacccaatatggccttagaagcttcccagggtatccggggcagttgctagtcacagtcttaatgtctccgaaatagtatgttttcctctctatgtttctattaaaatgtcagccccaaaacatgtttctgggtggaggtctaggtgcaacagcacagcctttgcaaacacagatagacttgggttcaagtcataatagatgagttgagcctctcatttttcagtcttcattggggatggctctttccatttgcaagttgttcaggaaatgttaattgaccctaaactgtgtcctagggggcagttgtcacacaggagtttctgtcttcaccaccagctgtgtccttggcttccttccctgaatctgccaaggctggattctggtgctaaatgtgaaatggtgacacaaacttctaggaactgtgagcttggacggccctcctccatagccgcagggcatct

SEQ ID NO: 129562 - DNA, 1004 bp, Homo sapiens
caacagttcttgcctttccacttgccaaacaggtatctactgccttcatgtaaagcatttgtgccctgcaaactaggggctgtggggtgagggctccgtgtagctggtttcaggcactgagaaagatccaccctggcagagcttgaaactccacgccctctcctcgttcacatgctgtggcgtggctgagcctcccgggatgggttgtgtaaaaggtggggtgggggctgtgccatttgtgttcccaggccctggacatggagacacagggagcctgaagtgggtgagagggtcaaggagttccgcaaagagtagacttagtggttacgaggttgggcagagaaagaggtcagaaacagcaacacggaggtttctaggagttaaccaacagtgaacattgaattcagagcttagcccttcctcacttttctctaggatcaaaaactagcttctggctaatggtccattcattgactgattttttttcactcattcatttattcattcatctagtcaagcaagtctcttcctttttccgtaaatacaatgtatactttatacattgttttatcctagtcccttagctggaaatatctgttcctgtccttttcttccttttcactttttataattcctgctcaaatcttagtttaaggtttagcttgggtttagattaaagcttaacttaagggccacctcccttttgaagccttcccctatctccaaattaattaccccattttttctctttttcttttttctgtgttttttttttctcctgagacctagtctcgctctgttgcccaggctagagtgcagtggagtgatcatggctcactgcagcctcgacctcctgggatcaagcgatcctctggcctcagcctcctaaagtgttaggattacaggcatgagccaccatgcccttttgagatgtagtctcgcttagtcatccaggctggagtgcagtggcgcgatctcggctcactgcaacctctgcctcccag

SEQ ID NO: 129563 - DNA, 1044 bp, Homo sapiens
gctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggt

SEQ ID NO: 129564 - DNA, 1962 bp, Homo sapiens
ctccaaagcccacgctaccaggtacaacctcaaggctgcggcgtctcttcacctgccccctagcccccaaaccgctgctatgtctagggcctgacattccggcgccctctgggacgtgctcagatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgccccgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagagccgcggcgcccccggatctggggcgggcttggcgtcccgagcggcccccggcgccggagcctcccggctgcgcgctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcggcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgttt

SEQ ID NO: 129565 - DNA, 1036 bp, Homo sapiens
ttatttctgggaagaagccaggatgaattcgaaagcatcctgacaccccacccctttcttttctctagacttcaggttaactcctgcccttcggttttggtaaaactaccctgccaagccttatcttgtattttgctcctgtttttgttatcaaatgtgtaaaacagtcacgatgaatatacatgccaactgctttcagaggcaacggttagtctcttgcaagtttcaacgtgcacattttggagctgctgtctctgtgggaacctgcaggcacctcatggatgcaccacaactcggaaattacagtaccacctggaacaccttatccaggcaaggagatcattaagcctggtgtttgaggcaatcgattcacttggaagaaggtgctttggtggttttgagaggaacaatccctacatgaaatccctccatgggaaatggagaacatcagctatttcccattgccttcaaacctaaagatgtcgccaggcctcttggcttgttactgaagcagcgaaataagtcagaaatcaaagacttagaagttacgaaaagaaaatctcaaaaaggagaatggggtcaggcgcggtgtcaggcctggaatcctagcattttgggaggcagaggcgggaggatcgcttgtggccaagagttcaagaccagcctgggcaacatatcgagacgcctgtctgtattttaaataaataaatatggagaatgggaaacccatcaggctgtaatctcacagggaatttagtaccctttacctaagacaagacctgggcacttgggaagcctccccgagtgcggtttggggagggggagggcatcttaaattccagtcctcggtcactcttgtggctttgccaagggattttcaaatcccgggaatgccagggatggagatgaacaggctgaaatcccccacgctgccagggttagggaggggaaaacaacagtccacagcggccgcgaaggtttgtatttttttttttttggtaacaaggggcttgtgtgcagtccaatatcaccatcg

SEQ ID NO: 129566 - DNA, 1045 bp, Homo sapiens
tgaagaaggtcgcgtgatgacaggcccctggcagctgctgggaaatggtggtctctgccgggctgtcatccgcgtgattgcggaaggcaggtgacaccattcttagcctcgggcccagggagttccagcaggtagaggcctaccgagcaaagaggaatgcctagcatcggcctaactcgggggtgggaccagtattaattgttaaagcctctgggaaagggctcttgtgacaaaaggagtctgttggaaaagcgcatttttcaggtgtctgagggaaggatgacctcgaaaataaatggtgctggagaaaagctccagggaatggaggagctttcagagagacaggatgccagcctgagaaacccaaggagggcactgctcagagaccgcagttgcctcccgcaggtcagaccctgctgaggaccggttggttgtgaagttagacaaaagtgctggacttttagcctctgtgaatatgtagatttcaaagggtgtcggaaataccgttgaaagtggtaattcctcatttttcctccttggcagctcggattctgaaggtaattttgagactcctgaagctgaaaccccgatccgatcacctttcaaggagtcctgtgatccatcactcggattggcaggacctggggccaaaagccaaggtaaagaaaaacttgcatttttcctgcctgttttgtttcaaaagttttgaaaaatatcaatgaaggaaggaaaaaagtgtaaatttaggaccatttaagagagtttgactaagaaagagctgtttgaaacctcctggcttatgtatttttaggggtgtggtgatcgaggctttctcctctgagtagagtttgtgcatttgcagtataagattatcattatcaaacattcctactaggcctttctcctcagcccctaaaaaaatatgtatagtaatgaagtaggaagatcatgtttatatttgacttcacaaattcctcaggctaagttgctttctactggggtgtggctggagacaaaaattacaggtaagacttgacttaatttt

SEQ ID NO: 129567 - DNA, 1067 bp, Homo sapiens
tccatgctgtgcttacccagctgagaattcagcaataccctcaacttgccctaggctgcattttgccattgttctaggcagggacaacatgggaataggcaagcttatatactggagaatttgtgtgcgacgcatagctgtgtagcactctcagtgatgaagataacacttattcctcatagcttcccttttcttccgtaaagattggcagatcagaagggagattttgaagcttgaaagaactatttggtggcctttccatcaaatttaaataaagctcataagacacatgttaaggagctgtttgaaagcctttttgaattgccatcagcttgggcggcccttcctcatcgttttgtcagctgctagactgattcatcccgccagattctttgccaattgaatagaggcctggatgacctaggcccccaaaaccacagagacccaattgtttggtccttcctgtaccagtgactctcacatttttttcattctctctaaaaggaaaacttttaaatgtttatggatcatgaaggctctatggggtagttcatgaatgcagactgtaattgtaggggtagaggagtgtccagtccaggaaacaaccctgcatattatgaaggctttcagtttagggtctttaaacaataggatgattgctcatcaacctggtcgtaccctgacttccagggtccttgggtgcaacatccggagctagtccagagtaccgccaatggccttgtcacacatacacagcaaatgtgcaaagacagccagagcacaggtctgcctggagaggatttcagtgggcagaaagcccttcagagtcatttcatattgaagtttaatttctgggactggataagttccctttctcccaaaattattgattgttttgttcctggtaaagatagtctttcatacttttgtggttccaagacatggttggaccgcagttataaattatataagactaaatcattctggaagaatgatttacgaggagttagtcaggagttggagttgaaatatgtaaacattctggcttcctggtacataatggccct

SEQ ID NO: 129568 - DNA, 1014 bp, Homo sapiens
ggccagagcctttactgctagtagtggacctgggttttgaattcagcttttaagattgcagatccagagctctttggaacatattatacagcttttctctccaggaaatttgtgaatccctctctgttgttcactatctgaagagaagacatatcagaggaaataaagggtcttaaaatgttgccagagcagggtgtgtgatgggggaaagcatcgtcttaagtatcctgtcatgtgatagtagtttaaaaaatcaaaaaatacatcttccacatgtgtgaacttggcacatattattctgaagtatgaaatgtattttaggaagttgaaacatcagaagtttggaagcttgcagcatgatttagatataaattaatagtcaagcaaaaatcatcactggataagtgcagtgggattgaaaacattttgcttcctcaatgcctagcttcagctcatcagtgaaaaataaagaaggagtagacaaattcagtactagcctttgcattctgtctccacctgagtcatgcatggttgagaagaggcaggtgtgtggaggtgtgtgcggctgccaggggctctgcgcctgttttatggtagatagaggagtttttaagaggcctttgttggtgatctctggctgcataacaaattactccaaaactgaaaacaacgaacatctcacatagtctttgtagttgggaaatttgggagctgggtggtgtggctcaggtcacttttgagaatgctgtcaagatgtcggctgggactgcagttgtttaaagacttgactgaggctcaagaatcctctcctaaggcggcttactcatttgcctgggctgtgagtgctggctgttggtgggaggctgcagtcctcaccatgtggaccactgctgggttgcttgagtatcctcacagcatggcagctggctgccccagagtgagtgatccaagagcaagcaagatagaaactgcagagtcttctgtgacttagcctcaaaagtcacacttatttcc

SEQ ID NO: 129569 - DNA, 1070 bp, Homo sapiens
aataccagaggtttccttttcagattgttgtcttttttctgaatccttagcttaatcagctaagctcttttcccttgaccctagagacttttttatgtttaaaaaaaatagaccagtcacggtggctcacacctgtaatcccagcactttgggaggccgaggcaggtggatcacttgaggtccagagtttgagaccagtctgaccaacatggtgaaacctgtctctactaaaaatgcaaaaattagctgggcgtggtggtgcacacctgtagtcccagccacccgggaggctgagacatgagaattgcttgaacccaggaggcagaggttgcagtgagccgagatcacgccgctgctctccagcctgggtgacagcaagactccatctcaaaaaaaaaaaaagaatggcatgagatagacaggtagagatttgatggttttcagaaatcctggctggactgttaggagtcgtgttatagacaattcaaatgtcactgctggccaccgtcttcatactctatggataaaacagaaattccagtcctgtaacttacctctgtagcgtcaataacgtgggaaatgatccaaaagggtcttgtagaaagaagactttttacataaacagaaagctgtgatttttgtgggaaacaaacctaccactaaaattgatgagaattcttgtctccatgtgtaatttctggctcatcagccaggaggtaaaatttcaataagaatcaagaatattttaaatgatcagttaaaactgagtaaattagttggtttagtcaatcccccatctctcctgggaaattatctgacttttgcaaggtccttggtgttttcagtgtaattacctaaggtcctattccatatcaagtttcagtttaactttgctacaggattactttatcacaaaacttgagtagatgataatacaatcatacatcacttagccacagggtaagccacagggaaatgcatccttaggtgattttgttgtgtgaacatcgtcaagtgaacttactcaaacctaggtggtgaaacctactacacacctaggctatatggta

SEQ ID NO: 129570 - DNA, 1526 bp, Homo sapiens
tgcaggatgaaatatgggagtatgagaagcactgtgtttgtacttgtcactgtagatcagttggggaaatgcttctcagcattgctatgacttaaagaaaaactccagatatcatggtgacttacagcagaaaggaagacgcccagaggtttaaagagcagaaggatcaacttcagtaccaagaaagtagagagatataggaaccagttcctcagcagccccggaatggctaaggggagtgaaatgtcattagtagctctcgatctgttctttgattatatataagcagttaaatggttgttggaaaatattattgattgggtgccctcttttgtggcttttaaggttggttactcctctctagacagcacttagggtatgtactgggcacgtcactgcctaggtacttcctcccctaaatgtgggatgcttctgcatactgaagttgataaggagtcatttgtgagtctttgagttgcatgcaaccaatgcattaaataagatgaaatctgggccaaagaaagggtaatttattctacactttatattcggcagcaagaagcaccgtctctcgagtcctgccaccctcacccagtagcctttttcccctattctgtttttgttgaatgaacttcttgatctaatacacttaatagggctttttttaaggccttatgcaatcaaaaatcttgtcgtcttgttctttttagaagaaaggagtgctagacctcttggaagtttatttttcatctgtaaatttgaatttgtggcatttctgagtgtttctaccagtctcctttgtagttgaggtctgttcatcattcactcactggtgataacattcatgaatacgacatttttaatttgtatctcacctcatagaaagaattgtgcagcttttacatctgccagactagagttgaatattccagtctttacatgatttttttctccatctgtctgtctctttcctgtctctaattttgttggtgcatcaggactactgaacaagtgaaatttctctgttttctgttgtaagtactcctgctgtttctttagtccctgggaccgttggcagtttcctctctcccctcccccagccatctctccatagcatgtttgcttctaattctgagtttgatcttctgatgatttttttgcatttcatcagtcacttcatgagtcagcttagccttgcagttgtccatacctaagggagtggggcttggcctttacaccttaggtgctagagcttgcactccctggcttggcaggtgtcacgtggcgctttgacaataccaaaagctggcttggccccaagatcatcacagcagtggtttgagggactgttctgctatttaatattggaaatcattggcttttttggtagcataaagctactggcttggaacagttaataaattttactgagtcagctcaacttgagtttggtggcagagggtagcactcagtaagaagattagggaaagaagatcatgaactagtgattatgcacattccggtaa

SEQ ID NO: 129571 - DNA, 1004 bp, Homo sapiens
gttcatttaaatttacatatggtatcaaatcactaaggtaactagatagcattaagtaaattcaatatttagaatattccagatattacattctttgcaattatttaaacttatgccaaaaagtttttagatgtcacttgaaaatgcaatgggggacatagattttcaaaaaaaaattaggtatatgagcaaaaaaattgaaaaccattgtcttaaaccactgaaactgcttgcttataaacttaacctagagaagatcattttttaaaacctcagactcaagttacagaaactaggttctataaaacagcatctcacaattgaaagactccaacttcctccttgctttgtacccaggtctgtggttaacctctcacatatctgtatggagttgtgtctactttgttccattcatgggatgtcacttttccccattgcttgccctcctaaagggtagcatcttctctgttgtgtttctcaggatgaaggggcagtgatctcccagatttcagacatttctaatagggatggccatgctactgatgaggagaaactggcatccacgtcatgtggtcagaaatcagctggtgccgaggtgaaaggtgagccagaggaagacctggagtactttgaatgttccaatgttcctgtgtctaccataaatcatgcgttttcatcctcagaagcaggtatggaagcatatcttcatctttctaatgtacataagcatggaaatgcctgaaagcctaataaagcaggaggagccttacagagattaaagaattgggtcacttgaaggatagatttaggatgctgacctatgctttgcttctttacctggaaaagggacacaaagtgcttattgaagtactaggaacgtagagatacttgtgacaagttgtataggagatgctgatgtatgtgagactgcttgaatttctttataattttatgtgaatatggccatatcttaaagtatagtggtgtgttagttcatttgcgtt

SEQ ID NO: 129572 - DNA, 1030 bp, Homo sapiens
tcatgaaaagaaaagtttgccagtgttttgctctggaacctgagcttatgaaagaagctcctcagagcttctgagccagcacctcagagggcgaagtgctgccagaagggagtggaaaacttagtagcaaggaagaaccaacacacaggcatggtccttgacttatgtatggccattttgcatatgggcaacaatggcacacacccagcaggctgggttacagcaggaggtcgctgcggagcagcggaagttcaggatgatcctgaatcatccgggtgaaagggtgggggtgagagttcagagttcaaatatatttgctatttctgccttcttaggcctgaaagttagtattttagaaacatttccatctgcagtggctaaagatacatacaaagcatcaatatgtaacaggagcagctgtcacttgtttttgtttttgcttttttaaaaaagaaattcccatttacatggagcttatccccagaaacttaatcatgggtgtgtttctcttttatccatgtggttctttggtgactgaccgctattataagtacactttctcccttttagatcagaataaaattctctaggttatctgctcaacagaagctaagaccactctgatagtcattataacagtttttctttagttacttccataattagatttgttttttaaaaagcttccccccgctgacttttctttaaacatggttttaaaggatgtgatcaatttagtaatgaggaagttgttgaaggatgtctggggttaagaagctgaaagctgacagattcagtgtaatccctttccccacaggggctgctggagtcctctgcagagaaggcccctgtgtcggtgtcctgtggaggtgagagccccctggatgggatctgcctcagcgaatcagacaagacagccgtgctcaccttaataagagaagaggtaaaagctctcctgtttagtctgcttatcactccatttctttgtaaggcccatgtaccagcaggtagattgcatctctgctggctc

SEQ ID NO: 129573 - DNA, 1024 bp, Homo sapiens
tgaaatacttttggaattaggacacaaaataaaacttgtcactgaatcagaggtagagtgtctgaaagggtggattgactcaggaaagtctaaagtcagatcgcatctgttaggaagagcccagaagaatatctttaacttagtttgtaaaagattgactcatctaagcagaatgaatctatttccttgcagtattcaaataggtgcaaagagaaagggaaggcagttggttctataagtaaaatataagtttgactaaagataaaatcttaacaaaaacctttttagaaccttaagaaaccttatataatgtaaaaaaaaaaaaaaaaaaaagataacgagagccccaaagcagataaatggattacatacattgtcagtgtatgttaatgtgtttaattgtttgggacagcatttctccaactttcattgtctgaaaatcctcctctggtaataagttctttttttctcatttaggaaaattgtagctgaatatgaaaagactattgctcaaatgattggtaaggagaacattttgttttttgagggtatgagccataggatctgtcttagtctgttcagcctggtataacaaaatatgtaagctaggtagcttataaacaacaaacatttttcatagctctggagacaggagagttcaaggtgcccacagatgagatgtctggggagggcccattcctcatagaaggggctggctagctctctggggtctcttttataaggacactaatcctgacataatcacctcccaaattcccttccatgcccactttcaccctgaacatactcacacactggggattaggtttcaatacacaaatttggggttggggggtggcataaactataagaccatagccggatccatttatgattttcagaccatgtcacaaacttgtatttgtctgtcacttagatacagtcgtctcattattcgtgggaggtatgttctgtaaagttgctgcaaacactgagttagtgaatactaaacactgctcctggc

SEQ ID NO: 129574 - DNA, 1226 bp, Homo sapiens
ctttacaaaacaacagggattgatcctcctgcatggaatttagagtctcttctcatctatatcataaggattgactccctaaaccagagtctgtcctttctccactaaattgccgaaatgatactttctatcatccacatcacctaatgccttcccagctcagggccttaccacagctgttcttctctatggaatattctcccaggtagctgtatggctcacatcctcatttctgtccggtctatgctcagatctctccctgagagcaggtactctctgtacagtaacagccccctccccgcccccattcctccttaccctgccttgttctttccccatcacttgttaccacgcgtctcccccaactagagtataagccataagagcgggaatttggtcacatccccggctgtgtccctaccacgagaacactgcttgtcttctaaggagtgtctattttttgaataaatatgtcattccttttgacttgtgattcccagaagatgaacaaaggacaagtatgacctctcagaagagcttccagcaactgaccatggagaaggaacaggccctggctgaccttaactctgtggaaaggtccctttctgatctcttcaggagatatgagaacctgaaaggtgttctggaagggttcaagaaggtagagtgttttttccctctgtctcctggtgtatttccagtagtgtatttccttggtaactggtcatcaaatacatatgccagaggttgtgggtatccttttaaataggagctcagggcctactggccttgtatcctctattccagtgaagctggatttttttccacatttttccttctttggttgttcaggcatctggcccactgggtgccatgtcttggccattcctctcctgtgtcaagccaataagccccaggctgtggcgtagactgcaagaactgttaattgaaccctcagacctcaggtgaattctagaaatgttctttctggtaattcaccttttcagttttagtaaaagggattagaaggaattccatgtctctgaaaaattcaagctgcatattctagaagacattagtataatgtttcaaatttagatgtaaatgggcctgttgatttaatttaactttaccatatcaaccagacacaattatagcaatgaaatggctttattttcatattaaaataaaaatgaaactggccagtttatcaaatatggaaatcg

SEQ ID NO: 129575 - DNA, 1025 bp, Homo sapiens
cccctagaacggtgctccctgggagattcagactccagcatccctagatatgctaatggattgagtgagacccagatacttatgtttttgacaagtaccccagataattcctctgataacaagaaaattggggaactaagagattcatggacaagtttcagagggctggtgactgtcctcaccctttactcaatttaagcatgattttatgagtacattttttgaggtgtgtagcctttttttctttaaagcatctctgatgtagaaaagttaaaaatcactgaattaggatgtctagggtagggtagatccagacttgggactagttaactctatttgcctttatttcagaatacaaagtggcctgcataattatgtcatttgtctttcagaaccaagaaattgaagaactgacaaaaatctgtgatgagctgattgcaaagctgggaaagactgactgagacactccccctgttagctcaacagatctgcatttggctgcttctcttgtgaccacaattatcttgccttatccaggaataattgcccctttgcagagaaaaaaaaaaacttaaaaaaagcacatgcctactgctgcctgtcccgctttgctgccaatgcaacagccctggaagaaaccctagagggttgcatagtctagaaaggagtgtgacctgacagtgctggagcctcctagtttccccctatgaaggttcccttaggctgctgagtttgggtttgtgatttatctttagtttgttttaaagtcatctttactttcccaaatgtgttaaatttgtaactcctctttggggtcttctccaccacctgtctgatttttttgtgatctgtttaatcttttaattttttagtatcagtggttttatttaaggagacagtttggcctattgttacttccaatttataatcaagaaggggctctggatccccttttaaattacacacactctcacacacatacatgtatgtttatagatgctgctgctcttttccctgaagcatag

SEQ ID NO: 129576 - DNA, 1781 bp, Homo sapiens
aggtaattgtagcacattaccaattataaggtgaagaaatgtttttttcccaagtgtgatgcattgttcttcagatgttgaaaagaaagcaaaaaataccttctaacttaagacagaatttttaacaaaatgagcagtaaaagtcacatgaaccactccaaaaatcagtgcattttgcatatttttaaacaaagacagcttgttgaatactgagaagaggagtgcaaggagaaggtctgtactaacaaagccaaattcctcaagctcttactggactcagttcagagtggtgggccattaaccccaacatggaatttttccatataaatctcaatgaattccctttcatttgaataggcaaacccaaatccatgcaagtgttttaaagcactgtcctgtcttaatcttacatgctgaaagtcttcatggtgatatgcactatattcagtatacgtatgttttcctacttctcttgtaaaactgttgcatgatccaacttcagcaatgaattgtgcctagtggagaacctctatagatcttaaaaaatgaattattctttagcagtgtattactcacatgggtgcaatctttagccccagggaggtcaataatgtcttttaaagccagaagtcacattttaccaatatgcatttatcataattggtgcttaggctgtatattcaagcctgttgtcttaacattttgtataaaaaagaacaacagaaattatctgtcatttgagaagtggcttgacaatcatttgagctttgaaagcagtcactgtggtgtaatatgaatgctgtcctagtggtcatagtaccaagggcacgtgtctccccttggtataactgatttcctttttagtcctctactgctaaataagttaattttgcattttgcagaaagaaacattgattgctaaatctttttgctgctgtgttttggtgttttcatgtttacttgttttatattgatctgttttaagtatgagaggcttatagtgccctccattgtaaatccatagtcatctttttaagcttattgtgtttaagaaagtagctatgtgttaaacagaggtgatggcagcccttccctagcacactggtggaagagaccccttaagaacctgaccccagtgaatgaagctgatgcacagggagcaccaaaggaccttcgttaagtgataattgtcctggcctctcagccatgaccgttatgaggaaatatcccccattcgaacttaacagatgcctcctctccaaagagaattaaaatcgtagcttgtacagatcaagagaatatactgggcagaatgaagtatgtttgtttatttttctttaaaaataaaggattttggaactctggagagtaagaatatagtatagagtttgcctcaacacatgtgagggccaaataacctgctagctaggcagtaataaactctgttacagaagagaaaaagggccgggcacagtggcttattcctgtaatcccaacactgtggaaggccgaggcaggaggatcacttgagtccaggagtttgaaacctacctaggcaacatggtgaaaccttgtctctaccaaaataaaaattagctgggcatggtggcacgtgcctgtggtcccagctacttgggaggctgaggtgggagcctgggaggtcaaggctgcagtgagccatgatcatgccactgcactccatcctgggtgacagcaagatcttgtctcaaaaaaaaaaaaaaaaaaaaaaaaaccaggagtgaaaaaggaaagtagaaggc

SEQ ID NO: 129577 - DNA, 1034 bp, Homo sapiens
aggatagctcaagttgaattttctttccagccagttaccctttcaacctacccatactttgtacaactcttacacaaatacttagatatttattagatagccctgaattcactctaattataaacagggagtgtaaactgcccccagatgttcctgggctgggtaaaagcagctggagtgaagcactcattttccataaaggtaacaaagggcagctcagtggttactcaagctcaaaagggtttttttaagagcaagcattggttaagtctgtgtatactgagttggaagtgatttcagcacattcttttttagtggagtgaaagttctgaagcccccttttaacttcctcttggtttttcattataattggtagccatctcatgaactgtctctgactgttgtctctttgtggtcatgtgattgtgagcttgctttctgacttgcatttctgactttatcctgttgttaggaagatagaaactaggttttgaaagattacatgattcaagcgagggattttaaagtaaagatgtatttattctgaagaatctaaaagataacagattatttgcttatgaaagaacaatatagtctgggaatcccagaatgtcaagccaaaggtctaagaagtcatctccttcaaatactttaataaagaagtatttcgaggagatatctgtccaaaaaggtttgactggcctccagattccagttatttttaaaaagcaacttaccactaaatccttgagtctccatagagtaacagtaaagaaactgatgtaacagactctcctctcaaaggatctcctctggaagagactatcagcggcagcattctccagggaagacccatcccctagtgccagagcttgcatcctggagactaaagattgcacttttttgtagttttttgtccaaatgcaatcccatttctgtgcctcttagcatgcagttagatttggacaaacaagattcctaaggaatgactttattaactataatatggttacagctattatataaatatatat

SEQ ID NO: 129578 - DNA, 1050 bp, Homo sapiens
gagaagagaagggcctctgagttgctagccaaagttctgggagcctttcttaggtttgattattgattccaattgcatatctaatttcagaaaccctgggagtatggtttcctagccctcagcatatcagaaatctcaggagaatggaagaaccactggagaagtgggtgagagggtgtggaggagtgcatgggttttgttttgttttgttttgtttttttgagacggagtctcactgtgtcacccaggctggagtacaatggcgtgatctcagctcactgcaacctatgcctcctgggttcaaacgattttcctgcctcagcttcctgaatagctgggactacaggcgtgcgccaccacaccaggctaatttttgtatttttagtaaagacggggtttcaccatgttggtcaggctggtcttgaactcctgacctcgtgatccgcctgccttggcctctcaaagtgctgggattacaggcgtgagccaccacaccagccaagtgcatggttttatccagttcattcctatgctcatacatgggattgctgaaaagttaactagcattcccacaggttacatgtgctcaagacaatcttcatcattcctggggatgatcttggagtaagatgtggttgaactgtgatcagtgcctttgttttaggtggaaagtgctacgtggttttgctagtaggaggggtggcctggtggggggatggcagtggagctcacccctgcggtgataagagcagccttaatgattctctcatgcccttttatattcttaagatattacatcatgtgcattatgtatctttttcttaataaaaaatgtttttaattaatgttcataagactttacaaataaaaagcctggaaaaagtgtacaaattaaaaatactgtaccacattgagaaaaaaccacaatgagatatacctacacacataccagcatggctaaaatgaaaaagggtgacaggccaggtgcagtggctcacgcctgtaatctcagcactttgagaagctgaggcaagcagatcaccggagtcc

SEQ ID NO: 129579 - DNA, 1054 bp, Homo sapiens
catgttgggctgagggaaggtcatcatcagtgcactcggggagatgctcatacttcactggagccccatttactgctacacttgtccctggccaggacctggccccagttagatgacaaatcctgcactaatgtccactctcttattcctggatctcccagggcttcctcagagggacccccacccccaccctcctctcatgtcaccttgaagcaggcgtcaagtgagtctgtgccctgctatgttttgccatccctttctctctttttggggggacacttttttattgtgataaagtatacatgacataaattttaccattttaaagtgtatatgtagtggcattcggtaaattcacaatgttgtacaactctcaccactgtctagttccaaccgattttcatggcttctaaagttgacgccatacctattaagcagtcacctcccattcttctcttctcccagcccctggtcaccactaacttgctttccatccagtctacagatttgcctatttttgatacttcatataagtggaatcatatatatgtggccttctgtgtctagctgctgttgctgcttttttttttttttttttttttgagacagagtctcactctattgcccaagctagagtgcagcagcatgatcttggctcactgcaacctccgcctcccaggttcaagcgattctcctgcctcagcctcccgagtagctaggattacaggcctgcgccaccacacccggctaatttttgtatttttagtagagacagagtctcaccacgttggccaggctggtatcgaactcctgacctcaagtgatccatccgcctccgcctcccaaagtgctgggattacaggcgtgagccaccgcacctggctgtgtctagcttcttatgtttacttttgccatcacttcattgacacattttgaaagtacagtattgctgttgcctaattttatactttaattttggtcagtgcaataaacagccctgatgtctgagaatgtgactgtacctgtggggaaaggaatgtcaaaaaaggacgtt

SEQ ID NO: 129580 - DNA, 1082 bp, Homo sapiens
atttttaaatgcatgataccatattgttgactgtaggcacgatgtaatacagccagtctccctactctagaacttcttcatcttgcatgcaatcaaataattcttgaacagaaacaaatgctggcttgattttccttaaaatgttactacaatattatggcactagcgcttgtattttgatttcacattggttcccgtcatgatagaggagatgaaattccttagggccgccctactctagtacagcaatctgcagactaactatgttttagttgcagagaattgcttacatcccccactttctaaagtccacttggctaagtaattgcaagaccaaattatatggccctgaacaaagagtaaacagaagcgtgaaacacaatattgcactagattgctggtcttgtcaaatttactctgtcaaatgtgttttttcctctttttccaaaaaatacgtagttgcttttactttccaaaggccacgatatgactcatggatcatcaaataaccaaaaagattgcatggctcttagtactcctggggtgccaatgaaagccctttgcttttatttaatttttttaaataaactgaaagcagttctttccattgatggggtgaagagcgttagcagtgttggtaagaagatggatatttggtgcattttagtagaaagcatacaaagttatgggaggaggttataataacacataatgtataatggacaatactgttgtcttaaaggctacatgaaaattggtgtttttttaaaaaaacgtgaaattttcctaagcaaattttggctgaaagccaggaataatttttgcattgtatgcttcaacctgtcagaatgccaagaaccaggaaataatgttctttaaaaattgggcaatagatgcacgtggtgcagaatttggaatgtaggaatgcagagttagtgacaaatttctccctcccacttctgtcctctcagcaggggcagccagtcttgacagtttcttgtgtctgtctggagataatctctgcctgagagactatctcttaagatcatggtaactttcagatcttcagcaaattgtttggg

SEQ ID NO: 129581 - DNA, 1043 bp, Homo sapiens
ggcttgaatactggctccgctgcttgctgcctgtgtgaccctgggcaggttccttcacctgccccatccttagtttcttcatctgtgaaatgggattgttaggattaggcgaccacatgtgaaggtgcctagcagcatgtctggcgcatcataatttctaaatatatgttagtttccttctttctttctcaggctgttactttgccaaagcaccagattgatgttaggagtttgagctctgtcttcatttgactccctaaggaagtcacttcccccagttgagccttagaggactcatgtgtagtgaatgaagaggtatgcacaggacctttgagtgctgacatgctgtgagtttatggatcgatagttgggtcttctggtcatttctgtgttctttgtgactctcactggaagaggcggaagggagtagaagtcacatgggtaaaaatttcttcttcaacaagaaatactgctgttgctagaaaaaggattaacgtgggaggtgtgccacatccctgtatgggcacctcagctgcttccttggtgacggagaagaataagccatatattttcccccctggggagctggctccttcaaggaccttagtggcagaagagctcttgagcaaaaaggaaggtactggcattgtctgcataaaaccacctatctttatttatttatttatttatttatttatttttgagatggagtctggctctgtcacccgggctggagtgcagtggcgcaatctcggctcactgcaaccttcgcctcctgggttcaagcaattctcgtgcctcagcctcccaagtagctgggattacaggcgcatgccactatgcccggctaattttttaatacttttagtagagaaggggtttcaccatgttggccaggctggtcttgaattcctgacctcaggtgatccccctgcctcagcctcccaaagtgctgggattacaggcgtgagccaccacgctcagcctaaaaccacctatcttttaacaggaacctgccctgtgccctatgtggttccacaaaa

SEQ ID NO: 129582 - DNA, 1040 bp, Homo sapiens
ttcctagatatccaggcaaatgacttagcatcatgggagatttcttgttctgctttgtggagttcactcatctcactccctcaaacaccttagctttgtggagacttgttgtattgcttgtattctgacctaggaatgtcttcccttcttttctgtggcttttgtagttatcaatgccctgtctcagagatatttccttcaagccaatgatcagaaagatatgaaggactgggttgaagccctgaaccaagccagcaagatcaccgtaagtttggtttcttctgttttctggtggtagtaaaagtgcctcttcccaggctatggccttgttggggttggggaaaactgagatggcagcggggactttcccaggagcctggtctgtacccagttctctcccacctcgtctttttccttggctgaccaaacacaagttgaactgagagtctgagtttgaatcaagttcaaggggaagttcatggagcgtcccctttgtgcttcctgggagggctcccgatcagtcatgtttcgggtgattctgggatgctgattcagaatgtggtaggattggaaaatggattggtgactgtgaaaagtcaagtaaggggaaaagcatatggggagggaagtcagaactttttcccagcttgggggatactcttcttactttcagaggctgcctgcagggtcagtccaagccatccgcctccctgtcctagaaaagccttctgtttaaaagcatcacagagctcgttcatggactgtcctacgagtgtgctctttttccttgagttggctaatgaagaattcctttctttttccttagagatatagaaaaagaaaggaagaagggtaggaaggatggagaggggaaactatgttttggaaaaaactagacttttaatcaataagacaggcagactcctggcttatatagatcatggcttctttgctgaaaagtttgtttctgtatcatacagtcagaaatgcttatgtttgaggggcttccagtagtgactattacatgctgcagcaaatta

SEQ ID NO: 129583 - DNA, 1191 bp, Homo sapiens
gggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgcagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagca

SEQ ID NO: 129584 - DNA, 1050 bp, Homo sapiens
caagtgccaggcaaccagggaccactcctatagcttagagcctgctgaggttattcaaactagccagttctaaactattcgccctgccctgtcttgcctttcctgcagaaaccccaatgaagatagtggccaaaaaccttcccctcccttctatcttccaaccaccctggtatctttgccaggtagccttgtataacatgatgtgcctcctgtctctgggacctatgagtataataaactttggtttttcctgatcctctcacctcactgaccatatcataaaagaaaacaaaatggagggtaaaaggccacagagggtccactgcactgtctcatcacttacgttaaattcactaatccttaagggtttaaattttcgtgcagtaaaacatcttccttttcattcctttcacctaggtataccggacactacttcataaccactttactctactccttcttcctgggatgttttggtgtggatcgattctgtttgggacacactggcactgcagtagggaagctgttgacgcttggaggacttgggatttggtggtttgttgaccttattttgctaattactggagggctgatgccaagtgatggcagcaactggtgcactgtttactaagaagagctgccatcatggcccagggaggcgggtgaaagctccgtcttctgaattcatctctacaggctcaaaactcctctttgatatcagacctgatgttattttccttcttttggagggcatttgtttggttaagaaggcttctttggactttggaatttcaacccagattttaccttgcagacggaatgacaagcaaaaagtgttgtggggaatcaaatttgttcctttcctcatgcacaaaacataaaggatagtggcgagtttacaagctgtggatgggtttccatagtcttcctttctgtacattgctatatcttcagtcctttggagcaagtggacctaacaagttgagcaaaatgaatatttggatccatgttcctcttgtgaccctgagtcttcatgcaaggagatctgaa

SEQ ID NO: 129585 - DNA, 1036 bp, Homo sapiens
ttttaggatgattttaacgtcttccttctagtagtgtagaatcttcatatgagtagaccccaggagagcctgattctaatcagtcttattgaaaggctgagaatcctgttgtgaagatatcttgggcctaacctcccatcccagccacttaagagaagtgattaagcagtctgtggatagcaatacaatgaaatacgattttgctatcaaaatgacaaatgtgtaggctatgtagatttgtagaaaagttgatacaaaagatgttaatcataaaaagtaaggttcactttaagtcatatgtgataattacaactatcagaactatgtttgtttagctgtaaccatcagaagaggttatttattcaacacatattttattgaatacgtactgtaccagtgcaggaagtacatgatgaataagataccgtccttgatctcaaagaacttaaattctttgctggaggaacttaaattgtctagggcattaaatcttagaaatgggtggtgtttttcccaaagggacacttaaacaaacaacagaagccatttctttttaaatgtaaagatgggtaaatatttaagaaaagtgtaacactaaaaaaagtaagagtgtagacctagcagtagaaattataattaagtatgtttgaaggtagttttttttttttttgagatggagtctcacactgttgcccagactggagtgcaatggctcgatctcagctcactgcaacctctgcctcccaggttcaagcgatccttctgcctcagcctcctgagtagctgggattacaggcgcgtgcgccaccacacctggctaaattttgtatttttagtagagacagggtttcaccatgttggcaaggctggtcttgaactcctgaccttgtgatccacccgcctcggcctcccaaagtgctgggattacaggcatgagccaccacgcccagcccaaaggtagttattaatatacggtatgtatttatctggaattgacctggcgaatactagaatgattaaaaaaaaaaaaaaaaaa

SEQ ID NO: 129586 - DNA, 1051 bp, Homo sapiens
gtccataaaatgaaattaagtttcactgaaaaatttacatactttcccctggggattctattgcttcagattaaagtttataaagtatcattagtgtcttccacagggtcattttacacaaacacagttttagtgagatgtcaactggcttttgttggttgttggattgactgtgatttaaaatgttaaagatgatataatgcatcttgttctgcttctaggctgaaaggtcactgaggcagagctgtttgtaccttgtatcccctggaattttgcctaaacatttgtgtactcatagggtggtaggagatagtccgcagatggtctaaagaatgccatgtgatactgtgagatgccaataatataaataaaactttgttattattaaacttgactggcctaaagtaattttgttagctctgcaatttctgtgatgattttcagcaatgtagcaatatttgaagataatacagtatttttcatttagaatcattgtcattatcggggctatgtggagggagttcataattcatccattgctcttagcgactgttttggactcaggtaagcaatttcctttatcttctttttttttgtttcccctatgtcttaccctctttcctgtttctgtctccaaattaaatcattttgggcacttagcaaaattggaatttactttgatgttactgaacatttttacagctgtgtttcagatatccttggcatgtttatttaagaaagtattatagttgatgagttttaatatgtaaagaggaaattttttttgagaccactaaatcatttttgctatttaaaatgaaatatactttaaatttctgtagcactttatatttataaaattttcacttgtattatttaagacttgtatttaagtcttattatgactgtgaataagagctcattatctctgtatttaggtgagcaaactgaagttcagataaattatattacaattcaaattaagttattatagtattaacattacattccttgaggtcatggcaacatggcactgtgctggttggttgac

SEQ ID NO: 129587 - DNA, 1049 bp, Homo sapiens
tgtaatgcatagtatgaacaaataaggactgttcccacccactattcccatcacttgaggcagttttaccttttttggctaagatttttgttaacttgtgctaggtttttagataatctcttggcaatgcgacgttttgatttttttgttctaggcattagttattaatttctcactatagaagatgagttagttttctttccttctcttccttcaacccttaacaactcccatcatacctatgctgattttccattcttcatcctcccaatagttagggcagtgatgactgtgtattgtataatggccacattaatgctcttcacaactaaactgtatagtaagttataattacttgcctgatttctctagagttactaattctgtctttctgtttctctctctctcttttggtttggttaatttcctatgtactttccattaattgacctgtatattgttaaccattggcctgattgtgccttgagttgattagtggcatcaagtattctatttatttcaatttgttcaaataagtctgaacagaaggcctctgttcctcttcagtcttgactggtttccctctgtatagttagttagggttctctagagaaatggaaccattgtgttgtgcgtttatgtatacagtcatataccgcataacaacattttggtcagtgagagattgcatatacaacagtggtctcataaaattataatgctgtatttttactgtaacttttctatgtttagatatgtttagataccttttctatgtttagatacgtttagatgccattgtgttaccattgcctacagtatttagtacagtgacatggtgtacagatttgtagcttaggagcaataggctgtaccacatagcctagatgtgtagtaggctataccacctaggtttgtttaagtgcactctgtgatgtttgcacaatgacaaaatcacctaacaactcatttctcagatcatatccctgttgttaagtgacacattactgtagatattactgtatatataatctggaggaattattacg

SEQ ID NO: 129588 - DNA, 1089 bp, Homo sapiens
aaaataaaaacaaaaattagccaagcatggtggcgtgtacctgtagttctagctgtttgggaggctgaggtgggaggattgcttgagaccaagagttcaaggttacagtaagctatgaacgtgccactgcactccagcctgggtgacagagtgagatcctgtctcttaaaaaaaaaaaaaaaagggaaagcaagaatagattgttactttgtcatctgtcgtcagtgtttgtcaatgtatttaattagtagggacatctaaaccaagcatccatatatgataaatgaaaaaaacaaaagtattagctggcagtgttttctccaacccttcctagctgatctaaccagtggtgcagttggtttatatgtgagagcaatgagaatgaatatgctgcaaatggtactatactgtgcatggtttttaatttacttataatctattatttaatagtgtttcttttagggcttgagtttgaattcaggctaacttttaagtacaacttaagatttatttttacattttgtcattacatatgaaatgtggaacaaaaatgtatcatgtgtgaggcaggaaaggttttccacggtgttgaggggtattgaggctgttcatccaggtgtttagactgttgtagggaatacttttatttcaaaagctaaattgccataactttttttttctttttttaaatgtttaatgttacagaagccaaggctgcccccaaagattgtttcattgaagtgaattctaaaggtgacagatttggcaattgtggtttctctggcaatgaatacaagaagtgtgccactgggtaagtggaggtgcggtcataatggaatatgaaagattataagatccgtcatctctagtatcttttttttttttttttttttgagacggagtcttgctctgttgccaggctggagtgcagtggcgcgatctcggctcgctgcaccctccgcctcccaggttcaagtgattcccctgcctcagcctcctgagtagctgggactacaggcatgtgccaccacgcccagctaattttttgtattttagtagagatggggtttcaccatgttggccaggatg

SEQ ID NO: 129589 - DNA, 1009 bp, Homo sapiens
aaaatattttatatttctacaattaacatttgctttttgtaaaacattaataatgaaacattacaaaggaggaaaaagtcatgtataatctcaatccatatatgttcactaatatcagtgaaattattttcttcttcacactaacattttacatagttggaattattctgtaatattatcattgcttctacccattctacctcctatgctatcagttaagctaagcaactacagtaaaacagtgcttgctaagaagaaatagcaacaaagacccccatgtcactcaatctgacagtcgtttttaggtcttcatacaatagtacttgacctgtcagtagcattcaattatgctggccattttctccttcttgaagaaacctctttttttttggtgattgtgtagggtgttcttcttctcccctgaccccatgtgatttcgtttacttccgtggcttcatttgcctcctctctgagaagctccagccctgctggcctgcatgtggcctgcggccacagggctctgcacctgctgttccctctgttcagcatgctgtctttccccctctcagcctgctcagttcttcgtcctccagatctcaggtgaagtgtggtttccttacagaagacttcttccacttcctcaacaggaccagctctccctctgacaggtgttcttgatgctgtttgcttctttttcatagaatttgatatgttttcattattttttagttcatagtattttctaatttacactgatttttttcctttgactcgtgttattgaaagcctattgcttaattcccgagtagttgggaatatactggttatctgtttggttttgatgtctagttcaattccattgagaacacattctatatgatttcacttttttggaatttgagatgtgcattattcagttacacttggaacattcatccatacagactaatatgtgggccagcctcttaataccagaccaatatatggtctgtatgggtaaatgttccat

SEQ ID NO: 129590 - DNA, 1098 bp, Homo sapiens
cagccagggcgacagagccagactccgtctcaaaaaaaaaaaaaaaagattcagtgaagctaattcccatacccatcacctcaccacattgtcattccaaaagtggacttgatccctttagagtgctgttcctatggcttgtggaaagggatggagacattttgttgcatttttcacccattttcacagtacatataaatcattctgtggggaaaaaaattgcagatgatagaccacctgttctatggtagaagccagagggtgctcaaggtcttcaccaccactgtgcattctctgccagtcatagaactttaggagttaacagtagatagtaaagaacatcttggtcaaggtcacttcatcattgatttagtaattccatctgatcattcctaacgtcttatagtgtaatgtgatatgtgaaaaatattacttttactttcttatttgaggctaagttatacagtttcactttgttgtaaacttcaactacttcatcaaggaaggatataatgaattccaaaaccgaggattctagctgagtggtttttatagtattagttagatactgtataggtttggcaatacattttggaagattttatttaaaatacattgacataggaaatatgttaccttctaactaatacagttggtttgaaccaagatcttagtactttggtattactgaatttaaaaaaataccttaaaagaattaagtattccacattcagtggtaaagatatgtcaaataagcaaaatatttttgactgtcagcattataaataaatacaggttgagcacccctaatctgaaaatccaaagtgctccaaaacccaaaactttctgagcaccaacatgatgccacaggtggaaatttccacacctgccctcatgtgatgagttgcagtcagaatgcactgtttagtacttatatgtgaataaatctaagaaaatgattgcttaccagtagtatataaattcagagtcaggagtgatggtgagccaaacaaccacagattgtccacatgaggggctgagagagtaacacctttgctttctgatggttcagcatacacagacattattttatgcaca

SEQ ID NO: 129591 - DNA, 1061 bp, Homo sapiens
ttctcaaattaactgtattggtgtaagagttttgtcattaagtgtttaagtgttattctgaattttctaccttagttatcattaatgtagttcctcattgaacatgtgataatctaatacctgtgaaaactgactaatcagctgccaataatatctaatatttttcatcatgcacgaattaataatcatcatactctagaatcttgtctgtcactcactacatgaataagcaaatattgtcttcaaaagaatgcacaagaaccacaattaagatgtcatattattttgaaagtacaaaatatactaaaagagtgtgtgtgtattcacgcagttactcgcttccatttttatgacctttcaactataggtaataactcttagagaaattaatttaatattagaatttctattatgaatcatgtgaaagcatgacattcgttcacaatagcactattttaaataaattataagctttaaggtacgaagtatttaatagatctaatcaaatatgttgattcatggctataataaagcaggagcaattataaaatcttcaatcaattgaacttttacaaaaccacttgagaatttcatgagcactttaaaatctgaactttcaaagcttgctattaaatcatttagaatgtttacatttactaaggtgtgctgggtcatgtaaaatattagacactaatattttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagcactaaaaattttttcataacctttcataataaagtttaataataggtttattaactgaatttcattagttttttaaaagtgtttttggtttgtgtatatatacatatacaaatacaacatttacaataaataaaatacttgaaattctcttttgtgtctcctagtagcttcctactcaactatttataatctcattaattaaaaagttata

SEQ ID NO: 129592 - DNA, 1115 bp, Homo sapiens
ccttacaagcttctcttctgtcaggactccagaggctggaaagggaccgggactggaaagggaccaggactgaacagactggttacaaagactccaaacaatttcatgccctgtgctgttacagaggagaacaaaatgctttcagcaaggatttgaaaactcttccgtccctgcaggaaaggattgatgctgatagaagagcctggacagatgtaatgagaactaaagaaaacagatggctggagatgacatttatccagggtcactttgtcaggccctaggacttaaatcgaagttgaacttttttttttttttttaaccaaatagataggggaagggaggagggagagggaggacagggagagaaaataccatgcataaattgtttactgaatttttatatctgagtgttcaaaatatttccaagcctgagtattgtctattggtatagatttttagaaatcaataattgattatttatttgcacttattacaatgcctgaaaaagtgcaccacatggatgttaagtagaaattcaagaaagtaagatgtcttcagcaactcagtaaaaccttacgccaccttttggtttgtaaaaggttttttatacatttcaaacaggttgcacaaaagttaaaataatggggtcttttataaatccaaagtactgtgaaaacattttacatattttttaaatcttctgactaatgctaaaacgtaatctaattaaatttcatacagttactgcagtaagcattaggaagtgaatatgatatacaaaatagtttataaagactctatagtttctataatttattttactggcaaatgtcatgcaacaataataaattattgtaaactttgtggcttttggtctgtgatgcttggtctcaaaggaaaaaataagatggtaaatgttgatatttacaaacttttctaaagatgtgtctctaacaataaaagttaattttagagtagttttatattaattaccaaactttttcaaaacaaattcttacgtcaaatatctgggaagtttctctgtcccaatcttaaaatataaaatatagatatagaagttcatagattgactccttggcatttctatttatgta

SEQ ID NO: 129593 - DNA, 1031 bp, Homo sapiens
ttcagccctttgcttgaaaatcccagctcaatcactaagttcattagtgctggccagggcagagttgtgaggttgaaaatagactcagttggcccctcccacacatgtgcacctccctgtggcatccccttccctgactgcccttccctctccaccactggcttcaacattttttgcagtttttgactgcatagggtgaaatttccaacacccagcttgacatgtcttgtttccagtagcttcaatatattaaattcaattccctggacacttggaagtccatgatgatagtattcatcatataagcaaatcatcgataatgctttggttggctaatgttgttccctctaccttatctcagttaaaatgtataaaatagtctttaaggggtggtaaggtcatatgatgatataaagttataattctaatgatttctacctgaatagctttacgactactttaccatttataaagggcttcctttcactcatttattcctcaccaaaggcctatacggccagtgtcttcttaatttagagattagggaactgaggctcatagaggtgaagtcatctgctctaggttccatgatttagacggtgctgagtggcaccagcaggaccacactccacagcactgtgtcccattccatatcctcgatgtcctgctggaacaatttggaggatatcgttatttggggtgggggatcagggtggattttgactaagataattcccagacgtggctgaactgtttctacaacattgagtttgactacagcagacgctacacccatcgctgcctttgcagtatgggctttgctttgtattcgtccagacctggatgccctgggggttgccacaccagaccacagtctcccagagcctccgcaagcatgtgctggctttctctatcctcttccgtggcctatcagcacgtttataagttacagtttggccctgtctgcagaatgtgctgacagctttcagtaatggatatggacgtctgctgaaaggtttggctgtgtttgt

SEQ ID NO: 129594 - DNA, 3363 bp, Homo sapiens
ttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgatactgtgagctgtgacttttttttcccactcagtcatacacttctcaccctttccggtgaaccacatgtatctttctcctcttgagtttcttcagtgatgctttctggtcccagttcaacagcttgcaaatggtaactgggtgtgggtgggctgaaggagaacttgggaggcaccacaggctacccgtggcccccaccctcccatttaccatctgctcctataaataacttccagaagtgtttctcctggttgtgtgtgtttcagatcagagagaaggttaaatgcttgctctacaagaatgtagctttcggccctgcctgaatttcttttccatgtttctcatggaaacattctctttcccctccggct

SEQ ID NO: 129595 - DNA, 1076 bp, Homo sapiens
gggtgtgtgggtggaagccttgcatcattaaaaagagggggcttggtaattttctattaaaaagagttcagaagatacgcaaattatctggtgactggcacctagaaagtgatttccaactcctttgggaatatctcgggctgaccagtcttaaaggggagttgattgtacccgcgacactgtgtgttcagtctgcttcgtttatagagcatgtccacgctcatttatcttcatcagcagcccctgtggagtcattgctacaggatgtggctcacaggttaacactgttaattcagtgtccattgggacagagaaaagagaaagcagagttggtgaatgggctgattttcccacactcctgggagttgagaacagaagcagccctggtaccatattggatttgaagagagctcatcacctggatttatcaattaggacttcaccagaacttgctctaatctgccagaaagtcaaagtagatttggattttgtgtaggtcttctcagttggcagaacattagtgctgcctgtcagtggggattagtggttgattagcgattgactgatactagcagtacctgctgtcttaccgccatagagacccagtagtagaaactgatttctcccatgctgtggttggacgttgatgtttaatgcaggaagcatgaccatttgaaacaacctttaactttcccttgctgagtgcacacacatagttctgcctgtcattttataggactcaattttcaaggaattgtaggtctttcaatgttaaaatactaaaccaataacttgctcttcaaaacaaaaccaaacaaaaagaaaccctcatggtcaggcgtggtgactcatgcctgtaatcccaacactttgggaggctgaggagggaggatttcttgagtccaggagttctgggcaacatagtaagatccgtctcttaaaaaaaaaaaaaaatcagccaggcatgatggtgcatgcctgcaatcccaggtacttgggaggctgaggtgggagaattgcttgagcccgggagtttgaggctgcagtgagccgagatcgagacactgcactccagc

SEQ ID NO: 129596 - DNA, 1045 bp, Homo sapiens
aactcttgggttcaagtgatctgcttgcctcagcctcccaaagtgctgagattacaggtgcgggccaccactcctggccatattatcattttttaaagttttttttttaaaattttattttatgtacagagagctagcatggtttctttcacttggtggatgccttggataatccattcagggaagctcacttagtctaacctaatgaagcctacctcctctgcatactgatggaaacactggcagcacatattgaggccataatgacaagaatgagaaccctggccgaatttttttggatggctccaggagagctgctggtgacccatcttgcttttaggagtgcaacaaggcaaaaagtgaaaagtttttttttttaatactccctgcattgtctctgttatctctgaattccttttcttccttttctgttttgtatgttacagtctctgccattcacatttggaggctttccttaaatacttgccagcccttgactgtccatttgaatttaacagcgagacatgacgttggaagctctttgtgtacatgcagggcctgtgatttgttaggcctcacttgagaattttgcagagggcccatatgtcttttcttttgaactattcttaggttgatgcagaagtaactacggtttttgcagttgaaagtaatggcaaagaccgtgactacttttgcaacagcctaatagtttctttagagaaaaaccactcaatcctctgacacaggcatataaatgtagtgttctaagacccgagtgtctcattcttcactttgcagactttcatgtaaccctttggtgttcacgcagcagcacctgtccggtcctcctctgtgtctagtataccccagcggcaggctgtgtgcaggttcaggccttctttttttcccccttttcttttctttttctttttttttttttgagatggagtcttgctctgtcacccaggctggagtgcagtgtgcgctctcggctcactgcaatctccacctcccgggttcaagcgattctcctacctccagcctc

SEQ ID NO: 129597 - DNA, 1050 bp, Homo sapiens
tctctgatccactctgaggcccaagcccttgctccccaagatgcgtggcttcccagatgaaatcacaccaggcagcactttgctctcagagtggggttttcattttgcaccattagcttaactcagtggggatttaacacaatccaggaaatcaagcagttagcagcaggattctggatggctgacaccgatgctgctggtgtgtatgcattgatgatgctggcgagtgtgtgtgcatgtgtacatgagcttgcgtgtgtgcgttcatatgtgagtactggggagagggctctgcaaagttgcaatctctactctcctgcctggccaccttcctgaggtgtctggggtccagaaaacaggacaacttcaattaaataatttgtcccaaatgagccactcaggagcattttccacatctgctgttttttgttttgttttgtttgttttgctttgttttgtttttggagatgagagaaaaagaaatctgctttggatcttgttcttttagtttagttttttttgttcttgtgtgtaacgtatgtcttgtagtcagcaaatgcatccaagtatgcagcatgtggcttgtggtcaggggagagacgctgagttattgtgacaaagcacaagcccctttctctgctaaacgaattaatgatgccagacattggctcctgctgggaacagtggggtctgttaagctgccattgcaaggccattgtcagtaggacttatctgggccctagtgccgcaaagccagctcgccatggtgcccagaactctgctgagtgttggaaggaggttgtggttgcttgcagccaaatgccgtacccagtgctgttactgaatctcatttgcacaattggacttggggagggtgctttctgcctcagacctcagggttacccaagacatgtgtgatctggggctgggaggcaggaaaccagtgctctgtcttcatggcttagtgaggctttggtatctgagcagacttttccacctggaggctctgtggggtaggaggggtggagcaggcccatgcgactggtgcat

SEQ ID NO: 129598 - DNA, 1024 bp, Homo sapiens
agttggctgtgttggtgggtgaaccttccttctggtggagatgtaagatgatctttctgaagaaggtggaggagccagctagggcccccatctctttaggtcaccagcagcgtatgaatcctacccttgaaatgagttcctagctgcccccgacctcgtgtgtggaccccctcttcagtgaagaaagggatgacgccagggtgtgtaaagacagaatcctggagtcgttccatgttgcgtgtcttggagaggaaggccagatggcctggagcattctagtggctgtgactctttgggaacggacctgcagttggcagcaaggagcatggacatggaatgaagtccaggcccagggctgaaccccctccccccgccccgcttcctttatccaaggaggagccactggccccacactccctctgcctcccttggtgttgattttcctggtgactttgaaaaacaaatccttttttgccttcacagttgtgtccctgtgtttgtgcggcgggggaggcggtgggaaggttgagcgggaaccgcccctgcctcggaacaggagtagaatccatgtattgtgttgggttttccctgtgactgacagctctttgcctggaggcttcttcgcttacagacttaatgtatctcctggcaggtttccttgttttggatgattactcgaagtcgggaataggcaagcccagggaggaacacagagtgtttctctctcttgggttcatcgtccccatccctgtccccccattcccgacgctctttggaagtggggtgatgccaggaatcgggtctgggccggctggcaactatgagcttctgctttacccacccaccccctccccccgcccagttccatagaatgaggaccctgggttggagtggaaacgttgcctgttcctcccatggagccctcagcctgagagttcctggggacccataccccaaaactccgcagagaacaccaaagggtggccacttctgaggcggctgggagggatcattggcacccccg

SEQ ID NO: 129599 - DNA, 1064 bp, Homo sapiens
ggacctggactgcagtctgtctggctgggtgaccaagaagagggacttgccccatagtcagtgtgtgcaagagccacccctgtagcgtgagcctccctgggtttgagtgcctcttactgctggcacctggggacttcctaattcaaagggggcaggctcaggatggttgccctccgcatcccacaaatagttggtgatgagttatgaggaaagtgaaccagaagcagccagcttaggtttctttgaaaatagacatttgttgatccacattggcagggggctggacgtattgactgatctgggagctggggccagggcatggtggcagggggtgaagtcatcttctggattctgctgagtgttaatgacagtggcaaaaaaaaaaaaatgctgcagatactcccccagtgtctctggctttgctagtgggtggctgtgagagacccatttgggaattaggtaagttgagttctgtgagtgctgcagcgcatatttaagtgagagggtggatggacacatgaatggtgatgatggggacgagatgaaatacagccttccaggtctttccagggaaggtactgtagtgaatttttttttttttttgagacagcctcttgctcttgtcgctgaggctggtgtgcagtggtgtgatcttagctcattgcaacctctgcctactgggttcaaggaatttttctgcctcggcctcccgagtacctgggattacaggcgcccaccaccatgctcggctaatttttttttctttttttttgagacggagtctccctctgttgcgcagactggaatgcagttgcgtgatcttggctcactgcaacctctgcctcctgggttcaagcaattctcctgcctcagcctcctgagtagctgggattacaggcacgcaccaccatgcctggctaatttttgtatttttagtagagatggggtttcaccatgttggccaggctggtcttgaactcctgacctcgtgatctgccctccttggcctcccaaagtgctgagattccaggcgtgagccactgcactggcctgtagtgattgtt

SEQ ID NO: 129600 - DNA, 1050 bp, Homo sapiens
gaggctgatttggggacaggtcgagaggagcagggaaggacagcagctccttctcagaagctgcagggagtacaagttgccacctgctactgtgtctggttgggcccggttttttccggactggctctttttttttttttttttttttaacatctacccctaggtgtcagcatgactctgtccaggatttaaatggctgccctctgggtgccttcccagggaggggagagttcaatgcttaggggattcagagtgggggtcctcatcaggttccgcgaggcaaagaaaaatggacatccccacagcagggtggtttttctctcttcttcccaagtcactctccatcgaaagagaattctgaaccagcactcgcagctccaggagaaggaggagctggtgggggccagggggaggtgggggagatgccaggggccttggggccttccagggatggtctgttatagtctgacctgcagaatacctgaattcaccacaccctgagagtctctcctctgagaaaagtaaatgtaaacggcacccctttggagggccagctccctctctctcgcctctatctgacatggatgcagagaagtggctccggccaagccacactttcagaagactcagtgtgatgctgaacaacgtgtttctcataattcctgccttgtgtccctgagatcggatttcttacagaattcttatctggaaaagcgtaaagataggtgatgtgagtccattcggaggcatcccagtccatgttttcattaatcgaacatggtaaagtacacggaagggtcttgttcctgccctgtcaaagtaagctgcacacatgtgggaggacacatgcaagtcggagggaatcatgcctcacgacagggtcattctcagggtattgcaattgtggatgaagatggaagctggatgtagatggccaccagagctaaactggagagcgcgtatcctgtttccatgcatggggaagattgatgtgttctctgtgatgcagcagtgtgagttacttgtctgtttctgcattaactcaaattc

SEQ ID NO: 129601 - DNA, 1433 bp, Homo sapiens
cggacgtggtaacgagtgcggctcgccccgccgggagctgattggctgcgcggggcggctccgagggctcggccgtaggagccccgcgcactccagccctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggtaaggctgcctcctcccacgtgcgcgagccgccccctccatcccccggccggagctgcaggagaacccgcgccaccctacgcccgcccgccgctgggtcccggtgctggggactgagggcccgaggttgctcgcatgctgtgcacgtgattcctaagcgcgtctggtctgtcccaggtatcgctcagcgcccctcgcgacccaggtgcacggcggggctggcccgggagcggcagctctgcgccttggcctcgcagggactcgctgtggtccccggagccgctcttcctgggatccaacttcgcctttcccatacctgaaacaaagccttgcgctttaaataacaggggagcttccctctcctctaggaggactccgagtccctatcgaagtttttaacctctgagacgggaggaaaaaacaaaaacccaaagcgtagaaagttcagaaaggccgagagaatgcttggagcagcttttgtttattttca

SEQ ID NO: 129602 - DNA, 1024 bp, Homo sapiens
cgggtacgcaacctggctccccacgcctgctctggcgagggagagagactcaccggggacgggaagggtgtgggcgacaaccgggcctttgagggtcccgcagttctggggaggtccaggcacagaaggggccttggccaaacgtgtaagaagagagccactaagcaagacaggtgtttggagcaggaagaataatataggccgatcgccggggttgacgaccttatggaactttgttgcccggtgccgggaatctggatccagcagtgttcccctgctgcactcccccaaatccccaccccgggttattgtcggcagcgatgaggagccaattcctgaggctccaggtcgtctcagtcaccaggttgtaaactatatcctcctacctctccgcgcaagataaatcatcatcattctcgtgactggtgtttgctgcctctgtgctggccgcactgtttggctgaaagggtttattaggtgcatggccaggcggtgcgttcaggctttcttggaaccttaaagacgtcgggcgttagataggcctggacaggaaaatgtctcagaacaaggccttaaacttgtcacattcactgggagccacctgttttgtcttgcatatcaaaatggtcatcaggatataggtcctttgggcaacattgcaggcaaaaatggaagaatgggatttgcttccccttcagacctagcaaaactttaaaaaaaaaaaaaaaatcattgtatcttgttgtagaggtaatggagtgtgtgcgtgcctgcctgtgtttttgtgtgcccacatatgtacattcaaccaaagattcttttggtcttgacccatgttatgtagattgtgtttcccgttcagggatcaatttctggttagctggaagcaggttttgtggctctctcctctgtgacagggaggacgagggcctgagaggtgattaggcattccttgggtgtgggactgagagatgctggtcatgggataagtgggtgtggatgagtctgtgtagagaaatgtgta

SEQ ID NO: 129603 - DNA, 1054 bp, Homo sapiens
aacatcacaattgatgtgttttacatgttaagattgacatggaatctggctgggcccggtggctcacgcctgtaatcccagcactctgggaggccgtggcgggtgcatcacttgaggtcgggaattcaagaccagcttggccaacatggtgaaaccccatctctactaaaaatacaaaaattagtcaggcatggtggcgggcacctgtaatccccgctactcaggaggctgaagtagaagaatttcttgaacctgggaggcggaggttgcagtgagccgagatcatgccattgtactccagcctgggcgacagagcaagactcttgtctcaaaaaataaatcaaataaaaagatatacatggaatcaatcaaatgttttatttttaagcctcttacggaaactatgacatacaatttatgtacttcaaaatcagaatataaagtattctttttttaccacaattatttggacattaaagattcctttgctttaaggttttaaagcaacacttacacctcatatatttgagctaaatgtgtatacacagaatcagacattagccttccactctgtgtgtggcagagcctttattttgtaatctaagtgcaaaagcacaatgtagttactgtgctccactgattcttgtcaggaaattgatgtttctaaattctggagtccttttacctctttgactctgtatagcccagaactgcttgtggtactgagtactatatggaatgttacatggcactcttcaattgtgcctttgaatttcttttttctttttaaatgtttgggttaaaacactagcttatgctttaaaccactagaaaagctttgattgtctgtgtatgtgtgttgagattaaatttaaattacaggtttaaactttccttgctttgatgaaaaattgaaaggtttctgtttctctactacttaccctagaaattttactgattgctctgctattggagctgattttccttttgtgagaacatcacacttggcaacataatagagaaagtgactaatatgcaagtgttttgtattatt

SEQ ID NO: 129604 - DNA, 1072 bp, Homo sapiens
aacaaaacaaaaaaaaaacttgcccagcaaagttatgcttgaaccagataaaagaatgatgttgccgtttctttgctcgtaacctgtactcggagaaaggagacggaaagctgttctgaaggaatcctttctttgaaaccagccatgcaggcatttttctgagtgtcttccctagtattactggactggagtgaagggagactgagtctccagtttccaattctgcaggtgaactgagaaggaaattagaagattgagaggccttagttgggcacctttatgggctacttccttctattcattattttaggatgattgacaaactctgatgtgaagatagtgcctaagggggtttttttgctcataaagaccaagcacagctaaaattctttgaatgctgaaaataggagaatgatacatgcattgcttcaggtaattagatgaaaaaaacaaatcttttatttagaaataatactcctaatttattacgtaagaaccatgcagattgctctttgaataatcttacgctcttttgaagaagcataaaacatgagatttttttatccccaaaaaatatttgaataaagtgtttaaattacttttcttcaattagaaaattctttatatgaaacaggtagagttttaaattctaaatcagtttataccaaagcatctaaattgtgacatcctaatttgttaagtttggtctgtatgttatataagccacacttaaatcattgcttaatttccaactttatttccatacacttcttttttccctttaagttgtgatcacatttgtgactttatcatttgctaatagtgtgaatttaaggaaatatatagtaatttaaagaactggatcaaagcctcttttgaacattagagccagaaaaaagttatgatgacttcgagcctgaaataaaacatgtaactctttgatttgggatgtagctattaagatttattttcttctagcttatctgtctcagaattgcctttattaaagctggagatttggcaatttccagaagttcctttgtatcctatctggtttttgtctacatttgct

SEQ ID NO: 129605 - DNA, 1422 bp, Homo sapiens
taaatttttttaaaaacctaggtcacataatcccaggccttccagctgataataatttcagcagttttgttatactctgcaacaatagttcttaaactttcaggggtcatgaaccctttcccaagaaaaaagttttcatataatttcagggtatttttaaatccctgaattcattacctccatggattctcagttaagaactccctagttcaacaaataaagcatcgttttcagaatttatttgttttgttttcaaaacataagttatcagtgtttgggaaggaactacatgtggactactataattacatttcttaaaattttcagcaaattggagaaagcaaacttaagtaggaaaaatgtttaataattgaaaaataaagcaaactgaaagcaaagtctgcagatcacaccctccaccttgccaagtccccctttgtgtgttgtgtcctgtagtgtgttttcttaacagccatgctgtttagattgaaattaccatttatgaagacagaggcatgagcagtggaagataaaccgaagaattaaaggtaaatatgaaatgatatggcttgtatgcagcttttgcaagtttagaggatgcatgaatattcttccccgcatggtaaataaatcattaaatcacgcagttaaataacagtatatttgctgtgttagcttaagctagtcactgtattagcttgatatttaaaatgtgtattcggcccaagttctatttggtgatagagaatttaattctgattttttttcctgctgtattgtgttcagactggttttgttgttactttggtgggggaatgggggatggcagttacttggcttgttttaatatttcaaaactatcctagacatataaatacttgggttttgcatataagaatgagttcagagatgtctacctatatgacaaatggctttaataagcaaaggaacatttcagaggggagtggggagattctgaatatttcatttattatgtttaagtggcttcagacccctgtggaagaaaccttacctactgagtagaaacataaatttcattcctttgtttaaagtattaatgtccttaaatatccagatgctgccctttaatgagtaagaaacaaattaatactactaagaatctctaggcagagtcacgttgaagccctaagtactttagcatagccttctaagtgacaggaagtagcacttcactatttctgccaattttagttacgtggtcttcctacagaaagtgttctgctgctgcgcttttctagttgactgtgcttataggtatctgtcactaattaatagacagcacagacacagaatgtaccaaagcagacacatgtcttcctagggcaacatcaataacagctaccattttgagggcacgtactatgtgcctggtattgtaca

SEQ ID NO: 129606 - DNA, 2115 bp, Homo sapiens
gtgataataaaaacagctaatgtttgttggcacatctgtgccagcactattctaaatgcttaattttaatcatcacaacaaccctatgaggtagatattgttatccctgtttttcagatgaggaagccgaggcagagagaacttaagttgctggcccaaggacaaacagctagtagacagcagtcaaggcagcgtggctccatggtgatgtgcttggtcagagatctgaatatataggacttagatttgtagactattgagctgtagactcatttagacaaatggtaccaagatattttagtagataaaattctaggttagtagaacatagaccacatgttataagctgatatcagttgatggaagaaaaatggttttacaagttattttcaggatctctatcaaacctttacttctccctctaattacagatcccacttccagccgggcccctcatgtatccactggccgaccgcagagtgtccctacctcctctccagagcatcattcctttctatctgctgccagagccacggtgccatttactccaaggactcactttctaaaattccacacctggagtgacctctagtcgctcagcatccactttgtgtctccaaattgtgtaggactctgtaatcttttgattagtttctgagaaaacacaatgaagcacttcacttttttttattcaaagccatttaataaaacacagttggtcagcccagtgcaaagcttgttatctgccaccagtacataccattggttctcttcattccttgggccagcttctcaggtggctttagacctcaacaagccgtatcttcaccagtgttctatcttgttcccctaaattaataaaatgtttttctccaggattttggtgagggttggctgtggctgtcgttttgcacctcccagatttcaaagaattactggttttaccatgactcaaatcttaagatctgtttctactattcagttcctcaaactgaagcttattgaaaaaaaaatgtataatgttatttgttttattatagcaattatgcctaattaaagcagtatttaatgcaatttccagttatttctttggagaattttatgtcattgttccattaccttgaatgttggaaagatatgatacgtgctgcttgttcatcacaaaaatcagtaagcacaataaagtggatgccaaaccatcagacacataaatgttcccgctgtgtccctggatatggaataagcaggtataaaaaatattttaattatagttttgttataaatataacttatgagaaaaaaatttgataggaataatactgtatattactaatttttaactatccctaaggcaaaccttatgacccacagaattttctcatatacagtattcagtgcacagaaatcttatgattggctcaagtacagtaagttacttctcagtaaaactctcaagtctgagtccatatttgtagctctgcttttggctgtacgttcctaggatcggggctgcttatgcctttcgtttatccttggggtttgagagcgctgtatttgggagagagtttaaaaatacattaggagagagaaaccattaaaagtttcactgtcagatatattgtaggtgctaatactggatttcgtctcagatttaatttcttttatgggtctgttagtcattcaacaaatcccataagtatgtgttaatattttaattgtgtaaaactcatttgttactttacagcctgtaatagtgtgtctgcattttcaacctgttgcaataactttgctgaaatattaacacattaataaaacttttcttaaacaagttgtctctgtgtcatatttggtgggatttggtagtaaatgatggtaaagtggtaaatgataggacactaaatttgtcagataatactagaattgtagtagtgtaccgtacaatgtagcttagtgttttaaaataaacatcttacatttctatgtcacacctctcaatttcttacctgctttatcttacaacagcaggtatattataagtaaaaattaaggagtagtcgttgacaaagcctgctctcttccccggacagcatgagcttcaccactccctccaccttc

SEQ ID NO: 129607 - DNA, 1112 bp, Homo sapiens
attacaggcgtgagcccggccagctcctaataatgttaagtgcttgctaggagtcaagcgctgtgctgagcgcaggggcttcccacgtcattgcgtccccagtgcttagtgccaggcactgagcagaggcgcgattcgtatttgaactaaaacgaaccccgtccctgaggaacaagacctctactgggaagtcaaagaaatgaatagtgattgtatggtgtgatgggtgctcagctcttggtggacagaagtaagggggaggcttgtttgagaaacggatacctgacctaagccttggaggaagaggcagacactggaaaactagagtccctgcgttctctcaccacttgctaaagggcctctacaaccccaggaaacctcaataaacctttcctttctccagatagatgtctgttcttgcagataattagaaaacgcattgcagagtattggttctttccctctcattaggttcctggtttcagagaagatgaccgaagaagtggatttcctgggacaggactctgatgggggtagtgaggaagtggtcctaactcctgcagagctcattgaaagattggagcaggtaagcatcccagatcgaatccctttgctccagtcagcctttttatttagttcaactgtgaatatcagggatcacaagatgaggaaacggaatttggggcttactttagaacagggactggatcttaccatctacatggaaacgggaagcaagaaggacatcctctgttagagacctcatcatatcaaacacagcatccccaagtggggtcagtaagggacagctttgggcacattcagtgaacagttcacagagcaaggatccacgtgatattttcagggactgtagaggtccctgaacttctttaccttagtcccttgaacatctgctgtttccctggagaatgcctgtttagcaagaaaatgctgaaatgcctgtaagggaaaactggtcatatttttcctttttctcacatgttttttcttgagtcgtctgctctccatatgtccactgcttatctaaaatcctttctgaaatatttctcctttaagttgtaatagctatgacttactgcatatttcccatg

SEQ ID NO: 129608 - DNA, 1152 bp, Homo sapiens
ccttctcttgtagcctccccacctggcccctgcaaacatttgagtttgtggtccctggcctagatgatctgagcataaatcattgtcaacttcagagaagctgtaaaatgtggatatttcagtttctcagctggtgttttaatactgctttttagacccaatggaagtttcgtctgtgtgctgtactatctcccttacaatcagattggagttcttttggaagcctctggctgaacagattctattcaaatggtcattttctaaaagtaaatgactattgtttgtactttatacaatgataaaatgaaaactcacatgatatttttgttttccttggactgaaacatagtctgggtcctcaacgttgccggtgatgatggttgaacatcatgttttttataaaccttaatttctcatttaataggaagaaaatctcaggagagccaaaagggaggacctgaaggtcagcatccaccaaatggagatggagaggatccgctacgtcctcagcagctacttgcggtgtcgcctcatgaaggtttgacgtggagatacctggagggattgagacagcacagtctgtaatgcagactgaatgtcctggggaaaacttgggctggggcccaggagggtccaggacctgaagatgctgctaagagcccaatatccatgtagctaaactgtaaggagagcgagagattgctccacagaagcacagaggaacgtgtgtggcccactgcggggacaccgcacacatttttagtctgttcacctgccgagtgagtggttcccccttgcgttacagcatggcagtgctaaagggagagttgttggcattggtcaatagtgaatgctgactagaggagaacttgtttccaaaattattttgtctgtcagatggccaacgtcagtgtcaaatgaaccaggatgacttacattcacctacagctttgtggctatctaacttacaaaaatgaagttgcaggccaggcgtggtggctcacacctgtaatcccagcactttgggaggctaggcgggtggatcacctgaggtcaggagtttgagaccagcctgaccaacaaggtgaaaccccatttctactaaaaataaaaaaattagccaggcgtggcggcaggcgcctgtagtcccag

SEQ ID NO: 129609 - DNA, 1032 bp, Homo sapiens
cactgcagagcctacaccaacattgcccctgcttagaggggctggccatctcttcgtcacaggtcccagaatgcacagggctcgcctagctggaggggagggctgaaacaggaggctagggagacctccagtgagtccctgtggcctcagaagagggagcaggttggagggtgtggagagaggagggaggggagccggggaaggggagcttggccggagcccctcctcgggcttcttcgcaccagcccctgagggctgccgagcaaggaaagggaggtataggcagagcccttaccgtcggatcaacccaccgggggccctggcttacaggataaagcccatgttcctcagtgtttcacagtgcgccagatccaagcaagacctcctcaggcaaaattgccataccaaatcaaacgagctccagtacacccgagccctggaaattcatctctgcccagcctgtgctggggctggggaccacacagccacccctgcggtggtggaacagggtcttagtccctttgggctgctcacagttatggagactgggaagtccaggatccaggcccccacagactcagtgtctgccaagagcctgttcctcatagatggcgccttccatatgtcctcacagagaagggaaggggcaagcagactctcaggctacttttataagatcactaatcctagtctctgtgtgtcctagtcccctccctcccccccaccttttgatttttgttttttgtttgctttttattttttgagacaaggtcttgctcagttgccccagctggagtagattgacgctgtcatagctcactgcagccttgaactcctgggctcaagcgatcctcccacctcagcttcccaagtagctggaactacaggcatgtgccaccatgcttggctattatttttaaaatttttttgtggagacagaatcttgccatgttgcgtaggctggtgtcaaactcctggcctcaattgatcctccagcctcagcctctcaaaatgctgagatcacaggcataa

SEQ ID NO: 129610 - DNA, 1228 bp, Homo sapiens
ggagttcgagaccaaccgaccaacatggtgaaaccccatctttactaaaaatacaaaataattagccgggtgttggtggtgtgcacctgtaatcccagctactcaggaggccggggcaggagaatcgcttgaacctgggagcaggaggttgcagtgagccgaggtcgtgccattgcactccagcctgggtgacagtgagactttgtctcaaaaaaaaaaacaaaaaacaaaaaaaaaacaaactaggcataaactcatgaggtcaggagatcaagaccatcctggctactaaaccccatctctactaaacccatctctactaaaaatacaaaaaattagccaggcatggtggcgggcccatctactcaggaggctgaggcaggagaatggtgtgaacccgggaggtggagcttgcagtgagccaagatcgtgccattgcactctagcctgggcgacagagcgagactccatttccaaaaaaaacacactaggcgtaaacaagaatgaagacctggaaccgtagagaaaatactagaaacccctcgtatcacgttgtgcctgaggacaataataaagtagtttactaggcatcagacattcctcagcagtgctgtgggtcacgggcgtgaagcggagctcgaggcaggattgcttgtgttgctgcatgtcctgtctgctgttttagcccgtgtcagtagatggggccattgtactgtttgttctgcacacttggcggagcagcagaggctctcagcacgccttttccctttgtagtattttctgagctaaggaaagtcaggcagaagtagttcataagaaggcatcactgcctgtgatcggggctgcatttagccctgacctgataatggtaggagagttcatttagcctttctgctgcgaagattgtaaatagattaaagaaaacagctgtggccttctcccgtcatacatcattagactgtgtaaactaacattttagaacctctaatattggacttaaaaccaatttctgtcgtgcttaattgaaaatcacaactaaaccaataaaccattattaaatttccattctgcagcagaaggcacctctggacggctcccggcttgtagtttaatgaagtatgtgctccctgctgttaacccgcagccctccccaactctccagcagctttgccaagtcagcctccgggccatctggctgtccttggccaaggcactgttaacggagtga

SEQ ID NO: 129611 - DNA, 1034 bp, Homo sapiens
acagtgtgcttcctaagccttaatgtgcatacccatcgcctggagctcgccttaagatgtaggttctgcctgaagcccaagttcatttagtatgtcatggttaattcagagtaaaatcaagagttagtacttgatttatgcttgttatataaagaaagagacaacttcactgtatgatcattttgtcacttttcaaaagcatttaattcccattcaattgaaaatgtttcaagaacaaacctgtttggtcattttattgatattgcacatttgtatatgaataaatttttgcaaattaaaaaaaaaaaagatgtaggttctgaaacagggtgaggtccaggatcctgcctttctaaggagctcccatgttgtgcagttgctgctggcccggggaccacattgaatgacggctctacgtcctcatgcctccagctgctgccctgtacatgtccaactgcacggagcactttacatcctctaaaaccacagtaaattgctccatttcctaaattacctcttcaagagaagactggttttgatgtcatttttaaataaaggagaagttgaatttcaaaaccaagtggaacaggaaatgatgtgacttggttgacattgattttaacatttggttcatggtgagtgttttgctttattgttaaaaactcgccactaaaagcatgacagaacattttatcaaatgatggcgtcatcctttaccgtaagtttgcccctagcaagacagctcttcctgagacgtgcttgcaggccgctatgtgggttttcccaccgcagtcatcatccgtcatctgtgaccttgctgcatttactccatgctcacaccccagcagcccgcctggctttggcatcgccctcagaggcatcaaacttcccctgctgcaatgtacaagagttagccaggaagcttgcagagtgctttggttttgttttgtttttttgacatgtcgccctggctggagtacagtggtacaatctcagctcactgcaacctccgcctcctgggttcaagcgattct

SEQ ID NO: 129612 - DNA, 1030 bp, Homo sapiens
gtttgagtttccttctagactatgtgcttcttggctacggtcttaggtgactgggactgaggctttcacagaatagagatggaggtgttcactgattgaaaacaggtctcattcttgctcttgtatcttgcttccttcccctcccagtgggctaccttgagaatggagcgaggagccaaggagaagaaccaccagctttacaagccctacaccaacggtaagatgggggtgtgatccttgtcctgagaggtccatttgaacagtgttccccagtgcttctggtgccacacacgctcttccctgcattagtgcaggatgtgtgctctgagtatgtctcacgtgctctcccccagcgtgctgcttgacagggacacattcttttgcaggaatcattgcaaaggatcccacttcactagaagaagagatcaaagagattcgtcgaagtggtagtagtaaggctctggacaacactccagagttcgagctctctgacattttctacttttgccggaaaggaatggagaccattatggatgatgaggtgacaaagagattctcagcagaagaactggagtcctggaacctgctgagcagaaccaattataacttccagtacatcagccttcggctcacggtcctgtgggggttaggagtgctgattcggtactgctttctgctgccgctcaggtgaggcagggcctgcgggagtggggctcgctgctgccaccccacgtggtgcacagcccacctgcctgctctgctgtgtattcccgttttagaaaggaggagggaatgactgtcgttagccaggccacgtgactctttggagggatacactggtgattctcctttagaggcccttggattctctgcatatcagacagaaatagttggatttcttaaagacagcttgcttctctagatgacagcaaacacagggacagggaacattgtgtgctttctgccactccttcctggacatggctcattctttcctgaagcttgcctctcaggtacaggggcagtattg

SEQ ID NO: 129613 - DNA, 2001 bp, Homo sapiens
gagcatttgactgtgtggataaagtgatgagacaatacagtttttaaaatggtttgaaatgtagggaggttttgtctgtttgtgtgaagaatattttgctccctttgggaagttctggggtttagaaacctttcttctgcctgggcgggtgaggaggttggcctctggccttggacctgcctctggatgttgactgggggaacggagttcagcccgcctgtggtctgcggatgccggattctaggctgtgaattctccacccactgatttgggtggatgtaagtgagtctccctgtcccctctttctctcctcatgtgtgaacataaaggtgctcatgcatcacaggactttcctgtaggtgctgatgtctatacaagcactttgctgttataaaggactgctgagctgttgaagtcagtaactctttctgtcttcctgtatgtaaaataaaacccagaatccttgtcctgttattgcaggtttaaggagttcatgagtaaacatgttcacttaatgtgttaccggatctgcgtgcgagcgctgacagccatcatcacctaccatgacaggtgagagcgctttgtattgataggaagggagatggcgctgcaggaaacaccacccacctatacttagccaaatgggaagacacttctgagcttttagttagagcagatgaagcatgtgaggtgagaggtgtgttacatgaactgtttcacactaattttggttgctttgcatacattttaaacccagggaaaacagaccaagaaatggtggcatctgtgtggccaatcatacctcaccgatcgatgtgatcatcttggccagcgatggctattatgccatggtaagagctctttccggtgcgttcttgaggcaagacttcctgctttagagtggtcagggctaggaggctcctggacccttcacataaacacatttatgcgtgggccaggcccccaccttactgtcactgtgggggctctgtgggactgtgataggagataccctgggcagagtgattggtgagtgtggctggagaggatgccaagggcagtcaggcagaccagcaggggcagagggagttgctggcaaggactgtgtccagggcatctgagaatctgcccagggaggggcagttttacacagggaattgcgctactttagtattttagtattttgtcttaggggtttcagttatgtttttaattacctatttctagtattactgattaaaaggagaagtttaagatttggggagtcttggtagtggtttcttggcagtgagcaaccttcagccggcaagcgttagaagtgagaagttggactgcttattttgtgagatgtggttcttcctagagtggggagattcgtgtgaagatggcttcactactaatgagtcctgtgcctgcgcttaggtgggtcaagtgcacgggggactcatgggtgtgattcagagagccatggtgaaggcctgcccacacgtctggtttgagcgctcggaagtgaaggatcgccacctggtggctaagaggtaatggacagaacactgctgttctgcttggccagttagaatgctgaaaaggtttcagggtagttatccctccacagtgcagttacgtgccttctatcataagcctatactgctttcataataattttttcctaaaacatgaaattttaaaagtggccgggtgtggtggctcatgcctgtaatcccagcagtttgggaggccgaggtgggcggatcacttgaggtcaggagtttgagactagcctgaccaacatggtgaaaatacaaaatactaaaaatgcaaaaattattgacgggcatctgtaatcccagctactagggagactgaggcaggagaatagtttgaaccagggtgacagaggttgcagtgagctgagatcgcgccattgcattccagcctgggcgatagaatgagactctgtcttaaaaaaaaaagtatagaaaccctagtattatttaccaa

SEQ ID NO: 129614 - DNA, 1047 bp, Homo sapiens
aaagttggtgtttgtgtaagaaaatatctttatttgggggaggtacactagatgaatgacaggatgctgagaggggacaggtggagcaagtgggaaacgttggcggtggttgaatcagggaatgggtacatgggagtgcatgatccttttctccctggttttggagatgtttgaaaactttatatacctatgagtaagacctgaaactaatcaaggagggaagacatttgcttgaggcaggctgtcaggggagccttccttactgatctgtagcagaggccgggttcctcgggggagatcagtgttgctcacagtcagaaccggccacatggagaggggcttccacagtactcatgcaaggtcagggagcagcaccccagtaccagcacggcccagtggagtcactcacagcagtcactgtggactcgcaaacgttgtgagaactactcatgtcttacctccagctttccattgttttcagtatgaccctcaatttggcgatgccttctggaacagcagcaaatacgggatggtgacgtacctgctgcgaatgatgaccagctgggccattgtctgcagcgtgtggtacctgcctcccatgactagagaggtgagtgcctgccccaggcaggtctgcgcctgctctgtgtaacgtcaagccggggctgagtggtctcatttgttctttcttacaggcagatgaagatgctgtccagtttgcgaatagggtgaaatctgccattgccaggcagggaggacttgtggacctgctgtggtaagtttagagccaggccttttcagctgagtttctgcagcagatgctgtgtcattgacttcacttacatgtcattccccgtggtgtggagaattaaacttgtcagctctagagagagcagtttgactctccccgaattccaacccagaagtgccctgtgcttccttgaccttggggaacctggatcagggatgcctggactgaggcagttgattctgtgtacctttctggggtttgaaccagtcttccaggacacctggacagtgcccatc

SEQ ID NO: 129615 - DNA, 1058 bp, Homo sapiens
cgctgtgcgggctgagtggttggggagatgtggccatggtcttgtgctagagatggcggtacaagagtctgttatgcaagcccgtgtgccagggatgtgctgggggcggccacccgctctccaggaaaggcacagctgaggcactgtggctggcttcggcctcaacatcgcccccagccttggagctctgcagacatgataggaaggaaactgtcatctgcaggggctttcagcaaaatgaagggttagatttttatgctgctgctgatggggttactaaagggaggggaagaggccaggtgggccgctgactgggccatggggagaacgtgtgttcgtactccaggctaaccctgaactccccatgtgatgcgcgctttgttgaatgtgtgtctcggtttccccatctgtaatatgagtcggggggaatggtggtgattcctacctcacagggctgttgtggggattaaagtgctgcgggtgagtgaaggacacatcacgttcagtgtttcaagtacaggcccacaaaacggggcacggcaggcctgagctcagagctgctgcactgggctttggatttgttcttgtgagtaaataaaactggctggtgaatgaactgggggacttctccctttactttctcccctggctgtggccctgagtagcaggcttctcgtgaggattcccgttctcttctgggagcatggccctggggctgcggagaagccaactgactgctggagcgaggaaccctgcagctcagaaggtgaacagctcgtctcagatgcttgcagatctttggttaatttagaatttccagcacagacgtggatttctccagagacggggtgtgtgcgggtcgctgatgtgaggcctaggggaagcaatgagtaaactccagggtgggggaggagcaagggcccggggagggctgcagaggggccggggcggggcagggcctgtgctgcatggtggcttctgcaggggagggacaggggagggctgcagaggggcagggtgggcagggcatgtgctgcatggcagcttctgcacagcca

SEQ ID NO: 129616 - DNA, 1021 bp, Homo sapiens
taatggtcttttgataaataatcacttgtaagtcaataaatttttattaaacagtgtggctctttgatttattaaaatccgaccgtgtttgtctgggagaaaagggatgccgaattgaagtggaggttttcatacatcttcctgacgcggagcagtcaccacacactccagagaaaaacaattgcattttaacagaaacaaaacggccgagtttggaacttgggcccaggcaaactttatctccgtcagcctgaggcttactctgcagggatcagctgcaggctggagggcgccgagttgagaactttgtgttggcctccaagagtgcccaggtgccagggctggatgcctctgctgggctgcgttctgagatggcacgtaccggccctctcccagctggggatgcaccctggggcaggcaccctttgtcagcagacatctgtcatcaacaagagaagctcgtgtggcaggaccctttagcttccttcctggccaaatcgccaccagagtcacctgtggcaggaagatgtggcaggagacagtcttttgcagcaatcgggctgtgtggattatttcttacagtgtgggccaatagctgaagactggaaatgcctttttgtgagattttcattggcatagagtttgctgtaaagagtttggcactttatcgagacaaatatggccccaaacagatggtcttacatagatcaacccaaccactgacgatacaaccagaattcttacccaggggaagttgtaggaaagggaaaacacttttttttttattgatcattcttgggtgtttcttgcagagggggatttggcagggtcataggacaatagtggagggaaggtcagcagataaacaagtgaacgaaggtctctggttttcctaggcagaggaccctgcggccttccgcagtgtttgtgtccctgggtacttgagattagggagtggtgatgactcttaatgagcatgctgccttcgagcatctgtttaacaaagcacatcttgcactgc

SEQ ID NO: 129617 - DNA, 1118 bp, Homo sapiens
ctacgagtccaggggttaatggcgactgggggagagggcggaggtgcagggtgcccgggaggaggcccctcctcgtcctctgccccccggggcctggcgggtgccgggaggtggctggggaggacccgtactcactgttgctgcactgccgcccgcctcgccagtcttggcccgtgtccgcccagcagttccgggtccgggtcgggtactcgttcccagccttggaaaaattccctacctgggggctgtagtagaccccctgcgagctgagccccccaaagcctgccacgtgggggtagccggagaggaggctgttgttcggcgcagccacgggcctgctcaggatgtccgtgatcccgtggggggttccggcggccagctgggggcccagccctggggggctgagcttgtagaaggagttctgcacagagtactggcacaccggggccttcatctccggaaactgagccagcggcgtgttgttcagcaggaacgtcccctgcaggttggactccatgatctcccagtcaggacagggaaggcttctccaggcccctaaaacccaagagcccactctctagccccaaatctcatggcaggcctggaggcttaggaccgtctccgagctcctgactgcctcccacctaaggcatgggccaggccctggcccaggaaccggcacccgatcagctgctcggaagtcaggtgctcggggcaggtgggaggcctccccagggctcctggcctctctccttgccctggccggacagggtggccccctaagcctcagctcagaccccctttctgcctctgagtcgggggaccctccatgagaagttttaagttcagagaaggaacatttccctgataaagatacggcccattagaatacaggccggagactggctgagccgccggagccgcgccgccattggtcggggcgcacacgggcctcacattggcttttcctagacaaattgcactttgaaagattgactgtacaatcagccagggtgtgtgtgtgtgtgtgtgcgcgcgcgcgcgcgcgcgcgcgtgtgtgtgtgtgtgtatgcgcgcgcgcgcgagagagagacagagaattagctctagaagcccta

SEQ ID NO: 129618 - DNA, 1044 bp, Homo sapiens
ggctggggcagcctgaaggtgttgttgaaagatctttgctttacttgtttgcatctaattttgtttatttctttaccaataaagatgctttctcctcaggggcattatgactgtgacctgggtggagcctgtctacagggtccccaaggttctctcagggctcaggggcaacacccagggctgcctgtagacgcccctccagccctgactcctacagggagcccccctctgagatgttcctaattcctagcccctggcaagacgcgagctcctcctcttctttcagagtctgtggtggctgctctgaaaagcatttaagagcctggaaggggagatgggctgtgcctcgaccacaaaccgcgccaaaaggaacctgctacaagatacaatgctttggaaactcgggaggaggagagaaaactgcatcggagggaatcaagggacgatctgcagggaggtgcctttaagttggctgtaaggggcactccagagtacagggagaagagacgcgggagggttcccaggcggagagtaccgctgatgacaacgctgcccgacagtgcggaaagcatgaggtcagctcggaccctcggctaccaagtggacccagaagggccgagcaaggctccgccagggtgtttaaagggtctggaaagcaccgaggagcaatggacggctctgagcgggaggacccttgcagtgagtgatctggaaaggaaggaagcctggagaccgcaagatcaattcggcaactcctgcgggaaggcccaggcccggaagtgatggagaccctcagggatgcgcagcgagcaggggcagcagtggttgggactggagtgaccacacccacaagaggggaaggtcggaccccagccaggcctcatctaagaaccatgcaggcaggagcgcatttcatccccatagttatcccgtgaggtcactacaggctacagataaggacactgaggcacagagagattgatttactcacctctccgtagctagacagctgcggactagggcaggaagccaggcaagctggcc

SEQ ID NO: 129619 - DNA, 3345 bp, Homo sapiens
ccgcctataatgtcaattccatgaatatgaacaccttgaatgccatgaacagctatcgaatgacacagcccatgatgaacagcagttaccatagtaaccctgcctacatgaaccagacagcacagtatcctatgcagatgcagatgggaatgatggggagccaggcctatacccagcagcctatgcagcctaaccctcatgggaacatgatgtacacaggcccctcccatcacagctacatgaacgctgctggcgtgcccaagcagtcactcaacggaccttacatgagaagatgagcaagatgaacttgcaatcaaaaacttaaatatatataaataaaggaaccttttatactgacaaaccagagaaaaatggacctttttccagttaaaatattgctgtagatttagaggaatttttctttggtttattttattttttagaaaacctgatcttctctttttttgggttcattttgttctgggttttggttttcttcacaatcttgaacattttacagtagaactcatctaaaaatggatttggggatggggaaacatgcacaaaatcttttcataattaaaaagagccttactttctttacataccacatggacagaatttgtgtaaaagtgaattatctttattttaaaatgtatgtttcccctcactgtttgcagctcccaatgttgtcatttttaaatgttatatacatctcaagggttaaccagaccctttcctccaaacccaacctttcatttcctacttcattccagcaggaggcacttaggggagactcggatggggacatggagaacaacccaagctccttaaacttattattattgttaatattattattattattattaataaagtgaggcaggaaaatgcttctccttttaaaatcccctccactcctcacacacacacacctcttgaaacccttccccaagaatgtttctttatagacggacttcattgaaatctttgttgttcttgaatcaagtgtaatataatttttttcttcttttttaaaatattcccactcagcactcagagacacaaaaatactgtaagtctcaattaacagcagaatctcagagaaaagctgtttgcaatccaaatccagcctttggaggaatagagatggtcaattaacaatcaaaaagaggagattaacctcttgtttttttaccacctggtgaatcagccataacgcacacacacgccacccagcctcttgtttctagtatgtactttgaaatgctaactgagggtcttgatgcttgagcctttgactgataaaactcaaatagcagtccccagtgatttgcctcttaggttctttcttaaattgttggtggatgactgtacattttagtgatttgaaaaataactgacaaaccattgaaacagtttattttatgttggaagagatggcgcagatgtgtgtcagaagggagatcacggtgtgagtttcgtagctatttaagtgatacatacctctagtttttgtatgtcttttgagatcctgagttcatcccctgtgaatcagagtgcacaagcacctctcctgtgagtggctaatgagaagagggacagaccgaccaccagcacagtagggcagatctggacagcagaatgttataacgcaagttcatgtgttgctcccaactccattctcttttctctcgtgcaaccagtttgcccattctcttcctattacttgctccagggataggtaaaaaaaaaaaaaaaaaaaaaaaaaatatatatatatatatatacacacacacacacacacacacacacacatatatatatatatatattccatcattagaagatggaaactattataccacttggtatgtgcagtcaaatatccaaaagggggaagtactgcttagagaaatatctgtaagcattaaattctctcctttatttgtacattttatatagataaatttttaaagtactaattaggcattaacttttttcaaatgcacaggtttgttggtttttttaatacactttaattgactttctcaagcgtgctaggtagaaacgcagaattccacatcttcccgctctcagctctgagcatgtgcaaggctgtgtaggacccagtttctctgtatatactattccagttcccagtcatctatgtagaaagtgcactgtgctgccatcgccctacatcttcagctgtgtcattgcttcctggttggggtggggacggggtgggtcgggagggaggtatattgggaggagggtgggtcaaggcagaaggagaagctgttgaaatgagggccgtgaaatcagtttctgttggtttgcggttgtgtttggttttgtttgtttctttataaaaaattcaatcgggcagctcccttttccacaagcctctttgtgactgtagaactattgtagaaaaaaaaagttcttttctatattataaaagaaattatccaacacagtaatattggtacctgtcattttttcacttctgtttaaaaaaaatgtatttttagcaagataacttgggtaatcttctaaaaaagaaatttaaaaactcactgttagtgactttgatgccttttaaaataagagctttttcatttcattccatctttaaaattttttatctttgttgtagaatattaaaaactattttaagaaagataaattctctttaaagagatctctagcgtgtgtgaatagagctccagatgcctctaaaagccgcatgtacaaaggaagccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttggatgtctgtcttgcatgtggaatttttctcccttcccagtatgtcagaactcttcaattcttgttctacacccagagacctataaacattagtcttttcattttcctctttattataggagtacaagtccatggcctttgctttgaaattccagttttcatttatgtctgtgtttaaatgccaacaatatggatgggttttccatttccaaggaacatggcacggtaaccctactttggattttgtaggggcattcatataaaaacctcctaaagggattttaattcccgtcccccccactcccctaaaaaaaagcaattgcaat

SEQ ID NO: 129620 - DNA, 1147 bp, Homo sapiens
attcctaaagctggacgtaaacccaagatccaggagagtgaagaaactgttgagccaaaagaagacatgcccctacccgaggagaggaaggaggaggaggagatgcaagcagaggcagaagaggctgaagagggtgaggaagaggatgcagccagcagtgaagtcccagcagcctctccagcagacagcagcaatagtcctgagaccgaaaccaaggagcctgaggtggaggaggaagaagagaagccccgtgtctcagaggagcagaggcagtcagaggaggagcagcaggaattagaggagccagagccagaggaggaggaagatgcagctgcagagactgcccagaatgacgaccacgacgctgatgatgaggatgatggccacctggagtccacaaagaaaaaggagctagaggaacagcccacgagggaagatgtcaaggaggagcctggtgttcaagagtcttttttagatgctaatatgcagaagagtagggaaaagataaaggataaagaggaaaccgagctggattccgaagaggagcagccttcccatgacacgtccgtggtgtcagagcagatggctgggtctgaggacgaccacgaagaagactcccacactaaggaagagttaatcgaattaaaagaggaggaagagattcctcatagtgagctggatctggaaactgtacaggcagtgcagtctttgactcaagaagaaagcagtgagcatgagggcgcctaccaggactgtgaggaaactcttgcggcgtgtcagaccctgcagagttacacccaggctgacgaggaccctcagatgtccatggttgaagactgtcatgcgtcagaacataatagccctatctcctccgttcagtctcaccccagccagtcagtccgttcggtcagcagtcccaacgtgcctgcccttgagagtggctacacccagatcagcccagaacaaggatccctgtccgcaccctctatgcagaacatggagaccagccccatgatggatgtgccttccgtatcagaccactctcagcaggtggtggacagcggcttcagtgacctgggcagcattgagagcaccactgaaaactatgagaacccaagcagttacgactccacgatgggcggcagca

SEQ ID NO: 129621 - DNA, 1056 bp, Homo sapiens
gaagattctgactccgagaggccaatgccaagattagaacccacgtttgagatcgatgaagaagaggaggaagaggatgaaaatgaacttttccctagagaatacttccgtcgtttgtcttcgcaggatgtactcaggtgtcagtcctcttctaagaggaagtctaaagatgaagaagaagatgaagagtcagatgatgctgatggtatgttttacagaactcacttactgtggtttattgtcttcagatatatagcagtagcagtgacagacccttcagtaaaaaggctgaaaaatgaacacaacccactaagcaagaaaaggaacgtttggcaatctctaaaaagttgtatcaagtatatccatcttgatttttaaatgtgttttcccttcaactcagaacctctattaatttgcctctgcagaaaatatcttactattaggcaactgttcttttttgcccaatcctttctaagcctttatcagaatctttagttaatgggagagttggacttagcatcaggaagatgtaataacccttcactagaatgtgcattctctagacttagtctgttttgctcattgctgtatgctgagtgcttaagcccggcgctcagtaagtagtgttaaatgagtgaatgctaagaagacaattctccagaaagagcagattcatgtaaattggaacttgtgtcacatctgttcaggagtctttcctgaattgtatctctaatgtgtcttacccaactagtagtaaatttctcacaaatggtaacaataactcaaaataaattttatagtatagatacaaatccaactatttacttttaaagcagcctagttgtcatttcttctctagagacactgaaactaggtctcatatatatgagccaggtcagaaacaagtctttttcaccctagcctaaagttttgccagtgtctcatgctgcctgcatctgcagtgtgtttatctcgcatgggctcagaatgagcatttttactttgttgggcaaatttgaagaaatctacttgtccagtcttggtacataaaccttt

SEQ ID NO: 129622 - DNA, 1082 bp, Homo sapiens
tccatgttaaataactgatcattttctttttaaagctcagtttccttttcttctctcaatacttaaaaggtcagaataggtaaatgtaagcaaacaagactgaaaaattaaccagcattgttttattttctaaaatcaggtgggaaagtctgtgtctcatgagaacaaagaacaagattcttattcagtagaaagtgaaaagaaaccagaagttatggctccagtcagttctacacgtttgagcaaacaagtccttcctcatgatagtcttcctgcaaatagccagccatctcggaggggccgctgggggaggaagaacagaaaaacccaggaacgttttggtgataaagattctaaactgctcttggaagagacgtcttcagctcctcaggaacaatatggagaatgtggggagaaatcagaagccacccaggaacaatacactgaaagtgaagaacagctggtggcttctgaggagcagccaagccaggacgggaaacctgaccttcccaagagaagactcagtgagggggttgagccctggcgaggacagctcaagaaaagccctgaggctctgaagtgcagattaacagaaggaagtgagaggctgccccgtcgctacagtgagggtgacagggctgtcctcaggggcttcagtgagagcagcgaggaggaggaggagccggaaagccctcggtcaagctcgccaccaattctcacaaagcccacgctgaagcgaaaggtaacgcatttctttccaggtcttctcttcctccaattccagtttatcttacaccttctcgttttagcttacagttctgaaagagtataagttagaaattcctagtgcattgctttataaaccttaagcctctgtatattgtagctcaagatcttcccagtgaacatttgagatgtgtgtgtgtgtttgacttctttgattcatgggaattcacttagaaatcataagcttatttaagggcttcacctcctgggatgcaaacaaacttttttttagcttactggtttgatgttcaaatcatgacttttaggggcttaaagccctaaaatatctttaaaag

SEQ ID NO: 129623 - DNA, 2652 bp, Homo sapiens
aaaattgtttaatctgagttcaaaagtgatagctcacagttctaaagagatcattgtgggatctgtgtaatttgagggaatattttacctcagatattgctatacaatgatatttagatgaatatatgcagaactaatggttcaaacaaaggattttgattctagtcttgagatgttaattaagccttctcttagctttagactgtccttctgtccatattttattggaagcttgtgctactggttgttttacacattttctggtctttttagatgagcagtaggggatggaactcagattacttcctttaatgttaatatattgttttgaaataggactcatgattagacatgttatatatgccattaaattgcaaagttagggaaaatattttacttttggtgattgggggtgtgtgtgtatggtatacaaacagtccgtgcaataacagtattgtttgtatttacttttcctaatgtaatacgtttccaaattaacattcttagactgcttttatgttttctttaatgacagtaaaaatacctttctctgccatctccattttcgttgcttttccttagaagttaggcctttgtttttcagttcttgagagttgtgcactatagaggacagagtccacagttccacacttatattggcagtcctgcttgcctagagttagaatgataggtaattgtgaggagttttggttgaagtgaaagattgtcatctaattcactgacagaactacaattttaataggattatgtgaaaatgaaggcattcttttgtacttctcagttcagatacagcagttgccatctagtggtccaaataaagcatgcaaggcttgttttccccaggacgttgaacgaaactgttaacagtcctgatttttaacacttcgaatattttaacaaggtgattgatattaactgtagacataataatactaacttagtcttcaatatatataaattatgtattctttctgcagatttgttttgaagtagttttgcaatttgtttctctctttttttttttggaaggaatttacctttggagttattcttggttgtagaagaggggattgttattttggtgaatccagtttttcagagttgctgacctagttctgatttgagttatttgtgattctttaggttatttgttatcaaagcgtgaaggccaagcagggtctccagagaaaccgttatctgatctgggtcgtctttcctacatggcatattggaaaagtgtaatattggagtgcctttatcaccaaaatgacaagcagatcagcattaagaagttaagcaagttgactggaatctgccctcaagacatcacttccacactccaccacctacgaatgctggacttccgtagtgaccagtgagtatcacatctttttgtatacctttgaaagataattaggttgaagttttttggatcagccagtcagattattgatgaaagggcattaactaatataaatgatatacttggtgataatgagatatcattttcctttctaggatattttatttgattgactatatatatggtctatatatagtctatatatatgctttttaaactgaattgtttttctgatacccctaatttttggacctaagctactgaatctttcatcttctagtattgggagctctttcacaatacaagaagtaaccactctagaaacagtcattaaataaaatgcccatgttaaattttcatataaatggcacaaagtaaatatagattgaaaggaagaacagacagttcacccttcactaaagtggtcagaaaaaggtcacaaagaaaggaggcatttgagccaaataaatggagaataggaaagagagtgcagaagagcagcagaacttctggagcgggacgtgtgagacagcaggcagtgaaaacagcccgcggccacggtagagagcgaagcatttgtcctgcttcacactcctggccgtctcatgtggtggcacatttctgcattccatcgtcccaggcaggctatctttgcagcacctatcatcttacatgcttcaccaggggtctcatctccacattcatttttatgtacaccttgtacattgttgattgctataaacttttctctggttccagatttgtgattatccgccgggaaaaacttatccaggatcacatggcaaagcttcagctgaatttgcgacctgtagatgtagatccagaatgtttgcgctggactccagtcatagtgtccaactctgtggtctcagaggaggaagaagaggaggctgaggaaggagaaaacgaagagccacagtgccaggaaagagaattagagatcagtgtaagggcatgaatagtctctatttttgatgacagaagatatatttttgatttcatgagtatttataataatgtattatgatcatctttcacagaaaagtaaattcacattagaatgtcaagagttttatttcagtggtagagatttcaagaagactggacctggtttacttaagtatttttaagccttggacaattaggaggagaccatcaaatttcttataatgtgttacttgtgagaaaaatatttgttaccagggtgccaagaagcagctcagttttaagctggatagtagttgaga

SEQ ID NO: 129624 - DNA, 1545 bp, Homo sapiens
agcctcatttaccacatgattgcttgaggaacccgcttggtgcttctgcgtggcaatagttagtacccccttaagtagttttatctgggttcaagcccgatcatggtagtcagattgcattgcttcaggcagctggcatagattagactacatagttacatcttcttttacctaataaatgtattttagaagggttgtatttagatcttttgttgtgttaagtactttgaaaacgaaacttgctatctaaaggattgctacaattcatctttttattaaagcaaaaattgctcttttaaaaccagattatcacttccttatctggctgttcctgctatgttgaaggtatgaggttttatatatttggttgtcttaaaacagcagatagcataatactgccatttcaaaggatggcttccaggttccaaagtgttctggtcatggacaccttctcctagtctggactgtggatatctagagatgcttttaactgatacatattattctagaactaaagagaccctctactgactgttttgttctgtttatttctctaggttgatgggaatgtgagtaccatttattgtcaaaacctgtgtcttttggcaaagttgtttcttgaccacaaaaccctctattacgatgtggagccatttcttttttatgtactaacacagaatgatgtcaagggctgccaccttgttggctacttttctaaggtaagtatgtcagcttaaagtttgtttgaactcatatagaaatctgaaagaatctttgctggttctcactcggggacacaacaagatgcagcacctcctaggtgtcatctagctgtttggaaagaatagaaggaacatttggaaacttaccaggtgctagaaggtgcttagtaacattcaacaacctatattctcctaggattatggactgctggcaatactcacggggaaggttttaaatggcttctcttcccatggtaataacatggaacttctgaaataaacagtcattagctctctgagttctgtctcagcttcaatcttctcttccttatttgaactttaggcatagaaataagagtaagaaggcattttggttaaaggatattttctccttttttaatcttccattcccttagagggagaaagtttatttctagtcagagaacataaaagatatacttttatttaagcaagcctgtggtaaaatccaagtgtataaaacagttaggggaagtactagctttttataagcatttataagaattctttaggctacttcattagttagatgtgacttaaaatatattcactcatttataaaattataaaagtgactattttgtgtaaagttagatacaactaataggactgctctgaggagcaccagagcaggagagaaagaaaactctgacataattaatgagtcttctcacttctagagtggcacactgattcatcatttgtagctttacggattgtttgggactcagattccggtgctgatccttaggcattggcgtactgtgtttgagttgcagatggt

SEQ ID NO: 129625 - DNA, 1001 bp, Homo sapiens
ttcaaaagctgctttcaaaatgggaacttgaaaaaatggttatggtcttcacacaaatcaaacatttttgtgtgtgttaatctacttagcaaatattattttctttaattctaggatagtattttaagcataactatccaaattgatagcaactaaattaattttttcatctcagtacttaaatatgagacaagatacagtaatttatttgaattatatattttgtcattttaccgtccagtatttttgcatatgcagttttttttttaacctgttacctgggtagtaatgagaggcaaaaagatgataattgtggaagtttgaagtactctaaaatataaagccctgtcttttttgtttaattatcgtttacaggctgcccaaattgtatctttgtgaattttgtctaaaatatatgaaaagtagaactattctgcagcagcacatgaagaaatgtggttggttccatcctcctgccaatgagatttacagaaagaataatatttctgtctttgaggtaaggtagatacttagtaattgtcctctcatccatttcataagtagggccacctatattgcatctattgtgcaactttctattgtctattttatgtatcactaaaatggaaaaagtactaattataatttttaaaacttcatttgattataaaatgccagttgattttgcatatattaagatgtgataaaagtacatcttagaatctatgaaatatggcatttaaatgaaaggatttctatcacttatttaaaaggaatatctcacagagatctgtttaatagtaaatcttgatgatgatgatgatgatgatgatgatgtgtgacctctgctctgtgattctctattgctgttagtagcgctcttgatcctcagttctgtggttttcgtgccaagtattaattgagtacttgcttatgtgccgtttacttactgtaacagtaaaatttcagattgtcaggatcccctcagtctctcacttttc

SEQ ID NO: 129626 - DNA, 1015 bp, Homo sapiens
catgtttagcgaaaacgtactttggttgaaatgttaaaataaaaagacctagcaaaggtaaccttgtagttcagatatgacagtttgattttggctaggactggaatgagtggtttctgtgtagccatttcttcctccctgtgtagagagccttgctgatttctaaatcttcgtaaaaggaaacacccttgctgtggaggcttgctcaggggagctgggagtggaggcgggctcacacatgagcgcatgtgcaggaacgtttcacggtgcaaaggttaaaggcgggtgtgggcagaggggaacctaccacaggtcccattctggacagacgtgcgcagttgtggtgatgtgcaaacagctgtactggaactggatatccactttcacatcgggcatccgcctagaagagcagcgggcagctgatgggaagaccctcaaacaacagacagtgccgcagcaggtgcatgacttcagcttttgggctttctatctgatccttgcctcaggaagttagatctggtttctggtatttagttattttgaaagtttcctatactgttgttattactttgagttgtgaagatagatgaaaagatagtactttatgagttagagtagttgattctagaatgtagtttaaaaacagcctttaaaaaatctttttacaaagttctgtttgggttttgagaaatgaaagaaatcttattttaaccctgtattatgtattcttcattgtttttggttttgtatttggaggagccccagtacttggtggtgttataacacaattcatcccacaaacagatctttgtcttttgttttgaggtgtctaaggaagagcttgaggtttcatttggctacattccagtatgaaacctgagataagtcccttggccttttataaaagagaatggttagaaagaccagaaggtctctaatgagttatggtgaagaggcttctttaaacggatttatataaaaccaatgaataaaaatttcttttagttttgttata

SEQ ID NO: 129627 - DNA, 1123 bp, Homo sapiens
ggagttgaaataatagaaaggtgcaagaaggatgaccaaagagagttaaacgggttgctgagccctgctgaggctcggggagacagtgtaaatgcttattgacagtaatcgggctaatcctatgtttctttccagcatttgattaaactcagcattgtctgtgtgtgtattggcaccaaggaaataaacagctagatcttggaagtctagttcatgcttatttttgttggcagtgcactgaaattctgatgatggtgctatttctccatgaggcttattcatttagcatcatgcacctgccttggtaccagaactatagggcaaacaaaaagacacagactctgccttcatgaagcttttagtttcacaaacagacagataataaacactcataaaaataaaactgtacttacaaactgatagtcggaaggaaatgagaatgcagtgaggggttctgacgggctgggctaccttgctgagggttggggttggagtgtttatgagaagggaagacttttgaagaagtaacaatttatacatagttccaaaagagtattcaaaagtcagcagagtaaagagctagagaagaacatttcagagacaagtggattgcctatgtaaacgtctaagggtgtgaaagaggttgataaacttaaggaactgaagttcagtgtaactcaaatacagtgaacagaagagttgcataaggtgaagctggggaaatagactgaggccagaagttagaattggggtttttatcataattgcagtgggaagacattgaatggtttttagcaaggaaacagcaagatctgtttcattaaaaaatggtttttcttggctactacataaagagtggtttagaattaagcaagagtggaagctgggaaaccactttgcaggcttttccggtgatcaggatgagagaagatgttagctaggactagaggggtggtggtagaaatgggagagaagtggatggatttagatatattttggagttggaatcagcagaacttagtgatgagttttatgtgtagcttgaggaagcaagagatgatcaaagatgacttccaggttctctgacttaatttaataaagaaagtggtttgaagccacttgg

SEQ ID NO: 129628 - DNA, 1102 bp, Homo sapiens
tcatatggtgaatgttatgatgcctgcttattccaggaaggaaactggaaagaatagaactgggtgaaatgctgttgatctaagcataaaaaaaagaccaaaatatttgcagatgtgatgaggtcattgacttttctacttcagatcttgacaaatatagttgtaagtcatggattgcacttaaaaagggagagacagaaccacagctccaggctgcttatgtatcaggctaagttccctaattttcaaagtagaaaacatctgtggagaggacttaataatgtggcaaatcattcaagtcagaggagaagaatttgattaactgtccaataaattaaagcttaaaatagtcttattgctgagccttgaatttagagatactaaccctgtgaaggaagtagaaagggcttgaagaaagtagaatgagaatgaactcttttggaccacaagggccagaggtgtagtgtctcatctactacaagagaattccctgaccttggtttcctccctgaatgtctccttggtgagggagagtgtattcactgctctcattcgtggttgattgtccagtgcaggagagaaagtccttgtaattgtcagagtcccctttgtatgctttattgattggtcttttaccatagtgatgatcaactaattactctttaagcattcaagactcttcatgtctttatcaacctgtagataagttcctgatctgagcatgtttatctaagaaaatatgcaatccgtttagattaaactaggaaagaatctcagagcaaatcctaatgaaagacatttttgaattaaccatttgtactggagacggtttattagaagaatctactagaaagcttttgaaatagaaattgttagagcaagtgtatcaagtatatggagaaccaatattgaatttttgacagtggtgtgagcgtttgctttaataggctctgtcattttctttatgaattataaagtttaagtaccgaatgctgtattagagaggtgcatgcatcatgcactagggggcattaaagtcacatagtacctttagattgtacttttttcttccagtttgagaatgttgtcaacagtgagtcct

SEQ ID NO: 129629 - DNA, 1079 bp, Homo sapiens
tagggtcttctctatagtgtaggattcacttgttttctctatgaaaaaaattccattgtcatatctggcacttttatataataataatggctaacacttattcagcccttaataagtgccagacactattctaagtgctttatatgcattgaattgtttaattctgccaacaacccagtgaaatatagctgctgctgttactttcatttttcaaaggaagaaactaaggcatagtaaatgttgaactgggatgaaaatccgagtagtctggcaccaaagtctgactcttaaccattgctttatgttgcttctcttatataaaaacaggaaagaaaaagttgttactgtgacatttcacatgtcactctcctgatcttgtctcagttgttaatatctattaggtgtacaaatcactggataggttcttcctattgaggtgatggctaagtcccatttttgtgttctttggatgtaaaataatttgaatgttttcatctattagcagaaatcagaaattgtggactagaaagctgggctatgtctggaggaggtggggcaagattcagtagctagttttgtctttttaaaaatgtctgtagtaactcacctttgatgatatgtaaacgtcttcaggcttgtcaacctccctttattatcaaaagttttacttactttttttacacgtaagactatcttgaaggtgatataactgaaatgaatgggcattagcagcctgaaatgtacagaaccaatattgtagtctatattcaaaatcttaaatcaagctttgattttcctataaaatgatcttttgattcctggccttcgaagaataacccatccttgtgttttagagataaaagtataactttcagttggtgcagagatcacagtgtagtagaactttatacctggaaggatcttagttgttcttagtccagttctcattttacagatgaaggcactgacatatgtttagaaaaaatgtgatttgtccaagtcgtacagctagtaagagagaattatgactagaacaagtcttctgactcctggcctgtcattctttgcactataagtag

SEQ ID NO: 129630 - DNA, 1081 bp, Homo sapiens
tgctttaagcattggccttaccagactgcacacctaagtctatgctacttatactacctctattgccttctctccatcactcttaggaggaacatagattaaacaaaccactcttaacatttgttagctactgtccttggacaagtttctaaagatcccaaaacataatactgatgcttagtacatgttgttttcccctttcaacctttcccttcctccacaccacagttggaatttctttttcgtactgctagaaaacacttactgtttctctcacttaatgtcttctgccgaggagtcactgtgtctgtttacttgtatatatcttactgctcttgtactagatcacatgctttttcagcgcttacactgtgtcttcttgaacttattccagttgaatttttcaatcttaagggtttgctttttaaaatccacactgtatcatttaggttctaagtgatgaacatgactgggataggattttttggagtaaagtttctaaatggtcataacaaggaccagttgtaaaggcccagccagagcaggctttgtaaaaactcacctacttagctggaatttaggagagtaatacaattgtcctaaacttactctggtaggaatttaaaactataattttgatgtctttgtagtaatactaaataaaagtattagtactggaatgaattgtgtttttcttcacagccggttgctgaaccaatccccatctgtagtttctgtcttggtacaaaagaacaaaaccgagaaaagaagccagaggaactcatctcctgtgccgactgtggcaacagtggtatgtgatttccttctgtttttcttctaaaatgtgttacgaaggcaagcggaaagtatgttgacttgagtttgtatccttgatccttatgagattaatacagtcatacatcttttaattatgggggataagttctgagaaacatgtctttagaaggtttcatcatcgtgtgaacatcatcgagtgttctgacacaaaccaagagggatggcctactacacatctgggttatgtggtgtagtctgttgctcataggctcaaacccgtaca

SEQ ID NO: 129631 - DNA, 1053 bp, Homo sapiens
catccctattaaagttttgtaatggctaatgggttatgttggaattgattaaaattatagaaagttatatactataagtaatggaaattataggtcttttcccaggccattcattttttttttaattattataaatcttttgcaggtgtgtacttttgagaacagcttatccttaaaaatgtttaataagcagccatagagtacttgatagtatatgggatgctgaagaatttaaagagattaaagtccacccagatatagtttccttgaagatatagaatctaggaggaaaggctctgagtaagtaatgataaatggagctaagcatggtttcattgcattttaatttcaacaaacgcttacttagtatatactaagtgcaaggcataggtgaattaagtggtgatatctgctcacctaggatatcagtttggaaaaggtggctaaaaatggaattcaaaactgtcagaaaggatttggtcagagcatgagttcatcaaaggctattattagtgaaagaatgaaaaacttggtaaaattgacatgaagagcttgcctgagtggaagagaaccatacgttttagaacattcagctttctcaaagtatgaacactttccaacaaaggatgagtttcctaaagggaatatgtgtgcagtttgttactcttatgatattggaaataacgaattttgcagagattcttccagaaggcttacttttttggtgtgtgagtgaaaatatgaatggtacttaattggtttctaattgttttgtgtggattttgtctttgaattgactgacatttataagtgctttgaaaatgtgagtacaaccttttctttgattgattcaaatttttatgttatgttaaaatgcccaccaaggagtaacatttactagacttcttactgtgtattgggttatattttgacaacctagcaatactcgttttcctcatgcccagtcattgagcatcattttggtttccttcactataccatgcctgaaaatagtccaattttccacccttctaagcttaagacttaactcct

SEQ ID NO: 129632 - DNA, 1031 bp, Homo sapiens
attgaattaaagaaggtaatgtaggatcttgaaagttggggttcttattttcaagattttttataaagttgagtatctagactgcaaaatgtgtcagtggttttagagggaagaattagcttttcattctttgcagagtctggtgagagtgcttgaatccatgtctaaaaaaagggctttgcttactaaagctttatgtagttacttaaaaaataagtgtgctcctacttctttttttcctgaatccttcaggcttatacagtttaggaaccattaatttgaatcagttatttgggcaacttacctgtaatattttcattatgtttgttacttagcatatgctatcctgtattgtaatgttaatgcacacgtcttaattttacaactagatcataagacccagcagcagggagctagttttattatatatttgtttctctagcacctaactaaatatccttatacacaataaatactaaagataatggtctgtgtaggtaacattgaggatatgaatagtatgaggtgatttcactagctgactactagtatgctagggctgttattacagaataccgtagactaaatggcttaagcaacagaaatttgttttcttacaattctggaaactggaagttgcaaatcaaggcaccggcaaggttatcctctctccttgtcttgcagatggtcacctttttgctgtgtccacacgagcttttctctgcgagtacactcctgatttctctttctcttataaggataccagtcctattggattagggccccagctttatgatctatttaacctcaattacctctgttaaaggccttctctccaaatagagtcacattgaggaattagggcttcaccatatgaatttttcagggagcaaaatttagcctgtaacaatgacctcctgaagataggtaggtatgccaagttgctaagatattaaatagaatccacactagatacttcagtaaagaaaatgatgtatagggaattgataaagcagatgctggagaactga

SEQ ID NO: 129633 - DNA, 1141 bp, Homo sapiens
gctaattttttgtatttttagtagagacggggtttcaccatgttagtcagggtgttctcaatctcctgacctcgtgatccacccgctttggcctcccaaagccctgggattacaggcttgagccactgcgcccggccaacaataaaaattttaatgaactttctagtcctagtcccaggagaaacctttgctgtgttttaaagttaactcaacttcatctctcattctctagactcctcagcccttaaaagctcagtttagtgccttatagaactcagtccacacatttcttaagtaactgctctggaccagtcactgtcttacataatttactaattcatttatgattatctttaactagataatgaggtccttgaaagtaagaaaccctgttttatactataattttagaaattaagaactgaaagagactttagagctagtcatgtcaaatattttcattttacaaatgaagaacccaggcaggttaagtcagttccccatatttggagaattaggattaaagaactagcctttcatcagactatctactttattggttgattgttaaattaatctgaaggaagttctcagcactactctatgttgaggattctatattgtctatataaactgtgtcattgtagaataataaagttatttataactcctgatttcagcacacggtatttcctatttgtttcttatgacgtgttcttaggggcaaattgcatgatagttttggagatacagtattatgaaaaaggcatttttggttttagattagagtaagttgactgatttttttttttttttttttttgagatggagtcttgctctgtcatccaggctggagtgcagtggcatgatcttgactcactgcaacctctgcctcccgggttcaagtgattcttgtgcctcagcctcccaagtagctgggattacaggtgtgcatcaccatgcccagctaatttttgtatttttagtagaaacagggtttcaccacgttggccagtctggtctcgaactcctgacctcaggtgatccgcccacctcggcctcctaaagtgctgggattacaggcatgacactgtgcccagtcaactgatttcttaggttaaataaatactcctggtttata

SEQ ID NO: 129634 - DNA, 1198 bp, Homo sapiens
cacccattagtcgtctcagggtcacatgtcaccttttccatgaagatacttgttatggtcttttatgtagggtgtttttttctttttaaacttacatactagattatctgcacctagcacagtggtgctgtatatggttgttcagcaagaatccagttcctgtgaagtttcctaagataacagcataagataatatttaaaatttttattttcatataaactaatagcattaccttttaatattttacttcagattactttatggttcctgttcttttattcaagttctgcagatctagttactgttatccccattttatggtcaaggaaagagacacattgtagttaactaactgattttctctctgatgtagctagttatttatatgcaatgttctcactaatgtattttccgcaacgaattaaactaaaacttgagagcgtgatattaaaaggtgaatgatgatatgtgatttgagacacttggtatgaaagccagccttgtacaggggtgctgtgtatgcagagtcatttactgtagagtttacattaaaaattgattttcaaggtaaaaaattgctctcttcatcttttatattgctttattcaccaacttttaaattacaattttaaaatgtcttctatatatagactttctagaactaaaccagtacagttgccattaggtgcatgtagctatttaaatttaaattaattaaagttaaagtaatgataaccactagcacatttcaagtacccactagctcacatgtggctagtggttacagtattggacaacagagatatagaacatttcatcatcccagaaagttctactagatggcactgttcttgagaacagtgttaaaaaaatgtcactcgaggggccaggcgcagtgtctcatgcctgtaatcccagcactttggaaggccaaggcagaggcaggcggatcacttgaggtcaggagttcgagaccagcctgggcaacgtgaaaccccgtctctactcaaaaaatatataaaacttagctgggtgtggtggtgcacgcctgtaatcccagctacttgggaggatgaggcaggagaatcgcttgaacccaggaggcagaggttgcagtgagccaagattgtgccactgcactccagcctgggcgacagagtgagaccctgtctcaaaaaaagaaaatattacttaagg

SEQ ID NO: 129635 - DNA, 1036 bp, Homo sapiens
tttatcaacttcctttaaccggctgtcatttcttacagtggtaagagccattgccatcgattctgatgcttaaaatggaaactttggtgtcatcttccatacctcacttgtctgtcttttggattcagttctattccatcccatgtcttctctcttacactttttaacatctcttatttaacctcttctgtattcgaggtcctctgttagagcaggtcctcatcatttctctcctgattaccttagtagtttcttcattgattttccttcctccagtatcatcttcgtctagtccacattattgccaaaatgatcttactaagaaatgattaagaacacaagcgcaaagaccagaccatctgggctttctatcccacactgggactacttgctttatgaccttgggtaatttgcttaaccattctttgccacattttcttctataaaatggggataatacagtgcttatctcatagtgaagttgtgagaatttaatgagttaatatacatctgggctgacagaactttgtgcaatgatggaaatgttctatatctgtactgccctctgtgatagccagagccatgtgtagctattgagctcttgcaatatggccagttgagtgaggagctgaattttaaattttatttagttataatttaattgaaatagccacatgtggctagtagctgctataatggacagtacagaatatgtaaagtccttagaaatagtgtttagcacataagtgctccataaatgttaactgttattaccatctttctaaaattaaacttctctgcttaaaatccttcagtaccaaattctgcgatatagtatatatgagttgtaacccattcccgtgcgttgctccaaacttgtcaattgccacttcttcataatgccctctgtgttccactgtaccagttctcaaagtgtggatgtagaggacagcaccagcaatagtatcccccaaaaacttgtttaaaatgcagattcttgagccatatttcaggcctattcaatcagaaactgaat

SEQ ID NO: 129636 - DNA, 1110 bp, Homo sapiens
tggagtgcagtggcacgatcttggcttactgcagcctccgctgcccaggttcaagcaattcttccttctcagcctcccatgtagctgggattacaggcatgctgaccaccatgcctggctaattttgtatttttagtagagacggggtttctccctgttggtcaggctcatctcgaactcccaacctcaggtgatccgcccaccttggcctcccaaagtgctggcattacaggcatgagccaccctgcctatagtgttaactgaagtaactaaatttagacatgttggaaaatagagtttgtttcttcaggtagacttgtatatgtactaatctcattggaaaactaatttcatgatagtatctattcaattagagttggtgagctctgttctatatttttaaatggagtcttattttcagtagtgaatttcctgtgtgacttcccccaaagatatgaaaagtttacattaaaaatcgtaatacagtgaactctaggatgagagattattcctttgaacagattatgtctgctccttttattgtattttaactattttctttcctctccttcgaactacgcagtcagttgctatgcagaattgatagtttgctgttacgaacctagatgttctcaaaaaaagaaaagaattatccagagtttatttgacagtgatggagaaaggaaggtgtataggtcaggagtagtttcacttttaggaattaattggttcagcatatagtcattgagcacctactgtgggccaggcactctgcttggaacagaaacagttctgtcttctctgggatgctaatgcaggtatttctattgacctggccaactgtaaggtgaagatgaaattcaaagactgcgtggagtaacccgagcaagttcctctttactttttctggtatcaattctaactttttgtttttttttggtgatattaacctttggaaggaactgtatgttagattttcggcagctgagtggttttgatccttttgggagatcaactgtgttggaatacgtttaagaggagtttttgtgaagacattggaactttagtgtgttcttttcacattgataagtactgaggagaatccatggg

SEQ ID NO: 129637 - DNA, 1892 bp, Homo sapiens
ttctgccttattgactgtttttgtctactctgaatgtctagaattttgaaagatgaaagattcacttttactttcattgcaggattctttctactaatccagatacttgttgaagtgctgactagtttcttggggaaagatgtcaaggaagagttgaaattcctagactggtgagcagagattgcggagtacagaatagccatcacccactctggttagtggtagcttaaaggtcattcttagaacatgtcatcgtgtttcctcattgtatcctaattactcatcttttttttttcttttctttttttttcttttttatcccaatggtttacatacatgattgttttggaatattaatagataagtttggaaattcttaagggtgcctagtaaacacttgctgtttgattgctttatgatgaggatgcttattttcattcgaaataggtcttggtagaaaactgaccttattttcattgcttttcaggcataagatgcacatttttctgctctggagccgggaatgaaatattcttgagttcttacaactttatgacgagacccatgtgtggtgctattgagaaattcattgggaagttggaagacatttcaatcaacaggttgttttggtttctatagtacaattggggtggcattctgttttgtgaaaggaggaaggacttaggccagaaaactcatatgctatggttaactggttcccagcctccgagaatcttgttttccatggtgtaaaacttactcagcatcaggataagggataacgactctatggatatacagaatccttcaccatggtaaaactcgcaaacccgctttatactgagtggattttggaggccatcaaaaaagtgaaaaagcagaaacagcgtccttcagaagaaaggatatgcaatgctgtgtcttcatcccatggcttggatcgtaaaactgttttagaacaattggagttgagtgttaaagatggaacaattttaaaagtctcaaataaaggactcaattcctataaagatcctgataatcctgggcgaatagcacttcctaagcctcggaaccatggaaaattggataataaacaaaatgtggattggaataaactgataaagcgggcagttgagggcttggcagagtctggtggctcaactttgaaaagcattgaacgttttttgaaaggtcagaaggatgtgtctgcattattcggaggcagtgctgcctctggctttcaccagcagttacgattggctatcaaacgtgccattggccacggcagactccttaaagatggacctctttatcggctcaacactaaagcaaccaacgtggatgggaaagagagttgtgagtctctttcctgtttacctccagtgtcccttcttccacatgaaaaggataaggtaagaatggcatatgcttcggggtttatagagctgatgatataggatgctacaaattcacatttctgggaagttatattcaagttttttgtttggggacttctgtggagtgatcacctctggttttttattggtgagttgtagctatgagagcttcatagatttgttctggtactttgaaatatttgaagcctaagattaaaaatgtagaatgttaatctgactaaaagaacttatttacattacaatgaaaaagtgacatatgagtttaaaacttttttttaaatttttttttattattttgcttgaggagtactccagcgtgagactttaaaactttaactaaaggttcttagaacaccttactactggaagttgatgagcagccaaatcatggagacttgaatttgaaacaagcagatgactctgagaacatttttctgttttccattttgttgcagattactcgttagacagaaa

SEQ ID NO: 129638 - DNA, 1076 bp, Homo sapiens
gggagttaagatccgaggctgcaggcgcttgactttccgaagacctggagactgatgacaatcccgactggaaagacaatgagtgactgtcactcattcttttacctgcgaagcttagtcaattaggacgttcgttcccagcttgttaaactcaggatgtagcttctcatttagtttagacttaatatctgtataatgagcttacttggagtaatgatactctgatttctatcctcttgagaccctcaccaaattgaagcatgattctcccagggggcttctttttaggcagctgatttaaaaacaaatcttggctcaggtttgaatgtttgcttcactcttttctttcctatcagagttaatagtaatatctctttcctagtgtgtattagttttccgtttgattttaatgtcactaccaagaatagttgctgtgggagccatttgtctagcattgtttatattgtaatgcaaatgatctccagaatgagagcagaagttctaaaaaacacttcagttaaacttatttttggaggcaaaagagttagattcagaattcagtactttagtgattaaacaagattgcatctaccagattcttttatagggatactgactttgattcagagagacagtacatttctgtttatgttttattaatgttcgtttcaggacagcaatcttgaatttatatctttattatttgggcttctctttagtcctacaagtagccagtgtatttctttttctgtaccgtccgtttgatatgtagtatgtgcgttgaccccagtgattctgggccttcctcatttctagttttcctgtctgaattacttacacgcagtttgacagttgtgactctcttcagcatatgaatagaaacatcttagtttgggttaggagaagctatcagcatgtaattcttaaaatttgaatgaaagtggattattgttaaattcagtaagcacttttactctaggctattttcaatagtatttttgtttccattaggagagattaaggtaatactgtacttaaattataaactgggtgtgcatattgtattcattcttttc

SEQ ID NO: 129639 - DNA, 1366 bp, Homo sapiens
tgcctcagtttcctcatctataaagaggtgggaataacagtacacacttcatggtttgctgtgaggattaaattagctaatttttgtagactgtacaacagcgcctggcacatagagcacattcttaatattttaactcacatcatccttggagctgctttgaaaatacaggggacccttgaacaacacttgtctgacctgcagggtccacttatgtatggatttttttcaaccaaaggcaggatgaaaacagtatttgtaggatgcagaactggtatacgcgtgttccacgctgcaggacttgagtgtgtgtggattgtggtagacagggctcctggaaccatggcctgagcacacagaaggaggctgtcattaggggcttccttttttatacttgacaggttgcagcgagccaaggtgtttcaacgggggcacctgccagcaggccctgtacttctcagatttcgtgtgccagtgccccgaaggatttgctgggaagtgctgtgaaataggtgagtaggtgagagcacgtgaaacgagctgaaatcccacctctccagtctcccccgcccccggaaggaaaggcagggtgcgatggcagggccaggggtgggggccagggacagggaaggcgcttctgccatgggtcaggaagcacagtgccacacagcaagcagagcctaggtgtgaccctgaatccaggctggcacccttgccacccagcctgtggcttccgagccagcctgcatcaggcctgggggaggacggggcagagaggggagcctcctgagggctgaatgaaaggggactcccatgtgaggcatccatgccctgctctctgtcagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcaggtgagggcacatccccaaggagggattccccctgtgagaagctgctacagctggggaaagattctgtcagatccgtcagggttctcccaagaaacataaccaatacaggatggatagatggatagatgatagacagataatagatgataggtgatagatgatagattgatagatgatagatgataggtgatagattagataaatagatgatacatacatgatagatagatgataaatagacggtagatggatgacagatagacagatgataggtgatagatagatgatagattgatagatgattgatagataaatagatgatagatacatagatgatagatggtag

SEQ ID NO: 129640 - DNA, 1050 bp, Homo sapiens
ctcgctagggcaagggcgtgggcatcgcctccctcggtgactttcttccttgcctgatgccacagcaaccggatgggggagggtgagagggacaaaagtttgccacaaagtttggaccaaccaaacacattggtttctttacaaaataaaaaaccagttgtatttttcttctctcccattcaagagcagtggtatctcttgccttctccatccctttgagctccatttttttcttaatcctaaccttttttccccatcccaaattgcttatagagttagcacgacatcagtatgagctggtcaccttccctgacaacgcagacatgtggggcctgggaaatgaaagagcgccttgggacagggggatttggaaatgtcatccgatggcacaatcaggtaggccctctgtgcagcttggggaggggcggggagccaggccccctcctcactgcctccactttctctgatcctgctgggccaagggctcacctttggctttggtcatcttgggacagtgaatagggggactgggaagagggcttcaggacttctgagctgactccaggttagtggtctccatgctttattgactatgtcacctaaataaatagtaaaataaagttaagctcttagtctctattatatatatatggtaacagtagaatatcatgtactaatatatactgatattatatgttataaaacatatagaaataggaaaatttaaaggatgagactaaataaataatttaaaatattttaattccttgaggccagtagttcaagagcagcctgggcaacatagcaagacctcgtctctacaaaaaaggtttaaaaattaggcagccagctgggcgtggtggcttatacctgtaatctcagcactttgggaggctgaggcaggcggatcacgcagtcaggagatggagaccatcctggctaacactgtgaaaccccatctctactaaaaatacaaagaattagccaggcttggtggcacgtgcctgtagtccccagctacttgggaggctgaggcaggagaatcgcttg

SEQ ID NO: 129641 - DNA, 1360 bp, Homo sapiens
ttttattctagagatgggacagcaccacacacgggggcagggagcatagcagagagggagcaggattcatgatcagagagccgggccagggctgcagacccgccccaatccatccgatccacctgacccacctggactcatctgtggggctctattctccaccttctcaccacaccacctcctcttccctagaatgttcacttctggtgggtggatggcagcccctcctggtctcaggggcagttgggtgccctcctccccattgttccctatgacagtaccacacagcctgctagtacatgttacctcattcgatttccaaaagctcacacatgggtgcacaggtatggttcccacatgatgggtggatgtcatggcccagagaggttgggcctcacacagctgtagcagcagagcctgggtcccagcccacacagacccagctgcaggccacctctccatctctgaggctgaataaggccatataacattatgaaaactggaagctctgaacaaaataatttttttttttgagacaagagtctcgctgtattgcccaggctggagtgcagtggcgtgatctcggctcactgtaacctccatctcctgggtccacgtgattctcctgcctcaccctcccgagtagctgggattataggcgcccgcccccacgcctggctaatttttgtatttttagtagaggcagggtttcgccacatcagccaggctggtctccaactcctgacttcaaatgatcacccacctcaggctcccaaagtgctgggattacaggtgtgagccactgcgcccagccaacaacaatttttattttaattgaaaaagaggtcggttgctctgcgagtgcacctcttcactccagaagggtcacaatagtgggggcgggagcccaggcgtttattcctgttcagtggccattcccagacacacttcaggtgctgttctcactgttcctccaggcccttgtgcctcttaaaaaaaaatttttttttccactttggaaagctgagacaggagaatagcttgaggccaggagtttgagaccagcctgggcaacataccaaggccctgtctcctcaaaaaataaaaaatgaaaaattagccagatgtggtggtgtgcgcttgtggtccctactactttggaggctggggtgggaggatggcttaagcctgggaggttgaggctacggtgagctatgattgtgccactgcatgccagcctgggtgacagagcaagactcagtctcaagaaaaaagataatcctgtctcagaacaaagagacagataaataaaataaaagaaactttccatggggcttggcgtgctggagtggctctccct

SEQ ID NO: 129642 - DNA, 1888 bp, Homo sapiens
tcaaaagcaggtcccctaaagaccagggcccagggtcagcactctggtcacatgggctggtaagagacatgtgtggatttccggtggtttgtgaccaccagctctgatgctgcttttcactttcttgacagtacctgaaccagtttgagaactgctgtggtctgcgggaaggtgccatcctcaccttgctgagtgacattggtaaatcccagtcccggaattcaggccgtgtccttcagggagagtgtggtgcccctgtgagtccctgcggagccctgcaggcagacacttcaatcctttggtctctgtggaaggggaatgggagcccagggacgggggaccctggtggagtagggaggtcaacaaggagtcagccagacagatgctgaactcaaataggtttcccttccttcctgattaactcatcaggtgaattatgatgtatagggaataacagatttcctttcccattataaagctcccctccctcctttcctggaatggccggcgctggaataagttgtcattcgaatgagttttgtcccttggcagtgaatttttccgctcccacgtaggcagttctttgccaatgagaggcgtaggaaaaactgtcctttttaatcccttgggtactgttggcttccccaaatgagggcatctgcggcaccctctgagaaggccaagctggccattcatggagaagagtgacctcagcctgcagaggtcagtggagcctcctagaccctggcgctcactcaggaggggtctgagggctgggcgctaaaggtcagcacctggccccagcctggggagacagggagagggacttgctcagagctttttgttttttttaaaaaataatctccagggttgttggtgcaagttgatagttggggtctaaggtttagagttatcagaatttatctttgactctttgcctccagatttggagaatgatgccattttcatccctccactacctcaacctttcaaagctgtatacattttttctttttgtttgctcaagtttttttggaaaattgtcaaatatatagaaaagttaaaagagtagtacagcaaaactcacataccgttcccctcggttcaccagatgttaacattctccctcatttgtaaagctgtcttctctaagccagggcctggaagggttgatggtccaacactgtcttgctagtgtgggtctggtctcttcctgactgctgcttttgacagaggagaagcaagaaggaaaggaaggggaaaagtcaagcaatgacatatttaaggttaagatccaaatagtctgacacagaaaattcccatcttgctctgtgctgtgtcttcgtccctttgggtggagttcacatggaggatacgttgacattacatcagttttatttgactcgaatgagcacccagtgctggcccaagggatcccctgcacatggcccgcatgagtctcttctctgtctacctagagcataatccatcagttagaaattccacttgttttcttgacaccctgacccaaggctcacccatccatgttttgcttggaggcttacttgattgtattttttacctcagtggccagattcttcatttgttctctgttgaattgggttgaaggcaggttagcaggttggggagtattctcttgcttttcttgggtgatttttattttgtttctctttggttaaagctttgtcaagttattattttttttttggatgtttttctctcagatatttttctttcactccttaggctgttgatgactttagcaagtagttattacgaaagtcttttttttttttttttttttgagatgatggcttactctgttgcccaggctggtgttgcagtaggcgacctcagctcactgcaa

SEQ ID NO: 129643 - DNA, 1017 bp, Homo sapiens
atccatgctggtcttgagcggtcctcccacctcagcctcctgagcagctaggactacaggcaggagccactgagcctggccgaggccacactttccatgaggtatttcaggggccactgagtaggggtcagagctctgagctccccaccctttgtttacgttatttggtctgaatattaggtttctgtttgagtcactcattcattcaagcatattgatggagtgtagtctgtgtcaggcactgtgctcagggctggtgatgcagtggggaaaaaagacaagcccttttcggccttcagagcttagggtttagcaggaaagcaagcattactgtgatgcttacacagataactaagaaattacagttgtggtgagtgttacaaagcaagagtgcagggtgttgcaagaatatatattgggtggcctcagcctggtctgggacttgaagggtaaggaggtgaaaagggctggaggtgggggacggcagggggaattccgtgcaaagggatcacacacaggaagacctgcaggtgtggctggaaccgagcacaaaagggaaagagagtcttgagttgaagctgagaacaaggtagagcacagattatgaagggccttcagggctgggctaaagttctagactttatcttaaaacctctgcagagattgatgggttttaagtgggagaaggagcaactctttggaaagcccactcctgacactgtgtggagaaggaatcacactgaacaggagggaaaagtgggtgaggtaggggcagtgaagatgtagagggcaattagattccaggagggcttagcacaaatgcccagcaagacttgtcataggttgcttgatgatggcagtagccaccacaattgggagtgactcaaggagtctgcggctttcagagtgggtctcacagagggctgtgattcaggcgcctgtgtccatatggcatgtgatttggtagatccttctggagtcctcctcagctcagcagcagtcgagcaagggggaccc

SEQ ID NO: 129644 - DNA, 1006 bp, Homo sapiens
ggccagatgcaagagctgcatgaatggacagagatggtccaggtttaaataagaagcaagggttaggttcccttggggaaaagccaagaccatttcctgttaggaagggcattggattgatgatcaacactccctcttgtcgaaggtttttgactaattttgttgggatgctaaatccataggaaataaaaggtctaggcagaaagtctcagggcagcgtaaatcagatgtcaccaaaaaaagttaattatgaaggcaaaggaaatacatgtgacttaatgaacctcacacaaactgaaggttgaagtcaggctccggggctttttcctggacttatcctctgttttcccctgtgtacttgggcaaggatcttcacctgtgtcttagtatcgatttttatgaatcagtactgatggagtatatgtgtgtttaatggtgaatattaaccatagaagggctgagtgctcctccccatcttgggactcataatctgtgaaataaaacagtctgggcctccctgcccgggtagcatcaggatagacagatgaagagaagagaaagtaatgtgtcttgggcatcttctgtatgccaggcaccatgccagaggctttaagtacttcatcttacttgactcctcagatggccctgttagaagcctattttatgcaaaaggaaactgtagctgggggtaagtaacttgccaaggggtcacacagctagaaagcggtggaccctagatgcaggcgcagccattcagaccccacagtccacattcctttgagccagtccattgagggtcctcagggaatgtggcgggtcccctggtctcgctcccccgcagatcttgcatctcagcatgcgcctaccacatcagttgacattagcacagcttttccattaggagaacgaagtgaaactcctggtagaacggatgatggctctgcagaccgacattgtggacttacagaggagccccatgggccggaagcaggggggaacgctggac

SEQ ID NO: 129645 - DNA, 1078 bp, Homo sapiens
ggtcacataaacaaacacaagactctgaaaggtagagataagacggaagactatccctggaccttgggatctgaggaaggactctggtagttattccgtggcttttctttttgtctcaaggttgagtgctggcttcggaaggccaaggcgggcggatcaggaggtcaggagtttgagaccagcccgaccaacatggtgaaaccccgcctctactaaaaatacaaaaattagccgggtgtggtggcatgcggctgtaatcccagctactcaggaggctgaggcaggagaatcgcttgaacccgggaggcggaggttgcagtgagccaagatcatgccactgcatgggtgacagagcaagactctgtctcaaaaaaaaaaaaaaaaaaagatatgagtgctggagaagccaaccaatgggcacagacaagaaagcctgctctctctacctgcgttagtttcctagacctgccctagctagttaccacaactttggtggcttaaatgacagaaacttattctctcccagttccggaggccagaagtctgaaataaaggtgtgaacaggatcacacctcttctgaaggctctagggaggttctatccctggtggcgtccagcttctgttggctttaggcaatccttggcttgtgactgcatctctgcccctgggtcatattgctgccgctttctctgtcacatctctgctgtgtatctcttacaagaatacttgccattggatttagagccaatttgaaaaatccagggtaagcactttgtctcaagatgtttcatgtaatcacagtttgccatatgaggtaatgttcacaggctctggagattatgatgtggacatcttcttgggggccaccattcagcccactacagtccaccctctggcaccccaaaatccatatttgtcctacatgaaaaagacatttattcctcccaacatctcccaaagtctcaactcatacagcatgaactaagaccaaatttgcatctatatattagctcagaagtcctgcatctcatcatctaagtcagatgtgggtgagaccccgtgcatgattcattttag

SEQ ID NO: 129646 - DNA, 1035 bp, Homo sapiens
gtggtctgtcagctcatctgatttttaagttccatatggaggtagaaaattaggccaggcgcagtggctcactcctgtaatccccgcactttgggaggccaaggcaggtggatcacgaggtcaggagatcgagaccatcctggccaacatggtgaaacatcatctccactaaaatacaagaaggcgcgcctgtagtcccagctactcgggaggctgaggcaagggaatcacttgaacccgggaggcggaggttccagtgagctgagatcgcgctgctgcactccagcctggcaacagagggagactgtctcaaaaaaaacaaaaaaaaagaaaattagttatcttggtgaaagcataagcatagatatttgcttgtatatgtattccagtttaagaaaaattaaggccttgatggatttctaattggttttccttttcttctttccttatagaaaagcagcatctgttatagcaaaatacccacacaaaataaagagtggagctgaagctaagaaattggtaagtttagttagcatgttgatcgaagagttcacacgtgtccaaatttggtgggttcccaccaaaccaaacttgcctgtctgaagcagccttgacccacacaggctgatttcactactcctgatttcttggaataacattcatgctgtttcatacacactttttcaagctcaaaatgttttcatttgggagaagatgggttaaaatttttaaaaatatatgtaattacagttttctttctctctgttacaatatatacatgtactcacgttgaatttcaacttgagtgttggtttttaagaagagtgaccaagtggcactagcatatctggtcccacctatttttctctgatccccaggtgtaggaacctatgtgagttagtgggagtgcgtgttccccagagagatcttactaataagcacatgattaagacccttttgttttatggcatttagccctgttctctgtaatttccacgaagccttgtgtactgtgtcacagtttctagagggtca

SEQ ID NO: 129647 - DNA, 2632 bp, Homo sapiens
tgactgaaagatcgttatcttttagaatttctttatttctttatttatgtttttgagatggagtcttgctctgtcgcccaggctggagtgcagtggcgcgatctcggctcactgcaagctccgcctcctgggttcatgccattctcctgcctcagcctcctgagtagctgggactacaggcgcccgccaccacacccagctaattttttgcatttttagtagagacggggtttcaccatgttagccagtatggtctcgatctcctgacctcgtgatctgcccgcctcggcctcccaaagtgctgggattacaggcatgagccaccatacccggccatcttttagaatttctatgtttacactctcccaagcatttttatggttttatttcaccccatgatagtaattatatcacttctgatctgttaagaatagaccttttaaaagtattggataacttagagatgagacatcttcagttactctgttattcacctattactccttaggttacttgtgaataattttgtgtgggtcacccaggcaaatgtaaatagctcttcatgtcttttagcagactggtatgtttccaataagatcatttaagtcctcaaagcattcctaaatcattgttagacttttttttttcttaaagattcggcaggatgatacgagttcatccatcaatttcctgactcgagttagtggcattgggtaagaactattttttaagcagacacaatcgtcagttagtttatttttcctgttagccaaagtaaattacatgctgtttctcaaaacctgtacttcaccacctctgtaccttagccatacagttcacccttccatagcttatgatctgaggccgattcttcagatagtgtctctactgtaaggtccccatccaaggcagatgttacctccttcatgaaaccagtttggttacccaggcagaaagaacctctccctcctctgaactccactaccatttcctccgtgtgcatctatttcctgctccagcttggcctcttttgtttctctgagcatgatatttatcatagcacctcatgaatttggaacaagccctcaagctttttttaaattattttttgagacagggttgctatgttgcccatgctggtcttgaactcctgggcttaagtgattcttcctcctcagcatcccgagtagcttggattataggtgcacgcccccttgcccagcttcaagcatttttaaatgaagggattattatcttaaaatttgagctggtaccaaggtgggcttttttgacactggctgaagtaaagattaacattgaaatattaaggctttagtgctctcatctttatggcatggggcattcctttaaatataatgatttgttctttaaatggcagcattttcggtgaaagttattctaaaacatattaaattcttaaacctagtatgttgaaaatgaaaatgactgcttggggactcaaggccattataaaattttcattggaagaattacaaaaatttttttttttttttagagatagtgtcttattctgctatctaggctagagtgcagtggtgctattatagctcactgtaaccttgaactcttggggtaaagtgactctcctgccttagtactccttttgagtagctgagactacaggcttgcgcaaccatgtgtggccaatttttgtatcttttgtagagaagaggtctccctatgttgcctaggctggtcttgaactcctggcctcaagccttcctcccacttaagcctcccagagtgctaggattataggtgtgaaccacaaggtgttttagagagcatctattatcctttttttctaggcaagagaactgaaagttgaatatagaacatgagtaaccatggcagagccagatttgaacccatatcttctgactccgagttcagttctgtttcttctatgctgcattgccttcctaacatcagtatcagtttctatatcacaatataatgtgatgatatttgcatagcttactgaatgatacaggtttatttgtcccgaaacactgtggccccagactattgtgcttgtatgtttatatgtgtgtgtatgcatttctttctgttcaccgctcctgctttattatgctgtaaactggtatggtgagaagagagtcaggaaatctggataatggtctagagctagcaccagctagatttgtgaccttagcaaatcgcttcatctttctaggtttcagtgtccttccttatgaaataagagagaaatttggttaatcagtaagcttccttctgtccccatcctataagagcatcttcagtcatttctgacattctgatttatttatatgaataaagtgatattttagaaacctaaatcagattttatcattgctttgtgcagtgtcctctaatagctttccattgcactcagaataaaatccaaacctatcaccatggctctaaaagcacagtagagtgtaacacctgcgtactgttccatagcacctcataccgtcacttacatcactctatgcatcctagtttttctcttctcttgaacaggccaagctcatgccagccttagggcccttgcactaattgtttccttttcccgaaacgtttt

SEQ ID NO: 129648 - DNA, 1140 bp, Homo sapiens
ttttgtgactgacttcttccacttagcatattgttgtctgagtttatgttgcaggatagtatttgaaaatataattttgcaggatataagagcggtaaactgtaaccccttgccttgtcagtagacagcagtttactttgaaaataatgccctaacttaaatatatttatttactcttgttacatgaacacatagtttatttacaaataagtttagatggagcctttgaaatattacaaagaatgacacttaaggatttttatccagtttaggaataaacctccccccattcactccacccccaattttgctgttgtcatctcagtgaattcattctagccttgatttgtgagaatgatctgctggtatggcacggacaattgttataaaaggcaatttaatttttaaggagatttaaattttacgaaaatcttttgtctacttattctgtctttatagatattttggggactttgaaaaaagaattcctcgtgaagagatgttacaaatgcaagtaagatgtgtcaaattatattctttgattagaattgagagtgtcacttggtgaaaagccattttgggaatactgacttaatttttcttctattaggatattgtactaaatgaagttaaaaaagtggattctgaatacattgctacagtctgtggcagtttcagaagaggtaacatacttcctaatcttgggttatttttgccctgatgttaaaattgcctaatatatgggaagaatttggattaaaaagatgtaatttgtggtacttcatagactcactaagacctagtagtattagttaagggtatttgtttatagatgggaatatgtaactaggggaaattcatcctgattttattataggatgatattttaatgactagttttaacgacgtttattaaatgactttaagtatattgaaatgctagtaatggttgtctttggccttttggctggatgatagtgaagttgtgggtagttttgttaatttacctttctttttcctttttttttttttttttgagacagagtctcactctctcgccacgctggagtgcagtggcaccatctcggctcactgcaacctccgcctcccgggttcaagtgattctcctgcctcagcctc

SEQ ID NO: 129649 - DNA, 1019 bp, Homo sapiens
tcatggatagagtatcttctgttattactggaagcttttttgtttgagactatactggtagcttttttgtttgttttcttcttcctgcataatcatcgtttcttccacgttgctctcttctgtttattttgatgtctgtgtttcgtgttcagggttttctttgattagtttcttgcttagaatcacacaaagaccaaatcctcataatgagaatccttatttgcagttttgtgtagttctctaattatcgtgaagtgtaatagaaaggtagggatagtgtattgctcacagaagctgctaagttaaaagtgctcagaattctagagctgctaacattaaaaacaaaaatggccttgtgttttacttgattaaaattaagccttaagtttagaacatctttaaacttggtttaaaatgttcattttagggtgtttgccagcttcccagtaaaaatgatgaaaaagaatatccacacagaagaattgatatcaggtattgttcagactttgttgctgacctgttaacttttccaaacttgtctcgttttctccctccctgtttgtatcttggagttcacattcatatctagagcctttttttactcccaagagccatatgttcttgccaaatgcaatgtttagctccaaagtatgtaaagaataatgactgtctacagactccaatttattttctctagatttgcacctcaccatgatgccttccacagctcaaaagtcatttcctgcctgggctaagttagttgtaataggtgataatgcaatttcatttctccacatctctttcagaacaaagttcacagaaacctaaacaaattacaaggttggggtgatttgagcagtctacctcatgatagtcttctcttcaaattattagaccacttaggcttatctttggtattttgttccttattgattttaggagtcctatatttgctaaacttgaaatgcatggtaaaaaaatgtatctactgtccattttttttaggttgatacccaaag

SEQ ID NO: 129650 - DNA, 1240 bp, Homo sapiens
cagaagaacctgctgcagaaagatttcccatgatacaaagagggcaaaggaatgagataatcagcagtgttgatagctctgagaatttgatatgagggtcatattaccagtagcaaagctgggcagatttttagtaggcaagatgaaaaatcaaggcacctgaggtttttgaaggctttaacttcagagtttacactaacttttggtaagcaggttgctgcaggtagaatctgtcatatttctggttaatgggtaaaattatagcactttaagaagagctttgagagaagatatattctagatgaatacacttcaattcgtatggtaaattcttattttaagaactgaatttcagaggagaaaaatgttaaccctgaggattttgattgcatcttttaacagtttctttaaaaatttccattgttgtcttatacaggtctttggtttcataagagcctgagagagatttttctaaggtaaattttgcatatatttttaaaagaagtccagtttaacatagcatctttttcatcctgtaagaacttacttttctttgaaatgcaatcagaaagatgacctctgaatctcacgggaaaactgttttattctcagtattctggaaaggtctgttttttaaggagcagactgctgtctcatacctttgattgcattaaagcattaatgatacacaggaagagaaaactgtataccccttctcacaggattaaacagcagaagaactgtgggtgaataaatactaaatggttatttttattcctttgccctgtttttctttataagatatgtgtaacacaccaacgtactgtgacctaggaaaggctgctaaggatgtcttcaacaaaggatatggtaagtatgctattgtaactttccagtttggggtaaaggttagtgttgaatgcctactgtgtgtaaatactgtgttagtaaaataagggtaagtcagcattattccacttcacaagatttaaggggataactattaacaggctattagacctcattctttagaggcagaaccccttacaagcattaaaagcaattatatacatatacagatgcatatacatgtccatatttaatgttatctggaatgtagaataatatatataacatttatgtctctttgtctggccctgaggacaattaaattagggggtagaacttttcctccctccaaacagtggcattgtttttatgaaagtgacaacataacttt

SEQ ID NO: 129651 - DNA, 1080 bp, Homo sapiens
ccaccacgcccagctaatttttgtatttttagtagaaacggggtttcaccatgttggccaggatggtctcaatctcctggcctcgtcatccgcccaccttggcctcccaaagtgctgggattacaggtgtgagccaccacacccagcctcttattcattcttatacttttgttcatgcttttatgaaataaatcatgaagtatcctatcatttgaacttataatgagtaatagatgatagtagtctatacatgtctaatcctaacaaaattatatttgtagaactaggtcatttgaaatgtttttactatatatgtggcatgtaccaaaataatatttacattgggagatgagagagaggatcttactctaaaaattcctagacagtagtaagaactcatgttgttttcatcatttgcttttgtttgtttgtttattgcagaaagaagagtgggaaattgaaggcctcctataaacgggattgttttagtgttggcagtaatgttgatatagatttttctggaccaaccatctatggctgggctgtgttggccttcgaagggtggcttgctggctatcagatgagttttgacacagccaaatccaaactgtcacagaataatttcgccctgggttacaaggctgcggacttccagctgcacacacatgtgtgagtgtttataatttattccttagtatcagtgcagttgcccaaaatattgtagccattagcatgctgagaagtgatggtactcagatttagcatgccttggtgaatatccatccttgcggtgctatcctcatagcaaaaccttgccaggaggctggtgcacgtggtgtgcaggctgtgctgctggtggtcactggcccctcagcctgcaccccaaacttgaggaagctccagcctctgtagaagaaccactgggatagagggagcccagagcatggcttacctcatggtaagatgaccctttggagatgttactgcttcctctgctgccctctcatcttgacagtatctggaagcaggtctgttttggtcaccaacaaccaccaccaaattgatctgagcatcctggga

SEQ ID NO: 129652 - DNA, 2312 bp, Homo sapiens
gagctgagattgcaccactgtactccagcactttgggaggccaaggagggagggtcacttgaggtgaggagttccacatcagcgtggccaacatggtgaaaccccgtctctactaaaaatatgaaaattagccaagggtgatggcatgcgcctgtaatctcagctgctcaggaggctgaggcaggagaattgcttgaacctgggagatggaggttgcagtaagctgagatcacaccactgcactccagcctgggtgaagagtgagactgtctcaaaacaactatataaaacaactatataaagagctatatgctgaagagaagaatccccaaacaattctacctaaaatctaagctattttaaaagctttaacaaatgtaggggactgggtaatgttgtactagagcttgtttctgagattagcccatgtacattggtagagtgtagcctttgtggctcacctgtttttactttgcaatgtctgctcccacaggtgggctcggtggtggccgtgggctggatccgctcccgcaaggctgtggactggcgcctctttcggaacatcttcgtggcctggttcgtgaccgtccctgtggctgggctgttcagcgctgctgtcatggctcttctcatgtatgggatccttccatatgtgtgatttgtcttcttccagctgcaaacagctaaagggatggtctggtgttggcgtgtgggagacatgtgtgctcgtgccgcacatacacatcctggccgtgcacggctctctcatgaccagctctctgcctcccttccaggaggctccatcccacactgttcacccaggctgcggagactcaccttcccgagctaacttaactactgtacataataatatgtattaaactggtatcgtggtgatataatgtggtgcagttacttatatattaaatatctattgtatccatagaataggcagcattatttcaaacatattcaagttgggagtggagatcattgcctagaagtcaatattcaataaatcttgtacataactatttcgatggcaaatgttaagccttctaaaaggaaagtgtagattggaaaatgattttttttccaaatgatgtttttgccttctaatatactgtaaggtaatgagcttcagaacaggcaacctgaccctgcagaggtcgcgtgctgtgggatgacagcgggacgggagctcacaagtgctttcactgaagatttgttcatatactgtgtattgattgttgtgtaatatatcatcattgcttttgtaaatacgtaaaactgtaattttttaatggtgtgcttcccttatacttttttgatcagagaattttggaaagtaccaaagaagcaggggaatcattggccagtgttacgttttcacattgtctgtctcccaccctcactgatcacgcctgccccagagcagtgtgtggcggtgacaccgtcacccagcatgcgccacgccgtggctcccaccagcagtgccaccgccaccacaccccagatcccacccaccttgcagtggcctttccttgtcatcagagtagagaatgcacaggtgttggtgagggcgtgtggctgagcactacatgtcaagtccagagtcagtttctatcccaattctccctgcagcctgaagaacggatccttgtctccaatgtcagcacaaaggaggctttttctgtgctttgacattctagcacttcagggatgagagggagggagaatcctggatgctggatggagtatttctctgaggcccacacaaagctggacacccccaggctctactccatcccattggagtctcttctttttttgatagcgggagggaggaagtacgactaatgttggagcctgaaactatggaaatgctgctaaaatttttatattgacaaacattttcttggtacttcattgtcatttttcattaatcaaccatattaaatttataataaaaaatgcccctcagaagtttgcctctgaagcctttttctcaatattgacaatttttctttcagagtgagtttccacaaaaaccaaagctatataatttggcccttgtatttttcacatacctttttttggtttcccttatttgactactgttacgggcttgtacagaaaacacaggtgagcaggaaagggaggcacggcgtccccgccccgcattcagaaacccgcagtcagcagctcatggagcagtcggttgccatgttcagggctgaggacccagcagggaagtgcaggtcttatcctttgctcaagcagccaaaaacaccctggcttgcatattctgg

SEQ ID NO: 129653 - DNA, 1028 bp, Homo sapiens
aagtgccatgaaatagtagggagtgtttccttcgcttatattcgaaaggctggggctgggcacgttggctcacgcttgtaatccgagcactttaggaggccaaggtgggcggatcatgaggttaggagcttgagaccatcctggccaacatggtgaaaccccatctctactaaaaatacaaaaaagttagctgggcatggtgtcgcgcttgtagtcccagctactcaggaggctgagggagaatcgcttgaacccgggaggcgaaggttgcagtgagccgagattgcgccattgtactccaccctgaggacagagcaaggctccgtctcaaaaagaaaagaaaaaaaaaaaaaagactggaaaatgagaccttctctaacccttttcaggaagagcactgtccatgacccatggctctgtgaaatcgcccatctccaacggcaccttcggcttcgacggccacaccaggagcgacggtcatgtgtaccacaccgtgcacaaagactcggggctctacaaagatctgctgcacaaaatccacatcgacaggggccccgaggagaagccagcccaggaaagcaactaccggctgctgcgccgaaacaacagttacacctgctacaccgcagccatttgtgggctgccagtgcacgccacctttcgagctgcggactcatcggccccagaggacagtgagaagctggtgggcgacaccgtgtcctactccaagaagaggctgcgctacgacagctactcgagctactgtaacgcggtggcagaggcggagatcgaggcggaggagggcggcgtggagatgaagctggcgtcggagctggccgaccctgaccagccgcgagaggaccctgcagaggaggagaaggaggagaaggacgcacccgaggttcacctcctgttccatttcctgcaggtcctcaccgcctgtttcgggtcctttgctcacggcggcaatgacgtgaggtgggtgctttcattcattcattcaacaagggtccttgaggctccgccag

SEQ ID NO: 129654 - DNA, 1062 bp, Homo sapiens
gtgttgtaaaatctcatggtaatgcagtgatgctgaagtcatctgactctcttagaggatgcttggaggttggaatctcaaattatttgttgaatgtagccagttagggccaaacctggacttggctgtagtgagcactatgggttttgaggaaggagatgctgagctctgggctttggtcctccggaaccggcttgacccaacagatcttttctgtttccaagtctgacatcagctcatgtgattccagggctttaatgtgtctgctggccacaacagtgggctctttgacattgcatttgtgtgggagagatggccccagccaatgccatttctgcagaagtggagcagatcacaggcagtgacaacgcccatccttttggccacactggggtttgggaagagtttcttgtaacagtattttgtatcattttgtctgtgttggctccaaatgctgctgggatcctgaccttccactctgtctccttgtcttcctacaggaagaccctgttcccaatggcctccgggcactcccagtattctatgctgctaccatagcaatcaatgtcttttccatcatgtacacaggagcaccaggtaaggatcccttggaagcatactccaggggcaaagtgcattgtattctaacagtatcagtttatttggtgctggtattgttggctgacagtaaaaagcattactcatggtcattatggaataggtgctggagttgttggctgatagtaaaatgcgttactcatggtcattatagaatagtaaaaagagtggtaaatgcatttacttgtcttaattaaatacccaagagatatgtagagtacaaaggcaacagactttcaagttagaaaaaaaaattaaatccccactctgccatttacgcagctgtgttgccactatagcttagcctctctgagcctcagaacctgatctaatcccacaggcctacagggttgtgcaggggtcaggagagggtgtggagcacctggggccatgcctggcacccagtgagcgggacagtccacacatcagcaatgcccagcggag

SEQ ID NO: 129655 - DNA, 1027 bp, Homo sapiens
gatggcaggaatgaaagtacccggctggccttggcaaaggaaatggaagttggcccagcttttaaataacccttactgttggaacagcaacagagtctccatatgtgttgataagaagggcaggcagaaagactccgtgggaggcaggactcaggatgctgtcttctgaggcccgagcttggggcaggggtttcttgaccctgcattggcagtgtggtcagtggtgtgtgactgtgtgttgatgtctgagtgtggccataaatgtgtgaaggtcagctctgccaagtcacagggcttgttaggttctgaattaaaggtaaataattctggaaatacttatgaatgtatgtaatacattttgtttatcattgtgttctatgaataggaccataattatgaatgaattttaacattcattagattttttttttaattattcagttgcttcttggtttatatctccactgttgtctggtttcatgtctggcctgctgtttgtactcatcagaattttcatcttaaaaaaggtaagtggggctgctacttttaattaaatcttaagaactatttttggctctactcagtagaaattaataatgagaggggttagaggaataattgtattcatacattgtcaaggcacagcaccctgcagttagcgtcagatgttattataaatagccagaaagagccaaggtaaattacccagagagtcccccagaaacaagcactgcaaatagtgtttcttggctctgtactttagttcattaatcaacactcccaggagttgtgctgagacctcaaaaaggaaaggtaattatttcctgaatgttaagcagaatagaatgagatagtgttaagattttgaaactgtcattaaaaaacagctggagaatttcctcacccaaatgtgaaggtgtgttcccttttttttttttaatggagagagcaaggttgaaacactgacgcaatttgaggaaaggataaaaagaaggaaatacacctattgggtacatcttgtctaaaa

SEQ ID NO: 129656 - DNA, 1040 bp, Homo sapiens
ctcctccaggatgtattttgtaaagtcagccacagaaaatatagcagctttcaggaaggacaaatcttatggtctgaattcaattgggtgggttgatatcactgtctcacatcatgagattattttaattgtaagaatataggctggtagcggtggctcacacctgtaatccgagcactttgggaggccgaggcaggcggatcatgaggtcaggagattgagaccatcttggctgacgcggtgaaaccccgtctctactaaaaatacaaaaaattagccgggcgtggtagcgggcacctgtagtcccagctactcgggaggctgaggcaggagaatggcgtgaacccaggaggcagagcttgcagtgagccgagattgcgcctgggcaacagagcaagaccccgtctaaaaaaaaaaaaaagaatataaaccatatcatgtattttctaagctatgaatccgtgctatgaaacgtgctccaaaccctggctttctttttaaaaccactagtccccgaggagcccagggctcagatgtggaggcttaaggaggtgtccgcgggtaggcctggcgctgccatggagcctgatatgggtttggcagcacaaggctggccccttctcctcccaacgcacgccttaaggattgacacagggtcacagccagcctcagctcaaaggtcagcacgcctagcactcatggcagcaactgtgtgtgttgcttcatggactgggtcctgcacagccataaatgatcctcctgcaactcagatgcctttgaaggaaatgccaggggtcccctgaaaagtgctgctgctgccaggcaaccaggtttccagaattaacgtttgggattaataacgtgcccagcttatcagccaggccctttgttcccctacagttccatgggagcttttcaacaactgcttctgaaagtgatctctcccggttgatgcttttaatactcactacaaaatctgatctgcttatgaaaatatttgaagtgaactgtagcctagaaaaacatgaaacctagaaaag

SEQ ID NO: 129657 - DNA, 1436 bp, Homo sapiens
catgcaactaaatttctcatttcttaatcttttgctcatttgaggcacttgttcctctctgaaaataatgaccaaatatgtttttccgattgcatgaaaaatgtaacctagtaaggattactattagtctgtaattattaagcatgcttcaactcctgacaattctagaaagcaggtttttttgtgtttttggttgggggtggttatcctaattataatcttccttgaattgctttatggttaggtccgtcacatgccaaagttagatcccattagcaggcttaaaacatttatttctgaaagaacaaactgttacaggttgctgagtataattgatttcttttgtttcctttctgctacaggaggagacatcacagctttcccagatcgggaggaaaaatatggaatgtgttttaccgctgactgaacacaaccaaatgaactgtcctgacagtagtttgcaaaccagcagctagcagtttgtccagcctctaacattgtccagcactttccagagcaaactcactgtttacaagaactcttggccttacgaagtttataacctcaagctttgtttatttaaaatattcctgcaaaagaaaagtacccggcacccactttccaaaatggccatggatgagtatttgtggatggtcattttgggtttcatcatagctttcatcttggccttttctgttggtgcaaacgatgttgccaactcctttggtacagccgtgggctctggtgtggtgaccttgaggcaggcatgcattttagcttcaatatttgaaaccaccggctccgtgttactaggcgccaaagtaggagaaaccattcgcaaaggtatcattgacgtgaacctgtacaacgagacggtggagactctcatggctggggaagttagtgccatggttggtgagtagcctcttctctataccgatgggacatccgcccactgacccgcttccctgcagtactttgcccatatccataaatgtgatttttgctttggcttttcaaaaactggttggatgtttcacatttactctcttatttttgctttctgcatattaatttatgatttttaaagtgtttaaatatcaggcaaccatttattttctgaacttttgagcaaacttggttgctaaaatagatttcagctaagtgaatacttttcagaaagtacagaaaaagacctttgtagaacagcgctttattattttagagttgtttgaaggttgtctaagtgaatgtgttttcaaggttgatgtatgaaatttccaggaaggttgatttagatttttttcttaaggtttttcatcaattaggaggcaatgttttgaaaacttggatgtcaaaaataatatttattagtctaacttttatattcacagtttaagttctaaagaagttaccaaataaatcttaagtgcgtg

SEQ ID NO: 129658 - DNA, 1031 bp, Homo sapiens
gtccaactgataaagctagtacaccaatatgttaattatggttattttgcagtactgggccagtagcatttttccttgttttactttctcattttctatatttatcaaatttgttatgagcacatattattattagttttgagacagggtctcactgtcatccaggctggagtgagaggtgccatcagggctcacagcaaccttgactcccccagcttgagcgatcctcccaactcagcctgccaagtagctgggactactggcacacaccacgacacctggctaattttttaaatgttttatagagacagggtctcgctatgttacccaggctggtcttgaactcctgaactaaagcagtcctgccttgctctcccaaagtgctgggattacagagataagccaccatgcccagccaatattatttttacactggaaaaatctgattcatttttaaggcagagacttgggatcatggcttttggagagacacccacgtaaactgatgtgtactggtcattgaaaaaggttaattctgttaattctggagtattagaggtatccaggaagtgtctgctttcactaccacactggatcttaacaaactctataatctgatctgatttttggccaggatctcagactcagtattatttggagagcaatggcagcaagctggggactttagcagatttttaagtcaattaaaataacacttctggtgttatgattatccattaaaatttcagaagggcccggagttcagaatgttaaattcaaagcagtgaacagtggaaccatgtgcagtaggtctcaggtaatattttgagtgacagtgatgagggatgatggaaagaatgaatcccctagccagtgtttccagggcacttatctgtgtagtatcacggtgtatctcaccagcgttcactacatgtgagagcactttaagaaagtactggctccctcagtcatttctgccagacgctgccaggatgtcctcatggcctgaatcagaaggttattgtgggtaa

SEQ ID NO: 129659 - DNA, 2370 bp, Homo sapiens
ttttaaaggtacactgtagttgggtattagttttcacaccagtattcacttgacctattgtagttcttagtcctgcaaaagagaaaagctgattcgaatttatccattgtttaatttcacagacgtttctgtaggtttttctactactaggaagcatgtgctttatgatgagttgctaaaatgcgcataaacacttgaggagtgttcgttttaatgatttacgtgctgtgagagagtggcagcggtgagtgagagcggagaaggttttcattatataagtgttagtgccggaattcctcgtgtttgccggtgctgcgattctcttcgctgcttctaccccgtgtgcctggtgaaatgatgctggctgtgactggttatgaccttgggcgacaaatcatgatgagctctatgcagagtcacacactgggggtccaggtgcggagaaacagggcagctttgtggccgcaggaggagtccaggagccgagcccgcctgcccttgccctgctgttcccacgccgcaggtgaccgcacgtctcccctgcagtcctgttggagccactctgtccagctgcccgtgctctcatcctactcctccacgtcttaaaatagttacagacccagaggctctgacagaatcgctgccggttgcagatttatttcactgttactttctgcctagagggatagccttctgctcagaagctttgaggggtttctcagggacgcagagaggaaccttttctctgggacctcttccctcacatgaggttttaatgggtctcttgcctgcatggctaaatgggaactgcgctatgtaacaggttgcctttcggcttggagcccggatgctcagtgatcacatccctagaatgttctctctctaaaggaaatcttgtcggaagaggctgtgttatgtgagttccagctgttcatctaaagtggaaggagcagtgagcaggagggatgccttcagcttccgtccgtcttaaaaacaagtgtaacataatgggatatggccctcaggaggaaggctgatttctcgggcatacggggtactgctgtcattatttagcatgtattaagcaccccacagcacatgcggtgcacaaggaaagcatagttccaacccacatgctacaacaaggcaggacacagaaactgggccccctgacattcagtaactacactggcagaaaaaaaaatgtgaaaatgaagaaaagggaaacaagatgagtggggtgggttgaggatacttcagcattcagctcctctgagcttttgccaaagacgattaggacagacagctgtgccacctgggctgtgccttccctttctcctccatagctgggaagtgatggggacaagtgacaagactgaccccagaagccttgccccccactctcagtcctctgttgcaatcctcctacaaagaggagaagcttcacagtttcacttgcacctaaaactattattattatgtggagggggtaaacttgttataaagtgcaataaatatcaaagcatctttctccataaaatgatatttagatagaaatctggagttccagattctcccttcctgaactggtttgcaattcaacaagttacttaaccctgcactggtttaggatattgagtcaactgtaatattagttagggaaatgccttcagcttctcagaggaaaggcattatgaaggtctactgagcattattgcagcttgtaaaggagttagaagcacatgaatcagaagaagggctgataggaaggcttgggtactggggagtaataacatgagcggcctgcgtggttctgtgagtctgtgagtccctccccccgtgcccaacctcagccagtctctaaggttctgggtctagttcatggctccacaacaaagagacttggctccacaaagaacctcaaaaaaaaaaaaaaaaccaattgagggttggaaaatgatacctatgataagagggtagggaacttctattatttagcctggaagaggaaacaaatgaccgggagactcttgaattgttcttcaagtatatgtgtgtctcagtggcaaagaatggtgacccactggtatctatttccatctagaataaaagggtcaggtccagcaagggttgggctggaacagaggtgccgacagtggggaccctgtttcttcagcgtcagcaccgcctggaaacatgtgagaaatgcagattctcaggccccacccaggccctgctgaatcagaaaacatggggtagggccagcagcctgtgtttaaaaaatctcccaagtgattctggtgcacgttgacatttgaggtctgctggatgagatgcaaagatggagggtattataaaatgggcaatctg

SEQ ID NO: 129660 - DNA, 2429 bp, Homo sapiens
ttaatagtttttatgattattacacattaaaatgatcatatcttggatatattgagttaaaatatattattaaattaattttacctctttattgttacttttctaaaagcagctactagaaaattttaaattatacatgtaactgctcatagaaggttggtatctgggttcattcattagtggacattcataaacatagtaattttctttaatttcatggattcgttgaactaaagatcccataggtcaccgccttccctgtccctcctctaccaccaaaaattaatgagaacaaatgggaagaatttactctgcttttcaaggtactctgatacagatttttatctactgtcataagtatacctagaacaaaagcactgttgactcaagtagtttcactaatgaaaaggaagcagcagaatgactaatgtaaattggaggagactcttttatttggaatgctttggttcttccactgtggaacaggtgtggctgctgttgaaacagcagagtcatactaggcatatctgacatgtgaggaaccggagcattgctcaggggcccctgccttccaatgaatggatgtaggatccatcatacatcagattgctcctttccaatacaaactctgatgcagaaatgcacttggtgtatttgctttttcttactttctggtttagggcagaaataatattttggcttagagacttttgtcctgaactatgacataataggatgagaatatcgtgtcaaaaatagccttacaaggtcctttttggcattaagacttctggagtgagtttgcagtggattattgagaataattctgttcattagcagctagccatctttgatgagtgctgacttctctcctttcagcacagagcaggaaatgcctgcctcccatgactctgggttggagtgaaggggaatgcataccagccaccctcttgcagaggtggggcaggtgctggcacagagcctcaggttaggccgaggggatgcaatctcagatcagcagccagcagtgtttgtaaacaacaggagggagattgtgctggtgatgtccaactcacaccaatgaagatcaaccggtttgtgctttgggcagcaggctgcagatggacagtgcctcctgagggcatcgccatgttttagggatccatgttgcaggatacctgtctgcaagagagagtcaaggagggctttttaagcccctggggttcaggcctggcatctgggtgttaagtagagtgaatctcctgaagtccaaactaacatatgacattttaaaatgaggaaaacaaatggctctgaaaaggtctataggattataggtaagtggttaatacggaagatgttataaaggtctcaggaggagatggggtgatccagggttggttgaagtcgttgaaatggaattaccctgtcttttacctgtctgtgggaaaaaaaaaaaaagaggaaaatgacatctcccaaagatgcttggagatttgattgatgtttgtaaagtgctttgatatctttcatagagtgttcaataagagcaaaatatgtcatcagaacttagtctaaagcaaactagtcccaaaccgtcttgagtagatactaagcggttttgtgtctttgttataagttgtacttatattttcgagagaaagtttttcatgttctgattttcttttaagtgtcagctgtatgtttggggtctttacctgttaacttgagttccaacatgctttgtagatggtcagtcacctacagaggacaatttttctagccaaggagttaaatccaccttaaaatgcttcttgccaaggacaatgcctttgcaaatatttgagatgtttattctcagttgtgatttattactgaatctgtgtcttcatagcgactccttgggaggtgcaggaggaggcagagccagaaagcaagtccctgcaatcagttcattatagagaaagaaaaagcttttatttcaggattctggtggatagacttactgatatgtatattctgtgtctatttaatttcacgtagtgctgcatctaatcacgctgtttaaataatcggacagaatgtccttttgctttgcttttgcttgtgaagagcacacagcactgccaccttgttgccaaagtttggtctgatttgaatgtgcttaaaaatcaagtgaatgcctgttgggaaaaagcttactccttctctttgtcagtacttgcaaaaacaacttaaaagaagttagtattattggactgaattcagtaattagcataatcatgatgctatgtattgttcaccagggcacgccccttggccgcatttcccattaagaggacaccgatgttgtcctagtgaataaatcccggcacacatgatgcaaatcagcgtgttcctgcctgctgcttggctgcagttaattttag

SEQ ID NO: 129661 - DNA, 1062 bp, Homo sapiens
gcctcaggcgatcttcccacctcagcctcccaaagtgctgggattatattacaggtgtgagccactgcacctggctgaagatgcctttctttctttctttttttgagacagagtcttgctctgttgcccagggtggagtgcagtggcacgatcttggctcactgcagcctctacctcctgggttcaagcagattctcctgcctcagtctcctgagtagctgggactacaggcatgtaccaccacgcctagctaattttttttgtatttttagtcgagatggggtttcaccatattggccaggctggtctcgaactcctgacctcaggtgatccgcccgcctcagcctcccaaagtgctgggattacaggcatgagccaccgcgccgggccagcctttcttgattaacacaactggaagcctcttctttgcttatgttcctattggaatgaacttttaacttttggaatgcttactaattactcccttatatgataagtttatggaccgtgggacagtgtcatgactcatcacattatgagcctcttaaaggcagaactgtcattgacaccactttctgctgtggtcatgggcatcctgccacttatacaaatcttgcaaatgcttgggagtttcctgatggtgctttaacagatgtttgttaaataggtggctgttctgaatgtagagcagtatgaaagccccaagagaattccaatataatttaaaaaatcaactatgttaaaatgagtattcaaacaacagcagtcataatgctgcctttactttcacaatcctgataaaaactgtcataaaattatgctgaattagctatttatcaaggttttttaaagaactgtcttgaagagtttgcgtcttttttttttttttagctgaagaggataccagtttcttctgtgtagagttagagctctctgtttgtatgtatgtgaactgagtccgtttctgaagtgtgaagactgcatcgctgtggatcacactggtgtagccctcctgagcatgcagcctttttggaggaatgtgtgttagtcagcttttgctgc

SEQ ID NO: 129662 - DNA, 2140 bp, Homo sapiens
ctttttcatacctgtataaaaaggcaagatcaaaatatatgaagtttatcatctaggacgaggaaagttaagaccagcttttaaaatacccccaaacattgactgtctgaatataacagcataaagtcatgtcatatgtgtctcccaagactccagcggtttctgaatgagaggtggagaggcagccactgtgatggtggcagctgttaattctgcccagtggattgttccaactgagttactgatatgaggatgcccttatatggacagttctccagacgttatatgtttctaattttgatctcacccctggcctttgtgttttagctgctgtctaatccttctcttggctatttttaatactttttttcctccatgcatctcagaattgtccagcattctaaagaatggcaagttaaatgtgatttattcttcctgttttttcagtgcctaggattagtttaagcataaaagtggttttgagagagattactttagtaaatgatctcagagatactctgttggatactgtttgaggggtgttttgtgttattcgttccttatcttaatgatttttcctgagcactgaccaccacaacactcttatgagaagaaatggtgtatttaaagttgatacaaagaacagtgactactaatctgatgttgtgatttgggaatgcatagttctgatctgctgtgtatgaacaacttgaatgctctttgtctaactagctgcttattactttaataattttaaataagaagggcaagaattttctttttcaaagtcacagtgttggttggaccttataaatatgttgcccttttacatttttatccatcttattgaaaaagagttttttgggctggacgtggtggctcaggcctgtattcccagcactttgggaggccaaggtggccagatcacttgaggtcaggagttcgagaccagcctagccaatatggtgaaaccccatctgtactaaaaatacaaatattagctgggtgtgatagcgcacgcctgtagtcccagctactcgagaggctgaggcaggagaatcgcttgaacccaggaagcagaggttacagtgagctgagatcacaccactgcactccagcctgggcatcacagtgagactccatctccaaaaaaaaaaaagagtttttcaagtttttttttttaagccgtaaagaaatctggatctatccagagctgttctttatggtttacataaaaggttcttagtttgggaaactaaaaaggataattttcagttgttttcaaagagcatttttaaaaaacagatctgagtcaaagaagtgggaaatgaatcctgtcctggcaattggagaggcaagaatataatgtcaaaaagaagaaaccaactcttaaaatgaaagcattaatgtctaaaatggataattggcttttatttcgcagtctacaatcaaccatgactatcccagtactgtttgtccactcctcttttgcgaaccatccccctgtattatgaaggaactggtctctggtatttctcagaatggtctcttggattattgtaattattgggctattacagttctgagagctgagttgttgatccttctgggtttggttttatggtttttttggtggggttttttgtttgttttttgcttatcacagctactttgaaaacgaacactcatttttttagtactttttaaatgaaatacttagtacctaaggatacaatcatgtacgtttatcaagagacctgtggaagtagtcacctgctgggttcttatagccaagtgcaactagatcctcttataaatattttatctcttaatttgagcttgactttgaactgcttaccctaacagtgaccacttcttttttttttttgagatggagtcttgctctgtcacctaggctggagtgcagtggcgcgatcttggctcactgcagcctttgcctcccaggttcaagcgattctccttcctcagcctcccgagtagctgggattacaggcacccgctaccacgcccagctaatttttgtatttttaatagagatggggtttcactgtgttggccaggctggtgttgaacttctgacctcgtgatccgcctgccttggcctcccaaagtgctggga

SEQ ID NO: 129663 - DNA, 1349 bp, Homo sapiens
tgccctgtttatcacttggtcccacttttatatttttcctcttcggtccagaatttcttatttagtttcttgtattttgcctactccctcccttctccatgattcagcctagtctttccgtcctctgtggacttgggtgtgccttcctctgggccacctcgtcttttgctgctgttagccctcccgcctgcgcacctgccacttcaccctcgcctgtggtccacttacgttccactcagcccggtcagtcctgctttgttcttctccaccgccttggtctcccgtgtgtcttatctagctctggttccttctcgtctccacatttattttgttttcttcctgtgcttgttagtccttgtgcacttggtccttgagctctttttctattaataggtattactagatggatttgttgtctgcctttacatagaacacacatccttactgtgcatttcctgggtagccaggatgaatcaattattattaacttcccttcgaacattgagcttcctctgttttctgtttctaagaattagattagtattctagaagactaatactactttaaagacagtcaaaacagtcatacgctgccatttcagccctttatttaagagtttgtgacatttatcactcccttgaaagattaaagaacacccaaagcaagtttggggtggaggtggggaaggcaggaagagaaaggtaagtgctataaaaggactcattgttaatttctagaaattggactgagatctgaaagcataagccttaacattttttagataaacggtccctgaaaagaataaaaagtatcagtacttccgttaactagctttagtattgggtcatttgtagtttacattctcctttaagttttaagaccttcagtagttaacaaagcagacagagactggccaggcacagtggctcacacctgtaataccagcactttgggaggctgagttgggtggatcacaaggtcaggagattgaaaccatcctggccaacatggtgaaaccccgtctctactaaaaatacaaaaaaaaaaaaaaattagccaggcgtggtggcaggcacctgtagtcccagctactcgggaggctggggcaggagaatttcttgaacccgggaggccgaggttgcagtgagctgagatcgcgccactgcactccagcctgggtgacagcgagactctgtctcaaaaagaaaaaaaaaaaaaaaagcagagacttaatcttgtaaatactcattttatttttgagaggcttaatgtctccttaaatattaacctgtgtcattttgtaattatactgtaatagtgtcagaatgccattaacaaccaacccttt

SEQ ID NO: 129664 - DNA, 1780 bp, Homo sapiens
ctggacgtgatctattctttaactaggaatgtacagcagaatgacccagggtttatcctgaaagtagcagatgtcttcacttaactcctgagacgcaaatttggtagagctgctgccacaggccccggacatcagtattaaaccatccttaagtgattctggtgccttttctccagtaagaagaaccagccctgtattttatatttaagaaaacctgggcaaacaaatgacttgcctagatttggttcagtggtaccaagatttagtcaccagataatacagtttcagaatcctatggctggaagaagtttaccaagtcatcaattcagtagttcatcttacagcggagtgtaaaccatgcttttcaattatttgcggttcttttactgtataccctgtgatgcccttttaagtttttttgaaaatattgtatacttaaaactgaagtgaaacattaaaatttcttattagaattatttttcagtcttagctgaaatacaatattgtatgaaaatttgcactgcattattagtttttttttttaatctagttgattttcaacttttcttttttaaaggcatctccttggaaacaatgccatctttgaatgtgagagataaacctagtttcagcatgtctgcagcagagaccagtacatcaggcttattcccacaggaagcctcctaaagcctgtggcgcggcaaccatttccaggactaaataataatgtgtcagatgcctgtgagtggactgcctggccaaatgactcatgaagatattcacggaagaatagtcaaaaaccaaagaaaaggcatattctagaagcaccttcaattccatcgaggatttttgagcagctgaagaagaaagttctgaaaatatgagtgacaggactccagcacattttttttagttgtttcttacattatctttgttaacccatccgcttttgtgtataatattaagttattttccactactgcaatggctagtaatttacttaggctcagagttttactctgtatggacagagaaataggaggtaacaacagtgggagaacaaataggaacagttcactgggatgttggtccccagaaattggctttcattgaataattcctaaagggtgtcgtgtgctgaattgctttttcatagtgatgtgctgcttcttgttcatactcttatgactttaatttcacctttatctactcccagcctctgtatatgcctacgtttttaaaaataatttttggcactgaagatctgattaccatattttttcagtttaaaaattaaatcctcgcaaatagatctttggtatagttgcattctaccctaggttattttctaggatcaagaatagaacaatttctgttctttccagcattactctttactattcatatgttcttgttcagtgttttgttgttctcatattctaggtggaaatgaagggtaatctctatgttctattttcagttttctaggaaaccagaaaaacatgggtagtagaaatgtatagaaaatgtatgaggtctcttaaccattgtgttaaacttgcattaagcttcttttttagcaatatcgatgtcagtgttacctcttctttcctttttatttattttttttgagacagagtctcattctgtcgcccagactggttggagtgcgatgatgcgatcgcggctaactgcaaccgctgcctcccaggtacaagtaattctcgtgccttgggctcccgagtagctgggatttttagtagagaacaggtttcaccat

SEQ ID NO: 129665 - DNA, 2673 bp, Homo sapiens
aatttctaagtgacattcctaattaagggtaaacaaacataatgaaacaaggctaattttccaataccaaactaaaaaaataaaaaacagtggactggctattactttgttgatgagtctagcacagttttactgggcatttaaatgttaaggatgttatttacattgtagctagttgtgaaagatttgtgtgtctaagtttttagtttgcctttaaatgtcttgaacatatgcttagtattgagtccagtactttgtgcattaatagtaagttttttgattggatttaattgaacagttttggcttccttaattttattttgaagatagaatttaatgatttgtgtaggcataacagttacaattaacagtgattccgagatgagcgtagggtttaacttaacagttcacattttcttgcgagttgaaaggactggagagttggatgtgtgtcttctttgtgattaaaaaagcatgctggaacttagctatcagaagattctggtggtccatctttgggaagaggaaaagattaagaatgctttgctagtcagtatttacaagagggtttctttacttaaaggcattttctctttggggaggggaggagttgagagttgtcattaatggaaggatcttagaataaaaaagatgtatacatgttttcctttggagtgaatttgtgactggagatggggtttcactgtgttagccaggatggtctcgatctcctgacctcgttatctgccctcctcagcctcccaaagtgctgggattacaggtgtgagccaccgtgtctggcctatgtgctttttaaagatggaactgatttagaatgcagtatattacagtacatgaaaaaattttggaatttctgtatgtttttcactgttggaaagccatagtgagtgtaataacagcattggctcctgttcataaggcatttaaatgatgtgtttcctatgacaggaagacaagcgtttctcattccttcaaaatttggctctcagatggagtgccctttaagctccctgaatgcagggacttcttctgtttcactcattgtcttttttctggggcctagaacagaacctggcaaactgagagtgctatgtaaacctttgtagaatgagcactttccctggggaatcctctctccactttccactagtgaagatcccacctgcttttaggtgcagggccactccagcctgactttctctgcaatctgcagcccacaatgattctttgaacattaactgtgtataccacactctgtgacagtgaatcttttatagctttatattgatacatgagtgtttcatgtattttgtttcctcacccaaaatataagctcttcaaggctacaggatatcctatttttgagaattgccttggtatccagtataatatataatattatataatacctataatatataatgtaatatatgtaatatataatatatataatatacatgtatatatacagagtaggtttatatttacctattaaatgaatgttacataccgtggggaaacatcaaagatactcaaaatggtaggttatattttagttaggcaaacctagtgtacacatgtgaaacagtactagaatttggagctaaataagagttaatacttatgtcgtgcttaaaatgtgaacctcacaacaatcctttgaagtaggtacaattatttcctcatttttcagaggaagaaatggagacacagcaaagtaattaagtttgttgctcaagatcgtaccggaaatcataagtaggcagtctggctccagaggcggtgtggtttctctggggagctttactttatacttcgaagggacatctaagcactacttttgcagctgtaagagatgctcttttaaaaatttcaaagtagcgtaagagattgcagtgtctctaaactgcagaaggaatgctggattttctatatagaggacattgataatggaatggttaaggggacattatatattgaaatgactaaagatggtggagagaaactgaagtttgaatctcaaagctgaggattatgattttttatagatactgaattctagaacagtgattcaccaggacataggacaatgattgcttgttactaatttagtatcaaaaaacttatgccaaataaaataatattgaatgacactggatatcttactgcatttctttttttaaacacttaccagatttgaagccctagtggtagtaatttaccttaatgtgggtattactaaaggtttcctatacacttctgtccatttgctttatctttttgtggaatctttttttttttttttttttttgagacagggtctcactctgtcgcccgggttagagtacagtagtgtgatctcactgcagcctctgcctcaagcaatcctcccacctcagcctccagagtagctgggactacaggcacgcaccactgtgctcagctaatttttaaattttgtgtaaagatgaggtctcactatactgcccaggctggtcttgaactcctgggctcaaacaaccctcctcctgcctcagcctcccaaagtgctgggtacgtcagtgagccattgtgcctggcctttttgtagaatcttttttttttttttaaacagactccggctctgttgcccaggccggagtgcagcagcgc

SEQ ID NO: 129666 - DNA, 1254 bp, Homo sapiens
ggagccgggctcctttcccctaccgcgccgcgacccccgcccgggctgcgcgcgccgcctcccgcgagcccccggcccgactcccgggctcccgcgggtgggggccagggctggtcggcgccggcggggctcgcggcggcggcgggttgcgtcccccgcgcctgctggcccacgtggacctggccgtcgcttgccgtgcggcgcctttgcgaaaactcgacggaagtggcagggaccgggcattacctgcgagtgccgggcgcctcctgctccgctgtgcgcgcttggggtgggactcggcgggggaggggtcgtgtacattgtcccaccaggcgcaatgtagccgggcggcgcagaggatttcttttttggtcttgagagcatagagtcccttttcatattcacgtgtactcttaagaaagcgtctgttctccaaactggctttccattctccccgtcctaaatggtgcgtggctgacaccgtagtgttttcaaaactggatatggccaggatgctatagcattgtcagtgtaagtcccttttgggtatttttatttaattgtgtagtgacttgacagaagtgtttcccagcttgacctaagtaatgaatttgcataggatttcagcatcagtatggaagtgatcagatgtcagtggctggtgccaccttgcagataaatggccactggtccacgtagttcgtctttactatacattttgattaagttctctaggaccagctgactggtaattataagtcacatgaaaccctgcagagatgagagcttacattgaacacttcttaacaagttttctattctttgtttcatctgttacaattaaactcaccttcgtctagggtaagaccattactttacgcaataacatactagcttaatttacggtatttatatgtatttatatatattgtatatacataatcatacatataattctataacatttagtttgactctaaagttggaaaatcaggaaaataacaggtgatgttgagtactgattgtttgccgggcctgtgccaaatggtgtgcatgctttatgtaacttaatctaaaaaaatttgaatacgtgagtttgatttcagtgtgtccaaatgtgaaacgtgtacattattgttattgttttgttttttttgagacggggttttgctctcgttcaggctggagtgcaatggcactgtcttggctcactgcaacctccgcctcccgggttcaagcgattctccttcctta

SEQ ID NO: 129667 - DNA, 1083 bp, Homo sapiens
gatcacaaggtcaagaaatcgaatccatcctggccaacatggtgaaagcccatctctactaaaagtacaaaacttagctgggcgtggtggcgcacgcctgagtcccagctacttgggaggctgaggcaggagaatcgcttgaacctgggaggcggagacgcagtgagccgagattgcaccactgcactccagcctaacaacagagcaagacggcatctcaaaaaaatttttaaaaaattaataaatgagataaatagataactagagctaatctttaatccaataggataatacaattgtaacatctttaataccaatgtaagatatttcctaagctggaaagtttgggtgcctttatttatttaaaaaatcaggacagataattgaattatgccttcttcttaggtttcctcttactcgacccagtctttgtaaagaatgggaggcagctgtcagaagaaaaaactttaaacccaccaagtatagcagtatttgttcagagcactttactccagactgctttaagagagagtgcaacaacaagttactgaaagagaatgctgtgcccacaatatttctttgtactgagccacatgacaaggtaatatgcattttaaaatattgggttgctttttgtttatcaaactgatgtgttcattgattaaaatgtggaaaattgagttagtgttaagagaataaatgtgcctggaaccttgtagttaacagtgatacacttctgaaaacacaaaatgcagtttattaaagataaatatcctcacactaagaaacttagtccagctttgtaacttagttaaaaaccactctgtactgccagttatatattgataagttttgggttttctttatcagtgacagtttagtttcaaagcatttttttctcctcagtgcttaatatttaattagatctgatgattcattttgtctctttcctgcaccgtccctctacttcaggtagaaaagtttattcaaactgaaactgttttctcattttggaatgtttctataccactgattcccaaaaaaagtcagtatttcttaaattccacagattcttttattatt

SEQ ID NO: 129668 - DNA, 1049 bp, Homo sapiens
gctacgatgctggcctcccatccacggcaagggcgaaaagtagtgatttcttcgtttaaaggcctttgtttctattttaaatttacccctaagaccatattaaaacacctggctgctctgtgaccctggtggtggcaaaacccgcgccaccctaggcatcgcccgtgggctccgaacgcgtcaacccaggccgtgagcgaagcctgcaaccagggcctgttccaggagcgcgagaaacggctgccgcggcgacgcgcgccgagaacgcgcgatcgggcggcggttcccagcgggacgcggtgggaaacgcccgacacggccggccccagaccccacccgcccctcgcgcggacacgcgcctggctccgcccccggccccgccggccgcgcgcccccaccccggctgagaccggccccgcgaggcgcgcagggtcctcacttgtggaaagaaacgggcttgtccttgtcgtagcggttcttgcagccgtaggcggagcaggactgcaccatccttccggtcctcaggcacttcacttctgccgccgcagaaggcaggggaagctgttctcagtgtcgctgcgctcggttggattccctcgcttcttttgtagctttggccaacagttacagtgatggtggcctccctcgggggtgactagtgtgcccgttttgttgtttgcattagcagaaggaccacagccatcgcccgtctcccatctccaagatggcggaggcagcttcaacctcacctctcgcgaggggtgcgtcccactgtctctgattagccccgaggtcagaggtaacgtttcctgggaagctaactattggctgaggccaggtgtttccggcggtggcttcagagttgccgaagtgggcggagccctgagcttccggcaggcaggaaggaactgcttgtggggggaggaggcgcggcgggaggccggattcctggggcatcctccagccccgggctgttcccgtgggttaattgatgcggaccttttctggggcagcttacagtagggaacaactagggcctcttggagaac

SEQ ID NO: 129669 - DNA, 1054 bp, Homo sapiens
ggggttgcagtgagccgtgcttgcaccactgcactccagcctgggcgacagagtaagactctgtctcataaataaagataatatcgattcttacataatatagtaattaatcctttatcacaaacccttgtagcaaagcacatctccccatgatctttttttatcctatatataaactaagtgttgtacttagggtggacgcgttcctcctcttactttcgggaatgccctactctgtctgtggagtagctgtactttcaccactttacgttcttaataaacttgcttttgctttgtactgtggacttgccctgaattctgtcttgcgtgagatccaagaaccctgtcttggggtctggattgggacccctttcctgtaacagttttacttcattccctgctccttttctttatatagatctgagccaggcagacctggagagcggactgttgagtaatcccttggcccttattctctacctttcctgcccttttaaatgttgctgtttccccagggttccatcttctgccctcctctaactcctaaacaccctgctccttaaactgaaccaaataccataattctctcatcttttatttcctttgtatatccgttctgcctttgggattatcatctgtgaattatcatctgtgaattatctgttcaacagttgtctaaaccagaaaccttggagtcatcttggattttttttgtcacccataaaacccgttgatgaccaggttaattttgtagactaaataaataaatgccccttaaatccatccctcttcatgtctcctcactgttgttgttgtttttttttttgtttttttttttgagagggagtctcactctgtcgctcagtctggagtgcagtggcacaatctcagttcactgcaacctccgcctcctgggttcaagcgattatcccgcctcagcctcctaagtagctgggattacaggcacccgccaccatgcctggctaatttttgtatttttgtagagatggggtttcaccatgttggccaggctggactcgaactcctgacctca

SEQ ID NO: 129670 - DNA, 1030 bp, Homo sapiens
acagcaattatttctacactaataaataataggaaaactgctatcttttaaagcaaattaataataaacaaacatgaagacatctgaatagattaaggctaggcaatttgcccattcttgcaaatatacaatctataaaataatataaggtaatttgaagctggaaagaagcccatgtttccaaaaagtaatttagtaatgttttatcacaatttcacatgcaaagggagctatcacatctactcctcaaataaatacatatacaatacctgttctgtttgaagctgttctcgaagtacccttactagctcctggttttctgggtgaatgttttgatgtacatttctgttgaatagaatataataaattttgaatagaaaatattatcatatgaatccattttcttcatgggtctactttctgacttataactactggtaattaatgtaattgatggcatacaagcacttcacttccaggactgtacgtttcaggctgtcctgtggtgagttcttctgagatcactgatcattagccaatttcaggttcaagcggcaaatggtaaaatccagaggcctagtaccttggaaatctattgtaaatggaagcttacaagtaatgtaaagaacatttgtttctttggtgaaatttcttcaaaataagcagctatctaattttacctactattatgcatttgaacgcttttccacatctaattagatccttctcctaattttcaggtattaggggaggggaacagagcagaaactaaatttaatgtagaaaagccaaaacttggccgagtgtggtggctcatgcctgtaatcccagcactttcggaggccaaggcgggtggatcacctgaggtcaggagttttgagaccagcctggccaacatggtgaaaccctgcctttactaaaaatacaaaaattagccgggcttggtggcgggcgcctgtaatctcagctactcaggaggctgaggcaggagaattgctggaacccgggaagcagaggttgtagtaagctg

SEQ ID NO: 129671 - DNA, 1054 bp, Homo sapiens
tctctactaaaaatacaaaaattagccgggcgtggtggcgggctcctgtagtcccagctactcgggaggctgaggcaggagaatcgcttgaacgcgggaggctgaggttgcagtgagccgagatcgcgccactgcactccatcctgacgacagaacgagaatctgtctcaaaagaaaaaaaaaattacacatgtgtgtctcgcctgtgtttggttcctgtgttggtgcctctggatatttgtcaaactagagttcctacattccttatcaggttatttctgtcgaatctctagcacttttaagtgacgtataatcttgtaggcaagtgaatgaagtcagtgagtatatgtcacattgacttactcctgactcacatgcagcttgtctttagatgggcagataagatgctggccctactggagcgactgtggttgtgccgtcctgagcacccttcctccagtggccccggttttcaaggctttgacacaatggacctaaagtctcctttttcaagcttggctgcatatccacagtgcttttgtgcatgatgttacgttgttctggaggtttcattttgtaattccagttacctttgatgaaagaaattagtaaaaactttttggatgtgagtaattgcagaagccatgtggctgctgagtttctacgtaagccttggggtaaaaagacactgagattctctcctttgttccaggaagtcccggaatttcctatttttctattttctctgtgtgttttattttttttccttccctgaaagctttggaaatgcctgaggagaggtgagttgaacttgtcttagctgtctggttactccggttagttggaggctagttctcacccacagctgcttatcagattaaagagggcatgtcctgtgtgacagtgctccagattgcatcctgtcttcccagggaacacatacttagagctgtgattaaagagagtttgagatgctatgtggagcagctctggggcaggcatggctagtttttatcatatcaaaacatggctagttttatcatgattccttggc

SEQ ID NO: 129672 - DNA, 1027 bp, Homo sapiens
tgcacgtgcagtattccaaaatgatgtaaatgttttaagtagagattgattgtacttctttaaaaataggctttaatggccgggcgcagtggctcacgcctgtaatcccagcactttgggaggccgaggcaggcggatcatgaggtcaagagatcaagaccattctggctaacatggtgaaaccacatctctactaaaaacagaaaaaattagccaggcgtggtggtgggcgcctgtagtcccagctactcgggaggctaaggcaaaagaatggcgtgaacccaggaggcggagctttcagtgagccgagattgcgccactgcactccagcctgggcgacagtgagactccgcctcaaaaaatctatatataggctttaatttgtaatggtaattcacaagtgattgagctgatgccagtgtagttggaagaaataactgccgtcgtcctatattccaacaggttgcagcattgcaggaagagaaaagtagtttgttggcagagaatcaggtattaatggaaagactcaatcaatctgattctatagaagaccctaacagtccagcaggaagaaggcatttgcagctccagactcaattagaacagctccaagaagaaacattcaggtaaaagacaactcattaaaatctgatttttaaaaatttgttagctgtcatttaaagttaagagtatattggccaggcacattggtccatgcctggaatcccagcactttgggaggctgaggcgggctgatcacttgaggtcggggattcaaaatcagcttggctaacatgaggaaaccccatctctactaaaaatacaaaaattagccaggcatgatggcaggtgcctgtaatcctagctactcgggaggctgagaaatgagaatcgcgtgaactgggggtgtggagatttcggtgagccgagatcgtgccactgcaccccagcctgggcaacagaacgcgactttgtctcaaaaaaaaaaaagaaaaaaaaaatataatgttaggacttctgggaaact

SEQ ID NO: 129673 - DNA, 1045 bp, Homo sapiens
acatgtcaccaacagatgaatgtagaaacaaatatgagaacccagctgtcttctattaaaacagataatagaatcacaaaaatataaaacagtgccactcttctcactttttttgttttagaaaatagttatttttcataaagagtatgttgtttttattaacataatgggtttattactgtaatccactgtgccagaccatatgtgttaattttataataaaaaaagcccttaaattgtatctgcaatatttcagaaaaatgttgcatgatgtcttgctttctggtagggaaatagtaaccagttgtcaccgttcccaagacttgggacagtggagttcatttttatgacagttagtgcttgagaatgcagcttgtggccactaacatgggagacatactcaagaaggctttattctcatgctttatatctttcttttactgttctaaggagaatgaggaggcagtaaatagtgctttcttggtctattttatatcggttacagactagaagcagccaaagatgattatcgaatacgttgtgaagagttagaaaaggagatctctgaacttcggcaacagaatgatgaactgaccactttggcagatgaagctcagtctctgaaagatgagatcgacgtgctgaggtaaaaacctcaccttcaccgcccagcacagtttggctctggtgttagaaactctagggtttctgaggatctagcaaacttaagagccaggctacctgggctgggatcccgggtctactgcttatgcaacctctgtatggctgttttctcatctgcaaaatggaaacaatacacatgcctacctcaggtttatatgaggagttgagtgaatttatatttgtaaacacttgcaacagtgtctggcaattaagcgatacacaagtgtttgtaaaatagaaattgtgaccatcacttcttacttgtacagctctggagctgttcttccgccacgcccgcaaggcctcattttcttgctgggccttgttattaccccttcagttctctcatgaggtgcctcac

SEQ ID NO: 129674 - DNA, 2577 bp, Homo sapiens
gtgttggcagtccttgttagattcccagattgatttctgattcctaaaactgtcaccaacatttaaacttccttatgcccttattaaaatttaaaacatgtttttattcaaaatgcgaaatcacaaagaggtgaaacaaaactaccattagtgtattgaaatattattaagcctaattaagtatcttagagatgaactgaatggggcaacatttcttaattcagtgaaatcactaggtcctttaaactgagaaaaacgtaaaatccattctggtctctaaaagtctgaggagacttttattgatttgttatgggagtgagggaagggcatgtggtacataggaagtaaaaatggtgaaatatcagaatcagcttaaacttcagtgttacaatgatggccattgtgcatggttctcttacattaaaacataaataaaagcatttattcttcaaaagataatttggcatagcttgattaggtatcgctatggtaatcaaatctaattaaatatgctgtgggccattactttaacagaacgtatttcagaagtgagatgctagccctgtcaagtactatttacataaactagtccatttatttgactgtccagatgccaatgtcttgctgtaaactaagcagaactttgctctgagttcttttctatatgtagaaaagattcagatagctgaaactgtgcctccaaatggcttagagaaataagtagtacaatacaggatatatggttcttgccccagcaaatatttttatgtttttgtcttacctttctctttctctaacttaaagtgttgcatctcgggaatgtgcaacacataaagcaacctgccaaaggaagtggtcccctctggagaagaacaacataatttctgccagcttctgttatcaaaagcacagtcctttcatgtgatcttaagtcggagtagaaggggttgcacatttttattattatttttatgtaatttgtttttagcatggaagcagaaaaacattgttatatccagccatatggataatttgagctagccacaatatataaaacttcagagaacaagacaggatgaggagacggtagaaaaaagaaaaatgtacatttcttttaaaagtgcatatcttgggctgggcacagtggctcatgcctgtaatcctagcactttgggaggccgaggcgggcagatcacgaggtcaggagatcgagatcatcctgactaacatggtgaaaccccatctctactaaaaatacaaaaaaaattagccaggcatggtggcgggtacctgtagtcccagctactcgggaagctgaggcaggggaatggcatgaacctgggtggcggagcttgcagtgagcagagattgcgccactacactccagcctgggcaacagagcgagactccgtctgaaaaaagaaagtacttatcttttacttctgttcatgaattactaaatcgttgcttctcttggctgctgtgtttgcttcatactaatttgtcctctctgtctcttggcatggtttctgctcaaggctattgtaagtatggcttccttttcatttttatatagtgagcagtttttggatttagactgccatcatagttgatggtgtggaaaattttattaaggtagttttgtgcaaaacgaatatctggattacttgcctcataggtttaagacctttacaattaagatactcaaaggatatcgagctcttaaagagtcagccaacaagaagtctgctcttggttttattccccattccactcctgttccatcccattattataattaattcacttatataaattatcttgatacagtctatccccctcctgccccatgctttggtaggaacagtcttcagtttggagaggcactgcagcataggaagcatagaggtgaaggacatgcatggactctggggtctggcagacctgggttttggatctgccacttaaaagctactaaatgttctccagcctgcccttcctcaactgtaagatggggctattgttacacaggctgtgaggtttacatatgacagtgtctatgacatgatttagagcattgtttggcatattaaccatccatttaactatgttactacatatcttctcagagttaaagttttgctagagtctaatcaaaacataagcacagaattaaagtttctaaaatgtatttacattttacccctgtgctaaagaaggaatgagcaataatcgaaagttaatagagttggccgggcacagtggctcacacctgtaatcccagcactttgggaggccgaggtgggaggaggatcactgaggcccacaagtttgagaccaacctgggcaacaaagtgagatcctgtctctatttttttttttttaattttttataaaacaaaggtaacagggttatctttttgtatatttgggaagcggtgatagaggacatgtggatctactgaggtaactatagttaacatattgaggaaagaagtgaaatttgaagtattatagagctgtgttagaatggaagtgaatacaaaattgtggtaattattatcaaaagaacttagt

SEQ ID NO: 129675 - DNA, 1056 bp, Homo sapiens
cacagatgaacctcaagaacatagtgtttagtgaaagatgcaagtcagaataatacgtaatgattaatgtataaaatttaaattgcacaaaattaagtgctctctctctctctctctctatatatatatataattttttttttttttttttttttttgagacggagtctcgctctgtcccccaggctggagtgcagtggcgccatctcagctcactgcaagctccgcttcccgggttcacgacattctcctgcctcagcctcccgagtagctaggaccacagtcatctgccaccacgcctggctcattttttgtgtgtttttagtagagacaaggtttcaccatcttagccaggatgggcttgatctcctgacctcgtgatccgcctgcctcggccttccaaagtgctgggattacagatgtgagccaccgcgcctggcctaagcaatatattttttaggaatagcacaaagacaataaaaccatcatgaatttaatgagaatgattcaaattctgactttggttacctctgggaagaatatagagacatgcatgactactaagttttggggatgatttgtatttatttttatttttatgtttttaaactatatttatttatttatttattttgagacggagtttcactctgtcacccaggctggactgcagtggcatgatctcggctcacttcaacctctgcctcccgggttcaagcaggtctctgccttggcctcccaagtagctgggattacaggcccccccccaccacacccagctcatttttgtacttttagtagagacggggtttcaccatgttggacaggctggtcttgaactcctgaccttgtgatccacccgccttggcctctcaaagtgctgggattacaggtgtgagccaccgcacctggtctatttatttatttatttatttatttatttatttttatttattttgagatggagtctcgctctgtcgcccaggctggagtgcagtggtgtgatctcggctcactgcaagctccgcctcccgggttcacgccattctcctgcctc

SEQ ID NO: 129676 - DNA, 1090 bp, Homo sapiens
tgggagagcacaggacccattctaattgaaaagagccccctgctaattgccaaatcaaggcattcatctctgagtcctggactgggggttaagggggtccattttctttttttttttgagatggagtctcgctctgtcgcccaggctggagtacagtggcacgatcttggctcactgcaagctccgcctcccgggttcacgccattctcctgcctcagcctcccgagtagctaggactacaggcgcctgccaccacactcggctaattttttgtattttttagtagagacagggtttcactgtgttagccaggatgggcttgatctcctgacctcgtgatccgcccgcctcggcctcccaaagtgctgggattacaggtgtgagccaccgtgcctggccaagggggtcagttttcttacagatgataatgctttgtgattatgtaagttaatatctttaaggagatttgtgctcaagtatttaaaggttatgcattatgaggcctgaataacttatttgggagactttaaaatagcctcccaaataagtaacagcatgtgtgtgtgtgtgtgtgtggagagaaatcaaatatggcagtgaagcaattggtgagtctaggttaaaggtaaatggatttttattctaccctttcaagttttctatgggcttgaacattttgatagtaaaagtattaggggagctgggcacagtggctcacgcctgtaatcctgtcgctgtaggaggtcaaggctggaggattgctttagcccaggagtttgaggtcagtctgggcaacatatccagactccgtctctacaaaaaaaagttttaaaaaattagctggtcatggtggcatgcacctgtaatcctagctgttcaggaggctggggcaggaaaatcacttgagccctgtggttcaaggctgcagtgggctatgatcacatcaccgcactccagcctaggtgacagagcaaggctctgtctttaaaaataaaataaaactaaataaaaatattgggtggagaagtaaaaagacctttcccagtagtcctctagttggccagccagaatcacatccaatgtccatgcc

SEQ ID NO: 129677 - DNA, 1920 bp, Homo sapiens
agacaattaagcctgaatttttccaaaagaaaatttgtgcctaattatgggaactaaaatgcctctatgagattttaatctatagtgagtagtattaacattcctaattgtgctttatgatacactgtaacaaattctgcatgatgaaattttcttttgtgaagtatgttccactattttttcattgattcctttttttgttttaatgttgcagggaatgaccctgcataaaaaggcagctgaagatagactggcaagcacaggctcagggcagtcatttctggcgaggcagaggcaagcgaccagcagcagaagatcatacccaggccacgtgcagccggccacagcaaggtagagaagttgtgccgctcaatcacagacacctgcacccacaacatacttctgttacacacaagaacatttcaggaaactcagccagcttattttttgtttctcttctatgtcaatacttagtgtttctcattttgaggactttttctctctcctgtatctttgttttagtttctttggtttttattttgtagtcctttcagttatttttaatgtgccaaaaatttgtacatgttcaattaaaaatgttgtataatagtgtaatacttttctttgtatgaaaatgtcctcttcttcaaaggtataggctttgtaatgaattagattttctgccaataattgatatacaatttatattctttattgtgcctgtgtgttaccatgctaagaatgtctttgtttaaagggaattaatctttttatgatgtattaatctgtgttttcaattgttttccaagtacagttcaaataacttgcatatttactatacaaaatggttgacaagtgttctttttgcaaagacttgaatacattggcagaggtgctaatcacatcttccctaaggcacctggaagaattatttgaggaaaaaatgagttttcacattgttttataggaaattaaatttgtccaaagatttggagactatttttaaaacataaatacataaaatttcattatttcctgctatcttgtttgctggcagaagtgaatgtttggtgaggttattttgggataaattacaaaagaaaaaaaattagacactgcattaatttcttgttcttttggaatatcttagtaactgaggatcattttctaacaatgtggttgacataccttcagttgctttccacatctaaaagagttatctttcatatatgtacaagttattggtagtcttatttttgggctgtttgttgacttatgccccatttgttttacttgttctttaatataaacccttccattttttaacaattcctaacacttgatatcttaatatcagtcactaacattagtaacttcttgtatgttatattatggcagatctctttacgttttttctcacatctatctgctagtccaggaatttgttactaaatagattttcttggatatttggttgcctcaaagtgcttacatttgttaacagattgtaaaccacatttatttacattgatgaatgggctgttgaataatcattgtaaagcactttgtatatataaggtgctatataagtgtgaaatatcattcatttataaatgaaatgccttctaactttccatattgacttatgtatttggtcccaaattatatttaagtcttttttcttgcaacgtagcccattttttgaaagcaaaacatttctgaaattaggtcatggtttttttgtttatttttaggttaggtcacttaatataggaggatgttttctcatgtacttgctatttgcaagttcaggtttcatttggttctttatgttaaatacgaataagtaacctcaaatcaagctaaatgtaattaagaattttcagcaactatattcaagtgtttgatttttaaattctt

SEQ ID NO: 129678 - DNA, 1420 bp, Homo sapiens
accacaaagcagcagaagttagggataaatggagatagccatgagtagaactgctgtagggcttcaggaggctacgcagacctgatcaactgcaaagtttccaaagtaaaagattaaaaactttcagacggttcttacctctacccgtgtttcacaaatagcctgaggatccaactatttttaaagcaaattggggccagacgtggtgcctcacgcctgcaatctcaccatttgggagacctaggtgggggtggatcacttgaggtcaggagtttgagaccagcctggccaacatggtgaaaccccatctctactaaattacaaaaattagctgggcatggtggcatgtggctgtaatcccagctacttgggaggctgaggcaggagagtcacttgaactcaggagccagagactgcagtgagctgagatcgcaccactgcattccagcctgggcgacagagtgagactctgtctcaatcagtcaatcaatcaatcaatcaaattggaatatgagcactaaccttggtaagttaaaattttgggaaaattgtacctgcagaatatgatggatgaaaacaacagccaggtgcagtggctcacgcgtataatcccagcactttgggaggccgagacaggcacatcatctgaggtcaggacttccagaccagcctgtccaacatggtgaaactccgtctctactaaaaatacaaacaattagccaggcatggtggtgtgtgcctgtagtcccagctacttgggagggtgaggcaggagaattgcttgaacctgggagacagagattgcagtgagccgagatggcgccattgcaccccagcctggcgacaagagcgaaactctgtcgcaagaaaaaaaaaaaaaaaaaaaaaaaaaaaaacagtctgtgaactactcactgaatgaattttgttctgtgagatgagaggttttcattttcattttctatttacagccccagtcctaatctcctacccatccacctacccagatattttttctctatctgggttggaaaggccccaggcttttagaggggagttttacttctgacttttttttccccccgagacggagcctcgttccgtcacccaggctgtagtgccgtggcatgatctcggctcactgcagcctctgcctcccgggttcaagcaattctcctgcctcagcctccagagtagctgggattacaggtgcccaccaccatggctggctaatttttgtaatttagtagagatggtgtttcaccatgttggccaggctggtctcaaactcctgacctcgtgatctacccacctcggcctcccaaagtgctgagattacaggcacgagccaccgcgcccagtcgtacttctgacttttcttcagcatctgttgtatgctattattttgatgtttacattt

SEQ ID NO: 129679 - DNA, 1772 bp, Homo sapiens
aaacaaatatctaatttattttctaattgtccttcccttcattgagtattaactaggtgcataatgtagttgtatatgtttactagtaaagggaaaaacacttattttcattttgagactgtttggctattactaaagctgagaaagtgattttaggtcgccaaggatactatgatttgatgagatgagaagaaatctgcggtggctgaaaatcgtgaccaacttggtgttatctagatctgctttatctagtttgcaagccataggctcaattttatgtccttcttacttacacacagtagccccacacagttttgttttaaatgaaggcaaaagtagacatttttaaagtatattcaacattgtgccattatttacctgataaaggtgaaatcagaggtgtccacggcctcaaagtttgggcccatgggactatcaaatccgaattatatctacttagagcttagaggaagaattaggtatcatgagaaaagcaactcctacttgagagaaagaagactaccaaagcatgttgaggctttaacatgggagacttccaggtaggcgttaacacttgagtggtaactagcttgatgaaggaaaataattactttagcagttatgttgtaaaattaataaaaaggactcatgtttattctggtgtatttgtcaacccatgggtagtgattactccgtgtacattctatagtgtgtgtattttatttagtgtcttaatatatagtctttatatagtatcttaatattatttactgttacttctagtcatttatgtagtatattttactgcaaaatttgtagcactttactaatattagatcattattttccctcttcccctctacctttctggcattttctgttatcttagagtcaggaatctaaaggtctaagtctagaaatctgttggaagctgggttggagctactggatatgagttactttttacatgtctccttaagaagactcttttataatgtaatacttagaagccaaatcctttcaaacgcaaacacccttgaaacttgatgctttctgaagttgtattcataaaaattatcccatcttacagttaatcagaagatgttcttacctttggtttgcctgcctcctgaaacacaaacctgcagattgcccctaacttcagcagtgcctccgtcactgcatgtacctaaaagacaggaaagccaagttctgggagctgtcaagtcggaggatcaggaaaatggtggggaagaggtgactggaaaggcaggcactaaagatggcaggctgcaaaagcattctgagttcccctgtaacagataggttttatgaactcagctgttttcttttttctttttttttcttttgagatggagtctcactctgagtctcactctgttgcccaggctggagtgcagtggcacaatctcagctcactgcagcctccacctcccggtttcaagtgattctcccacctcagcctcccgagtagttaggattacaggtgcccaccaccacgcccaactaatttttgtatttttagtaaagacagggtgtcgccatattggctaggctggttttgaactcctgacctcaggtaatccacccgcctcagcctcccaaagtgctgggattattataggcgtgagccaccatgcccagtgaacttggccattttcttacattcatatatagcaaagttttcaacttgtctaccgagagactttctttaggagccaggacttctacatttgtaacttgagtatatt

SEQ ID NO: 129680 - DNA, 1230 bp, Homo sapiens
aaataatataaattgatgttatatagttaacatttatcaggcaaattcatatgaatgcttatttcaaataaagattgatagatttaatgatatccttccttttaaatttatatagatctaatgaacattgccaacagttttttttgtttctgtcccttaaacatttcccctgaaagtccacctcaaaggtacatcaagatgcaaacaatttttttatcttcataacttcctgctcttattaacttgtattatgaatcaaattaagttttatgtataaggcatttactattccagtgacttagctaatgaaaacatttaaaaatatgtattaatttacttggcctgctactaaagtgcttaacataactaaatggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaatttttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttt

SEQ ID NO: 129681 - DNA, 1034 bp, Homo sapiens
taaattatacagagtacctatgtataattttttttttgggtgggggtggatggagtctccctctgttgcccaggctagtgtgcagtggtgtgatcttggctcattgcaacctctgcctcctgggttcaagcaattctcctgcctcagcctccccgagcagctgggactacaggtgtgcaccaccatgcccaactaattttttctgtatttttagtagagacgaggtttcaccacgttggcaaggctggtctcaaactcttgacctcatgtgacctgcacacctcggcctcccaaagtgctgggattacaagcatgagccaccgtgcttggcctataattgttaaattatacagattacctgccaaaaatttgtctaactgtattgctgacttgtagctgtatttgatattgttattagggaacttctgtgtaataatgcgactttggatgttgtatgtttgccctaggcatttccggagagttcttttgaagtcacttcagaaggatctacatgaggaaatgaactacatcactgcaataattgaggagcagcccaaaaactatcaagtttggtaagtttggagtctagctgtgtctcccaggctggagtgcagtggcatgacctcggctcactgcagcctctgcctcctgggttcaagtgattctccagcttcagcctcctgggtagctgggattacaggtgcacgcaaccacacctggctaattttgtatttttagtagagacggggttttgccatgttggccaggctggtctcgaacttctgacctcaggtgatccgccctcctcagcctcccaaagtgcagggattacaggtatgagccattgcgcctggcctagaattttatttaaaaactaccactgtagccaggtgcagtggcttctgcttgtaatcccagcagtttgggaggctgaggcgagcagatcacttgagttcaggagtttgagaccagcctggccaacatggtgaatccccgtctctactaaaaatacagaaattagccgggtgtggtgg

SEQ ID NO: 129682 - DNA, 1988 bp, Homo sapiens
ttcagccaaagaaaattataaaaatggaacccaatataaaatccttaagtattttcctagcgcagaaactcctggccgggcgcggtggctcacgtctgtaatcccagcactttaggaggctgaggtgggcggatcacctgagggcaggagtttgagacctgcctggcaaacatggtgaaaccccgtctctacttaaaatccaaaaaattagccgggcgtggtggcaggcgcctgtaatcccagctactcgggaggctgaggcacgagaattgcttgaacctgggaggcggaggttgcagtgagctgagattgcgccattgcactccagcctgggggacaatgcactccagcctggggaacaagagcgagacttcgtctcaaaaaaaaaaaaaaaaacaaaaaaactcctctgttgacaacttgcaacttgtcatagctacttgccagtgtagcagtaaattcagttctgcccactcatttgtagaatgagaagctgcttgtttgatgacactttgcacttagggaaaattgacaggcgtgtgttaagtagaggaacttatatatttgataaaataatagcacattttgtcttgtctctcattatacaatctagtaatgtttcttaattttttgacacaatttcatggttgttgaaagatactaccagatgtagtttgagataaactatctgaattttttttctattttttttgtgttaccttttctccacagtggagtgttaagaattagagatgaatttttgtttattgtgtgtcctttcatgtcacctttacaacatgtgcaactgatattttagttcatgggtaaattaacaaaaaacttctctcccttctttgggctttaggcatcataggcgagtattagtggaatggctaagagatccatctcaggagcttgaatttattgctgatattcttaatcaggatgcaaagaattatcatgcctggcagcatcgacaatgggttattcaggtattgcctttcttgtacagtgtttttcagattttttttttaactgaactaaataaaattactcttaaagtctgtttctaaaccaaaacacacacatacgtagatcattgcacccaatatataactaaaaattattggccatgtgtggtggctcatgtctgtgatcccagtactttgggaggccaaggcaggaggattgagtgaggccaggagtttgagatcagcctgggcaacaaagtgagacccccgtctctacaaaaaatacaaaaattagccatgcatggtggcacacacctgtagtcccagctgcttgggaggctgaggcaggaggattgcttgagcccaagaatttgaggttgcagtgaactatgattacaccactgcagtctaccctgggcagcagagtgagaccctatctattttaaaaaaaaacaaacattattaacatacttaaaacctgacatccttcatgttagctaacctttataatctctttggatgtagtaaatttttagtattttttagattgaatttgtatcatatttgctagcaaattgagtataaagagtagcatatttttactacagatgtattattttaactaacaaaggcatattatacatttttttcatatataaactttggaataggattttacagtaacttaagttttttatttctacccatgtgtcaaagttttatgctaaattctgaatagaatagttgtaactcccactctgggtattttatttattttaaacagttctagtattgtttcctgtgaattttttccagggattgctactttctgcactattcattagaccaagagcatttcaccaaatacttaaaacttaaaaatttttaaacttttccaaatttgattaaaaggataacatattctaaaggtattcaatatttttacttatctctgaaaaacttaatcacataaaagcatacattttacacatacagctctctccatcttccacaata

SEQ ID NO: 129683 - DNA, 1047 bp, Homo sapiens
ttcctattgtgaattgaagcttttagattagttttgtgtccttccctagaactgaattgacagctgcagccttaagggattctcgtgatttaaatatgactgagagaggtgccacagtacactaagaaacgctgacacaagtgaaagtgtgtttacaaagctgtgccacagtcttagtaaaactgtgtcttggccgggcgcagtggctcatgcctataatcccagcactttgggaggccgaggcaggcggatcacaaggtcaggagttcaagaccagtctggccaatatggtgaaaccctgtctctactaaaaatacaaaaattagctgggtgtggtggtgggcgcctgtagtcccagctactcgggaggctgaggcaggagtatgacttgaacctgggaggcggaggttgcagtgagctgagattgtgccactgcactccagcctgggtgacagagcaagactccgtttcagaaaaaaaaaaaaactgtgtctcatcattgcactgttcttttaaaattgtatatatatatttttcttgcagatacactctggaaatgattaaactagtaccacataatgaaagtgcatggaactatttgaaagggtaagaggttgtttttgctttttttatatataaaaaagaagtggctatatgatgcatcatggagtgtattccataatcagattccaaaaggatagtaaataatttttcatttttctgaacctaagagcagaagtataacagcattatggaaactctctgggagtttgcccttctatgcacctcccaagtacctaccaacactgttttcagaataatccaccagtaaataatgccattttaattgtatttaagaatcctgtagtctttatatcaaagaatggaacacacacacccccaggctctagttggctcaggaacacagtaaagcggggtagtttacaggtagattttgccagtgggcagccaacctttctgttttcatttctagagatctccgccttcaggttaacctactcctcaactagaaaaggtttcacttgc

SEQ ID NO: 129684 - DNA, 1062 bp, Homo sapiens
tcaaaggcatttgcgcttgaaattgaattacatattactttaatttttatttttcattttcagttatgtgaaatcctagctaaagaaaaggacactataagaaaggaatattggagatacattggaagatcccttcaaagcaaacacagcacagaaaatgactcaccaacaaatgtacagcaataacaccatccagaagaacttgatggaatgcttttattttttattaagggaccctgcaggagtttcacacgagagtggtccttccctttgcctgtggtgtaaaagtgcatcacacaggtattgctttttaacaagaactgatgctccttgggtgctgctgctactcagactagctctaagtaatgtgattcttctaaagcaaagtcattggatgggaggaggaagaaaaagtcccataaaggaacttttgtagtcttatcaacatataatctaatcccttagcatcagctcctccctcagtggtacatgcgtcaagatttgtagcagtaataactgcaggtcacttgtatgtaatggatgtgaggtagccgaagtttggttcagtaagcagggaatacagtcgttccatcagagctggtctgcacactcacattatcttgctatcactgtaaccaactaatgccaaaagaacggttttgtaataaaattatagctgtatctaaaaacaatgccatagaagtttgattttttaatagcattgaactatatattatacaagacacattgtctcagcttagaaaagcatttgagaaagaaaatattgctataaaactgtaaactagaaacatgatgtgttggaggaaatgttaaaatgtaaattggtcagttcttgactgaaagtgacaaaatccactcaaggtagtttaaacccaaagggtttattcaggtttataaatatctcacagaagaattgcctgatcttttagaaagacattcccaaaccatgctacacaactggaccgtcccgttgctgctgcctgtgccagaatcaggaaactgctggatgaggagtgaggaagccacgatcctggctgccag

SEQ ID NO: 129685 - DNA, 1092 bp, Homo sapiens
atatcaattatttcattgaaaaaccgtggtcacaggcagttatctaattcttgagaggcttaatttattcatctgtaaagtggggaaaatacctagctcataagattgtcattattatagggaaactactaaattcagtacatgtcacatcttagcactcgatgaatataagttccttacacgatcctttgatgcactagatttgagtggtgttgactgaatcctcttgtagtagagacatctgtgcaaaaggagacctgtgtgtgtgcacatgcatgcatgtgtgtgtgtgcacatgcatgcatgcacgcacatatatctgcgcatacacaaagtaatgtgtgagagaccccagaaatcccagagtgtaagcttttgagaagcactactggaagcaactgttcacacgaatgtactttgtctctaacacatctttcgggtgccttttttttttttttttaacttttcctaatttctaccagacttagacaaaaaaagacatgcagagctgaagatggatcaggctttgctactcatccataatgaacttctctggaccaacttgaccgtctactggaaatctgaatgctgttatcacgtatgtatcagttcacactcagttctgtttgctttggggcttgtttgatatgatccttaatgctctcatgtctaaagcccttcacaagttaatttcagttttgcagctaaagaaacaaagaagctatataaagagtcggaagaaatacagtcaggggaggatgcctaggaatgcacagcatctatttttatcttttcatctactcatcctttaaaaagccagttctcagggatgaacaaccttgatagactatgttttattttcctcctctctagtgcataaccctcttgctggaccagagaaggaaggagtgagacaccagggtattctccaggggccagcagagtggtgcaagttgagggagtggcagttattccagggccctgcctccctgatgataacaaatgcattttctctgaaggttttactcctattctagaccttgttgctttttaaggacaaggctattctttcatgtaaaataaaatattcta

SEQ ID NO: 129686 - DNA, 1051 bp, Homo sapiens
gtacttcaaacatgcaagttggaatggtaagatatttcctaaaagtaatgttgcttatatacgtccttcacagagcttcagggcaggagaatcactcagcattctccccagaaactccagaaatgagccccagcagcctcctctgagccactgagctcctgctccctcctagggtgacctgtagatgattctgcgagccctttagttttgttcctccttttgtgtgctgtgaatctgtaaagcttcactgtaataacagactctagaagtttctgctgtgggactgagggactctgcagaatatgttatggatttggttgtaaatgatcatggtcatattctagatatgccttctattacagccaccatgctcttgggggctctgtcttctaggacttatggtcctttttgagatggcgttgaactaggattggtctgagtggtggtgaataatatctgtaagtctggcttggtagttgctttacaaatggattagtgcttcttaaacataacaaacgtgtctacatatttctagtttggttttcctgtgtctagttatgttcataggaagtgtcccagccaggtccagtgcttggttgcagagtctcaaggaagagtttgtgagtttactttctttttttaaaggcagagtcttgctttgtagcccaggctagattgcagtggtgtgataatagctgaccacagcctcgacctcctgggctcaagcaatcctcccacctcagcctcctgagtagctgggactacaggtgtgtgccaccatacatggctagttttttaaaacaatttttagtacagatggtgtctcactctgttgcccaggctggtctcaaactcctgggctcaagcgatcctcccaccttagcctcccaaagtgctgggattacaggtgtgagccacaccacacctggcctatgagttttctttttctttttcttttttttttttgagatggagtttcattcttgtcacccaggctggagtgcaatggcgcgatcttggctcactgcaacctctgcctcccaggttcaag

SEQ ID NO: 129687 - DNA, 1016 bp, Homo sapiens
ttccacgggttgactccaatctcctgtttttcagatgatgctggagcctctcttctgagacgggcatgtgttatgtggttaggaagtccttccaaaagtcctgttactggatagttctcatacttgacccagtgcctacacgtgtgtataaaagagtgatttggggccgggcgcggtggctcacgcctgtaatcctagcactttgggaggctgaggcaggcgaattacctgaggtcaggagttcaagaccagcctggccaacatggtgaaactctgtctctactaaaaatacaaaaaattagctgggtgcagtggcacgtgcctgtaatcccagctactcgggaggctgaggaaggagaatcacttgaacccaggaggcgggggttgcggtgagcagagatcacgccactgcactccagcctgggcgacagagtgagacttcatctcaaaaaaaaaaaaataaaaaaaataaagtgattttatagggaatattttgttagtgtagatatggtatgccagatcctgaaaccttgtaggaaattatacattctgaacatgtagttcagttccattaatcctgaaaatacttataaaatcctatttcctgaagaattacagtatattggtatcagtgaatgctaataaatatgtaggtgggcaatgatagtcataaactaaaatttaaaataacagttgagtagctcaattctgtctctgatcattcatagcttcttattcttgtgaagggacattgcctatgtgatgtggaatttgtatctttgctatggtgtattaagtgacattgctccctcattagcaggtagtaccagccttattattgttattttttatttcaaattttaaatttttgtgggtacatagtttatatagtatggtagatatgagatattttgatgcaggcatacaatgtgtaataatcacatcagggtaaatggggtacccaccccctcaggcatttaccattttgtgttataaacaatccaattataattttt

SEQ ID NO: 129688 - DNA, 1096 bp, Homo sapiens
ctagacagtccgtatacatgaagtcatataacgtggctttttgtgcctggctgcttccacttagcatattttttgaggttcatccatgttgcatatgtcagcacttccttccaaaattgctgaattagattccgctttagggatacaccacattttgctcacccatttattagtcagtgaacatttgacttgtgtccccttttttgctgttgtgaacaatgctcctatatgtatgtgtacaagtttttgtgtgaacatatgttttcagttctcttgggtataggaatagaattgtctgctgatttcttttgaatgggtgttttgctgtgagatttcatggagagggaacatctggagaacctaacgtagtcagtaagtttttgtattactgccaaaaaggccaagaaatgagtcaccgggaatttcctaaagacatgtgcttagttcccttctatttgcatttagttcacccgtgttttatttttctgcccccactcaggagaggagctgcctttctcttcgagacatcacgtccagctggccccagtggctgctcatcctggtgctggaaggcctgtggctgggcttgacattcctcctgccagtccctgggtgccctacgtaagcgaacccctgggggtcatcccttgtgcatgtcctgttctgcccagtcagaggttctgggctttcacaggtctcgagtcagaggaattctctttccctcttccttctcctttgaggcctgctttgcatggggagaggagattggcacgtgtccagagtgatttccctgtgggtggtgtgagggtcagcttgaatagaattcgggcctcccaccttcatagtgtgggagcagtttgtcagtgagcgtgcatgagccagaaggacgttttagctggctcatgtttggggctctctgaattgggctgcatacatagccaatataaaccatgttttttttttctctttttggagatggaatcttgctctgtcgcccaggcaggagtgcagtggcatgaactcggctcactgcaacctgcgcctcccaggttcaagcgattctcctgcattagcctcctgagtagctgggattaca

SEQ ID NO: 129689 - DNA, 1015 bp, Homo sapiens
ctttattccagtaaacaaaaatctctggtatgtatggaaaaagcatgattttatggatgactgttcatgctgaaattggatttgttccgtacgagcactgaaacgtctcctccacccctcccaggtccctttcgtatgtcactacgctcagttcttttgccttcttcatcctgctggtcctgtacccagttgtggatgtgaaggggctgtggacaggaaccccattcttttatccaggtaagtcacctccaacctcaaacagagctgggatggtgaccaggaggcaggcccagggacctctggagcatccttggtgctggggtcttgagccactgccctagcggcaggtgtccaaaagccaggctgagggaggaagcagcagggcccacattgtcccagcccacaccagatgtcactggcctgctccagagcagtccaccccattttcaccgtgtaggttgtggagtcgttgtatgacagtttgtgactccacctgtttcttcaggctataccaaattgtggaggagcggaaatgattcagggcacattatccagtttctggttctttttttttttttttttttttttttgagacagagtcttgctctgttgcccaggctggagtgcagtggtgtgatctcggctcactgcaagctccgcttcccaggttcacgccattctcctgcctcagcctcctgagtagctgggactacaggcgcccgccaccacgcccagctaattttttgtatttttagttgagatgggatttcacagtgttagctaggatggtcttgatctcccgacctcgtgatccgcccgcctcggcctcccaaagtgctgggattacaggcgtgagccaccgtgcccagcctctggttcttaataatggtgctatgcttgctttcttaatataaatccactactatagagattgtgcattagaagaaatagcaagaggtgatatcaagggataaatggaatgatttagatgcagttccaaccgaggacttagaaa

SEQ ID NO: 129690 - DNA, 1452 bp, Homo sapiens
atttttagtagagacggggtttcatcacgttggccaggctggtctcgaactcctggccttaagcgatccacccgctttggcctcccaaagtgctgggattatagtcgtgagccactacaccaggcctttcaataatttttgatatggtttatatttaaatacctaagatatgcattacttatttttggcagtagccaacaatggaagtgcacactttctgttttttcattgaactggtttcaagaattaaatagatggttagatgtgactcatctgtgagaaacatgatcttctgtatgtctctctccttaaggaatgaattccattctggtatatgtcggccacgaggtgtttgagaactacttcccctttcagtggaagctgaaggacaaccagtcccacaaggagcacctgactcagaacatcgtcgccactgccctctgggtgctcattgcctacatcctctatagaaagaagattttttggaaaatctgatggctcccactgagatgtgctgctggaagactctagtaggcctgcagggaggactgaagcagcctttgttaaagggaagcattcattaggaaattgactggctgcgtgtttacagactctgggggaagacactgatgtcctcaaactggttaactgtgacacggctcgccagaactctgcctgtctatttgtgacttacagatttgaaatgtaattgtcttttttcctccatcttctgtggaaatggatgtctttggaacttcattccgaggagataagctttaactttccaaaagggaattgccatgggtgtttttcttctgtggtgagtgaaacaatctgaggtctggttcttgctgaccttgttgccctgcaaacttcctttccacgtgtacgcgcacaccaacacgaaatgccatcactcctactgcggctgctatgaagcttactggttgtgatgtgttataatttagtctgtttttttgattgaatgcagtttaatgtttccagaaagccaaagtaattttcttttcagatatgcaaggctttggtgggtccaaaaaatgtctatcacaagccattttttccttttcctctctcgaaaagttaaaatatctatgtgttattcccaaaccctcttacctatgtatctgcctgtctgtccatcatcttccttcctccctatctctgtgtatctggatggcagccgctgcccaggggagtggctgtggggagggcaggtactgtctttgcctgtgggtccagctgagccatccctgctgggtgatgctgggcaagacccttggcccgtctgggccttggcttcctcacttgtgaaatgagcgggaagatgactctcagttccttccacctcttagacatggtgaggtaacagacatcaaaagcttttctgaaatcttcagaagaaatagttccattacagaaaactcttcaaaa

SEQ ID NO: 129691 - DNA, 1072 bp, Homo sapiens
tatgttcagagatataaatggacagaggtagcctcacagagaagcccaaatttcagactgttatttgcttgctctgataaattcctctcagtcttctcacctttgttctgtcaccagatattctggatcacagccaaatgctgtggggagatgtgtttttctgtctatgctggggcctgatggcttagacatgcctggtctgaaggatttcctgaggttgagactgaccgtgccataccctgtgagttcagcttctaagacggttacttagcagtagacaaaaataaatcactttgaaaaggtgacccaaaatgctctcaacaaacagtatctatgattgttattttgaggtctgccacaattgatctggacagtctgcatatagcctacattaggtgccagttttttaaaggaagcattcagaacatagaggcagccttgatatctcatcacttttgctctcagctttctgcactgcagatatagcagtgagtataatttgtatctgcagtctttgaaacccttcagtacctgctaggaagcactggtccccattatggtgttaagaacctagctttggaatattgggctgggtgctgtcacgatggccaaattagggtaaaagtgaaatgagtcttcagctgcttcaaggatgtactgatggctggattccagcaagcccttttcccctttggtgggtgttgtttagagtagttatgactgagatgcagtggatgggttggtcatatctaacaagcctcaggaatgactagatgattcccttctgaggatctttcactacagcaatgcagaatgtttttgtttcatcccagagagatgttcacaacattttattcaatgagaaaaccaaataatagcagactattcagactatagcagactatataggatattacgtaatgcaatatccgggccccattataatattttctcctttatttttctccatagcacttgtcttcatttatacatgtaatttatgtgtctcattaatttctcctgttcccctgcaccatgaatgcaataagctccatgccccagaacataatac

SEQ ID NO: 129692 - DNA, 1020 bp, Homo sapiens
caattttttaaattgaggtaaaattcaccattttaaagtgtacaattcagtgatatgtaatgcatcacaacattgtgtgactgaggtattctcgtaagaaattttcagttacatctgcttatattgtgtaaaactagaaagttacatttgcaagagataaaattaaacactaagaaagttaattttttcaaactattattttctaatggtttttgttatttccatccccagttcagtgagatagaattgtagaaatctctcggaatattgggagtgttctgttcacctcttcaggtctgaaagagtgagcaaggctgcctagggttcagcaagaactcctttctggattaaatgctatgaatttggaggccaaatatgaatatagtccaatgataacaaaagctgatacattttgaaattttattgtgttccaactatcctgccagtttgcaaatcttcacattattcctaaatctcccaacaagcctgcctagttcttatcttttttccgcttggcaagtgaagaaacagaatctgaggggacttgctcaaggtcatatagtttaaaagtaatgtagctgaggtttccatatttgatctgtatgatgccatagcccagatcctcactccctcaactctctggactccagttgggtgtccaagcattcagttccattctaaccatttacctagagtaagcatgaaccccaaaggttaacggctcagtcccacaagactgccctcatttcagaaacgaatcccaagtcccaggcctcccatacttctgactgattggttgcaaactcgggttcacaggactccctcttcatgtttgataatttgctagaatagctcacagaacacagaaagtcactttacctaatattaccaatttgttttaaaggatatgactcagaaacagccaaatggaaaagatgcatagtgtaaggtataggggtacatggagcttccatgccctctctaggtgcaccacactctcagtccctggctgtgtttacc

SEQ ID NO: 129693 - DNA, 1003 bp, Homo sapiens
gcacagttgacttcgagaagggaatttattgtcagtgggcttgacccatttgccagagccctttaaacctgtatttagaggtcagaagctgaggaggtaagagattcgaagcaggagaggggtttatgtgctgttgctggcttggagatggagaggactacctggcaaggaatgcagcagtatccaggagcccagagcaaaccccagttgatagccaacaaggaaacagggacctcagtcctatcactgcaggagctgaattctgctagtacaaagaatgagcttggaattggatttttctccagagctcccagaggagaactaagctccaccaccaccttgatttcatctttgtgacactctgagcaggggacccagttaaaacatggccagacttctgacttctggagctgggagctaataaatgagtgttgctttaagccactaagtttgcggtaatttgttacacagcaataggaaactaacaaagtttttgaacaacagttgaaagttacaggtagtatagaccattatataaactcacaaatttaagacagtgggaatatgggactagaaagaagttaaatggttggtaagaaattctaccacttagcccacattgccacccttcccatggccagcccactccactcctttcatagcacttagtggagtgtgtccataacccgcccaagtcttgctcagtgttgtagcagcagcattgtagcagatacttggttttcagcctgaatgtattcagtgaacgaacgtaggaaggaattgtgaaatgctagttggagaaaataagcagctggaggaaagaaggcaagctggagattataggaacagtgattcaaagccaaattagaaattgtaggacgatgcttgttatcctagtccactggggctgctgtaccaaagtaccacagatcgagtggcgtataaacaatggaaatgcatttctcacagttctggaggctgggaagtccaaggtcagggtgtc

SEQ ID NO: 129694 - DNA, 1035 bp, Homo sapiens
caaagttattcttgactggaactctgagcccactttacatttctttgctcctatgtgctgagctcattgggagctttcccacctccatggcagcactcatagctgtccttgtgtccctggtacctaacgaagtgctaggtgccagcatatagcaggtggtaagtaagcagtgcttgttttaggattgaataaatgaactaagaaagaatagaaaaataggtaagctgatatttagctgtcatatttccaagaatgtgatgtttttggacataatattagcccatatttctaagaatcagaaaaccaagcttctaagaaaacaaaaaactgacttatgaggatatggcctctgggaagataatgtggtaacaaatatacgttaaaattttgcatgttttatctgtttgtctctggttggggggtatacaatataaatgttccagtgattctgaagttttccttttaactaaacttaatacattataattcattaaacagaggtggactagcagaaagactaaatggactgcagaatcgagagagatctgctatttctttgtggagacatcaatgtatttcttaccaaaagacactttcaggtaaggcttgtgcaggaatctgagacaatgtgtaaaaaaatattttagttaaaagaattcttacattaaaatatatgaagttaattgttaatattttcatgactttttaaaaattttttccaacattctaattttaacatataaaaactatatatagtaaatatatttaacttgatgagtttaaaaataagcatactcttatgaaaacatcaccacaatctgtgctataaatctacccttgacctccaaaaattttgttctattcttatcattaagagcactctaccctcttagcaaaatttattttgttttatttcattatttagagacagggtctcaccgttgcccaggctggagtgtagtgacataatcatgtagcctcaaactcttgggctcaagcaaattctctcacttcagcctcccgactggctaagac

SEQ ID NO: 129695 - DNA, 1199 bp, Homo sapiens
ccactactcatgagagcctgcctaagttcgagaccagcctggccacagttgaatactgtgctgggcactgaagatttagaggtgaatataaagaaaaggcaagatggatttaatgtctaaagtagaagattaggaggaaagcaattaagcagttacctgatttaaaatgttaccctacagtgttcatggaattgtttaaaagctatatcttagatacaaacatgtttgtctcttaatgtgtgggttaagtatttgattagatgagtatgtcctaattgagtaatccaggaggaaaggtcctaaatccctgaaagtaatagcatgtactattttgttaaaatgtaaggtctgtacttgaaactttccagctcttaaaaatgaggaaattccaagcattctgcactaatagatagtgttagtgggtagttggtggatgacgtcaaatgtcagaatggtgaacagcttcgttcatataaactgaaagtgtacaatctgggatcaagtgttctcgctgctctcagggatcggcgcacagcctgtgtgctcccatgtggcctgacttggatttcagagtttatatgaggcacagctgagagtctggaaaaggcacagcatcttctccttcctgtccagatgagccaagtgagcaggaagggtctcagcatctattcctgaggccctatgagaggtttcttcattcctttataatgattaagccctacattgggaatgggtttgatttgtcattgtacaaacttcagaggctttaatggtaattttattaaccttgctggaccttatggaatgttgataaaagcaaccactctttgttatgaaagcaaaaagagacattgaaaagttagttcaagataattggcaaagccagctgccatgatgagattgttgaatagtgatggtggtaatggcagaaaaggtgaaggctctttcttgaaagacagcacaggaatcaccgctctaatgctatctttgtgatgttactgttgaatatatgtgaggtgctgctgtcttctgactgacttcttggtcactatcacagtgttatgactgctataaggtgtaatggtcttttctcgtcattacattctgtttaggttttgtattgtatgagagagatctggggaaagagatatataattggacatttgtatatataatgttaagtgaaaaactgagagttg

SEQ ID NO: 129696 - DNA, 1048 bp, Homo sapiens
ggccatgatatctgcagtttattatctgtggttcagcaatataataatatcagtagccacagtgaccacaactatatatatatatatatagttcatgaatctggcatgttttctataagtctgaaagaatttcaaaaaaaaaatgttgaggcagagcagctacctgaggtagccaccaaacctacgtgcagagatcagaagaacacaaatacagtaaacgtgctgagggccaggggcagctgttcagagttgctgttctctgctgtctgctttggtgttccagaagggtgtggccccagtattagcttggcatggtggcgtacacctgtagtcccagctgctccaagaggctgaggcaggaagatagtttgagcccatgagttcaaggctgtagtgaagtatgatcctgcactccactccagcctgggcaacatagtgagaccctgtctcttaaaaaaaagaaaaagaaaaccagccaatattgaaccttttgtttttacagtgatcctatgccgaggtctctaaccacacagcaacctacaatgatgtgagaaggagccaggccccagaaggccaggcagtacaggaggaacgaggtgacgctgtcttatggttaaccatgtgacactacctgtggatagtgcccaggtctctcactccccaacctgaaaagagaagcctgcataactagacccctgtgcatcagattcaccccttccctgtgctacatgtgaaaaagctgggtggacatgatgtgccaagaatggcccaggctgttctctagtagcaaactcccaacctacataccatgtctttagtgcatggtatgactctcccctgatttccatctgccagacacagacgtggcctggactgcacctacacataattttattcttcccaaggtataagaccagtatctggcaagcaggcaggcttctcacaaaggccatttcctctacggaggggttggttttgaaaatcagccaggtctctcatccccaagaaacagataaaccatggtgcattttagccctaatgaattcac

SEQ ID NO: 129697 - DNA, 1045 bp, Homo sapiens
gttcaaacaaatttaagccaatcattgagagaggtaaactctattttagcatctgctgcagaatgtcttttctcaaaatatttacacttccaatgttatttctgtacattactgctcaaaccagatattcaaaacaaaacagattcttaacaaacaggttttgcccaagtcttacaactctgcaataatatgtgtaatagaaaaatagacagtaattgaaaagtttgtgtttttcttgtcttccagccactaaagtacctctgttcaaaatcactatacgggtttagctaattacaatctatacgtctgtattttaaaataaaatgttatactttttaaaaaaacaacttgatgtctttcagtagatttggactcattttgatataacagcagttacattaacaacagttctccagtttaggtgaaatctgtttgaatacttcctgttatacattgaaatggaaagttggcttcctcttgtaggtcatgttgctggtgaggaatttccagaaatctggagaagtgctgactcatagtatacagtggactgatccagcaacagtaggacttgagggggttttttgagctattggctgaggcaagcaaaatatgtggctgtaatgtttcattttatttttagatataagggtgagggaggaggagagactattgcttggcatgggatctatgttaatagctttaaaatggctacaagttctagggttagaggtgtgtctaaatgtgtgttttcctacagtctattattagaatttggaaaacaggttgtttttgctatagtcaccctactgttgttctctctgcctcttgcccacaggtgaaccatgtgccttcttgggctgtggttggtgactcaccatgggttctataatgtgaaagtcacatagtacttgcattcaggagagtgctgcagaaaaaggtccatggcattgcaccttttgtatctgatcaaaagtccgtgaatctaataataacaatttaagtattagctgacaggagtacagagaaaaactagcatttgttgcct

SEQ ID NO: 129698 - DNA, 1080 bp, Homo sapiens
ctggtgatacaattttactttttgagagctgttttgaagtcttcccacagaactgcaggcctctctgttttcccgtatgaggtgaggagatggcagttttgtccacacacctatgaaaaaacacaatgacagattaagtgtcctgaagtgtcggaaggatacctggtgtggtagcttctaaaataccaccaaaagttattttagagatgaattaattagaattgacatctgagttaggttaccaaatgaaataaagggtgccaggtaaatgtaaactttagataaactatcaggcacatgtatgctaaaaaaattattcattgtttatctgaaatttacatttacctgggcatcctgtattttattaggtaaatcaggcgactctccacctgaaactagattatgcaaactaagaattaacataaaaagtactgtcattgtgtggatgagaaatctcctcctcctcttctcctaaaccagtttaggaagcctgtgcttcgtcatttctcatatactctcctcccatgtacatccagattaaaatgtgtgtatttggcatgtggctcactgtttcacatgcctaactgcagcccctctgggatcctatagtcgcagcactattttggtaggtcagccatgggcagcaggtcctgtactctcctgaccacccccgaggaactgcaggctctcagcatttgcgtgtgtccctcctcagagccgtgggacaaccccagccagctagaggcagagagacaggcacgtaaacctcctggcacgtcttgcgggtgcctgggccaaagtatgcgactgtcctgattctctgaaggtctcaaagcattttcatattaagttattcaagtgacccagagaacaagaaaggagttgctactgcatgatgtcagagaacactcagaggttggaagggaattgggagaactaagtaattattaataaattctaaaagtttaatactcagtattcaaaggagaaagagtggagctaacactttgtaccaagggtgctggtcttgggaattaagatatctcctgcaagagatttctgatacaatttagtaaaatg

SEQ ID NO: 129699 - DNA, 1005 bp, Homo sapiens
tatgttctttgaaagagctatcaaaatttctgaaggttttatttgtacattttatttcattgtttgggcacttttttgaggctgtgacagtttttgtttatcctccgtatttccccctgaggggtcttgaggccatactgggagggcacaagggagcccaagcccagggacttagccttcttccatcccttcctgacacagggctttcactagaacagtgaagtcagactactggtggccatgctggagcatgaaggacagctgtgcctctgtgggtgggcttggctttagctgtccatagcaggcgagtcattgctctttgcattcctgatttagcaagaatatgaggggaccccaatattgcaaagaaactgttgcatgtctttctcttttccaggcaaaaactgattattccaagtggaagttgccctgttattctgaatacttacttttgtgagaaagttgttgccaaagaagattcagaaaaaacttgtgaagtgtactgtccggacataccccttccaagaagaagcatctctttggcccagatgtttgtaattaagggtctaacaaataattcacctgaaatccaggtaaactcctattggcctaaaggttttatgcttgtaataatgttagtgactggatttggaagggcttcagtgtaagtgaagatgttagccttttgtctccctccaaaaaccccaccacaaggatgtatgctgcatgaacttactgttacgcctgaatatattatagttcagttcagcatttagtggtgctcttgttacagtatttcatctttctaattatgtgtctttaatctttattctaatttattaaaatagagtcatgcatcacttaacagggatatggtctgagaaatttgtcattaggtgattttgtcattgtgtgaccatcatagcgtgcacttacacaaacctagatggtccagcctactacacacctaggctatatggtatggctgattgcttctaggctaca

SEQ ID NO: 129700 - DNA, 1010 bp, Homo sapiens
ggagggaagtcattgcaagataagactggaaaggtagattgagatcatgttgcagagggcttgagaattatcttatgggcaaactgctgaggcatttgatatgatccaagtagtgtcttagtggcaggcaggaagcagagttcagagcttgaatgtccagggcgaggtgctcagccctgtcagccctgcagggaggcccagcagaggaatggatgcaagagaagggcttcttgagtgatgaaaaaatctggattcagcaatggttaggatttgaggagtaaggaaaacaaaaaggtctaaagatggctttgaagttttcaaccttgataacttggaaaataataggcctggggagagggcaggagaaggtttagacttgaagtcagagacccaccgcttggagcagctgtacagcctgtgacgttccctaagcttctggcctcctggccacaggaggcatagtcctccaagggctgattagaggtaagactcggcctgagtcaggcctatactcaggcactgctgacctgacgcgggtctcctttggtgctctgcctcacctgctgcagcctcacagccagctagggggtgcacagaaggtggagttaatgacaggatgtcatgggaagtaggggctggcgtcccaggaggatgggggtgactcgagagttagcatctgtactacagattaatgtcccaggcacagcatcggccctgcatggatgaggcgaaaaccctttcatccaccaggataactaattgaatcacactttgagcctcttcaagaaaatgaaaaaatgtcaggtcaactccctaaattttcagttgacgttgcaagtaacctcatacattaaaaggctaggttaggtcaagcccataatatgaaattatccaggcaccctctttggtttattcttggccatgttcacttagccacatctagaatgagatggagtagaaaaacacttgtgagtgccaggacacccatgttctttttgccactaagcagc

SEQ ID NO: 129701 - DNA, 1027 bp, Homo sapiens
aacccatggatcctctgactctgaagtgggcagacgggcaccctagacccaaacttgtgactgccccaaggctttgtaaccatggggaaaagaaagattgcagtctttagttgaagactttgcattctctgtgccctcggttataacaataggtttttagaaaaatctgtcttagggtcaatttatagttcttcaaagtaagagctgaggcttttgttgacagtcaactgggtcttacctcctggtggttgcatatggcatgcattaataaatgaattctaaaaccacacaaatattactgaatatgttcaaactaaaaagcaacacagaaaagtactggatttatgattcatcacaataaatttatcagagaaaatggtgaaagaggaaatgtgtgtctctaaaacagatttggattttatttatttgggacatataaaagaggaaggaagagttgataaagaattcttatttgactcttcaaagtcactgttcaccagaaattcagagaatcaacatacaaattacaatggtagtttgttttctggaaggccagtgaaatacagctccttaatttataatgaaatttactttctaacaaattaagtctttctaatgagaccaacattgagaattcagcccttacctcgggatggtctgagaaaaccaaaaggccaactgttttattgctttagatcagttaggtgatgataactatgagcatttataataatattttaaattggccctgagaggcttgaagacatagaactgaatgtactgccagatatttttgcaggagtcacagatgtaaaagagaattctgcacacacatccccctccccagcacccaaatgcagcatattttcagttaaatcctctggaatggactatttttagagaaatggcagggggaagggtggctaggaagcatgttcttcacaacctttttcattatgtactacaaaaaatatttacgttttaatttaatcacgacatgtgctgtactgtggttcaccctactgag

SEQ ID NO: 129702 - DNA, 1113 bp, Homo sapiens
acacctggcttcaggacttaggagagctggcccttaatgagagggaaccctattttcttgtcagttaactgcatgtgtaacaatgcgcatttgtctggtaggtgaaggaaaccaagattttgagcacagaagagatgcaggcacttaactgggtgtgaaacaaattcacataatctggattgtgcaggtacccaaactcctagtgtccgtgtccattcgtgtcatgtggtgcctgctcccctgcaccaccgtcttatagtcatgaaagtgggggttattggggtgtgtctgtggcagaagcattgatcttaaacattaaataagtggaattcacttgacggactgttattccaagaagttttgaatggctctctggctgatggaatcagtgcagttgtgagactctcattctaaacacacatgtcctacttctctgtgagatattttatcatggctgttctaagcacttatctaagttaatcactcctatagatagcagcatcccctcacaccaggtataagggacccaccaaccatgctcagtgctgcatagggcagagaagtcgcctgcagcccaagccttagctcaagatcgctagcagcggagagtgtggtgtactggatgcatacctttgccttggcagtgggtattctatggcaggacagcaaaggaatgtactcaactgcttcccaaagtggaagctccgttttatgaacattaatcagataactttaagatgtcagatctcttgagcccgccgtggcctggctagccactggttcccaatatttcagagcttactaaggatcgtgctggtgtctgctggttgtcttgcagagcacaaccacacacagtgagcgtctgctcctcaacttgggtgctggtgcctgagctgcagctgcagttgcagccttctctatagatacacaaagatttaacgttccttaaacaaaaataactgaaaggacttctagagaatatccacttgtcttataaaaggactctcagcccagagagcttctgtgccttgtcgatagtggcagagctgggatcccaatgcttctgccctgctggtttgagtcacattctccatagagcagtttgcccttccc

SEQ ID NO: 129703 - DNA, 1013 bp, Homo sapiens
attctatattttctattcattaattctaatatctcaagtccccagcaggtctggtgttacttcttttgactattcccacatgatggtttgtttctttgtgtttgatttttatttgagcacatctttgtttggtcttattccatggtgaactagcaatccaagtaaaggtgctttttttcagacaggatatatttctgcttctcttgcaaaccagctggccctgtgggcctggaagacttcattaaggagtctacagttcttgacccttttgccaaggcagcacttaaggctcctggcttcatctgttctcctccaacatgtgcttttttcacattcttatctttagaacagtttttatgtccattttgtgatgttatttactgactataatttcttcaggctccgtgaaatgttttctgagaatatgtcattttgtgataaataagcttcatttacttcagttacaaaataagaggattggaaattcagtcataaataggctctcatgagtaacatcatctaaacttaaaagctggggggaatcccatcatgtcgctggctgtccatcatggctgtgttgctgcaagctgggacaccaggttttatcctgctgggatatgcgtgtctaaacgtgtactgtcgcagagaatgcctcttattgttgttcttatcgtaatgttatcctgcagcttttctcagtatcgagcatccacacaaagcaaatatttctttcatgggaaacggtaaaaatgggaaaaggacactctgtttctaggtaatgtatttggtttaagagaatggtcatcttgaggtacttttcagccatatttggcttaggttttagtttcatgcctgtggatggtggttcaaacacctgcatgaacacatacagaaaggatatcttgaattcaacgtttttttaatcctgactcacccatttaggaagatgactacagtggatttcttttttttttccccccttggtttttctttactttctttaaattatattg

SEQ ID NO: 129704 - DNA, 1019 bp, Homo sapiens
ttagcagggtatcacaaacatgtttccatgtccataagtattttctttgtaaccatttcagtgaccgtatactatttcactgtgtggatggatcctaatttagtgagcaagttcctgttgtgcagttggtttcccacagtgtctgtccatctgtctgtgtgccttcttccccctctgaatcgccacacatctcgaattgtagttccatggccttaggcattagagtctgttaagcattctaccagctcactggccaagtactcagtaagggatgtctgatgatgaatacctttgacttttcttgttccaggacagcggggattttcagtttgattgacaccctgtggcccccagcgatacctctgaaaacacctggccgcgaccagccctgtgaagaggtaagcccggcactggaaaaacttccccagtcacagactactccatgccaggtgccaagccaggcgtcatcactgtcactcacatggtctgtgtcccctgctccagtggcaacaaggagcccccatgcagtcagttcctttgtagtgatgcatgaatatgagccaggattgggattcaggtgcctggagaccaagctctggctgccttccctactgtgctgcacagcattttcttgaagttaacttatgatgaatgcttaaaccacaaccctcacatactgttggaacagttggggtctcagccttgtactaaagtaaacatatagaatttttcccacgaacttctagtcattcatagaaccaacactcagttaccaattggagcaggaactcaatacaatccatagacattcgtacaacgtcctgggtagccaggaacttccattgtcctgcttgtttatgagagtgtctcagaagcagcaaaatggatggaaagtgttccctcctctccctcctgagccttttccagcaggctagccagctgctgctttgggccagaggtcccaaaacaaaactggggctgtcttccttaggttgtggctgacttcttagtagtgctaa
